United States Patent 11,564,997 (MATERIALS AND METHODS FOR TREATMENT OF FRIEDREICH ATAXIA AND OTHER RELATED DISORDERS) - sequence listing, part 2

SEQ ID NO: 6720 - DNA, 20 bp, Artificial Sequence
  Description of Artificial Sequence: Synthetic oligonucleotide
  Target: FXN; (+) strand; PAM type: NNGRRT; PAM sequence: AGGAGT
ggtgggtggatcatgaggtc

SEQ ID NO: 6721 - DNA, 20 bp, Artificial Sequence
  Description of Artificial Sequence: Synthetic oligonucleotide
  Target: FXN; (+) strand; PAM type: NNGRRT; PAM sequence: GAGAAT
tactcaggaggctgaggcag

SEQ ID NO: 6722 - DNA, 20 bp, Artificial Sequence
  Description of Artificial Sequence: Synthetic oligonucleotide
  Target: FXN; (+) strand; PAM type: NNGRRT; PAM sequence: CAGAAT
tttgcctccctcaagcagaa

SEQ ID NO: 6723 - DNA, 20 bp, Artificial Sequence
  Description of Artificial Sequence: Synthetic oligonucleotide
  Target: FXN; (+) strand; PAM type: NNGRRT; PAM sequence: CTGAAT
tccattcttttgttcagagc

SEQ ID NO: 6724 - DNA, 20 bp, Artificial Sequence
  Description of Artificial Sequence: Synthetic oligonucleotide
  Target: FXN; (+) strand; PAM type: NNGRRT; PAM sequence: TGGGGT
ataccctcaggctctgtact

SEQ ID NO: 6725 - DNA, 20 bp, Artificial Sequence
  Description of Artificial Sequence: Synthetic oligonucleotide
  Target: FXN; (+) strand; PAM type: NNGRRT; PAM sequence: GTGAGT
tcacggttgtgaggtttgtt

SEQ ID NO: 6726 - DNA, 20 bp, Artificial Sequence
  Description of Artificial Sequence: Synthetic oligonucleotide
  Target: FXN; (+) strand; PAM type: NNGRRT; PAM sequence: AGGAGT
accacgatcccttccttcag

SEQ ID NO: 6727 - DNA, 20 bp, Artificial Sequence
  Description of Artificial Sequence: Synthetic oligonucleotide
  Target: FXN; (+) strand; PAM type: NNGRRT; PAM sequence: AGGAAT
aaaggtttagcagttgcccg

SEQ ID NO: 6728 - DNA, 20 bp, Artificial Sequence
  Description of Artificial Sequence: Synthetic oligonucleotide
  Target: FXN; (+) strand; PAM type: NNGRRT; PAM sequence: TAGAAT
attaaattggcaaaagcagg

SEQ ID NO: 6729 - DNA, 20 bp, Artificial Sequence
  Description of Artificial Sequence: Synthetic oligonucleotide
  Target: FXN; (+) strand; PAM type: NNGRRT; PAM sequence: AGGAGT
agcaggtagaatataaagca

SEQ ID NO: 6730 - DNA, 20 bp, Artificial Sequence
  Description of Artificial Sequence: Synthetic oligonucleotide
  Target: FXN; (+) strand; PAM type: NNGRRT; PAM sequence: AGGAGT
acttctacttgtgcctttga

SEQ ID NO: 6731 - DNA, 20 bp, Artificial Sequence
  Description of Artificial Sequence: Synthetic oligonucleotide
  Target: FXN; (+) strand; PAM type: NNGRRT; PAM sequence: CAGGAT
acaactaaggtttgaggggc

SEQ ID NO: 6732 - DNA, 20 bp, Artificial Sequence
  Description of Artificial Sequence: Synthetic oligonucleotide
  Target: FXN; (+) strand; PAM type: NNGRRT; PAM sequence: TTGGAT
acattctcagacacttttcc

SEQ ID NO: 6733 - DNA, 20 bp, Artificial Sequence
  Description of Artificial Sequence: Synthetic oligonucleotide
  Target: FXN; (+) strand; PAM type: NNGRRT; PAM sequence: TTGGGT
agactctggggccagacagc

SEQ ID NO: 6734 - DNA, 20 bp, Artificial Sequence
  Description of Artificial Sequence: Synthetic oligonucleotide
  Target: FXN; (+) strand; PAM type: NNGRRT; PAM sequence: AAGAGT
atagttgatcctcattcgtt

SEQ ID NO: 6735 - DNA, 20 bp, Artificial Sequence
  Description of Artificial Sequence: Synthetic oligonucleotide
  Target: FXN; (+) strand; PAM type: NNGRRT; PAM sequence: TGGGGT
aatcagtacccctagccttt

SEQ ID NO: 6736 - DNA, 20 bp, Artificial Sequence
  Description of Artificial Sequence: Synthetic oligonucleotide
  Target: FXN; (+) strand; PAM type: NNGRRT; PAM sequence: ATGAGT
ttagagaagctttgtcaggc

SEQ ID NO: 6737 - DNA, 20 bp, Artificial Sequence
  Description of Artificial Sequence: Synthetic oligonucleotide
  Target: FXN; (+) strand; PAM type: NNGRRT; PAM sequence: CAGGGT
gttgttgttgttgtttgaga

SEQ ID NO: 6738 - DNA, 20 bp, Artificial Sequence
  Description of Artificial Sequence: Synthetic oligonucleotide
  Target: FXN; (+) strand; PAM type: NNGRRT; PAM sequence: TGGAGT
ccctctgttgcccaggctgc

SEQ ID NO: 6739 - DNA, 20 bp, Artificial Sequence
  Description of Artificial Sequence: Synthetic oligonucleotide
  Target: FXN; (+) strand; PAM type: NNGRRT; PAM sequence: CTGAGT
aatcctcccacctcggcctc

SEQ ID NO: 6740 - DNA, 20 bp, Artificial Sequence
  Description of Artificial Sequence: Synthetic oligonucleotide
  Target: FXN; (+) strand; PAM type: NNGRRT; PAM sequence: TGGAAT
gtttttgatatttttttagg

SEQ ID NO: 6741 - DNA, 20 bp, Artificial Sequence
  Description of Artificial Sequence: Synthetic oligonucleotide
  Target: FXN; (+) strand; PAM type: NNGRRT; PAM sequence: TGGAGT
attttgctcatcacccaggc

SEQ ID NO: 6742 - DNA, 20 bp, Artificial Sequence
  Description of Artificial Sequence: Synthetic oligonucleotide
  Target: FXN; (+) strand; PAM type: NNGRRT; PAM sequence: CCGGAT
ctcactgcaacctccacctc

SEQ ID NO: 6743 - DNA, 20 bp, Artificial Sequence
  Description of Artificial Sequence: Synthetic oligonucleotide
  Target: FXN; (+) strand; PAM type: NNGRRT; PAM sequence: CTGAGT
aattcttctgcctcagcctc

SEQ ID NO: 6744 - DNA, 20 bp, Artificial Sequence
  Description of Artificial Sequence: Synthetic oligonucleotide
  Target: FXN; (+) strand; PAM type: NNGRRT; PAM sequence: CGGGGT
ttttgtgtttttagtagagg

SEQ ID NO: 6745 - DNA, 20 bp, Artificial Sequence
  Description of Artificial Sequence: Synthetic oligonucleotide
  Target: FXN; (+) strand; PAM type: NNGRRT; PAM sequence: GGGGAT
accttggcctcccaaagtgc

SEQ ID NO: 6746 - DNA, 20 bp, Artificial Sequence
  Description of Artificial Sequence: Synthetic oligonucleotide
  Target: FXN; (+) strand; PAM type: NNGRRT; PAM sequence: ATGAAT
cccagccaagatcagtgtta

SEQ ID NO: 6747 - DNA, 20 bp, Artificial Sequence
  Description of Artificial Sequence: Synthetic oligonucleotide
  Target: FXN; (+) strand; PAM type: NNGRRT; PAM sequence: CAGGGT
atgttgtgaccagcagctta

SEQ ID NO: 6748 - DNA, 20 bp, Artificial Sequence
  Description of Artificial Sequence: Synthetic oligonucleotide
  Target: FXN; (+) strand; PAM type: NNGRRT; PAM sequence: TTGAGT
tcctataaataatttgctcg

SEQ ID NO: 6749 - DNA, 20 bp, Artificial Sequence
  Description of Artificial Sequence: Synthetic oligonucleotide
  Target: FXN; (+) strand; PAM type: NNGRRT; PAM sequence: AAGAAT
ctttgtagcacataactacc

SEQ ID NO: 6750 - DNA, 20 bp, Artificial Sequence
  Description of Artificial Sequence: Synthetic oligonucleotide
  Target: FXN; (+) strand; PAM type: NNGRRT; PAM sequence: AAGAGT
ccaagaataaggactgtaat

SEQ ID NO: 6751 - DNA, 20 bp, Artificial Sequence
  Description of Artificial Sequence: Synthetic oligonucleotide
  Target: FXN; (+) strand; PAM type: NNGRRT; PAM sequence: CAGGAT
taataagagtacgtccctca

SEQ ID NO: 6752 - DNA, 20 bp, Artificial Sequence
  Description of Artificial Sequence: Synthetic oligonucleotide
  Target: FXN; (+) strand; PAM type: NNGRRT; PAM sequence: CTGAGT
tcacaggattgtaatgaaga

SEQ ID NO: 6753 - DNA, 20 bp, Artificial Sequence
  Description of Artificial Sequence: Synthetic oligonucleotide
  Target: FXN; (+) strand; PAM type: NNGRRT; PAM sequence: TAGAAT
caagcagatggagaacactg

SEQ ID NO: 6754 - DNA, 20 bp, Artificial Sequence
  Description of Artificial Sequence: Synthetic oligonucleotide
  Target: FXN; (+) strand; PAM type: NNGRRT; PAM sequence: CTGAGT
tgccttctgccttctctttt

SEQ ID NO: 6755 - DNA, 20 bp, Artificial Sequence
  Description of Artificial Sequence: Synthetic oligonucleotide
  Target: FXN; (+) strand; PAM type: NNGRRT; PAM sequence: GAGAAT
atggcaaccagtgacctttg

SEQ ID NO: 6756 - DNA, 20 bp, Artificial Sequence
  Description of Artificial Sequence: Synthetic oligonucleotide
  Target: FXN; (+) strand; PAM type: NNGRRT; PAM sequence: CAGGAT
aaagcccttcggtgccttcc

SEQ ID NO: 6757 - DNA, 20 bp, Artificial Sequence
  Description of Artificial Sequence: Synthetic oligonucleotide
  Target: FXN; (+) strand; PAM type: NNGRRT; PAM sequence: CTGGAT
atcaactcagaccctgtcac

SEQ ID NO: 6758 - DNA, 20 bp, Artificial Sequence
  Description of Artificial Sequence: Synthetic oligonucleotide
  Target: FXN; (+) strand; PAM type: NNGRRT; PAM sequence: CAGGAT
ccaaatcttctggacttcag

SEQ ID NO: 6759 - DNA, 20 bp, Artificial Sequence
  Description of Artificial Sequence: Synthetic oligonucleotide
  Target: FXN; (+) strand; PAM type: NNGRRT; PAM sequence: GTGGAT
agtgaccttttaagagcatt

SEQ ID NO: 6760 - DNA, 20 bp, Artificial Sequence
  Description of Artificial Sequence: Synthetic oligonucleotide
  Target: FXN; (+) strand; PAM type: NNGRRT; PAM sequence: CAGGAT
ccactagccacatgtggcca

SEQ ID NO: 6761 - DNA, 20 bp, Artificial Sequence
  Description of Artificial Sequence: Synthetic oligonucleotide
  Target: FXN; (+) strand; PAM type: NNGRRT; PAM sequence: GAGAAT
cgggcttagagagacacagg

SEQ ID NO: 6762 - DNA, 20 bp, Artificial Sequence
  Description of Artificial Sequence: Synthetic oligonucleotide
  Target: FXN; (+) strand; PAM type: NNGRRT; PAM sequence: CTGGGT
taaaatactttaatataggg

SEQ ID NO: 6763 - DNA, 20 bp, Artificial Sequence
  Description of Artificial Sequence: Synthetic oligonucleotide
  Target: FXN; (+) strand; PAM type: NNGRRT; PAM sequence: AGGAGT
agggcagatcacttgaggcc

SEQ ID NO: 6764 - DNA, 20 bp, Artificial Sequence
  Description of Artificial Sequence: Synthetic oligonucleotide
  Target: FXN; (+) strand; PAM type: NNGRRT; PAM sequence: TCGGGT
tctactaaaaatacaaaaaa

SEQ ID NO: 6765 - DNA, 20 bp, Artificial Sequence
  Description of Artificial Sequence: Synthetic oligonucleotide
  Target: FXN; (+) strand; PAM type: NNGRRT; PAM sequence: GCGGGT
acaaaaaatcgggtgcggtg

SEQ ID NO: 6766 - DNA, 20 bp, Artificial Sequence
  Description of Artificial Sequence: Synthetic oligonucleotide
  Target: FXN; (+) strand; PAM type: NNGRRT; PAM sequence: GAGAAT
tacgcgggaggctgaggcac

SEQ ID NO: 6767 - DNA, 20 bp, Artificial Sequence
  Description of Artificial Sequence: Synthetic oligonucleotide
  Target: FXN; (+) strand; PAM type: NNGRRT; PAM sequence: GGGGGT
atcactcgaacccgggaggc

SEQ ID NO: 6768 - DNA, 20 bp, Artificial Sequence
  Description of Artificial Sequence: Synthetic oligonucleotide
  Target: FXN; (+) strand; PAM type: NNGRRT; PAM sequence: CCGGAT
aaatgcaggttagttgttca

SEQ ID NO: 6769 - DNA, 20 bp, Artificial Sequence
  Description of Artificial Sequence: Synthetic oligonucleotide
  Target: FXN; (+) strand; PAM type: NNGRRT; PAM sequence: CAGAGT
ggttagttgttcaccggatg

SEQ ID NO: 6770 - DNA, 20 bp, Artificial Sequence
  Description of Artificial Sequence: Synthetic oligonucleotide
  Target: FXN; (+) strand; PAM type: NNGRRT; PAM sequence: GTGAAT
aaggcctggtaccaaaaaaa

SEQ ID NO: 6771 - DNA, 20 bp, Artificial Sequence
  Description of Artificial Sequence: Synthetic oligonucleotide
  Target: FXN; (+) strand; PAM type: NNGRRT; PAM sequence: TTGGGT
gaatttactccgaaactagc

SEQ ID NO: 6772 - DNA, 20 bp, Artificial Sequence
  Description of Artificial Sequence: Synthetic oligonucleotide
  Target: FXN; (+) strand; PAM type: NNGRRT; PAM sequence: AGGGGT
ctccgaaactagcttgggtg

SEQ ID NO: 6773 - DNA, 20 bp, Artificial Sequence
  Description of Artificial Sequence: Synthetic oligonucleotide
  Target: FXN; (+) strand; PAM type: NNGRRT; PAM sequence: GGGGGT
aagtgtgcaagggcaagtgg

SEQ ID NO: 6774 - DNA, 20 bp, Artificial Sequence
  Description of Artificial Sequence: Synthetic oligonucleotide
  Target: FXN; (+) strand; PAM type: NNGRRT; PAM sequence: GTGAAT
gctttcagtatgccctccca

SEQ ID NO: 6775 - DNA, 20 bp, Artificial Sequence
  Description of Artificial Sequence: Synthetic oligonucleotide
  Target: FXN; (+) strand; PAM type: NNGRRT; PAM sequence: AAGGGT
aaagtcctgaggcaaccccc

SEQ ID NO: 6776 - DNA, 20 bp, Artificial Sequence
  Description of Artificial Sequence: Synthetic oligonucleotide
  Target: FXN; (+) strand; PAM type: NNGRRT; PAM sequence: ATGGGT
ctggaggtgaaagttccgtg

SEQ ID NO: 6777 - DNA, 20 bp, Artificial Sequence
  Description of Artificial Sequence: Synthetic oligonucleotide
  Target: FXN; (+) strand; PAM type: NNGRRT; PAM sequence: GCGAAT
tgatgggtttgctttggtct

SEQ ID NO: 6778 - DNA, 20 bp, Artificial Sequence
  Description of Artificial Sequence: Synthetic oligonucleotide
  Target: FXN; (+) strand; PAM type: NNGRRT; PAM sequence: GGGAAT
ttagaaaagcttgccctgaa

SEQ ID NO: 6779 - DNA, 20 bp, Artificial Sequence
  Description of Artificial Sequence: Synthetic oligonucleotide
  Target: FXN; (+) strand; PAM type: NNGRRT; PAM sequence: GAGGAT
ggggagaggagaagagaaga

SEQ ID NO: 6780 - DNA, 20 bp, Artificial Sequence
  Description of Artificial Sequence: Synthetic oligonucleotide
  Target: FXN; (+) strand; PAM type: NNGRRT; PAM sequence: TCGAAT
gagcactcggttacaggcac

SEQ ID NO: 6781 - DNA, 20 bp, Artificial Sequence
  Description of Artificial Sequence: Synthetic oligonucleotide
  Target: FXN; (+) strand; PAM type: NNGRRT; PAM sequence: ATGGGT
aatatataaattatgcatta

SEQ ID NO: 6782 - DNA, 20 bp, Artificial Sequence
  Description of Artificial Sequence: Synthetic oligonucleotide
  Target: FXN; (+) strand; PAM type: NNGRRT; PAM sequence: CAGAGT
tacttcttaactttggcttt

SEQ ID NO: 6783 - DNA, 20 bp, Artificial Sequence
  Description of Artificial Sequence: Synthetic oligonucleotide
  Target: FXN; (+) strand; PAM type: NNGRRT; PAM sequence: TGGAAT
aacgtggcctcaaccagatt

SEQ ID NO: 6784 - DNA, 20 bp, Artificial Sequence
  Description of Artificial Sequence: Synthetic oligonucleotide
  Target: FXN; (+) strand; PAM type: NNGRRT; PAM sequence: CAGAGT
agatttggaatgtcaaaaag

SEQ ID NO: 6785 - DNA, 20 bp, Artificial Sequence
  Description of Artificial Sequence: Synthetic oligonucleotide
  Target: FXN; (+) strand; PAM type: NNGRRT; PAM sequence: ATGAAT
aaaagcagagtgtctatttg

SEQ ID NO: 6786 - DNA, 20 bp, Artificial Sequence
  Description of Artificial Sequence: Synthetic oligonucleotide
  Target: FXN; (+) strand; PAM type: NNGRRT; PAM sequence: CAGGGT
atctggaactttgggccacc

SEQ ID NO: 6787 - DNA, 20 bp, Artificial Sequence
  Description of Artificial Sequence: Synthetic oligonucleotide
  Target: FXN; (+) strand; PAM type: NNGRRT; PAM sequence: CTGAGT
ttaggcatctttccatgtga

SEQ ID NO: 6788 - DNA, 20 bp, Artificial Sequence
  Description of Artificial Sequence: Synthetic oligonucleotide
  Target: FXN; (+) strand; PAM type: NNGRRT; PAM sequence: ATGGAT
atgaaatagtattagattgc

SEQ ID NO: 6789 - DNA, 20 bp, Artificial Sequence
  Description of Artificial Sequence: Synthetic oligonucleotide
  Target: FXN; (+) strand; PAM type: NNGRRT; PAM sequence: CAGAGT
ttggacattcaggttgtttc

SEQ ID NO: 6790 - DNA, 20 bp, Artificial Sequence
  Description of Artificial Sequence: Synthetic oligonucleotide
  Target: FXN; (+) strand; PAM type: NNGRRT; PAM sequence: CAGGGT
gtcctcctctctgggcagta

SEQ ID NO: 6791 - DNA, 20 bp, Artificial Sequence
  Description of Artificial Sequence: Synthetic oligonucleotide
  Target: FXN; (+) strand; PAM type: NNGRRT; PAM sequence: GTGAAT
gggttggcatacctcctgaa

SEQ ID NO: 6792 - DNA, 20 bp, Artificial Sequence
  Description of Artificial Sequence: Synthetic oligonucleotide
  Target: FXN; (+) strand; PAM type: NNGRRT; PAM sequence: TTGAGT
ccttactgtcctctgcattg

SEQ ID NO: 6793 - DNA, 20 bp, Artificial Sequence
  Description of Artificial Sequence: Synthetic oligonucleotide
  Target: FXN; (+) strand; PAM type: NNGRRT; PAM sequence: GCGAGT
aggctgggaaatatagtcta

SEQ ID NO: 6794 - DNA, 20 bp, Artificial Sequence
  Description of Artificial Sequence: Synthetic oligonucleotide
  Target: FXN; (+) strand; PAM type: NNGRRT; PAM sequence: CCGAGT
tgtggtcaccacagccacct

SEQ ID NO: 6795 - DNA, 20 bp, Artificial Sequence
  Description of Artificial Sequence: Synthetic oligonucleotide
  Target: FXN; (+) strand; PAM type: NNGRRT; PAM sequence: AGGAAT
gtctcctctctcccagcttt

SEQ ID NO: 6796 - DNA, 20 bp, Artificial Sequence
  Description of Artificial Sequence: Synthetic oligonucleotide
  Target: FXN; (+) strand; PAM type: NNGRRT; PAM sequence: CAGGAT
acacacacgatggagagggg

SEQ ID NO: 6797 - DNA, 20 bp, Artificial Sequence
  Description of Artificial Sequence: Synthetic oligonucleotide
  Target: FXN; (+) strand; PAM type: NNGRRT; PAM sequence: CTGGAT
tggagccctgctgggcagca

SEQ ID NO: 6798 - DNA, 20 bp, Artificial Sequence
  Description of Artificial Sequence: Synthetic oligonucleotide
  Target: FXN; (+) strand; PAM type: NNGRRT; PAM sequence: TGGGGT
acttcctgctaataacagtt

SEQ ID NO: 6799 - DNA, 20 bp, Artificial Sequence
  Description of Artificial Sequence: Synthetic oligonucleotide
  Target: FXN; (+) strand; PAM type: NNGRRT; PAM sequence: CAGGGT
aataacagtttggggttcca

SEQ ID NO: 6800 - DNA, 20 bp, Artificial Sequence
  Description of Artificial Sequence: Synthetic oligonucleotide
  Target: FXN; (+) strand; PAM type: NNGRRT; PAM sequence: TGGAGT
tcacaccctgagacccaggc

SEQ ID NO: 6801 - DNA, 20 bp, Artificial Sequence
  Description of Artificial Sequence: Synthetic oligonucleotide
  Target: FXN; (+) strand; PAM type: NNGRRT; PAM sequence: CCGGGT
ctcactgcagcctccgcctc

SEQ ID NO: 6802 - DNA, 20 bp, Artificial Sequence
  Description of Artificial Sequence: Synthetic oligonucleotide
  Target: FXN; (+) strand; PAM type: NNGRRT; PAM sequence: CTGAGT
aatcctcctgcctcagcctc

SEQ ID NO: 6803 - DNA, 20 bp, Artificial Sequence
  Description of Artificial Sequence: Synthetic oligonucleotide
  Target: FXN; (+) strand; PAM type: NNGRRT; PAM sequence: CGGGGT
ttttgtatttttagtaaaga

SEQ ID NO: 6804 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcggcctcccaaagtgc

SEQ ID NO: 6805 - DNA, 20 bp, Artificial Sequence
  Description of Artificial Sequence: Synthetic oligonucleotide
  Target: FXN; (+) strand; PAM type: NNGRRT; PAM sequence: GAGAGT
gcccagactcatttttcttt

SEQ ID NO: 6806 - DNA, 20 bp, Artificial Sequence
  Description of Artificial Sequence: Synthetic oligonucleotide
  Target: FXN; (+) strand; PAM type: NNGRRT; PAM sequence: GTGGAT
accacatccaaatttcctcc

SEQ ID NO: 6807 - DNA, 20 bp, Artificial Sequence
  Description of Artificial Sequence: Synthetic oligonucleotide
  Target: FXN; (+) strand; PAM type: NNGRRT; PAM sequence: GGGAGT
tccaaatttcctccgtggat

SEQ ID NO: 6808 - DNA, 20 bp, Artificial Sequence
  Description of Artificial Sequence: Synthetic oligonucleotide
  Target: FXN; (+) strand; PAM type: NNGRRT; PAM sequence: CTGAGT
gcctggtttttgcagcagga

SEQ ID NO: 6809 - DNA, 20 bp, Artificial Sequence
  Description of Artificial Sequence: Synthetic oligonucleotide
  Target: FXN; (+) strand; PAM type: NNGRRT; PAM sequence: CTGAGT
caaagccttagcttctctgg

SEQ ID NO: 6810 - DNA, 20 bp, Artificial Sequence
  Description of Artificial Sequence: Synthetic oligonucleotide
  Target: FXN; (+) strand; PAM type: NNGRRT; PAM sequence: AGGAGT
gtgagcagatcactgaggcc

SEQ ID NO: 6811 - DNA, 20 bp, Artificial Sequence
  Description of Artificial Sequence: Synthetic oligonucleotide
  Target: FXN; (+) strand; PAM type: NNGRRT; PAM sequence: GAGAAT
tactcgggagcctgaggcag

SEQ ID NO: 6812 - DNA, 20 bp, Artificial Sequence
  Description of Artificial Sequence: Synthetic oligonucleotide
  Target: FXN; (+) strand; PAM type: NNGRRT; PAM sequence: CTGGGT
tcatgccattgcactccagc

SEQ ID NO: 6813 - DNA, 20 bp, Artificial Sequence
  Description of Artificial Sequence: Synthetic oligonucleotide
  Target: FXN; (+) strand; PAM type: NNGRRT; PAM sequence: CAGGAT
gaggttgcatagggcccttg

SEQ ID NO: 6814 - DNA, 20 bp, Artificial Sequence
  Description of Artificial Sequence: Synthetic oligonucleotide
  Target: FXN; (+) strand; PAM type: NNGRRT; PAM sequence: GTGGGT
ccccacattgtatcctggaa

SEQ ID NO: 6815 - DNA, 20 bp, Artificial Sequence
  Description of Artificial Sequence: Synthetic oligonucleotide
  Target: FXN; (+) strand; PAM type: NNGRRT; PAM sequence: CTGGGT
tcctggaagtgggtgatgga

SEQ ID NO: 6816 - DNA, 20 bp, Artificial Sequence
  Description of Artificial Sequence: Synthetic oligonucleotide
  Target: FXN; (+) strand; PAM type: NNGRRT; PAM sequence: GAGGGT
gtgatggactgggtggggaa

SEQ ID NO: 6817 - DNA, 20 bp, Artificial Sequence
  Description of Artificial Sequence: Synthetic oligonucleotide
  Target: FXN; (+) strand; PAM type: NNGRRT; PAM sequence: TGGAGT
ccctggaaactttcagatag

SEQ ID NO: 6818 - DNA, 20 bp, Artificial Sequence
  Description of Artificial Sequence: Synthetic oligonucleotide
  Target: FXN; (+) strand; PAM type: NNGRRT; PAM sequence: AAGGAT
aggggcacaaaagctcttac

SEQ ID NO: 6819 - DNA, 20 bp, Artificial Sequence
  Description of Artificial Sequence: Synthetic oligonucleotide
  Target: FXN; (+) strand; PAM type: NNGRRT; PAM sequence: AAGGGT
cattttaaaatgtataatgc

SEQ ID NO: 6820 - DNA, 20 bp, Artificial Sequence
  Description of Artificial Sequence: Synthetic oligonucleotide
  Target: FXN; (+) strand; PAM type: NNGRRT; PAM sequence: GTGGAT
ctaatctactttctgtctct

SEQ ID NO: 6821 - DNA, 20 bp, Artificial Sequence
  Description of Artificial Sequence: Synthetic oligonucleotide
  Target: FXN; (+) strand; PAM type: NNGRRT; PAM sequence: ATGAAT
agtcacaagcatacagcttg

SEQ ID NO: 6822 - DNA, 20 bp, Artificial Sequence
  Description of Artificial Sequence: Synthetic oligonucleotide
  Target: FXN; (+) strand; PAM type: NNGRRT; PAM sequence: TAGAAT
taccctgtaagctcaagaca

SEQ ID NO: 6823 - DNA, 20 bp, Artificial Sequence
  Description of Artificial Sequence: Synthetic oligonucleotide
  Target: FXN; (+) strand; PAM type: NNGRRT; PAM sequence: CAGAGT
ccttctagtcattaaccctt

SEQ ID NO: 6824 - DNA, 20 bp, Artificial Sequence
  Description of Artificial Sequence: Synthetic oligonucleotide
  Target: FXN; (+) strand; PAM type: NNGRRT; PAM sequence: AGGAAT
atttatctgtgatattacaa

SEQ ID NO: 6825 - DNA, 20 bp, Artificial Sequence
  Description of Artificial Sequence: Synthetic oligonucleotide
  Target: FXN; (+) strand; PAM type: NNGRRT; PAM sequence: TAGGAT
cagtttccagtttggggcta

SEQ ID NO: 6826 - DNA, 20 bp, Artificial Sequence
  Description of Artificial Sequence: Synthetic oligonucleotide
  Target: FXN; (+) strand; PAM type: NNGRRT; PAM sequence: CTGGGT
gtacatgtcttttggtgaac

SEQ ID NO: 6827 - DNA, 20 bp, Artificial Sequence
  Description of Artificial Sequence: Synthetic oligonucleotide
  Target: FXN; (+) strand; PAM type: NNGRRT; PAM sequence: AAGAGT
ttctgttgtgtatacccctt

SEQ ID NO: 6828 - DNA, 20 bp, Artificial Sequence
  Description of Artificial Sequence: Synthetic oligonucleotide
  Target: FXN; (+) strand; PAM type: NNGRRT; PAM sequence: GAGAAT
tactcgggaggctgaggcag

SEQ ID NO: 6829 - DNA, 20 bp, Artificial Sequence
  Description of Artificial Sequence: Synthetic oligonucleotide
  Target: FXN; (+) strand; PAM type: NNGRRT; PAM sequence: AAGAGT
ctcaaaaaaaaaaaaaaaaa

SEQ ID NO: 6830 - DNA, 20 bp, Artificial Sequence
  Description of Artificial Sequence: Synthetic oligonucleotide
  Target: FXN; (+) strand; PAM type: NNGRRT; PAM sequence: ATGGGT
aaaaaaaaagagtggagctg

SEQ ID NO: 6831 - DNA, 20 bp, Artificial Sequence
  Description of Artificial Sequence: Synthetic oligonucleotide
  Target: FXN; (+) strand; PAM type: NNGRRT; PAM sequence: TGGAGT
ctctttttttttttttgaga

SEQ ID NO: 6832 - DNA, 20 bp, Artificial Sequence
  Description of Artificial Sequence: Synthetic oligonucleotide
  Target: FXN; (+) strand; PAM type: NNGRRT; PAM sequence: CTGGGT
ctcactgcaacctccgcctc

SEQ ID NO: 6833 - DNA, 20 bp, Artificial Sequence
  Description of Artificial Sequence: Synthetic oligonucleotide
  Target: FXN; (+) strand; PAM type: NNGRRT; PAM sequence: CCGAGT
aattctcctgcctcagcctc

SEQ ID NO: 6834 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcagcctcccgagtagc

SEQ ID NO: 6835 - DNA, 20 bp, Artificial Sequence
  Description of Artificial Sequence: Synthetic oligonucleotide
  Target: FXN; (+) strand; PAM type: NNGRRT; PAM sequence: CAGGGT
ttttgtatttttagtagaga

SEQ ID NO: 6836 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcggcctcccgaagtgc

SEQ ID NO: 6837 - DNA, 20 bp, Artificial Sequence
  Description of Artificial Sequence: Synthetic oligonucleotide
  Target: FXN; (+) strand; PAM type: NNGRRT; PAM sequence: CAGGGT
attttattttactttaaaga

SEQ ID NO: 6838 - DNA, 20 bp, Artificial Sequence
  Description of Artificial Sequence: Synthetic oligonucleotide
  Target: FXN; (+) strand; PAM type: NNGRRT; PAM sequence: CAGGAT
cagggtttcactttgtcacc

SEQ ID NO: 6839 - DNA, 20 bp, Artificial Sequence
  Description of Artificial Sequence: Synthetic oligonucleotide
  Target: FXN; (+) strand; PAM type: NNGRRT; PAM sequence: TGGAAT
tttcactttgtcacccagga

SEQ ID NO: 6840 - DNA, 20 bp, Artificial Sequence
  Description of Artificial Sequence: Synthetic oligonucleotide
  Target: FXN; (+) strand; PAM type: NNGRRT; PAM sequence: TCGGGT
gcagccttgacctccctggc

SEQ ID NO: 6841 - DNA, 20 bp, Artificial Sequence
  Description of Artificial Sequence: Synthetic oligonucleotide
  Target: FXN; (+) strand; PAM type: NNGRRT; PAM sequence: CGGGGT
tttttaatttttggtagaga

SEQ ID NO: 6842 - DNA, 20 bp, Artificial Sequence
  Description of Artificial Sequence: Synthetic oligonucleotide
  Target: FXN; (+) strand; PAM type: NNGRRT; PAM sequence: CTGGGT
gtctctgttgtctcagattc

SEQ ID NO: 6843 - DNA, 20 bp, Artificial Sequence
  Description of Artificial Sequence: Synthetic oligonucleotide
  Target: FXN; (+) strand; PAM type: NNGRRT; PAM sequence: GTGAAT
caaatgaacacaaaatacag

SEQ ID NO: 6844 - DNA, 20 bp, Artificial Sequence
  Description of Artificial Sequence: Synthetic oligonucleotide
  Target: FXN; (+) strand; PAM type: NNGRRT; PAM sequence: AAGGAT
aaatctgatcatatctttag

SEQ ID NO: 6845 - DNA, 20 bp, Artificial Sequence
  Description of Artificial Sequence: Synthetic oligonucleotide
  Target: FXN; (+) strand; PAM type: NNGRRT; PAM sequence: CTGAAT
ataaacagtgatagcattta

SEQ ID NO: 6846 - DNA, 20 bp, Artificial Sequence
  Description of Artificial Sequence: Synthetic oligonucleotide
  Target: FXN; (+) strand; PAM type: NNGRRT; PAM sequence: CAGAAT
agtgatagcatttactgaat

SEQ ID NO: 6847 - DNA, 20 bp, Artificial Sequence
  Description of Artificial Sequence: Synthetic oligonucleotide
  Target: FXN; (+) strand; PAM type: NNGRRT; PAM sequence: TGGGGT
gaatcagaataactgttttt

SEQ ID NO: 6848 - DNA, 20 bp, Artificial Sequence
  Description of Artificial Sequence: Synthetic oligonucleotide
  Target: FXN; (+) strand; PAM type: NNGRRT; PAM sequence: CGGAGT
ttttggggttttctttgaga

SEQ ID NO: 6849 - DNA, 20 bp, Artificial Sequence
  Description of Artificial Sequence: Synthetic oligonucleotide
  Target: FXN; (+) strand; PAM type: NNGRRT; PAM sequence: TGGAGT
tttgctcttgttgcccaggc

SEQ ID NO: 6850 - DNA, 20 bp, Artificial Sequence
  Description of Artificial Sequence: Synthetic oligonucleotide
  Target: FXN; (+) strand; PAM type: NNGRRT; PAM sequence: CTGGAT
ctcactgcaacctccgcccc

SEQ ID NO: 6851 - DNA, 20 bp, Artificial Sequence
  Description of Artificial Sequence: Synthetic oligonucleotide
  Target: FXN; (+) strand; PAM type: NNGRRT; PAM sequence: CCGAGT
gattatcctgcctcagcctc

SEQ ID NO: 6852 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcagcctcccgagtagc

SEQ ID NO: 6853 - DNA, 20 bp, Artificial Sequence
  Description of Artificial Sequence: Synthetic oligonucleotide
  Target: FXN; (+) strand; PAM type: NNGRRT; PAM sequence: TAGGAT
gcctcagcctcccaaaatgc

SEQ ID NO: 6854 - DNA, 20 bp, Artificial Sequence
  Description of Artificial Sequence: Synthetic oligonucleotide
  Target: FXN; (+) strand; PAM type: NNGRRT; PAM sequence: CGGAGT
ttttttttctttttttgaga

SEQ ID NO: 6855 - DNA, 20 bp, Artificial Sequence
  Description of Artificial Sequence: Synthetic oligonucleotide
  Target: FXN; (+) strand; PAM type: NNGRRT; PAM sequence: TGGAGT
tctcactctgtcacccaggc

SEQ ID NO: 6856 - DNA, 20 bp, Artificial Sequence
  Description of Artificial Sequence: Synthetic oligonucleotide
  Target: FXN; (+) strand; PAM type: NNGRRT; PAM sequence: CGGGGT
ctcattgcaacctccacctc

SEQ ID NO: 6857 - DNA, 20 bp, Artificial Sequence
  Description of Artificial Sequence: Synthetic oligonucleotide
  Target: FXN; (+) strand; PAM type: NNGRRT; PAM sequence: CAGGGT
ttttgtatttttagtagaga

SEQ ID NO: 6858 - DNA, 20 bp, Artificial Sequence
  Description of Artificial Sequence: Synthetic oligonucleotide
  Target: FXN; (+) strand; PAM type: NNGRRT; PAM sequence: TGGGAT
acctcggcctccgaaagtcc

SEQ ID NO: 6859 - DNA, 20 bp, Artificial Sequence
  Description of Artificial Sequence: Synthetic oligonucleotide
  Target: FXN; (+) strand; PAM type: NNGRRT; PAM sequence: GGGAAT
tattaattgtagttgcctct

SEQ ID NO: 6860 - DNA, 20 bp, Artificial Sequence
  Description of Artificial Sequence: Synthetic oligonucleotide
  Target: FXN; (+) strand; PAM type: NNGRRT; PAM sequence: CAGAGT
ttttttttttttttttgaga

SEQ ID NO: 6861 - DNA, 20 bp, Artificial Sequence
  Description of Artificial Sequence: Synthetic oligonucleotide
  Target: FXN; (+) strand; PAM type: NNGRRT; PAM sequence: TGGAGT
tctcgctctgtcgcccaggc

SEQ ID NO: 6862 - DNA, 20 bp, Artificial Sequence
  Description of Artificial Sequence: Synthetic oligonucleotide
  Target: FXN; (+) strand; PAM type: NNGRRT; PAM sequence: CTGAGT
cattctcctgcctcagcctc

SEQ ID NO: 6863 - DNA, 20 bp, Artificial Sequence
  Description of Artificial Sequence: Synthetic oligonucleotide
  Target: FXN; (+) strand; PAM type: NNGRRT; PAM sequence: CGGGGT
ttttgtattttcagtagaga

SEQ ID NO: 6864 - DNA, 20 bp, Artificial Sequence
  Description of Artificial Sequence: Synthetic oligonucleotide
  Target: FXN; (+) strand; PAM type: NNGRRT; PAM sequence: CAGGAT
cggggtttcaccatgttagc

SEQ ID NO: 6865 - DNA, 20 bp, Artificial Sequence
  Description of Artificial Sequence: Synthetic oligonucleotide
  Target: FXN; (+) strand; PAM type: NNGRRT; PAM sequence: CAGAGT
atctgcctgcctcggcctcc

SEQ ID NO: 6866 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcggcctcccagagtgc

SEQ ID NO: 6867 - DNA, 20 bp, Artificial Sequence
  Description of Artificial Sequence: Synthetic oligonucleotide
  Target: FXN; (+) strand; PAM type: NNGRRT; PAM sequence: GTGGAT
tcgagaagctgaggcacgtg

SEQ ID NO: 6868 - DNA, 20 bp, Artificial Sequence
  Description of Artificial Sequence: Synthetic oligonucleotide
  Target: FXN; (+) strand; PAM type: NNGRRT; PAM sequence: ACGAGT
gtggtggatcacttgatgtc

SEQ ID NO: 6869 - DNA, 20 bp, Artificial Sequence
  Description of Artificial Sequence: Synthetic oligonucleotide
  Target: FXN; (+) strand; PAM type: NNGRRT; PAM sequence: CTGGGT
accagccactgcactccagc

SEQ ID NO: 6870 - DNA, 20 bp, Artificial Sequence
  Description of Artificial Sequence: Synthetic oligonucleotide
  Target: FXN; (+) strand; PAM type: NNGRRT; PAM sequence: CAGAGT
ctgcactccagcctgggtga

SEQ ID NO: 6871 - DNA, 20 bp, Artificial Sequence
  Description of Artificial Sequence: Synthetic oligonucleotide
  Target: FXN; (+) strand; PAM type: NNGRRT; PAM sequence: ATGAAT
atgttattttcatcaattta

SEQ ID NO: 6872 - DNA, 20 bp, Artificial Sequence
  Description of Artificial Sequence: Synthetic oligonucleotide
  Target: FXN; (+) strand; PAM type: NNGRRT; PAM sequence: TTGGGT
aagcatttggtaatcatgtt

SEQ ID NO: 6873 - DNA, 20 bp, Artificial Sequence
  Description of Artificial Sequence: Synthetic oligonucleotide
  Target: FXN; (+) strand; PAM type: NNGRRT; PAM sequence: CAGAGT
ggaaacgctggactctttag

SEQ ID NO: 6874 - DNA, 20 bp, Artificial Sequence
  Description of Artificial Sequence: Synthetic oligonucleotide
  Target: FXN; (+) strand; PAM type: NNGRRT; PAM sequence: TGGGGT
gaggactatgatgtctcctt

SEQ ID NO: 6875 - DNA, 20 bp, Artificial Sequence
  Description of Artificial Sequence: Synthetic oligonucleotide
  Target: FXN; (+) strand; PAM type: NNGRRT; PAM sequence: AAGAAT
atttttctgtttccccctct

SEQ ID NO: 6876 - DNA, 20 bp, Artificial Sequence
  Description of Artificial Sequence: Synthetic oligonucleotide
  Target: FXN; (+) strand; PAM type: NNGRRT; PAM sequence: AAGAAT
aattttagttcactaaaatg

SEQ ID NO: 6877 - DNA, 20 bp, Artificial Sequence
  Description of Artificial Sequence: Synthetic oligonucleotide
  Target: FXN; (+) strand; PAM type: NNGRRT; PAM sequence: TAGGAT
aagtagcatgtagttgtagg

SEQ ID NO: 6878 - DNA, 20 bp, Artificial Sequence
  Description of Artificial Sequence: Synthetic oligonucleotide
  Target: FXN; (+) strand; PAM type: NNGRRT; PAM sequence: TAGGGT
tgtaggtaggattaaaagac

SEQ ID NO: 6879 - DNA, 20 bp, Artificial Sequence
  Description of Artificial Sequence: Synthetic oligonucleotide
  Target: FXN; (+) strand; PAM type: NNGRRT; PAM sequence: CTGGGT
tcacgccactgcactccagc

SEQ ID NO: 6880 - DNA, 20 bp, Artificial Sequence
  Description of Artificial Sequence: Synthetic oligonucleotide
  Target: FXN; (+) strand; PAM type: NNGRRT; PAM sequence: ATGGAT
agagcgagactctgtcatag

SEQ ID NO: 6881 - DNA, 20 bp, Artificial Sequence
  Description of Artificial Sequence: Synthetic oligonucleotide
  Target: FXN; (+) strand; PAM type: NNGRRT; PAM sequence: ATGGAT
cgagactctgtcatagatgg

SEQ ID NO: 6882 - DNA, 20 bp, Artificial Sequence
  Description of Artificial Sequence: Synthetic oligonucleotide
  Target: FXN; (+) strand; PAM type: NNGRRT; PAM sequence: ATGGAT
actctgtcatagatggatgg

SEQ ID NO: 6883 - DNA, 20 bp, Artificial Sequence
  Description of Artificial Sequence: Synthetic oligonucleotide
  Target: FXN; (+) strand; PAM type: NNGRRT; PAM sequence: ATGGAT
tgtcatagatggatggatgg

SEQ ID NO: 6884 - DNA, 20 bp, Artificial Sequence
  Description of Artificial Sequence: Synthetic oligonucleotide
  Target: FXN; (+) strand; PAM type: NNGRRT; PAM sequence: ATGGAT
atagatggatggatggatgg

SEQ ID NO: 6885 - DNA, 20 bp, Artificial Sequence
  Description of Artificial Sequence: Synthetic oligonucleotide
  Target: FXN; (+) strand; PAM type: NNGRRT; PAM sequence: ATGGAT
atggatggatggatggatgg

SEQ ID NO: 6886 - DNA, 20 bp, Artificial Sequence
  Description of Artificial Sequence: Synthetic oligonucleotide
  Target: FXN; (+) strand; PAM type: NNGRRT; PAM sequence: ATGGAT
atggatggatggatggatgg

SEQ ID NO: 6887 - DNA, 20 bp, Artificial Sequence
  Description of Artificial Sequence: Synthetic oligonucleotide
  Target: FXN; (+) strand; PAM type: NNGRRT; PAM sequence: ATGGAT
atggatggatggatggatgg

SEQ ID NO: 6888 - DNA, 20 bp, Artificial Sequence
  Description of Artificial Sequence: Synthetic oligonucleotide
  Target: FXN; (+) strand; PAM type: NNGRRT; PAM sequence: ATGGAT
atggatggatggatggatgg

SEQ ID NO: 6889 - DNA, 20 bp, Artificial Sequence
  Description of Artificial Sequence: Synthetic oligonucleotide
  Target: FXN; (+) strand; PAM type: NNGRRT; PAM sequence: CTGGAT
atagatagatagatagatag

SEQ ID NO: 6890 - DNA, 20 bp, Artificial Sequence
  Description of Artificial Sequence: Synthetic oligonucleotide
  Target: FXN; (+) strand; PAM type: NNGRRT; PAM sequence: GTGGAT
agcctcattttccagcttca

SEQ ID NO: 6891 - DNA, 20 bp, Artificial Sequence
  Description of Artificial Sequence: Synthetic oligonucleotide
  Target: FXN; (+) strand; PAM type: NNGRRT; PAM sequence: CTGAGT
aaggcaaatcagagaggggc

SEQ ID NO: 6892 - DNA, 20 bp, Artificial Sequence
  Description of Artificial Sequence: Synthetic oligonucleotide
  Target: FXN; (+) strand; PAM type: NNGRRT; PAM sequence: AGGGAT
tagacccgtagttcttcagt

SEQ ID NO: 6893 - DNA, 20 bp, Artificial Sequence
  Description of Artificial Sequence: Synthetic oligonucleotide
  Target: FXN; (+) strand; PAM type: NNGRRT; PAM sequence: TGGGGT
ctgctcctgtgagacagtga

SEQ ID NO: 6894 - DNA, 20 bp, Artificial Sequence
  Description of Artificial Sequence: Synthetic oligonucleotide
  Target: FXN; (+) strand; PAM type: NNGRRT; PAM sequence: TCGGGT
tgagacagtgatggggtagg

SEQ ID NO: 6895 - DNA, 20 bp, Artificial Sequence
  Description of Artificial Sequence: Synthetic oligonucleotide
  Target: FXN; (+) strand; PAM type: NNGRRT; PAM sequence: TGGGAT
atatttttgaaaagctcacc

SEQ ID NO: 6896 - DNA, 20 bp, Artificial Sequence
  Description of Artificial Sequence: Synthetic oligonucleotide
  Target: FXN; (+) strand; PAM type: NNGRRT; PAM sequence: TGGGGT
gagattttgattacttggtc

SEQ ID NO: 6897 - DNA, 20 bp, Artificial Sequence
  Description of Artificial Sequence: Synthetic oligonucleotide
  Target: FXN; (+) strand; PAM type: NNGRRT; PAM sequence: TGGGAT
gcatgacctgggcagggcac

SEQ ID NO: 6898 - DNA, 20 bp, Artificial Sequence
  Description of Artificial Sequence: Synthetic oligonucleotide
  Target: FXN; (+) strand; PAM type: NNGRRT; PAM sequence: AGGAGT
gagaacttgtttttttttga

SEQ ID NO: 6899 - DNA, 20 bp, Artificial Sequence
  Description of Artificial Sequence: Synthetic oligonucleotide
  Target: FXN; (+) strand; PAM type: NNGRRT; PAM sequence: TGGAGT
tctcactctgtcacccaggc

SEQ ID NO: 6900 - DNA, 20 bp, Artificial Sequence
  Description of Artificial Sequence: Synthetic oligonucleotide
  Target: FXN; (+) strand; PAM type: NNGRRT; PAM sequence: CTGGGT
tcggctcactgctccgcttc

SEQ ID NO: 6901 - DNA, 20 bp, Artificial Sequence
  Description of Artificial Sequence: Synthetic oligonucleotide
  Target: FXN; (+) strand; PAM type: NNGRRT; PAM sequence: CCGAGT
agttctcctgcctcagcctc

SEQ ID NO: 6902 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcagcctcccgagtagc

SEQ ID NO: 6903 - DNA, 20 bp, Artificial Sequence
  Description of Artificial Sequence: Synthetic oligonucleotide
  Target: FXN; (+) strand; PAM type: NNGRRT; PAM sequence: CGGGGT
tttttgcattttagtaaaga

SEQ ID NO: 6904 - DNA, 20 bp, Artificial Sequence
  Description of Artificial Sequence: Synthetic oligonucleotide
  Target: FXN; (+) strand; PAM type: NNGRRT; PAM sequence: TGGGAT
ccatcagccttccaaagttt

SEQ ID NO: 6905 - DNA, 20 bp, Artificial Sequence
  Description of Artificial Sequence: Synthetic oligonucleotide
  Target: FXN; (+) strand; PAM type: NNGRRT; PAM sequence: CTGAGT
ccggcctggtgtgagaactt

SEQ ID NO: 6906 - DNA, 20 bp, Artificial Sequence
  Description of Artificial Sequence: Synthetic oligonucleotide
  Target: FXN; (+) strand; PAM type: NNGRRT; PAM sequence: TTGGAT
ctggtgtgagaacttctgag

SEQ ID NO: 6907 - DNA, 20 bp, Artificial Sequence
  Description of Artificial Sequence: Synthetic oligonucleotide
  Target: FXN; (+) strand; PAM type: NNGRRT; PAM sequence: AAGGGT
accaggtggcagatttgggc

SEQ ID NO: 6908 - DNA, 20 bp, Artificial Sequence
  Description of Artificial Sequence: Synthetic oligonucleotide
  Target: FXN; (+) strand; PAM type: NNGRRT; PAM sequence: TTGGGT
atttgggcaagggtctgcct

SEQ ID NO: 6909 - DNA, 20 bp, Artificial Sequence
  Description of Artificial Sequence: Synthetic oligonucleotide
  Target: FXN; (+) strand; PAM type: NNGRRT; PAM sequence: TAGAAT
caagggtctgcctttgggtt

SEQ ID NO: 6910 - DNA, 20 bp, Artificial Sequence
  Description of Artificial Sequence: Synthetic oligonucleotide
  Target: FXN; (+) strand; PAM type: NNGRRT; PAM sequence: CTGGGT
aatccctcaaagatggtttt

SEQ ID NO: 6911 - DNA, 20 bp, Artificial Sequence
  Description of Artificial Sequence: Synthetic oligonucleotide
  Target: FXN; (+) strand; PAM type: NNGRRT; PAM sequence: CAGAGT
tgtttgtttgttttttgaga

SEQ ID NO: 6912 - DNA, 20 bp, Artificial Sequence
  Description of Artificial Sequence: Synthetic oligonucleotide
  Target: FXN; (+) strand; PAM type: NNGRRT; PAM sequence: TGGAGT
tctccctctgttattcagcc

SEQ ID NO: 6913 - DNA, 20 bp, Artificial Sequence
  Description of Artificial Sequence: Synthetic oligonucleotide
  Target: FXN; (+) strand; PAM type: NNGRRT; PAM sequence: TCGGGT
ctcactgcaacctctgcctc

SEQ ID NO: 6914 - DNA, 20 bp, Artificial Sequence
  Description of Artificial Sequence: Synthetic oligonucleotide
  Target: FXN; (+) strand; PAM type: NNGRRT; PAM sequence: TGGAAT
gcctcaacctcccaagtagc

SEQ ID NO: 6915 - DNA, 20 bp, Artificial Sequence
  Description of Artificial Sequence: Synthetic oligonucleotide
  Target: FXN; (+) strand; PAM type: NNGRRT; PAM sequence: TAGGAT
acctcagcctcccaaagtgc

SEQ ID NO: 6916 - DNA, 20 bp, Artificial Sequence
  Description of Artificial Sequence: Synthetic oligonucleotide
  Target: FXN; (+) strand; PAM type: NNGRRT; PAM sequence: TTGGAT
aatgtcacgaagcgtgcatt

SEQ ID NO: 6917 - DNA, 20 bp, Artificial Sequence
  Description of Artificial Sequence: Synthetic oligonucleotide
  Target: FXN; (+) strand; PAM type: NNGRRT; PAM sequence: TGGAAT
gtgcattttggattcaatca

SEQ ID NO: 6918 - DNA, 20 bp, Artificial Sequence
  Description of Artificial Sequence: Synthetic oligonucleotide
  Target: FXN; (+) strand; PAM type: NNGRRT; PAM sequence: CTGAAT
tggaaattgcagcgggagca

SEQ ID NO: 6919 - DNA, 20 bp, Artificial Sequence
  Description of Artificial Sequence: Synthetic oligonucleotide
  Target: FXN; (+) strand; PAM type: NNGRRT; PAM sequence: GGGAAT
cctgactataaggacagtga

SEQ ID NO: 6920 - DNA, 20 bp, Artificial Sequence
  Description of Artificial Sequence: Synthetic oligonucleotide
  Target: FXN; (+) strand; PAM type: NNGRRT; PAM sequence: AAGGAT
aaaggagcaatggagcaggg

SEQ ID NO: 6921 - DNA, 20 bp, Artificial Sequence
  Description of Artificial Sequence: Synthetic oligonucleotide
  Target: FXN; (+) strand; PAM type: NNGRRT; PAM sequence: TTGAAT
agcaatggagcagggaagga

SEQ ID NO: 6922 - DNA, 20 bp, Artificial Sequence
  Description of Artificial Sequence: Synthetic oligonucleotide
  Target: FXN; (+) strand; PAM type: NNGRRT; PAM sequence: GGGAGT
cacagcctgatcagaggtgg

SEQ ID NO: 6923 - DNA, 20 bp, Artificial Sequence
  Description of Artificial Sequence: Synthetic oligonucleotide
  Target: FXN; (+) strand; PAM type: NNGRRT; PAM sequence: TAGGAT
agtcatgaaacctgttttta

SEQ ID NO: 6924 - DNA, 20 bp, Artificial Sequence
  Description of Artificial Sequence: Synthetic oligonucleotide
  Target: FXN; (+) strand; PAM type: NNGRRT; PAM sequence: CAGAGT
tagtgaagccccagtttgac

SEQ ID NO: 6925 - DNA, 20 bp, Artificial Sequence
  Description of Artificial Sequence: Synthetic oligonucleotide
  Target: FXN; (+) strand; PAM type: NNGRRT; PAM sequence: ATGAAT
gtttgaccagagtactttgc

SEQ ID NO: 6926 - DNA, 20 bp, Artificial Sequence
  Description of Artificial Sequence: Synthetic oligonucleotide
  Target: FXN; (+) strand; PAM type: NNGRRT; PAM sequence: TTGAGT
cttcttcttttttttttttt

SEQ ID NO: 6927 - DNA, 20 bp, Artificial Sequence
  Description of Artificial Sequence: Synthetic oligonucleotide
  Target: FXN; (+) strand; PAM type: NNGRRT; PAM sequence: TGGAGT
cctagctctgtcacccaggc

SEQ ID NO: 6928 - DNA, 20 bp, Artificial Sequence
  Description of Artificial Sequence: Synthetic oligonucleotide
  Target: FXN; (+) strand; PAM type: NNGRRT; PAM sequence: CTGAGT
gattctcccgcctcaacctc

SEQ ID NO: 6929 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcaacctcctgagtagc

SEQ ID NO: 6930 - DNA, 20 bp, Artificial Sequence
  Description of Artificial Sequence: Synthetic oligonucleotide
  Target: FXN; (+) strand; PAM type: NNGRRT; PAM sequence: TGGGGT
ttttgtatttttagtagaaa

SEQ ID NO: 6931 - DNA, 20 bp, Artificial Sequence
  Description of Artificial Sequence: Synthetic oligonucleotide
  Target: FXN; (+) strand; PAM type: NNGRRT; PAM sequence: CTGGGT
cgcctcagcctcctaaagtg

SEQ ID NO: 6932 - DNA, 20 bp, Artificial Sequence
  Description of Artificial Sequence: Synthetic oligonucleotide
  Target: FXN; (+) strand; PAM type: NNGRRT; PAM sequence: TGGAGT
cctcgctctgtcacccaggc

SEQ ID NO: 6933 - DNA, 20 bp, Artificial Sequence
  Description of Artificial Sequence: Synthetic oligonucleotide
  Target: FXN; (+) strand; PAM type: NNGRRT; PAM sequence: ATGGGT
ctaattattttattttattt

SEQ ID NO: 6934 - DNA, 20 bp, Artificial Sequence
  Description of Artificial Sequence: Synthetic oligonucleotide
  Target: FXN; (+) strand; PAM type: NNGRRT; PAM sequence: CGGGAT
acctcggcctcccaaagcac

SEQ ID NO: 6935 - DNA, 20 bp, Artificial Sequence
  Description of Artificial Sequence: Synthetic oligonucleotide
  Target: FXN; (+) strand; PAM type: NNGRRT; PAM sequence: GAGGGT
aaaggaggactatttctaaa

SEQ ID NO: 6936 - DNA, 20 bp, Artificial Sequence
  Description of Artificial Sequence: Synthetic oligonucleotide
  Target: FXN; (+) strand; PAM type: NNGRRT; PAM sequence: ATGAAT
caagaaggggcaaagggaac

SEQ ID NO: 6937 - DNA, 20 bp, Artificial Sequence
  Description of Artificial Sequence: Synthetic oligonucleotide
  Target: FXN; (+) strand; PAM type: NNGRRT; PAM sequence: GAGGAT
acatattcaacagattatgg

SEQ ID NO: 6938 - DNA, 20 bp, Artificial Sequence
  Description of Artificial Sequence: Synthetic oligonucleotide
  Target: FXN; (+) strand; PAM type: NNGRRT; PAM sequence: ATGAAT
aacagattatgggaggatct

SEQ ID NO: 6939 - DNA, 20 bp, Artificial Sequence
  Description of Artificial Sequence: Synthetic oligonucleotide
  Target: FXN; (+) strand; PAM type: NNGRRT; PAM sequence: GAGGAT
tctatgaatattcacaaagg

SEQ ID NO: 6940 - DNA, 20 bp, Artificial Sequence
  Description of Artificial Sequence: Synthetic oligonucleotide
  Target: FXN; (+) strand; PAM type: NNGRRT; PAM sequence: ATGAAT
tattcacaaagggaggatct

SEQ ID NO: 6941 - DNA, 20 bp, Artificial Sequence
  Description of Artificial Sequence: Synthetic oligonucleotide
  Target: FXN; (+) strand; PAM type: NNGRRT; PAM sequence: TGGAGT
tctatgaatatgcacacatg

SEQ ID NO: 6942 - DNA, 20 bp, Artificial Sequence
  Description of Artificial Sequence: Synthetic oligonucleotide
  Target: FXN; (+) strand; PAM type: NNGRRT; PAM sequence: GGGAGT
caggagcatcacttaagact

SEQ ID NO: 6943 - DNA, 20 bp, Artificial Sequence
  Description of Artificial Sequence: Synthetic oligonucleotide
  Target: FXN; (+) strand; PAM type: NNGRRT; PAM sequence: CAGGAT
tcgcaccactgttctccagc

SEQ ID NO: 6944 - DNA, 20 bp, Artificial Sequence
  Description of Artificial Sequence: Synthetic oligonucleotide
  Target: FXN; (+) strand; PAM type: NNGRRT; PAM sequence: AGGAAT
gtggtcagtggttatcagga

SEQ ID NO: 6945 - DNA, 20 bp, Artificial Sequence
  Description of Artificial Sequence: Synthetic oligonucleotide
  Target: FXN; (+) strand; PAM type: NNGRRT; PAM sequence: CAGAAT
aaaccactaaaaaggaaggg

SEQ ID NO: 6946 - DNA, 20 bp, Artificial Sequence
  Description of Artificial Sequence: Synthetic oligonucleotide
  Target: FXN; (+) strand; PAM type: NNGRRT; PAM sequence: ATGAGT
aggaagggcagaattaggtg

SEQ ID NO: 6947 - DNA, 20 bp, Artificial Sequence
  Description of Artificial Sequence: Synthetic oligonucleotide
  Target: FXN; (+) strand; PAM type: NNGRRT; PAM sequence: GTGAGT
gagttgataccagtggtgaa

SEQ ID NO: 6948 - DNA, 20 bp, Artificial Sequence
  Description of Artificial Sequence: Synthetic oligonucleotide
  Target: FXN; (+) strand; PAM type: NNGRRT; PAM sequence: TGGAGT
ttttttttttctttttgaga

SEQ ID NO: 6949 - DNA, 20 bp, Artificial Sequence
  Description of Artificial Sequence: Synthetic oligonucleotide
  Target: FXN; (+) strand; PAM type: NNGRRT; PAM sequence: TGGAGT
tcttgctctgttgcccaggc

SEQ ID NO: 6950 - DNA, 20 bp, Artificial Sequence
  Description of Artificial Sequence: Synthetic oligonucleotide
  Target: FXN; (+) strand; PAM type: NNGRRT; PAM sequence: CTGGGT
ctcatcgcaacctccacctc

SEQ ID NO: 6951 - DNA, 20 bp, Artificial Sequence
  Description of Artificial Sequence: Synthetic oligonucleotide
  Target: FXN; (+) strand; PAM type: NNGRRT; PAM sequence: CCGAGT
gattctcttgcctcagcctc

SEQ ID NO: 6952 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcagcctcccgagtagc

SEQ ID NO: 6953 - DNA, 20 bp, Artificial Sequence
  Description of Artificial Sequence: Synthetic oligonucleotide
  Target: FXN; (+) strand; PAM type: NNGRRT; PAM sequence: CTGGGT
ttttatatttttagtagaga

SEQ ID NO: 6954 - DNA, 20 bp, Artificial Sequence
  Description of Artificial Sequence: Synthetic oligonucleotide
  Target: FXN; (+) strand; PAM type: NNGRRT; PAM sequence: TGGGAT
gctttggcctcccaaagtgc

SEQ ID NO: 6955 - DNA, 20 bp, Artificial Sequence
  Description of Artificial Sequence: Synthetic oligonucleotide
  Target: FXN; (+) strand; PAM type: NNGRRT; PAM sequence: TGGGAT
tacaggcagctccaaagtgc

SEQ ID NO: 6956 - DNA, 20 bp, Artificial Sequence
  Description of Artificial Sequence: Synthetic oligonucleotide
  Target: FXN; (+) strand; PAM type: NNGRRT; PAM sequence: GGGAAT
aaactaatggcagttaggga

SEQ ID NO: 6957 - DNA, 20 bp, Artificial Sequence
  Description of Artificial Sequence: Synthetic oligonucleotide
  Target: FXN; (+) strand; PAM type: NNGRRT; PAM sequence: ACGAGT
gcagttagggagggaataga

SEQ ID NO: 6958 - DNA, 20 bp, Artificial Sequence
  Description of Artificial Sequence: Synthetic oligonucleotide
  Target: FXN; (+) strand; PAM type: NNGRRT; PAM sequence: TTGAGT
cttggccaaaagatagtttg

SEQ ID NO: 6959 - DNA, 20 bp, Artificial Sequence
  Description of Artificial Sequence: Synthetic oligonucleotide
  Target: FXN; (+) strand; PAM type: NNGRRT; PAM sequence: TAGAAT
tgttgagtcagttgggagct

SEQ ID NO: 6960 - DNA, 20 bp, Artificial Sequence
  Description of Artificial Sequence: Synthetic oligonucleotide
  Target: FXN; (+) strand; PAM type: NNGRRT; PAM sequence: TTGAAT
tgtttttatttctcacatca

SEQ ID NO: 6961 - DNA, 20 bp, Artificial Sequence
  Description of Artificial Sequence: Synthetic oligonucleotide
  Target: FXN; (+) strand; PAM type: NNGRRT; PAM sequence: GTGGGT
aaaaccttctgctcccagta

SEQ ID NO: 6962 - DNA, 20 bp, Artificial Sequence
  Description of Artificial Sequence: Synthetic oligonucleotide
  Target: FXN; (+) strand; PAM type: NNGRRT; PAM sequence: TTGAGT
ttctagccaattcatatacc

SEQ ID NO: 6963 - DNA, 20 bp, Artificial Sequence
  Description of Artificial Sequence: Synthetic oligonucleotide
  Target: FXN; (+) strand; PAM type: NNGRRT; PAM sequence: TAGAGT
gaaatgctaactctgtaccc

SEQ ID NO: 6964 - DNA, 20 bp, Artificial Sequence
  Description of Artificial Sequence: Synthetic oligonucleotide
  Target: FXN; (+) strand; PAM type: NNGRRT; PAM sequence: ATGAAT
ctaactctgtaccctagagt

SEQ ID NO: 6965 - DNA, 20 bp, Artificial Sequence
  Description of Artificial Sequence: Synthetic oligonucleotide
  Target: FXN; (+) strand; PAM type: NNGRRT; PAM sequence: TAGAGT
ctagagtatgaattcctgat

SEQ ID NO: 6966 - DNA, 20 bp, Artificial Sequence
  Description of Artificial Sequence: Synthetic oligonucleotide
  Target: FXN; (+) strand; PAM type: NNGRRT; PAM sequence: CTGAGT
cagctaccacctataacaca

SEQ ID NO: 6967 - DNA, 20 bp, Artificial Sequence
  Description of Artificial Sequence: Synthetic oligonucleotide
  Target: FXN; (+) strand; PAM type: NNGRRT; PAM sequence: TGGAGT
tctgttcttttttctctctg

SEQ ID NO: 6968 - DNA, 20 bp, Artificial Sequence
  Description of Artificial Sequence: Synthetic oligonucleotide
  Target: FXN; (+) strand; PAM type: NNGRRT; PAM sequence: GTGGAT
tcaagtggtccaggtaacag

SEQ ID NO: 6969 - DNA, 20 bp, Artificial Sequence
  Description of Artificial Sequence: Synthetic oligonucleotide
  Target: FXN; (+) strand; PAM type: NNGRRT; PAM sequence: TGGAGT
ctcttgtcactaggcagctg

SEQ ID NO: 6970 - DNA, 20 bp, Artificial Sequence
  Description of Artificial Sequence: Synthetic oligonucleotide
  Target: FXN; (+) strand; PAM type: NNGRRT; PAM sequence: TAGAGT
aaaatctgcctggagactgt

SEQ ID NO: 6971 - DNA, 20 bp, Artificial Sequence
  Description of Artificial Sequence: Synthetic oligonucleotide
  Target: FXN; (+) strand; PAM type: NNGRRT; PAM sequence: TGGAGT
gacctcttttttttcccagg

SEQ ID NO: 6972 - DNA, 20 bp, Artificial Sequence
  Description of Artificial Sequence: Synthetic oligonucleotide
  Target: FXN; (+) strand; PAM type: NNGRRT; PAM sequence: AAGGAT
ggcatcttagatattttaat

SEQ ID NO: 6973 - DNA, 20 bp, Artificial Sequence
  Description of Artificial Sequence: Synthetic oligonucleotide
  Target: FXN; (+) strand; PAM type: NNGRRT; PAM sequence: GAGGGT
catattactgtcttagaact

SEQ ID NO: 6974 - DNA, 20 bp, Artificial Sequence
  Description of Artificial Sequence: Synthetic oligonucleotide
  Target: FXN; (+) strand; PAM type: NNGRRT; PAM sequence: TTGGAT
ctgagggttcttcatctttt

SEQ ID NO: 6975 - DNA, 20 bp, Artificial Sequence
  Description of Artificial Sequence: Synthetic oligonucleotide
  Target: FXN; (+) strand; PAM type: NNGRRT; PAM sequence: AAGAAT
ttggatcaggacctccctct

SEQ ID NO: 6976 - DNA, 20 bp, Artificial Sequence
  Description of Artificial Sequence: Synthetic oligonucleotide
  Target: FXN; (+) strand; PAM type: NNGRRT; PAM sequence: CAGAGT
aaaaactttaaacaaattaa

SEQ ID NO: 6977 - DNA, 20 bp, Artificial Sequence
  Description of Artificial Sequence: Synthetic oligonucleotide
  Target: FXN; (+) strand; PAM type: NNGRRT; PAM sequence: AAGAAT
taacagagttttattcagca

SEQ ID NO: 6978 - DNA, 20 bp, Artificial Sequence
  Description of Artificial Sequence: Synthetic oligonucleotide
  Target: FXN; (+) strand; PAM type: NNGRRT; PAM sequence: CAGAAT
taaatcgggaaggctgcaac

SEQ ID NO: 6979 - DNA, 20 bp, Artificial Sequence
  Description of Artificial Sequence: Synthetic oligonucleotide
  Target: FXN; (+) strand; PAM type: NNGRRT; PAM sequence: GAGGAT
cggtgtgccacgtggttgga

SEQ ID NO: 6980 - DNA, 20 bp, Artificial Sequence
  Description of Artificial Sequence: Synthetic oligonucleotide
  Target: FXN; (+) strand; PAM type: NNGRRT; PAM sequence: TAGGAT
ccacgtggttggagaggatt

SEQ ID NO: 6981 - DNA, 20 bp, Artificial Sequence
  Description of Artificial Sequence: Synthetic oligonucleotide
  Target: FXN; (+) strand; PAM type: NNGRRT; PAM sequence: GAGAAT
tacttgggaggctgaggcag

SEQ ID NO: 6982 - DNA, 20 bp, Artificial Sequence
  Description of Artificial Sequence: Synthetic oligonucleotide
  Target: FXN; (+) strand; PAM type: NNGRRT; PAM sequence: CAGGAT
aggcggagcttgcagtgagc

SEQ ID NO: 6983 - DNA, 20 bp, Artificial Sequence
  Description of Artificial Sequence: Synthetic oligonucleotide
  Target: FXN; (+) strand; PAM type: NNGRRT; PAM sequence: AAGAGT
caaaactcggtgattggtac

SEQ ID NO: 6984 - DNA, 20 bp, Artificial Sequence
  Description of Artificial Sequence: Synthetic oligonucleotide
  Target: FXN; (+) strand; PAM type: NNGRRT; PAM sequence: AGGAGT
acacttaagttaacatactc

SEQ ID NO: 6985 - DNA, 20 bp, Artificial Sequence
  Description of Artificial Sequence: Synthetic oligonucleotide
  Target: FXN; (+) strand; PAM type: NNGRRT; PAM sequence: TGGAGT
tctcactctgtcacccaggc

SEQ ID NO: 6986 - DNA, 20 bp, Artificial Sequence
  Description of Artificial Sequence: Synthetic oligonucleotide
  Target: FXN; (+) strand; PAM type: NNGRRT; PAM sequence: AGGGAT
accaccacctcctgggctca

SEQ ID NO: 6987 - DNA, 20 bp, Artificial Sequence
  Description of Artificial Sequence: Synthetic oligonucleotide
  Target: FXN; (+) strand; PAM type: NNGRRT; PAM sequence: CCGAGT
gattctcttgcctcagtctc

SEQ ID NO: 6988 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcagtctcccgagtaac

SEQ ID NO: 6989 - DNA, 20 bp, Artificial Sequence
  Description of Artificial Sequence: Synthetic oligonucleotide
  Target: FXN; (+) strand; PAM type: NNGRRT; PAM sequence: TGGGGT
ttttgtatttttagtagaga

SEQ ID NO: 6990 - DNA, 20 bp, Artificial Sequence
  Description of Artificial Sequence: Synthetic oligonucleotide
  Target: FXN; (+) strand; PAM type: NNGRRT; PAM sequence: GTGAGT
aaagtgctggcattagaggt

SEQ ID NO: 6991 - DNA, 20 bp, Artificial Sequence
  Description of Artificial Sequence: Synthetic oligonucleotide
  Target: FXN; (+) strand; PAM type: NNGRRT; PAM sequence: TTGGAT
cccagtgaggcaccatctca

SEQ ID NO: 6992 - DNA, 20 bp, Artificial Sequence
  Description of Artificial Sequence: Synthetic oligonucleotide
  Target: FXN; (+) strand; PAM type: NNGRRT; PAM sequence: AAGGAT
tctcattggatatggagaca

SEQ ID NO: 6993 - DNA, 20 bp, Artificial Sequence
  Description of Artificial Sequence: Synthetic oligonucleotide
  Target: FXN; (+) strand; PAM type: NNGRRT; PAM sequence: CTGGAT
aaaggatctggcttagcatc

SEQ ID NO: 6994 - DNA, 20 bp, Artificial Sequence
  Description of Artificial Sequence: Synthetic oligonucleotide
  Target: FXN; (+) strand; PAM type: NNGRRT; PAM sequence: AAGAGT
tggatttgtattttctttcc

SEQ ID NO: 6995 - DNA, 20 bp, Artificial Sequence
  Description of Artificial Sequence: Synthetic oligonucleotide
  Target: FXN; (+) strand; PAM type: NNGRRT; PAM sequence: ATGAGT
gcagtttcctcagctatgag

SEQ ID NO: 6996 - DNA, 20 bp, Artificial Sequence
  Description of Artificial Sequence: Synthetic oligonucleotide
  Target: FXN; (+) strand; PAM type: NNGRRT; PAM sequence: GAGGAT
tcctctcttcagatttataa

SEQ ID NO: 6997 - DNA, 20 bp, Artificial Sequence
  Description of Artificial Sequence: Synthetic oligonucleotide
  Target: FXN; (+) strand; PAM type: NNGRRT; PAM sequence: ATGGGT
attgctatttttgctcctac

SEQ ID NO: 6998 - DNA, 20 bp, Artificial Sequence
  Description of Artificial Sequence: Synthetic oligonucleotide
  Target: FXN; (+) strand; PAM type: NNGRRT; PAM sequence: AGGAGT
tagggctgatcttgactagg

SEQ ID NO: 6999 - DNA, 20 bp, Artificial Sequence
  Description of Artificial Sequence: Synthetic oligonucleotide
  Target: FXN; (+) strand; PAM type: NNGRRT; PAM sequence: GCGGAT
actttgggaggccaaggcgg

SEQ ID NO: 7000 - DNA, 20 bp, Artificial Sequence
  Description of Artificial Sequence: Synthetic oligonucleotide
  Target: FXN; (+) strand; PAM type: NNGRRT; PAM sequence: GAGAAT
tactcgggaagctgaggcag

SEQ ID NO: 7001 - DNA, 20 bp, Artificial Sequence
  Description of Artificial Sequence: Synthetic oligonucleotide
  Target: FXN; (+) strand; PAM type: NNGRRT; PAM sequence: CTGGGT
tcgagccactgcactctagc

SEQ ID NO: 7002 - DNA, 20 bp, Artificial Sequence
  Description of Artificial Sequence: Synthetic oligonucleotide
  Target: FXN; (+) strand; PAM type: NNGRRT; PAM sequence: AGGAAT
aaatagactcagattgtcta

SEQ ID NO: 7003 - DNA, 20 bp, Artificial Sequence
  Description of Artificial Sequence: Synthetic oligonucleotide
  Target: FXN; (+) strand; PAM type: NNGRRT; PAM sequence: AAGAAT
tagtcagttccaaaagcatt

SEQ ID NO: 7004 - DNA, 20 bp, Artificial Sequence
  Description of Artificial Sequence: Synthetic oligonucleotide
  Target: FXN; (+) strand; PAM type: NNGRRT; PAM sequence: TGGGGT
ggtgggaggaagttgagcat

SEQ ID NO: 7005 - DNA, 20 bp, Artificial Sequence
  Description of Artificial Sequence: Synthetic oligonucleotide
  Target: FXN; (+) strand; PAM type: NNGRRT; PAM sequence: AGGGAT
acaaatgtcctttttgcagg

SEQ ID NO: 7006 - DNA, 20 bp, Artificial Sequence
  Description of Artificial Sequence: Synthetic oligonucleotide
  Target: FXN; (+) strand; PAM type: NNGRRT; PAM sequence: CTGAAT
aagcaagcagtcaggcagct

SEQ ID NO: 7007 - DNA, 20 bp, Artificial Sequence
  Description of Artificial Sequence: Synthetic oligonucleotide
  Target: FXN; (+) strand; PAM type: NNGRRT; PAM sequence: AGGGGT
cgaggcaatgggacccacag

SEQ ID NO: 7008 - DNA, 20 bp, Artificial Sequence
  Description of Artificial Sequence: Synthetic oligonucleotide
  Target: FXN; (+) strand; PAM type: NNGRRT; PAM sequence: CAGGGT
tgggacccacagaggggtag

SEQ ID NO: 7009 - DNA, 20 bp, Artificial Sequence
  Description of Artificial Sequence: Synthetic oligonucleotide
  Target: FXN; (+) strand; PAM type: NNGRRT; PAM sequence: GTGAGT
agaggggtagcagggtagag

SEQ ID NO: 7010 - DNA, 20 bp, Artificial Sequence
  Description of Artificial Sequence: Synthetic oligonucleotide
  Target: FXN; (+) strand; PAM type: NNGRRT; PAM sequence: GTGGGT
gggtagcagggtagaggtga

SEQ ID NO: 7011 - DNA, 20 bp, Artificial Sequence
  Description of Artificial Sequence: Synthetic oligonucleotide
  Target: FXN; (+) strand; PAM type: NNGRRT; PAM sequence: GGGGGT
tgactgcagagaaggtgcca

SEQ ID NO: 7012 - DNA, 20 bp, Artificial Sequence
  Description of Artificial Sequence: Synthetic oligonucleotide
  Target: FXN; (+) strand; PAM type: NNGRRT; PAM sequence: AAGAGT
tattaatatgccctttgaaa

SEQ ID NO: 7013 - DNA, 20 bp, Artificial Sequence
  Description of Artificial Sequence: Synthetic oligonucleotide
  Target: FXN; (+) strand; PAM type: NNGRRT; PAM sequence: TGGAGT
aaaaagagtggcctgatacc

SEQ ID NO: 7014 - DNA, 20 bp, Artificial Sequence
  Description of Artificial Sequence: Synthetic oligonucleotide
  Target: FXN; (+) strand; PAM type: NNGRRT; PAM sequence: CTGAGT
atctgcccctagttcttgcc

SEQ ID NO: 7015 - DNA, 20 bp, Artificial Sequence
  Description of Artificial Sequence: Synthetic oligonucleotide
  Target: FXN; (+) strand; PAM type: NNGRRT; PAM sequence: CTGGAT
tcagtcctctgccctttctg

SEQ ID NO: 7016 - DNA, 20 bp, Artificial Sequence
  Description of Artificial Sequence: Synthetic oligonucleotide
  Target: FXN; (+) strand; PAM type: NNGRRT; PAM sequence: TAGGGT
tggattgtggccccccagta

SEQ ID NO: 7017 - DNA, 20 bp, Artificial Sequence
  Description of Artificial Sequence: Synthetic oligonucleotide
  Target: FXN; (+) strand; PAM type: NNGRRT; PAM sequence: TAGGGT
tattattatactttaagtgt

SEQ ID NO: 7018 - DNA, 20 bp, Artificial Sequence
  Description of Artificial Sequence: Synthetic oligonucleotide
  Target: FXN; (+) strand; PAM type: NNGRRT; PAM sequence: CAGAGT
ctccaccccacaacagtccc

SEQ ID NO: 7019 - DNA, 20 bp, Artificial Sequence
  Description of Artificial Sequence: Synthetic oligonucleotide
  Target: FXN; (+) strand; PAM type: NNGRRT; PAM sequence: ATGAGT
tcattgttcagttcccacct

SEQ ID NO: 7020 - DNA, 20 bp, Artificial Sequence
  Description of Artificial Sequence: Synthetic oligonucleotide
  Target: FXN; (+) strand; PAM type: NNGRRT; PAM sequence: GAGAAT
ttcagttcccacctatgagt

SEQ ID NO: 7021 - DNA, 20 bp, Artificial Sequence
  Description of Artificial Sequence: Synthetic oligonucleotide
  Target: FXN; (+) strand; PAM type: NNGRRT; PAM sequence: GAGAAT
tgttcttgcgatagtttact

SEQ ID NO: 7022 - DNA, 20 bp, Artificial Sequence
  Description of Artificial Sequence: Synthetic oligonucleotide
  Target: FXN; (+) strand; PAM type: NNGRRT; PAM sequence: TTGGAT
cttaatccagtctatcattg

SEQ ID NO: 7023 - DNA, 20 bp, Artificial Sequence
  Description of Artificial Sequence: Synthetic oligonucleotide
  Target: FXN; (+) strand; PAM type: NNGRRT; PAM sequence: AGGAGT
tttataaaactctgtatgag

SEQ ID NO: 7024 - DNA, 20 bp, Artificial Sequence
  Description of Artificial Sequence: Synthetic oligonucleotide
  Target: FXN; (+) strand; PAM type: NNGRRT; PAM sequence: ACGGGT
aggagtgggaaatagtatta

SEQ ID NO: 7025 - DNA, 20 bp, Artificial Sequence
  Description of Artificial Sequence: Synthetic oligonucleotide
  Target: FXN; (+) strand; PAM type: NNGRRT; PAM sequence: CGGGGT
ggaaatagtattaacgggtg

SEQ ID NO: 7026 - DNA, 20 bp, Artificial Sequence
  Description of Artificial Sequence: Synthetic oligonucleotide
  Target: FXN; (+) strand; PAM type: NNGRRT; PAM sequence: TGGAAT
tttgggacaatggaaatagc

SEQ ID NO: 7027 - DNA, 20 bp, Artificial Sequence
  Description of Artificial Sequence: Synthetic oligonucleotide
  Target: FXN; (+) strand; PAM type: NNGRRT; PAM sequence: CTGAAT
ttgtgaaatactaaaaactc

SEQ ID NO: 7028 - DNA, 20 bp, Artificial Sequence
  Description of Artificial Sequence: Synthetic oligonucleotide
  Target: FXN; (+) strand; PAM type: NNGRRT; PAM sequence: GTGAAT
ggtgcgcaccaccacaccca

SEQ ID NO: 7029 - DNA, 20 bp, Artificial Sequence
  Description of Artificial Sequence: Synthetic oligonucleotide
  Target: FXN; (+) strand; PAM type: NNGRRT; PAM sequence: CAGGAT
tccttgggctcccgaagtgc

SEQ ID NO: 7030 - DNA, 20 bp, Artificial Sequence
  Description of Artificial Sequence: Synthetic oligonucleotide
  Target: FXN; (+) strand; PAM type: NNGRRT; PAM sequence: ATGAGT
cgaagtgccaggatacaagc

SEQ ID NO: 7031 - DNA, 20 bp, Artificial Sequence
  Description of Artificial Sequence: Synthetic oligonucleotide
  Target: FXN; (+) strand; PAM type: NNGRRT; PAM sequence: ATGGGT
gtcataccaaaacagtaaaa

SEQ ID NO: 7032 - DNA, 20 bp, Artificial Sequence
  Description of Artificial Sequence: Synthetic oligonucleotide
  Target: FXN; (+) strand; PAM type: NNGRRT; PAM sequence: TGGGAT
caggtggttactaagggcta

SEQ ID NO: 7033 - DNA, 20 bp, Artificial Sequence
  Description of Artificial Sequence: Synthetic oligonucleotide
  Target: FXN; (+) strand; PAM type: NNGRRT; PAM sequence: TAGAGT
aaattagtgtctaatgggca

SEQ ID NO: 7034 - DNA, 20 bp, Artificial Sequence
  Description of Artificial Sequence: Synthetic oligonucleotide
  Target: FXN; (+) strand; PAM type: NNGRRT; PAM sequence: TAGAGT
tgttacaaggtgaaaagttc

SEQ ID NO: 7035 - DNA, 20 bp, Artificial Sequence
  Description of Artificial Sequence: Synthetic oligonucleotide
  Target: FXN; (+) strand; PAM type: NNGRRT; PAM sequence: GTGAAT
gagttatgctgcccagcagt

SEQ ID NO: 7036 - DNA, 20 bp, Artificial Sequence
  Description of Artificial Sequence: Synthetic oligonucleotide
  Target: FXN; (+) strand; PAM type: NNGRRT; PAM sequence: CCGAGT
taaaaaaaaaaaaaatgggg

SEQ ID NO: 7037 - DNA, 20 bp, Artificial Sequence
  Description of Artificial Sequence: Synthetic oligonucleotide
  Target: FXN; (+) strand; PAM type: NNGRRT; PAM sequence: GAGGAT
actttgggaggccgaggtag

SEQ ID NO: 7038 - DNA, 20 bp, Artificial Sequence
  Description of Artificial Sequence: Synthetic oligonucleotide
  Target: FXN; (+) strand; PAM type: NNGRRT; PAM sequence: CTGAGT
cagctctctggaggcaggga

SEQ ID NO: 7039 - DNA, 20 bp, Artificial Sequence
  Description of Artificial Sequence: Synthetic oligonucleotide
  Target: FXN; (+) strand; PAM type: NNGRRT; PAM sequence: GAGGAT
tggaggcagggactgagtca

SEQ ID NO: 7040 - DNA, 20 bp, Artificial Sequence
  Description of Artificial Sequence: Synthetic oligonucleotide
  Target: FXN; (+) strand; PAM type: NNGRRT; PAM sequence: AGGGGT
tcagaggatcacttgagcat

SEQ ID NO: 7041 - DNA, 20 bp, Artificial Sequence
  Description of Artificial Sequence: Synthetic oligonucleotide
  Target: FXN; (+) strand; PAM type: NNGRRT; PAM sequence: GAGAGT
aaaactggcagctgatacct

SEQ ID NO: 7042 - DNA, 20 bp, Artificial Sequence
  Description of Artificial Sequence: Synthetic oligonucleotide
  Target: FXN; (+) strand; PAM type: NNGRRT; PAM sequence: GTGAAT
ctggcagctgatacctgaga

SEQ ID NO: 7043 - DNA, 20 bp, Artificial Sequence
  Description of Artificial Sequence: Synthetic oligonucleotide
  Target: FXN; (+) strand; PAM type: NNGRRT; PAM sequence: TGGGAT
tatcttttatcgctggttaa

SEQ ID NO: 7044 - DNA, 20 bp, Artificial Sequence
  Description of Artificial Sequence: Synthetic oligonucleotide
  Target: FXN; (+) strand; PAM type: NNGRRT; PAM sequence: GAGAAT
tcgctggttaatgggattga

SEQ ID NO: 7045 - DNA, 20 bp, Artificial Sequence
  Description of Artificial Sequence: Synthetic oligonucleotide
  Target: FXN; (+) strand; PAM type: NNGRRT; PAM sequence: CTGGAT
gtctttggacccacagagac

SEQ ID NO: 7046 - DNA, 20 bp, Artificial Sequence
  Description of Artificial Sequence: Synthetic oligonucleotide
  Target: FXN; (+) strand; PAM type: NNGRRT; PAM sequence: CTGAGT
aagattagctctgccaatta

SEQ ID NO: 7047 - DNA, 20 bp, Artificial Sequence
  Description of Artificial Sequence: Synthetic oligonucleotide
  Target: FXN; (+) strand; PAM type: NNGRRT; PAM sequence: TGGAAT
gttttcctcatctgtgaaac

SEQ ID NO: 7048 - DNA, 20 bp, Artificial Sequence
  Description of Artificial Sequence: Synthetic oligonucleotide
  Target: FXN; (+) strand; PAM type: NNGRRT; PAM sequence: ATGAAT
tcatctgtgaaactggaata

SEQ ID NO: 7049 - DNA, 20 bp, Artificial Sequence
  Description of Artificial Sequence: Synthetic oligonucleotide
  Target: FXN; (+) strand; PAM type: NNGRRT; PAM sequence: CCGAGT
caagcctggcacagtaggaa

SEQ ID NO: 7050 - DNA, 20 bp, Artificial Sequence
  Description of Artificial Sequence: Synthetic oligonucleotide
  Target: FXN; (+) strand; PAM type: NNGRRT; PAM sequence: TTGAAT
tcatttctatacatttgttt

SEQ ID NO: 7051 - DNA, 20 bp, Artificial Sequence
  Description of Artificial Sequence: Synthetic oligonucleotide
  Target: FXN; (+) strand; PAM type: NNGRRT; PAM sequence: TGGAAT
ttattattgttactaccctc

SEQ ID NO: 7052 - DNA, 20 bp, Artificial Sequence
  Description of Artificial Sequence: Synthetic oligonucleotide
  Target: FXN; (+) strand; PAM type: NNGRRT; PAM sequence: TTGGGT
tttcaataactctttgtttt

SEQ ID NO: 7053 - DNA, 20 bp, Artificial Sequence
  Description of Artificial Sequence: Synthetic oligonucleotide
  Target: FXN; (+) strand; PAM type: NNGRRT; PAM sequence: CAGGAT
gttttgctttgcttttgaga

SEQ ID NO: 7054 - DNA, 20 bp, Artificial Sequence
  Description of Artificial Sequence: Synthetic oligonucleotide
  Target: FXN; (+) strand; PAM type: NNGRRT; PAM sequence: CAGGGT
ttttgcatttttagtagaga

SEQ ID NO: 7055 - DNA, 20 bp, Artificial Sequence
  Description of Artificial Sequence: Synthetic oligonucleotide
  Target: FXN; (+) strand; PAM type: NNGRRT; PAM sequence: TGGAAT
gcctcggcctcccaaagtgc

SEQ ID NO: 7056 - DNA, 20 bp, Artificial Sequence
  Description of Artificial Sequence: Synthetic oligonucleotide
  Target: FXN; (+) strand; PAM type: NNGRRT; PAM sequence: AAGAAT
tgtttgcaaaagtgtgttat

SEQ ID NO: 7057 - DNA, 20 bp, Artificial Sequence
  Description of Artificial Sequence: Synthetic oligonucleotide
  Target: FXN; (+) strand; PAM type: NNGRRT; PAM sequence: TTGGAT
aatcattcagagcctctcga

SEQ ID NO: 7058 - DNA, 20 bp, Artificial Sequence
  Description of Artificial Sequence: Synthetic oligonucleotide
  Target: FXN; (+) strand; PAM type: NNGRRT; PAM sequence: TAGAAT
tctcgattggatggaggctc

SEQ ID NO: 7059 - DNA, 20 bp, Artificial Sequence
  Description of Artificial Sequence: Synthetic oligonucleotide
  Target: FXN; (+) strand; PAM type: NNGRRT; PAM sequence: AAGAGT
gtaaaggactcttttgttga

SEQ ID NO: 7060 - DNA, 20 bp, Artificial Sequence
  Description of Artificial Sequence: Synthetic oligonucleotide
  Target: FXN; (+) strand; PAM type: NNGRRT; PAM sequence: AAGAAT
atgcaccaactagtcttttg

SEQ ID NO: 7061 - DNA, 20 bp, Artificial Sequence
  Description of Artificial Sequence: Synthetic oligonucleotide
  Target: FXN; (+) strand; PAM type: NNGRRT; PAM sequence: AGGAGT
agagaaaaataaagccttgg

SEQ ID NO: 7062 - DNA, 20 bp, Artificial Sequence
  Description of Artificial Sequence: Synthetic oligonucleotide
  Target: FXN; (+) strand; PAM type: NNGRRT; PAM sequence: AAGAGT
aagcttgttagatgcgtggg

SEQ ID NO: 7063 - DNA, 20 bp, Artificial Sequence
  Description of Artificial Sequence: Synthetic oligonucleotide
  Target: FXN; (+) strand; PAM type: NNGRRT; PAM sequence: TGGAGT
tggaaataaaaaacttcatc

SEQ ID NO: 7064 - DNA, 20 bp, Artificial Sequence
  Description of Artificial Sequence: Synthetic oligonucleotide
  Target: FXN; (+) strand; PAM type: NNGRRT; PAM sequence: TTGAGT
agacttgtcatgtctgatgt

SEQ ID NO: 7065 - DNA, 20 bp, Artificial Sequence
  Description of Artificial Sequence: Synthetic oligonucleotide
  Target: FXN; (+) strand; PAM type: NNGRRT; PAM sequence: TAGAGT
gagttgacgtggtactctaa

SEQ ID NO: 7066 - DNA, 20 bp, Artificial Sequence
  Description of Artificial Sequence: Synthetic oligonucleotide
  Target: FXN; (+) strand; PAM type: NNGRRT; PAM sequence: TAGAGT
acgtggtactctaatagagt

SEQ ID NO: 7067 - DNA, 20 bp, Artificial Sequence
  Description of Artificial Sequence: Synthetic oligonucleotide
  Target: FXN; (+) strand; PAM type: NNGRRT; PAM sequence: TAGAGT
tttttttccacctaatcccc

SEQ ID NO: 7068 - DNA, 20 bp, Artificial Sequence
  Description of Artificial Sequence: Synthetic oligonucleotide
  Target: FXN; (+) strand; PAM type: NNGRRT; PAM sequence: CTGGGT
gtggtgtcttaactgtcaaa

SEQ ID NO: 7069 - DNA, 20 bp, Artificial Sequence
  Description of Artificial Sequence: Synthetic oligonucleotide
  Target: FXN; (+) strand; PAM type: NNGRRT; PAM sequence: GAGGAT
actttgagaggctgaggtag

SEQ ID NO: 7070 - DNA, 20 bp, Artificial Sequence
  Description of Artificial Sequence: Synthetic oligonucleotide
  Target: FXN; (+) strand; PAM type: NNGRRT; PAM sequence: AGGAGT
taggaggatcacttgaggac

SEQ ID NO: 7071 - DNA, 20 bp, Artificial Sequence
  Description of Artificial Sequence: Synthetic oligonucleotide
  Target: FXN; (+) strand; PAM type: NNGRRT; PAM sequence: GTGAGT
gaaccatcctgggcaacata

SEQ ID NO: 7072 - DNA, 20 bp, Artificial Sequence
  Description of Artificial Sequence: Synthetic oligonucleotide
  Target: FXN; (+) strand; PAM type: NNGRRT; PAM sequence: CTGGGT
aaataaaaataaagtcacag

SEQ ID NO: 7073 - DNA, 20 bp, Artificial Sequence
  Description of Artificial Sequence: Synthetic oligonucleotide
  Target: FXN; (+) strand; PAM type: NNGRRT; PAM sequence: GTGGAT
actttgggaggccaaggcct

SEQ ID NO: 7074 - DNA, 20 bp, Artificial Sequence
  Description of Artificial Sequence: Synthetic oligonucleotide
  Target: FXN; (+) strand; PAM type: NNGRRT; PAM sequence: AGGAGT
cctgtggatcacttgagctc

SEQ ID NO: 7075 - DNA, 20 bp, Artificial Sequence
  Description of Artificial Sequence: Synthetic oligonucleotide
  Target: FXN; (+) strand; PAM type: NNGRRT; PAM sequence: TTGGAT
aacttctccctgctgacaat

SEQ ID NO: 7076 - DNA, 20 bp, Artificial Sequence
  Description of Artificial Sequence: Synthetic oligonucleotide
  Target: FXN; (+) strand; PAM type: NNGRRT; PAM sequence: CAGGAT
tggatactgtaagcaggcat

SEQ ID NO: 7077 - DNA, 20 bp, Artificial Sequence
  Description of Artificial Sequence: Synthetic oligonucleotide
  Target: FXN; (+) strand; PAM type: NNGRRT; PAM sequence: GTGAGT
tcaggatattaagatctgaa

SEQ ID NO: 7078 - DNA, 20 bp, Artificial Sequence
  Description of Artificial Sequence: Synthetic oligonucleotide
  Target: FXN; (+) strand; PAM type: NNGRRT; PAM sequence: AAGGGT
tgttttgagcctctcaggta

SEQ ID NO: 7079 - DNA, 20 bp, Artificial Sequence
  Description of Artificial Sequence: Synthetic oligonucleotide
  Target: FXN; (+) strand; PAM type: NNGRRT; PAM sequence: TTGAAT
cctctcaggtaaagggttat

SEQ ID NO: 7080 - DNA, 20 bp, Artificial Sequence
  Description of Artificial Sequence: Synthetic oligonucleotide
  Target: FXN; (+) strand; PAM type: NNGRRT; PAM sequence: TGGGGT
tttgaattccctttgcaggt

SEQ ID NO: 7081 - DNA, 20 bp, Artificial Sequence
  Description of Artificial Sequence: Synthetic oligonucleotide
  Target: FXN; (+) strand; PAM type: NNGRRT; PAM sequence: TAGAGT
tgtgtaccctgtggaggtgg

SEQ ID NO: 7082 - DNA, 20 bp, Artificial Sequence
  Description of Artificial Sequence: Synthetic oligonucleotide
  Target: FXN; (+) strand; PAM type: NNGRRT; PAM sequence: AGGAAT
ttgatgtgctttcaatctag

SEQ ID NO: 7083 - DNA, 20 bp, Artificial Sequence
  Description of Artificial Sequence: Synthetic oligonucleotide
  Target: FXN; (+) strand; PAM type: NNGRRT; PAM sequence: GTGAAT
ccaaagagagcatgttgact

SEQ ID NO: 7084 - DNA, 20 bp, Artificial Sequence
  Description of Artificial Sequence: Synthetic oligonucleotide
  Target: FXN; (+) strand; PAM type: NNGRRT; PAM sequence: TAGAAT
agggccagataaaactagca

SEQ ID NO: 7085 - DNA, 20 bp, Artificial Sequence
  Description of Artificial Sequence: Synthetic oligonucleotide
  Target: FXN; (+) strand; PAM type: NNGRRT; PAM sequence: CAGAAT
gtgatctctaatgctttgtt

SEQ ID NO: 7086 - DNA, 20 bp, Artificial Sequence
  Description of Artificial Sequence: Synthetic oligonucleotide
  Target: FXN; (+) strand; PAM type: NNGRRT; PAM sequence: TAGAGT
ctttcatccaagaagtgtgc

SEQ ID NO: 7087 - DNA, 20 bp, Artificial Sequence
  Description of Artificial Sequence: Synthetic oligonucleotide
  Target: FXN; (+) strand; PAM type: NNGRRT; PAM sequence: GAGGAT
agttagtgtgctggaggttg

SEQ ID NO: 7088 - DNA, 20 bp, Artificial Sequence
  Description of Artificial Sequence: Synthetic oligonucleotide
  Target: FXN; (+) strand; PAM type: NNGRRT; PAM sequence: GTGGAT
ttcatctccgggggaacgaa

SEQ ID NO: 7089 - DNA, 20 bp, Artificial Sequence
  Description of Artificial Sequence: Synthetic oligonucleotide
  Target: FXN; (+) strand; PAM type: NNGRRT; PAM sequence: GGGGAT
tcggtccagcgatcactttt

SEQ ID NO: 7090 - DNA, 20 bp, Artificial Sequence
  Description of Artificial Sequence: Synthetic oligonucleotide
  Target: FXN; (+) strand; PAM type: NNGRRT; PAM sequence: GGGAAT
ctagctgtgttcagaagcat

SEQ ID NO: 7091 - DNA, 20 bp, Artificial Sequence
  Description of Artificial Sequence: Synthetic oligonucleotide
  Target: FXN; (+) strand; PAM type: NNGRRT; PAM sequence: CTGGGT
ggggacggggcaggttgaga

SEQ ID NO: 7092 - DNA, 20 bp, Artificial Sequence
  Description of Artificial Sequence: Synthetic oligonucleotide
  Target: FXN; (+) strand; PAM type: NNGRRT; PAM sequence: CAGAGT
tgcgccgtttccggcagatc

SEQ ID NO: 7093 - DNA, 20 bp, Artificial Sequence
  Description of Artificial Sequence: Synthetic oligonucleotide
  Target: FXN; (+) strand; PAM type: NNGRRT; PAM sequence: CCGGAT
cagatccagagtggccaccg

SEQ ID NO: 7094 - DNA, 20 bp, Artificial Sequence
  Description of Artificial Sequence: Synthetic oligonucleotide
  Target: FXN; (+) strand; PAM type: NNGRRT; PAM sequence: GGGAGT
cagagtggccaccgccggat

SEQ ID NO: 7095 - DNA, 20 bp, Artificial Sequence
  Description of Artificial Sequence: Synthetic oligonucleotide
  Target: FXN; (+) strand; PAM type: NNGRRT; PAM sequence: GGGGAT
caagacggcagctcccagcg

SEQ ID NO: 7096 - DNA, 20 bp, Artificial Sequence
  Description of Artificial Sequence: Synthetic oligonucleotide
  Target: FXN; (+) strand; PAM type: NNGRRT; PAM sequence: CCGAGT
ctcccagcgggggatggagg

SEQ ID NO: 7097 - DNA, 20 bp, Artificial Sequence
  Description of Artificial Sequence: Synthetic oligonucleotide
  Target: FXN; (+) strand; PAM type: NNGRRT; PAM sequence: CAGGAT
gtctgctggtcactggaggc

SEQ ID NO: 7098 - DNA, 20 bp, Artificial Sequence
  Description of Artificial Sequence: Synthetic oligonucleotide
  Target: FXN; (+) strand; PAM type: NNGRRT; PAM sequence: CGGGGT
cctgctgcccacacagactg

SEQ ID NO: 7099 - DNA, 20 bp, Artificial Sequence
  Description of Artificial Sequence: Synthetic oligonucleotide
  Target: FXN; (+) strand; PAM type: NNGRRT; PAM sequence: CAGGAT
tagctgtacctgcgaaggca

SEQ ID NO: 7100 - DNA, 20 bp, Artificial Sequence
  Description of Artificial Sequence: Synthetic oligonucleotide
  Target: FXN; (+) strand; PAM type: NNGRRT; PAM sequence: TTGAGT
atcaacaataaagatcatcc

SEQ ID NO: 7101 - DNA, 20 bp, Artificial Sequence
  Description of Artificial Sequence: Synthetic oligonucleotide
  Target: FXN; (+) strand; PAM type: NNGRRT; PAM sequence: TAGGGT
cttgagtctgctttgaaaag

SEQ ID NO: 7102 - DNA, 20 bp, Artificial Sequence
  Description of Artificial Sequence: Synthetic oligonucleotide
  Target: FXN; (+) strand; PAM type: NNGRRT; PAM sequence: AAGGGT
tggaggggctttaaagcaag

SEQ ID NO: 7103 - DNA, 20 bp, Artificial Sequence
  Description of Artificial Sequence: Synthetic oligonucleotide
  Target: FXN; (+) strand; PAM type: NNGRRT; PAM sequence: GTGAAT
acttactcttattcacagat

SEQ ID NO: 7104 - DNA, 20 bp, Artificial Sequence
  Description of Artificial Sequence: Synthetic oligonucleotide
  Target: FXN; (+) strand; PAM type: NNGRRT; PAM sequence: CAGAAT
gaaagtgacatgtcctaagt

SEQ ID NO: 7105 - DNA, 20 bp, Artificial Sequence
  Description of Artificial Sequence: Synthetic oligonucleotide
  Target: FXN; (+) strand; PAM type: NNGRRT; PAM sequence: TAGAGT
tgacatgtcctaagtcagaa

SEQ ID NO: 7106 - DNA, 20 bp, Artificial Sequence
  Description of Artificial Sequence: Synthetic oligonucleotide
  Target: FXN; (+) strand; PAM type: NNGRRT; PAM sequence: GAGGAT
aggccaccatgctaccctga

SEQ ID NO: 7107 - DNA, 20 bp, Artificial Sequence
  Description of Artificial Sequence: Synthetic oligonucleotide
  Target: FXN; (+) strand; PAM type: NNGRRT; PAM sequence: TGGAGT
ctgtagggccaggtggagcc

SEQ ID NO: 7108 - DNA, 20 bp, Artificial Sequence
  Description of Artificial Sequence: Synthetic oligonucleotide
  Target: FXN; (+) strand; PAM type: NNGRRT; PAM sequence: TGGGGT
ggacacaattttctagaaca

SEQ ID NO: 7109 - DNA, 20 bp, Artificial Sequence
  Description of Artificial Sequence: Synthetic oligonucleotide
  Target: FXN; (+) strand; PAM type: NNGRRT; PAM sequence: CAGGGT
gtttgagacggaacacccca

SEQ ID NO: 7110 - DNA, 20 bp, Artificial Sequence
  Description of Artificial Sequence: Synthetic oligonucleotide
  Target: FXN; (+) strand; PAM type: NNGRRT; PAM sequence: CCGAGT
acggaacaccccacagggtt

SEQ ID NO: 7111 - DNA, 20 bp, Artificial Sequence
  Description of Artificial Sequence: Synthetic oligonucleotide
  Target: FXN; (+) strand; PAM type: NNGRRT; PAM sequence: CAGAAT
gcggcagtgctagtgatgtg

SEQ ID NO: 7112 - DNA, 20 bp, Artificial Sequence
  Description of Artificial Sequence: Synthetic oligonucleotide
  Target: FXN; (+) strand; PAM type: NNGRRT; PAM sequence: CTGGGT
ccaaggaacctataaatacc

SEQ ID NO: 7113 - DNA, 20 bp, Artificial Sequence
  Description of Artificial Sequence: Synthetic oligonucleotide
  Target: FXN; (+) strand; PAM type: NNGRRT; PAM sequence: GAGAAT
agatgacaagctgagaaggg

SEQ ID NO: 7114 - DNA, 20 bp, Artificial Sequence
  Description of Artificial Sequence: Synthetic oligonucleotide
  Target: FXN; (+) strand; PAM type: NNGRRT; PAM sequence: GAGGGT
ttgctccaaaccctctgttc

SEQ ID NO: 7115 - DNA, 20 bp, Artificial Sequence
  Description of Artificial Sequence: Synthetic oligonucleotide
  Target: FXN; (+) strand; PAM type: NNGRRT; PAM sequence: CCGAGT
agcaggcctcctgaacttcc

SEQ ID NO: 7116 - DNA, 20 bp, Artificial Sequence
  Description of Artificial Sequence: Synthetic oligonucleotide
  Target: FXN; (+) strand; PAM type: NNGRRT; PAM sequence: GAGGAT
atgcttcacagcaccatgga

SEQ ID NO: 7117 - DNA, 20 bp, Artificial Sequence
  Description of Artificial Sequence: Synthetic oligonucleotide
  Target: FXN; (+) strand; PAM type: NNGRRT; PAM sequence: CTGAAT
aggggcaaactgcagactat

SEQ ID NO: 7118 - DNA, 20 bp, Artificial Sequence
  Description of Artificial Sequence: Synthetic oligonucleotide
  Target: FXN; (+) strand; PAM type: NNGRRT; PAM sequence: GCGGAT
actttgggaggccaaggcag

SEQ ID NO: 7119 - DNA, 20 bp, Artificial Sequence
  Description of Artificial Sequence: Synthetic oligonucleotide
  Target: FXN; (+) strand; PAM type: NNGRRT; PAM sequence: AGGAGT
caggcggatcacttgaggtc

SEQ ID NO: 7120 - DNA, 20 bp, Artificial Sequence
  Description of Artificial Sequence: Synthetic oligonucleotide
  Target: FXN; (+) strand; PAM type: NNGRRT; PAM sequence: GAGAAT
tgcttgggagactgagacag

SEQ ID NO: 7121 - DNA, 20 bp, Artificial Sequence
  Description of Artificial Sequence: Synthetic oligonucleotide
  Target: FXN; (+) strand; PAM type: NNGRRT; PAM sequence: CAGAGT
cagcactccatcctgggcga

SEQ ID NO: 7122 - DNA, 20 bp, Artificial Sequence
  Description of Artificial Sequence: Synthetic oligonucleotide
  Target: FXN; (+) strand; PAM type: NNGRRT; PAM sequence: AGGAAT
gaagaaggaaaggccaaggc

SEQ ID NO: 7123 - DNA, 20 bp, Artificial Sequence
  Description of Artificial Sequence: Synthetic oligonucleotide
  Target: FXN; (+) strand; PAM type: NNGRRT; PAM sequence: ATGAAT
aggcaggaatgaaacaggcc

SEQ ID NO: 7124 - DNA, 20 bp, Artificial Sequence
  Description of Artificial Sequence: Synthetic oligonucleotide
  Target: FXN; (+) strand; PAM type: NNGRRT; PAM sequence: TGGAGT
atgaaacaggccatgaatgt

SEQ ID NO: 7125 - DNA, 20 bp, Artificial Sequence
  Description of Artificial Sequence: Synthetic oligonucleotide
  Target: FXN; (+) strand; PAM type: NNGRRT; PAM sequence: GTGAGT
cctcgtgctaagcggctact

SEQ ID NO: 7126 - DNA, 20 bp, Artificial Sequence
  Description of Artificial Sequence: Synthetic oligonucleotide
  Target: FXN; (+) strand; PAM type: NNGRRT; PAM sequence: CTGAAT
actttctgacactcaccccg

SEQ ID NO: 7127 - DNA, 20 bp, Artificial Sequence
  Description of Artificial Sequence: Synthetic oligonucleotide
  Target: FXN; (+) strand; PAM type: NNGRRT; PAM sequence: AAGGGT
tgaatgtcctgcctctgctc

SEQ ID NO: 7128 - DNA, 20 bp, Artificial Sequence
  Description of Artificial Sequence: Synthetic oligonucleotide
  Target: FXN; (+) strand; PAM type: NNGRRT; PAM sequence: AGGAGT
gtccctctgaagaaatccaa

SEQ ID NO: 7129 - DNA, 20 bp, Artificial Sequence
  Description of Artificial Sequence: Synthetic oligonucleotide
  Target: FXN; (+) strand; PAM type: NNGRRT; PAM sequence: GAGAGT
ccaaaggagtaaagagcttg

SEQ ID NO: 7130 - DNA, 20 bp, Artificial Sequence
  Description of Artificial Sequence: Synthetic oligonucleotide
  Target: FXN; (+) strand; PAM type: NNGRRT; PAM sequence: TAGGGT
gcttggagagtaggcctctg

SEQ ID NO: 7131 - DNA, 20 bp, Artificial Sequence
  Description of Artificial Sequence: Synthetic oligonucleotide
  Target: FXN; (+) strand; PAM type: NNGRRT; PAM sequence: GGGAGT
aaacgtgatgaggccatagc

SEQ ID NO: 7132 - DNA, 20 bp, Artificial Sequence
  Description of Artificial Sequence: Synthetic oligonucleotide
  Target: FXN; (+) strand; PAM type: NNGRRT; PAM sequence: GAGGAT
catagcgggagtccacggag

SEQ ID NO: 7133 - DNA, 20 bp, Artificial Sequence
  Description of Artificial Sequence: Synthetic oligonucleotide
  Target: FXN; (+) strand; PAM type: NNGRRT; PAM sequence: AGGAAT
gatggcccaaaacctggccc

SEQ ID NO: 7134 - DNA, 20 bp, Artificial Sequence
  Description of Artificial Sequence: Synthetic oligonucleotide
  Target: FXN; (+) strand; PAM type: NNGRRT; PAM sequence: AGGAGT
caggcagatggcttgagctc

SEQ ID NO: 7135 - DNA, 20 bp, Artificial Sequence
  Description of Artificial Sequence: Synthetic oligonucleotide
  Target: FXN; (+) strand; PAM type: NNGRRT; PAM sequence: CCGGGT
accaaaaatacaaaaattag

SEQ ID NO: 7136 - DNA, 20 bp, Artificial Sequence
  Description of Artificial Sequence: Synthetic oligonucleotide
  Target: FXN; (+) strand; PAM type: NNGRRT; PAM sequence: AAGGAT
tactcaggaggctgaggtgg

SEQ ID NO: 7137 - DNA, 20 bp, Artificial Sequence
  Description of Artificial Sequence: Synthetic oligonucleotide
  Target: FXN; (+) strand; PAM type: NNGRRT; PAM sequence: CTGAGT
ggctgaggtggaaggattgc

SEQ ID NO: 7138 - DNA, 20 bp, Artificial Sequence
  Description of Artificial Sequence: Synthetic oligonucleotide
  Target: FXN; (+) strand; PAM type: NNGRRT; PAM sequence: CTGGGT
tcacaccactgcactccagc

SEQ ID NO: 7139 - DNA, 20 bp, Artificial Sequence
  Description of Artificial Sequence: Synthetic oligonucleotide
  Target: FXN; (+) strand; PAM type: NNGRRT; PAM sequence: GAGAGT
agggccgccgtgtccattga

SEQ ID NO: 7140 - DNA, 20 bp, Artificial Sequence
  Description of Artificial Sequence: Synthetic oligonucleotide
  Target: FXN; (+) strand; PAM type: NNGRRT; PAM sequence: TTGGAT
gcaggtaacgatgcgagggc

SEQ ID NO: 7141 - DNA, 20 bp, Artificial Sequence
  Description of Artificial Sequence: Synthetic oligonucleotide
  Target: FXN; (+) strand; PAM type: NNGRRT; PAM sequence: CTGGGT
tgattctgttttccctgtac

SEQ ID NO: 7142 - DNA, 20 bp, Artificial Sequence
  Description of Artificial Sequence: Synthetic oligonucleotide
  Target: FXN; (+) strand; PAM type: NNGRRT; PAM sequence: CTGAAT
gttttccctgtacctgggtc

SEQ ID NO: 7143 - DNA, 20 bp, Artificial Sequence
  Description of Artificial Sequence: Synthetic oligonucleotide
  Target: FXN; (+) strand; PAM type: NNGRRT; PAM sequence: TAGGAT
tgaagtttgattgatagcat

SEQ ID NO: 7144 - DNA, 20 bp, Artificial Sequence
  Description of Artificial Sequence: Synthetic oligonucleotide
  Target: FXN; (+) strand; PAM type: NNGRRT; PAM sequence: TGGGGT
aataattttttttgtcaaca

SEQ ID NO: 7145 - DNA, 20 bp, Artificial Sequence
  Description of Artificial Sequence: Synthetic oligonucleotide
  Target: FXN; (+) strand; PAM type: NNGRRT; PAM sequence: TGGGGT
acatcagcctcccaaagtgc

SEQ ID NO: 7146 - DNA, 20 bp, Artificial Sequence
  Description of Artificial Sequence: Synthetic oligonucleotide
  Target: FXN; (+) strand; PAM type: NNGRRT; PAM sequence: ATGGGT
cctcccaaagtgctggggtt

SEQ ID NO: 7147 - DNA, 20 bp, Artificial Sequence
  Description of Artificial Sequence: Synthetic oligonucleotide
  Target: FXN; (+) strand; PAM type: NNGRRT; PAM sequence: CAGAAT
tgcgcaccctgaggaggttg

SEQ ID NO: 7148 - DNA, 20 bp, Artificial Sequence
  Description of Artificial Sequence: Synthetic oligonucleotide
  Target: FXN; (+) strand; PAM type: NNGRRT; PAM sequence: GAGAAT
gaggaggttgcagaataaag

SEQ ID NO: 7149 - DNA, 20 bp, Artificial Sequence
  Description of Artificial Sequence: Synthetic oligonucleotide
  Target: FXN; (+) strand; PAM type: NNGRRT; PAM sequence: AGGGGT
gagcacctcaggcagtgtgg

SEQ ID NO: 7150 - DNA, 20 bp, Artificial Sequence
  Description of Artificial Sequence: Synthetic oligonucleotide
  Target: FXN; (+) strand; PAM type: NNGRRT; PAM sequence: CAGAGT
tggcaacccgatagcagtat

SEQ ID NO: 7151 - DNA, 20 bp, Artificial Sequence
  Description of Artificial Sequence: Synthetic oligonucleotide
  Target: FXN; (+) strand; PAM type: NNGRRT; PAM sequence: AGGAAT
cagcatttggttgataatgc

SEQ ID NO: 7152 - DNA, 20 bp, Artificial Sequence
  Description of Artificial Sequence: Synthetic oligonucleotide
  Target: FXN; (+) strand; PAM type: NNGRRT; PAM sequence: TTGAGT
agtctttggaaaagccctcc

SEQ ID NO: 7153 - DNA, 20 bp, Artificial Sequence
  Description of Artificial Sequence: Synthetic oligonucleotide
  Target: FXN; (+) strand; PAM type: NNGRRT; PAM sequence: CAGGGT
cactctgttcttacctccat

SEQ ID NO: 7154 - DNA, 20 bp, Artificial Sequence
  Description of Artificial Sequence: Synthetic oligonucleotide
  Target: FXN; (+) strand; PAM type: NNGRRT; PAM sequence: TGGAAT
tccatgaggccatgaggaag

SEQ ID NO: 7155 - DNA, 20 bp, Artificial Sequence
  Description of Artificial Sequence: Synthetic oligonucleotide
  Target: FXN; (+) strand; PAM type: NNGRRT; PAM sequence: ACGAAT
ccagcctccgatctgtccac

SEQ ID NO: 7156 - DNA, 20 bp, Artificial Sequence
  Description of Artificial Sequence: Synthetic oligonucleotide
  Target: FXN; (+) strand; PAM type: NNGRRT; PAM sequence: CTGGAT
cgtgcatgtgccattattca

SEQ ID NO: 7157 - DNA, 20 bp, Artificial Sequence
  Description of Artificial Sequence: Synthetic oligonucleotide
  Target: FXN; (+) strand; PAM type: NNGRRT; PAM sequence: GTGGAT
attcactggatgagcttgag

SEQ ID NO: 7158 - DNA, 20 bp, Artificial Sequence
  Description of Artificial Sequence: Synthetic oligonucleotide
  Target: FXN; (+) strand; PAM type: NNGRRT; PAM sequence: ATGAAT
cccaccaggctctcaatgtc

SEQ ID NO: 7159 - DNA, 20 bp, Artificial Sequence
  Description of Artificial Sequence: Synthetic oligonucleotide
  Target: FXN; (+) strand; PAM type: NNGRRT; PAM sequence: CTGAAT
tcaatgtcatgaatttaaca

SEQ ID NO: 7160 - DNA, 20 bp, Artificial Sequence
  Description of Artificial Sequence: Synthetic oligonucleotide
  Target: FXN; (+) strand; PAM type: NNGRRT; PAM sequence: TGGGGT
ataatagtttaggtgattgc

SEQ ID NO: 7161 - DNA, 20 bp, Artificial Sequence
  Description of Artificial Sequence: Synthetic oligonucleotide
  Target: FXN; (+) strand; PAM type: NNGRRT; PAM sequence: AGGAAT
gctggggtgctaggagagga

SEQ ID NO: 7162 - DNA, 20 bp, Artificial Sequence
  Description of Artificial Sequence: Synthetic oligonucleotide
  Target: FXN; (+) strand; PAM type: NNGRRT; PAM sequence: GGGAAT
tgctaggagaggaaggaatg

SEQ ID NO: 7163 - DNA, 20 bp, Artificial Sequence
  Description of Artificial Sequence: Synthetic oligonucleotide
  Target: FXN; (+) strand; PAM type: NNGRRT; PAM sequence: ATGGGT
gaatggggaataactgttta

SEQ ID NO: 7164 - DNA, 20 bp, Artificial Sequence
  Description of Artificial Sequence: Synthetic oligonucleotide
  Target: FXN; (+) strand; PAM type: NNGRRT; PAM sequence: GTGGGT
atagttggccttgtgtatct

SEQ ID NO: 7165 - DNA, 20 bp, Artificial Sequence
  Description of Artificial Sequence: Synthetic oligonucleotide
  Target: FXN; (+) strand; PAM type: NNGRRT; PAM sequence: GTGGAT
cacatctgattcaaccaacc

SEQ ID NO: 7166 - DNA, 20 bp, Artificial Sequence
  Description of Artificial Sequence: Synthetic oligonucleotide
  Target: FXN; (+) strand; PAM type: NNGRRT; PAM sequence: AAGGAT
agatgacttaaagcatacag

SEQ ID NO: 7167 - DNA, 20 bp, Artificial Sequence
  Description of Artificial Sequence: Synthetic oligonucleotide
  Target: FXN; (+) strand; PAM type: NNGRRT; PAM sequence: TTGAGT
taccatttcatatcagggac

SEQ ID NO: 7168 - DNA, 20 bp, Artificial Sequence
  Description of Artificial Sequence: Synthetic oligonucleotide
  Target: FXN; (+) strand; PAM type: NNGRRT; PAM sequence: ACGGAT
tatcagggacttgagtaccc

SEQ ID NO: 7169 - DNA, 20 bp, Artificial Sequence
  Description of Artificial Sequence: Synthetic oligonucleotide
  Target: FXN; (+) strand; PAM type: NNGRRT; PAM sequence: ATGGAT
gatcctggaaccccttccct

SEQ ID NO: 7170 - DNA, 20 bp, Artificial Sequence
  Description of Artificial Sequence: Synthetic oligonucleotide
  Target: FXN; (+) strand; PAM type: NNGRRT; PAM sequence: CTGGGT
gataccaaggaacaacagca

SEQ ID NO: 7171 - DNA, 20 bp, Artificial Sequence
  Description of Artificial Sequence: Synthetic oligonucleotide
  Target: FXN; (+) strand; PAM type: NNGRRT; PAM sequence: TGGGGT
aacagcactgggtctccttt

SEQ ID NO: 7172 - DNA, 20 bp, Artificial Sequence
  Description of Artificial Sequence: Synthetic oligonucleotide
  Target: FXN; (+) strand; PAM type: NNGRRT; PAM sequence: GTGAAT
ttaaatggttaatgtgttat

SEQ ID NO: 7173 - DNA, 20 bp, Artificial Sequence
  Description of Artificial Sequence: Synthetic oligonucleotide
  Target: FXN; (+) strand; PAM type: NNGRRT; PAM sequence: AAGGGT
atacctggagacttatcagt

SEQ ID NO: 7174 - DNA, 20 bp, Artificial Sequence
  Description of Artificial Sequence: Synthetic oligonucleotide
  Target: FXN; (+) strand; PAM type: NNGRRT; PAM sequence: GAGAAT
caaatgttttttcaggtttt

SEQ ID NO: 7175 - DNA, 20 bp, Artificial Sequence
  Description of Artificial Sequence: Synthetic oligonucleotide
  Target: FXN; (+) strand; PAM type: NNGRRT; PAM sequence: TGGAAT
caggttttgagaatcattct

SEQ ID NO: 7176 - DNA, 20 bp, Artificial Sequence
  Description of Artificial Sequence: Synthetic oligonucleotide
  Target: FXN; (+) strand; PAM type: NNGRRT; PAM sequence: TGGAAT
tttcttgggggcagcatttg

SEQ ID NO: 7177 - DNA, 20 bp, Artificial Sequence
  Description of Artificial Sequence: Synthetic oligonucleotide
  Target: FXN; (+) strand; PAM type: NNGRRT; PAM sequence: TGGAAT
tcatctgaagggctgtgctg

SEQ ID NO: 7178 - DNA, 20 bp, Artificial Sequence
  Description of Artificial Sequence: Synthetic oligonucleotide
  Target: FXN; (+) strand; PAM type: NNGRRT; PAM sequence: CTGGGT
tatgactggactgggaaaaa

SEQ ID NO: 7179 - DNA, 20 bp, Artificial Sequence
  Description of Artificial Sequence: Synthetic oligonucleotide
  Target: FXN; (+) strand; PAM type: NNGRRT; PAM sequence: AAGAAT
atgtgtcacagctctgtaga

SEQ ID NO: 7180 - DNA, 20 bp, Artificial Sequence
  Description of Artificial Sequence: Synthetic oligonucleotide
  Target: FXN; (+) strand; PAM type: NNGRRT; PAM sequence: TTGGAT
taatttctatggaagatttt

SEQ ID NO: 7181 - DNA, 20 bp, Artificial Sequence
  Description of Artificial Sequence: Synthetic oligonucleotide
  Target: FXN; (+) strand; PAM type: NNGRRT; PAM sequence: TCGGAT
atggaagattttttggattg

SEQ ID NO: 7182 - DNA, 20 bp, Artificial Sequence
  Description of Artificial Sequence: Synthetic oligonucleotide
  Target: FXN; (+) strand; PAM type: NNGRRT; PAM sequence: CTGAAT
ataatgtcttatgcctatac

SEQ ID NO: 7183 - DNA, 20 bp, Artificial Sequence
  Description of Artificial Sequence: Synthetic oligonucleotide
  Target: FXN; (+) strand; PAM type: NNGRRT; PAM sequence: ATGAAT
gaaaaattccaggagggaaa

SEQ ID NO: 7184 - DNA, 20 bp, Artificial Sequence
  Description of Artificial Sequence: Synthetic oligonucleotide
  Target: FXN; (+) strand; PAM type: NNGRRT; PAM sequence: AAGGAT
tcttcactcttcattctttg

SEQ ID NO: 7185 - DNA, 20 bp, Artificial Sequence
  Description of Artificial Sequence: Synthetic oligonucleotide
  Target: FXN; (+) strand; PAM type: NNGRRT; PAM sequence: AAGGGT
tctccaaatgagacacatta

SEQ ID NO: 7186 - DNA, 20 bp, Artificial Sequence
  Description of Artificial Sequence: Synthetic oligonucleotide
  Target: FXN; (+) strand; PAM type: NNGRRT; PAM sequence: CTGGGT
ctgccaaggtgtggcctgca

SEQ ID NO: 7187 - DNA, 20 bp, Artificial Sequence
  Description of Artificial Sequence: Synthetic oligonucleotide
  Target: FXN; (+) strand; PAM type: NNGRRT; PAM sequence: TGGAAT
tttcaatttaaaggttagta

SEQ ID NO: 7188 - DNA, 20 bp, Artificial Sequence
  Description of Artificial Sequence: Synthetic oligonucleotide
  Target: FXN; (+) strand; PAM type: NNGRRT; PAM sequence: AAGAAT
agtatggaatcagctgctac

SEQ ID NO: 7189 - DNA, 20 bp, Artificial Sequence
  Description of Artificial Sequence: Synthetic oligonucleotide
  Target: FXN; (+) strand; PAM type: NNGRRT; PAM sequence: CTGAGT
aaaaaagccgttttcatgag

SEQ ID NO: 7190 - DNA, 20 bp, Artificial Sequence
  Description of Artificial Sequence: Synthetic oligonucleotide
  Target: FXN; (+) strand; PAM type: NNGRRT; PAM sequence: GAGAAT
cttccccatctgttaaatga

SEQ ID NO: 7191 - DNA, 20 bp, Artificial Sequence
  Description of Artificial Sequence: Synthetic oligonucleotide
  Target: FXN; (+) strand; PAM type: NNGRRT; PAM sequence: TAGAGT
ccatctgttaaatgagagaa

SEQ ID NO: 7192 - DNA, 20 bp, Artificial Sequence
  Description of Artificial Sequence: Synthetic oligonucleotide
  Target: FXN; (+) strand; PAM type: NNGRRT; PAM sequence: TTGGGT
aggctagttctaattcccta

SEQ ID NO: 7193 - DNA, 20 bp, Artificial Sequence
  Description of Artificial Sequence: Synthetic oligonucleotide
  Target: FXN; (+) strand; PAM type: NNGRRT; PAM sequence: GGGGAT
attccctattgggtagatga

SEQ ID NO: 7194 - DNA, 20 bp, Artificial Sequence
  Description of Artificial Sequence: Synthetic oligonucleotide
  Target: FXN; (+) strand; PAM type: NNGRRT; PAM sequence: TTGAAT
ttgccctatcgtgatttcag

SEQ ID NO: 7195 - DNA, 20 bp, Artificial Sequence
  Description of Artificial Sequence: Synthetic oligonucleotide
  Target: FXN; (+) strand; PAM type: NNGRRT; PAM sequence: GTGGGT
cagcacttttggaggccaag

SEQ ID NO: 7196 - DNA, 20 bp, Artificial Sequence
  Description of Artificial Sequence: Synthetic oligonucleotide
  Target: FXN; (+) strand; PAM type: NNGRRT; PAM sequence: GTGGAT
acttttggaggccaaggtgg

SEQ ID NO: 7197 - DNA, 20 bp, Artificial Sequence
  Description of Artificial Sequence: Synthetic oligonucleotide
  Target: FXN; (+) strand; PAM type: NNGRRT; PAM sequence: AGGAGT
tgggtggatcacctgaggtc

SEQ ID NO: 7198 - DNA, 20 bp, Artificial Sequence
  Description of Artificial Sequence: Synthetic oligonucleotide
  Target: FXN; (+) strand; PAM type: NNGRRT; PAM sequence: AAGAAT
tacttgggaggctgaagcgg

SEQ ID NO: 7199 - DNA, 20 bp, Artificial Sequence
  Description of Artificial Sequence: Synthetic oligonucleotide
  Target: FXN; (+) strand; PAM type: NNGRRT; PAM sequence: CTGGGT
tcgtgccattgcactgtaac

SEQ ID NO: 7200 - DNA, 20 bp, Artificial Sequence
  Description of Artificial Sequence: Synthetic oligonucleotide
  Target: FXN; (+) strand; PAM type: NNGRRT; PAM sequence: CTGGGT
catcctttattgtaccctta

SEQ ID NO: 7201 - DNA, 20 bp, Artificial Sequence
  Description of Artificial Sequence: Synthetic oligonucleotide
  Target: FXN; (+) strand; PAM type: NNGRRT; PAM sequence: AAGGAT
tattattttcttacttaaag

SEQ ID NO: 7202 - DNA, 20 bp, Artificial Sequence
  Description of Artificial Sequence: Synthetic oligonucleotide
  Target: FXN; (+) strand; PAM type: NNGRRT; PAM sequence: GAGAAT
tactcaggaggctgagacgg

SEQ ID NO: 7203 - DNA, 20 bp, Artificial Sequence
  Description of Artificial Sequence: Synthetic oligonucleotide
  Target: FXN; (+) strand; PAM type: NNGRRT; PAM sequence: GTGAGT
cccaggcggaggaggttaca

SEQ ID NO: 7204 - DNA, 20 bp, Artificial Sequence
  Description of Artificial Sequence: Synthetic oligonucleotide
  Target: FXN; (+) strand; PAM type: NNGRRT; PAM sequence: GAGGGT
gtctcaaaaaaaaaaaaaag

SEQ ID NO: 7205 - DNA, 20 bp, Artificial Sequence
  Description of Artificial Sequence: Synthetic oligonucleotide
  Target: FXN; (+) strand; PAM type: NNGRRT; PAM sequence: ATGGGT
atgtagcaaaggcttttcca

SEQ ID NO: 7206 - DNA, 20 bp, Artificial Sequence
  Description of Artificial Sequence: Synthetic oligonucleotide
  Target: FXN; (+) strand; PAM type: NNGRRT; PAM sequence: GTGAAT
agcaaaggcttttccaatgg

SEQ ID NO: 7207 - DNA, 20 bp, Artificial Sequence
  Description of Artificial Sequence: Synthetic oligonucleotide
  Target: FXN; (+) strand; PAM type: NNGRRT; PAM sequence: GAGGAT
tgcacaggaggctgagacag

SEQ ID NO: 7208 - DNA, 20 bp, Artificial Sequence
  Description of Artificial Sequence: Synthetic oligonucleotide
  Target: FXN; (+) strand; PAM type: NNGRRT; PAM sequence: AGGAAT
caggaggattgcttgaagcc

SEQ ID NO: 7209 - DNA, 20 bp, Artificial Sequence
  Description of Artificial Sequence: Synthetic oligonucleotide
  Target: FXN; (+) strand; PAM type: NNGRRT; PAM sequence: TTGAGT
ttctgaaataaaattatttt

SEQ ID NO: 7210 - DNA, 20 bp, Artificial Sequence
  Description of Artificial Sequence: Synthetic oligonucleotide
  Target: FXN; (+) strand; PAM type: NNGRRT; PAM sequence: AGGAAT
tgacatgaaagtggaagtta

SEQ ID NO: 7211 - DNA, 20 bp, Artificial Sequence
  Description of Artificial Sequence: Synthetic oligonucleotide
  Target: FXN; (+) strand; PAM type: NNGRRT; PAM sequence: TGGGGT
ttaaggaatctgggctctta

SEQ ID NO: 7212 - DNA, 20 bp, Artificial Sequence
  Description of Artificial Sequence: Synthetic oligonucleotide
  Target: FXN; (+) strand; PAM type: NNGRRT; PAM sequence: AGGAGT
caagtgtatcacctgaggtc

SEQ ID NO: 7213 - DNA, 20 bp, Artificial Sequence
  Description of Artificial Sequence: Synthetic oligonucleotide
  Target: FXN; (+) strand; PAM type: NNGRRT; PAM sequence: GAGAAT
tactcaggaggctgaggcag

SEQ ID NO: 7214 - DNA, 20 bp, Artificial Sequence
  Description of Artificial Sequence: Synthetic oligonucleotide
  Target: FXN; (+) strand; PAM type: NNGRRT; PAM sequence: GGGGGT
aggagaatcgctgtaacctg

SEQ ID NO: 7215 - DNA, 20 bp, Artificial Sequence
  Description of Artificial Sequence: Synthetic oligonucleotide
  Target: FXN; (+) strand; PAM type: NNGRRT; PAM sequence: AAGAAT
acatgaacagcagccagggg

SEQ ID NO: 7216 - DNA, 20 bp, Artificial Sequence
  Description of Artificial Sequence: Synthetic oligonucleotide
  Target: FXN; (+) strand; PAM type: NNGRRT; PAM sequence: AAGGAT
gtggtccagtcatccatgtg

SEQ ID NO: 7217 - DNA, 20 bp, Artificial Sequence
  Description of Artificial Sequence: Synthetic oligonucleotide
  Target: FXN; (+) strand; PAM type: NNGRRT; PAM sequence: ATGAGT
tccagtcatccatgtgaagg

SEQ ID NO: 7218 - DNA, 20 bp, Artificial Sequence
  Description of Artificial Sequence: Synthetic oligonucleotide
  Target: FXN; (+) strand; PAM type: NNGRRT; PAM sequence: AGGAAT
gtaacatactggaggaggtg

SEQ ID NO: 7219 - DNA, 20 bp, Artificial Sequence
  Description of Artificial Sequence: Synthetic oligonucleotide
  Target: FXN; (+) strand; PAM type: NNGRRT; PAM sequence: CAGGAT
cccctttctattttttgaga

SEQ ID NO: 7220 - DNA, 20 bp, Artificial Sequence
  Description of Artificial Sequence: Synthetic oligonucleotide
  Target: FXN; (+) strand; PAM type: NNGRRT; PAM sequence: TGGGGT
ttgtgtattttttgtagaga

SEQ ID NO: 7221 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcgtcctcccaagatgc

SEQ ID NO: 7222 - DNA, 20 bp, Artificial Sequence
  Description of Artificial Sequence: Synthetic oligonucleotide
  Target: FXN; (+) strand; PAM type: NNGRRT; PAM sequence: TTGAGT
tttctattatttttaccttc

SEQ ID NO: 7223 - DNA, 20 bp, Artificial Sequence
  Description of Artificial Sequence: Synthetic oligonucleotide
  Target: FXN; (+) strand; PAM type: NNGRRT; PAM sequence: GTGGGT
tattatttttaccttcttga

SEQ ID NO: 7224 - DNA, 20 bp, Artificial Sequence
  Description of Artificial Sequence: Synthetic oligonucleotide
  Target: FXN; (+) strand; PAM type: NNGRRT; PAM sequence: TGGAAT
gcatgacttatttagctctc

SEQ ID NO: 7225 - DNA, 20 bp, Artificial Sequence
  Description of Artificial Sequence: Synthetic oligonucleotide
  Target: FXN; (+) strand; PAM type: NNGRRT; PAM sequence: AGGAAT
gctctctggaattacaaaga

SEQ ID NO: 7226 - DNA, 20 bp, Artificial Sequence
  Description of Artificial Sequence: Synthetic oligonucleotide
  Target: FXN; (+) strand; PAM type: NNGRRT; PAM sequence: CTGGGT
tgaggtgtgtaaaagagaac

SEQ ID NO: 7227 - DNA, 20 bp, Artificial Sequence
  Description of Artificial Sequence: Synthetic oligonucleotide
  Target: FXN; (+) strand; PAM type: NNGRRT; PAM sequence: TTGAAT
gtaaaagagaacctgggttt

SEQ ID NO: 7228 - DNA, 20 bp, Artificial Sequence
  Description of Artificial Sequence: Synthetic oligonucleotide
  Target: FXN; (+) strand; PAM type: NNGRRT; PAM sequence: TAGAAT
gggtttttgaatcacaaatt

SEQ ID NO: 7229 - DNA, 20 bp, Artificial Sequence
  Description of Artificial Sequence: Synthetic oligonucleotide
  Target: FXN; (+) strand; PAM type: NNGRRT; PAM sequence: ATGGAT
tggaggacttctcccaaaat

SEQ ID NO: 7230 - DNA, 20 bp, Artificial Sequence
  Description of Artificial Sequence: Synthetic oligonucleotide
  Target: FXN; (+) strand; PAM type: NNGRRT; PAM sequence: TGGAGT
aagacccatgttcatagtga

SEQ ID NO: 7231 - DNA, 20 bp, Artificial Sequence
  Description of Artificial Sequence: Synthetic oligonucleotide
  Target: FXN; (+) strand; PAM type: NNGRRT; PAM sequence: TTGGAT
taattttagtccgtgtccag

SEQ ID NO: 7232 - DNA, 20 bp, Artificial Sequence
  Description of Artificial Sequence: Synthetic oligonucleotide
  Target: FXN; (+) strand; PAM type: NNGRRT; PAM sequence: ACGAGT
aatttatgctgttcaaaacg

SEQ ID NO: 7233 - DNA, 20 bp, Artificial Sequence
  Description of Artificial Sequence: Synthetic oligonucleotide
  Target: FXN; (+) strand; PAM type: NNGRRT; PAM sequence: TAGAGT
cgagttcatgactttgtgta

SEQ ID NO: 7234 - DNA, 20 bp, Artificial Sequence
  Description of Artificial Sequence: Synthetic oligonucleotide
  Target: FXN; (+) strand; PAM type: NNGRRT; PAM sequence: CAGAGT
atgccttttcttttttgaga

SEQ ID NO: 7235 - DNA, 20 bp, Artificial Sequence
  Description of Artificial Sequence: Synthetic oligonucleotide
  Target: FXN; (+) strand; PAM type: NNGRRT; PAM sequence: TGGAGT
tcttgctctgtcacccaggc

SEQ ID NO: 7236 - DNA, 20 bp, Artificial Sequence
  Description of Artificial Sequence: Synthetic oligonucleotide
  Target: FXN; (+) strand; PAM type: NNGRRT; PAM sequence: CTGGGT
ctcactacaacctccgcctc

SEQ ID NO: 7237 - DNA, 20 bp, Artificial Sequence
  Description of Artificial Sequence: Synthetic oligonucleotide
  Target: FXN; (+) strand; PAM type: NNGRRT; PAM sequence: CCGAGT
caattctctgcctcagcctc

SEQ ID NO: 7238 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctcagcctcccgagtagc

SEQ ID NO: 7239 - DNA, 20 bp, Artificial Sequence
  Description of Artificial Sequence: Synthetic oligonucleotide
  Target: FXN; (+) strand; PAM type: NNGRRT; PAM sequence: CGGGGT
ttttgtatttttagtagaga

SEQ ID NO: 7240 - DNA, 20 bp, Artificial Sequence
  Description of Artificial Sequence: Synthetic oligonucleotide
  Target: FXN; (+) strand; PAM type: NNGRRT; PAM sequence: TGGGAT
gcctccgcctcccaaagtgc

SEQ ID NO: 7241 - DNA, 20 bp, Artificial Sequence
  Description of Artificial Sequence: Synthetic oligonucleotide
  Target: FXN; (+) strand; PAM type: NNGRRT; PAM sequence: TGGAGT
tcttaattagccaggacact

SEQ ID NO: 7242 - DNA, 20 bp, Artificial Sequence
  Description of Artificial Sequence: Synthetic oligonucleotide
  Target: FXN; (+) strand; PAM type: NNGRRT; PAM sequence: TGGAAT
tacctgatcagtggcccctt

SEQ ID NO: 7243 - DNA, 20 bp, Artificial Sequence
  Description of Artificial Sequence: Synthetic oligonucleotide
  Target: FXN; (+) strand; PAM type: NNGRRT; PAM sequence: CAGAAT
ccctgcatccgctacagaga

SEQ ID NO: 7244 - DNA, 20 bp, Artificial Sequence
  Description of Artificial Sequence: Synthetic oligonucleotide
  Target: FXN; (+) strand; PAM type: NNGRRT; PAM sequence: AGGAAT
ttctctggctgtatagttta

SEQ ID NO: 7245 - DNA, 20 bp, Artificial Sequence
  Description of Artificial Sequence: Synthetic oligonucleotide
  Target: FXN; (+) strand; PAM type: NNGRRT; PAM sequence: GTGGAT
actttgagaggctgaggcag

SEQ ID NO: 7246 - DNA, 20 bp, Artificial Sequence
  Description of Artificial Sequence: Synthetic oligonucleotide
  Target: FXN; (+) strand; PAM type: NNGRRT; PAM sequence: AGGAGT
caggtggatcacctgaggtt

SEQ ID NO: 7247 - DNA, 20 bp, Artificial Sequence
  Description of Artificial Sequence: Synthetic oligonucleotide
  Target: FXN; (+) strand; PAM type: NNGRRT; PAM sequence: GAGAAT
tactcgggaggctgaggcag

SEQ ID NO: 7248 - DNA, 20 bp, Artificial Sequence
  Description of Artificial Sequence: Synthetic oligonucleotide
  Target: FXN; (+) strand; PAM type: NNGRRT; PAM sequence: CTGGGT
ggcaggagaattgcttgaac

SEQ ID NO: 7249 - DNA, 20 bp, Artificial Sequence
  Description of Artificial Sequence: Synthetic oligonucleotide
  Target: FXN; (+) strand; PAM type: NNGRRT; PAM sequence: CTGGGT
ttacaccactgcactccagc

SEQ ID NO: 7250 - DNA, 20 bp, Artificial Sequence
  Description of Artificial Sequence: Synthetic oligonucleotide
  Target: FXN; (+) strand; PAM type: NNGRRT; PAM sequence: ATGAGT
ctcaaaagtaatagaaacag

SEQ ID NO: 7251 - DNA, 20 bp, Artificial Sequence
  Description of Artificial Sequence: Synthetic oligonucleotide
  Target: FXN; (+) strand; PAM type: NNGRRT; PAM sequence: TGGAGT
gtaatagaaacagatgagtt

SEQ ID NO: 7252 - DNA, 20 bp, Artificial Sequence
  Description of Artificial Sequence: Synthetic oligonucleotide
  Target: FXN; (+) strand; PAM type: NNGRRT; PAM sequence: CAGGAT
gaaacagatgagtttggagt

SEQ ID NO: 7253 - DNA, 20 bp, Artificial Sequence
  Description of Artificial Sequence: Synthetic oligonucleotide
  Target: FXN; (+) strand; PAM type: NNGRRT; PAM sequence: GTGAAT
gattataactacaatgtgaa

SEQ ID NO: 7254 - DNA, 20 bp, Artificial Sequence
  Description of Artificial Sequence: Synthetic oligonucleotide
  Target: FXN; (+) strand; PAM type: NNGRRT; PAM sequence: TGGGAT
gcatagccacctgatcctgc

SEQ ID NO: 7255 - DNA, 20 bp, Artificial Sequence
  Description of Artificial Sequence: Synthetic oligonucleotide
  Target: FXN; (+) strand; PAM type: NNGRRT; PAM sequence: CAGGGT
tcatctagctacacagtctc

SEQ ID NO: 7256 - DNA, 20 bp, Artificial Sequence
  Description of Artificial Sequence: Synthetic oligonucleotide
  Target: FXN; (+) strand; PAM type: NNGRRT; PAM sequence: GGGGGT
attccccacatctctgcctg

SEQ ID NO: 7257 - DNA, 20 bp, Artificial Sequence
  Description of Artificial Sequence: Synthetic oligonucleotide
  Target: FXN; (+) strand; PAM type: NNGRRT; PAM sequence: CTGGAT
ctcctccactcagcctctgc

SEQ ID NO: 7258 - DNA, 20 bp, Artificial Sequence
  Description of Artificial Sequence: Synthetic oligonucleotide
  Target: FXN; (+) strand; PAM type: NNGRRT; PAM sequence: AAGAGT
ctctaaataaccccaactcc

SEQ ID NO: 7259 - DNA, 20 bp, Artificial Sequence
  Description of Artificial Sequence: Synthetic oligonucleotide
  Target: FXN; (+) strand; PAM type: NNGRRT; PAM sequence: AAGAAT
aagaaatataaattttacag

SEQ ID NO: 7260 - DNA, 20 bp, Artificial Sequence
  Description of Artificial Sequence: Synthetic oligonucleotide
  Target: FXN; (+) strand; PAM type: NNGRRT; PAM sequence: GAGGGT
gaagaatggttggaggtggg

SEQ ID NO: 7261 - DNA, 20 bp, Artificial Sequence
  Description of Artificial Sequence: Synthetic oligonucleotide
  Target: FXN; (+) strand; PAM type: NNGRRT; PAM sequence: CGGAGT
ggaggtggggagggtgtcca

SEQ ID NO: 7262 - DNA, 20 bp, Artificial Sequence
  Description of Artificial Sequence: Synthetic oligonucleotide
  Target: FXN; (+) strand; PAM type: NNGRRT; PAM sequence: GTGAGT
gtggggagggtgtccacgga

SEQ ID NO: 7263 - DNA, 20 bp, Artificial Sequence
  Description of Artificial Sequence: Synthetic oligonucleotide
  Target: FXN; (-) strand; PAM type: NNNNGHTT; PAM sequence: TATAGTTT
actgtgggaggaatttagtg

SEQ ID NO: 7264 - DNA, 20 bp, Artificial Sequence
  Description of Artificial Sequence: Synthetic oligonucleotide
  Target: FXN; (-) strand; PAM type: NNNNGHTT; PAM sequence: TCTTGCTT
atttagcttggctgactcca

SEQ ID NO: 7265 - DNA, 20 bp, Artificial Sequence
  Description of Artificial Sequence: Synthetic oligonucleotide
  Target: FXN; (-) strand; PAM type: NNNNGHTT; PAM sequence: TTTAGCTT
ggttatgacagtgagagaaa

SEQ ID NO: 7266 - DNA, 20 bp, Artificial Sequence
  Description of Artificial Sequence: Synthetic oligonucleotide
  Target: FXN; (-) strand; PAM type: NNNNGHTT; PAM sequence: TCTTGTTT
tatagcctttagagagtcat

SEQ ID NO: 7267 - DNA, 20 bp, Artificial Sequence
  Description of Artificial Sequence: Synthetic oligonucleotide
  Target: FXN; (-) strand; PAM type: NNNNGHTT; PAM sequence: TCTTGCTT
ctcttgtacaaaaatactct

SEQ ID NO: 7268 - DNA, 20 bp, Artificial Sequence
  Description of Artificial Sequence: Synthetic oligonucleotide
  Target: FXN; (-) strand; PAM type: NNNNGHTT; PAM sequence: GGGAGCTT
tctgtgatctgacagattaa

SEQ ID NO: 7269 - DNA, 20 bp, Artificial Sequence
  Description of Artificial Sequence: Synthetic oligonucleotide
  Target: FXN; (-) strand; PAM type: NNNNGHTT; PAM sequence: GACAGATT
tagcttttgatctgtgatct

SEQ ID NO: 7270 - DNA, 20 bp, Artificial Sequence
  Description of Artificial Sequence: Synthetic oligonucleotide
  Target: FXN; (-) strand; PAM type: NNNNGHTT; PAM sequence: GATAGCTT
gggtcccttgggcagtgtgt

SEQ ID NO: 7271 - DNA, 20 bp, Artificial Sequence
  Description of Artificial Sequence: Synthetic oligonucleotide
  Target: FXN; (-) strand; PAM type: NNNNGHTT; PAM sequence: TTTGGATT
agtggccagaaaaaaggagg

SEQ ID NO: 7272 - DNA, 20 bp, Artificial Sequence
  Description of Artificial Sequence: Synthetic oligonucleotide
  Target: FXN; (-) strand; PAM type: NNNNGHTT; PAM sequence: GGAGGTTT
gtttcagtggccagaaaaaa

SEQ ID NO: 7273 - DNA, 20 bp, Artificial Sequence
  Description of Artificial Sequence: Synthetic oligonucleotide
  Target: FXN; (-) strand; PAM type: NNNNGHTT; PAM sequence: GAACGTTT
tagataatgaactaattatt

SEQ ID NO: 7274 - DNA, 20 bp, Artificial Sequence
  Description of Artificial Sequence: Synthetic oligonucleotide
  Target: FXN; (-) strand; PAM type: NNNNGHTT; PAM sequence: TATAGATT
atacatcaccttaatattaa

SEQ ID NO: 7275 - DNA, 20 bp, Artificial Sequence
  Description of Artificial Sequence: Synthetic oligonucleotide
  Target: FXN; (-) strand; PAM type: NNNNGHTT; PAM sequence: GACTGATT
aacagctgtttgtcccagga

SEQ ID NO: 7276 - DNA, 20 bp, Artificial Sequence
  Description of Artificial Sequence: Synthetic oligonucleotide
  Target: FXN; (-) strand; PAM type: NNNNGHTT; PAM sequence: AGCTGTTT
tataatgagggaagagaaac

SEQ ID NO: 7277 - DNA, 20 bp, Artificial Sequence
  Description of Artificial Sequence: Synthetic oligonucleotide
  Target: FXN; (-) strand; PAM type: NNNNGHTT; PAM sequence: GAGAGATT
ttgcttggattgattggtaa

SEQ ID NO: 7278 - DNA, 20 bp, Artificial Sequence
  Description of Artificial Sequence: Synthetic oligonucleotide
  Target: FXN; (-) strand; PAM type: NNNNGHTT; PAM sequence: GATTGATT
aatcccactgcatttgcttg

SEQ ID NO: 7279 - DNA, 20 bp, Artificial Sequence
  Description of Artificial Sequence: Synthetic oligonucleotide
  Target: FXN; (-) strand; PAM type: NNNNGHTT; PAM sequence: CTTGGATT
aagaaatcccactgcatttg

SEQ ID NO: 7280 - DNA, 20 bp, Artificial Sequence
  Description of Artificial Sequence: Synthetic oligonucleotide
  Target: FXN; (-) strand; PAM type: NNNNGHTT; PAM sequence: ATTTGCTT
gggaaaagaaatcccactgc

SEQ ID NO: 7281 - DNA, 20 bp, Artificial Sequence
  Description of Artificial Sequence: Synthetic oligonucleotide
  Target: FXN; (-) strand; PAM type: NNNNGHTT; PAM sequence: CTATGATT
tcctgggcttcagctcagtg

SEQ ID NO: 7282 - DNA, 20 bp, Artificial Sequence
  Description of Artificial Sequence: Synthetic oligonucleotide
  Target: FXN; (-) strand; PAM type: NNNNGHTT; PAM sequence: CTGGGCTT
tcactcattcttgcttagtc

SEQ ID NO: 7283 - DNA, 20 bp, Artificial Sequence
  Description of Artificial Sequence: Synthetic oligonucleotide
  Target: FXN; (-) strand; PAM type: NNNNGHTT; PAM sequence: TCTTGCTT
gtctccaaattctcactcat

SEQ ID NO: 7284 - DNA, 20 bp, Artificial Sequence
  Description of Artificial Sequence: Synthetic oligonucleotide
  Target: FXN; (-) strand; PAM type: NNNNGHTT; PAM sequence: TCCTGTTT
agtgatattctttgttggcc

SEQ ID NO: 7285 - DNA, 20 bp, Artificial Sequence
  Description of Artificial Sequence: Synthetic oligonucleotide
  Target: FXN; (-) strand; PAM type: NNNNGHTT; PAM sequence: TCCTGTTT
tgcaatgtaattgttagttt

SEQ ID NO: 7286 - DNA, 20 bp, Artificial Sequence
  Description of Artificial Sequence: Synthetic oligonucleotide
  Target: FXN; (-) strand; PAM type: NNNNGHTT; PAM sequence: GTTAGTTT
ccacagcctgcaatgtaatt

SEQ ID NO: 7287 - DNA, 20 bp, Artificial Sequence
  Description of Artificial Sequence: Synthetic oligonucleotide
  Target: FXN; (-) strand; PAM type: NNNNGHTT; PAM sequence: CTCTGTTT
ggtgtgccttaggtacctct

SEQ ID NO: 7288 - DNA, 20 bp, Artificial Sequence
  Description of Artificial Sequence: Synthetic oligonucleotide
  Target: FXN; (-) strand; PAM type: NNNNGHTT; PAM sequence: GTATGTTT
gttttcatagctttaatcca

SEQ ID NO: 7289 - DNA, 20 bp, Artificial Sequence
  Description of Artificial Sequence: Synthetic oligonucleotide
  Target: FXN; (-) strand; PAM type: NNNNGHTT; PAM sequence: CATAGCTT
ctgggcagaaaagatgtttt

SEQ ID NO: 7290 - DNA, 20 bp, Artificial Sequence
  Description of Artificial Sequence: Synthetic oligonucleotide
  Target: FXN; (-) strand; PAM type: NNNNGHTT; PAM sequence: AGATGTTT
acagaatctctgggcagaaa

SEQ ID NO: 7291 - DNA, 20 bp, Artificial Sequence
  Description of Artificial Sequence: Synthetic oligonucleotide
  Target: FXN; (-) strand; PAM type: NNNNGHTT; PAM sequence: TCATGTTT
ctgacactgaggaccagcca

SEQ ID NO: 7292 - DNA, 20 bp, Artificial Sequence
  Description of Artificial Sequence: Synthetic oligonucleotide
  Target: FXN; (-) strand; PAM type: NNNNGHTT; PAM sequence: GGCTGATT
aggtgtgcataaccacacct

SEQ ID NO: 7293 - DNA, 20 bp, Artificial Sequence
  Description of Artificial Sequence: Synthetic oligonucleotide
  Target: FXN; (-) strand; PAM type: NNNNGHTT; PAM sequence: GTTTGTTT
ttttttttttttgggttttt

SEQ ID NO: 7294 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
tcttttttttttttttgggt

SEQ ID NO: 7295 - DNA, 20 bp, Artificial Sequence
  Description of Artificial Sequence: Synthetic oligonucleotide
  Target: FXN; (-) strand; PAM type: NNNNGHTT; PAM sequence: TTGGGTTT
tctctctctttttttttttt

SEQ ID NO: 7296 - DNA, 20 bp, Artificial Sequence
  Description of Artificial Sequence: Synthetic oligonucleotide
  Target: FXN; (-) strand; PAM type: NNNNGHTT; PAM sequence: TGCTGCTT
ccaacagggtactgcagaag

SEQ ID NO: 7297 - DNA, 20 bp, Artificial Sequence
  Description of Artificial Sequence: Synthetic oligonucleotide
  Target: FXN; (-) strand; PAM type: NNNNGHTT; PAM sequence: TCGGGTTT
ctattctcctcccttcgaat

SEQ ID NO: 7298 - DNA, 20 bp, Artificial Sequence
  Description of Artificial Sequence: Synthetic oligonucleotide
  Target: FXN; (-) strand; PAM type: NNNNGHTT; PAM sequence: TGCTGTTT
aatatttgtcacatgtcata

SEQ ID NO: 7299 - DNA, 20 bp, Artificial Sequence
  Description of Artificial Sequence: Synthetic oligonucleotide
  Target: FXN; (-) strand; PAM type: NNNNGHTT; PAM sequence: GGAAGATT
tccatccctttgcctggtat

SEQ ID NO: 7300 - DNA, 20 bp, Artificial Sequence
  Description of Artificial Sequence: Synthetic oligonucleotide
  Target: FXN; (-) strand; PAM type: NNNNGHTT; PAM sequence: TGATGCTT
tttgtagttcctagaacaag

SEQ ID NO: 7301 - DNA, 20 bp, Artificial Sequence
  Description of Artificial Sequence: Synthetic oligonucleotide
  Target: FXN; (-) strand; PAM type: NNNNGHTT; PAM sequence: CTTTGCTT
attgggaggcatctagacat

SEQ ID NO: 7302 - DNA, 20 bp, Artificial Sequence
  Description of Artificial Sequence: Synthetic oligonucleotide
  Target: FXN; (-) strand; PAM type: NNNNGHTT; PAM sequence: CTCTGCTT
atgtgaatctaaccatagcc

SEQ ID NO: 7303 - DNA, 20 bp, Artificial Sequence
  Description of Artificial Sequence: Synthetic oligonucleotide
  Target: FXN; (-) strand; PAM type: NNNNGHTT; PAM sequence: TAAAGTTT
caggtgattctaatgtgctt

SEQ ID NO: 7304 - DNA, 20 bp, Artificial Sequence
  Description of Artificial Sequence: Synthetic oligonucleotide
  Target: FXN; (-) strand; PAM type: NNNNGHTT; PAM sequence: ATGTGCTT
aagacctccaggtgattcta

SEQ ID NO: 7305 - DNA, 20 bp, Artificial Sequence
  Description of Artificial Sequence: Synthetic oligonucleotide
  Target: FXN; (-) strand; PAM type: NNNNGHTT; PAM sequence: AGGTGATT
catggtttaacaagacctcc

SEQ ID NO: 7306 - DNA, 20 bp, Artificial Sequence
  Description of Artificial Sequence: Synthetic oligonucleotide
  Target: FXN; (-) strand; PAM type: NNNNGHTT; PAM sequence: CATGGTTT
ggtttcaaggcccagcaatc

SEQ ID NO: 7307 - DNA, 20 bp, Artificial Sequence
  Description of Artificial Sequence: Synthetic oligonucleotide
  Target: FXN; (-) strand; PAM type: NNNNGHTT; PAM sequence: TGGGGTTT
atctactgaatcagaatctc

SEQ ID NO: 7308 - DNA, 20 bp, Artificial Sequence
  Description of Artificial Sequence: Synthetic oligonucleotide
  Target: FXN; (-) strand; PAM type: NNNNGHTT; PAM sequence: CTATGATT
tgataggatttatcagaggg

SEQ ID NO: 7309 - DNA, 20 bp, Artificial Sequence
  Description of Artificial Sequence: Synthetic oligonucleotide
  Target: FXN; (-) strand; PAM type: NNNNGHTT; PAM sequence: ATAGGATT
tctgccattaggatattttg

SEQ ID NO: 7310 - DNA, 20 bp, Artificial Sequence
  Description of Artificial Sequence: Synthetic oligonucleotide
  Target: FXN; (-) strand; PAM type: NNNNGHTT; PAM sequence: GGTTGCTT
actgtagctgttcctctctt

SEQ ID NO: 7311 - DNA, 20 bp, Artificial Sequence
  Description of Artificial Sequence: Synthetic oligonucleotide
  Target: FXN; (-) strand; PAM type: NNNNGHTT; PAM sequence: GAAGGCTT
aatagcatatcagagaagac

SEQ ID NO: 7312 - DNA, 20 bp, Artificial Sequence
  Description of Artificial Sequence: Synthetic oligonucleotide
  Target: FXN; (-) strand; PAM type: NNNNGHTT; PAM sequence: GCATGCTT
tgctacatcattattagcta

SEQ ID NO: 7313 - DNA, 20 bp, Artificial Sequence
  Description of Artificial Sequence: Synthetic oligonucleotide
  Target: FXN; (-) strand; PAM type: NNNNGHTT; PAM sequence: CTGAGATT
cgcctcggccgcccaaagtg

SEQ ID NO: 7314 - DNA, 20 bp, Artificial Sequence
  Description of Artificial Sequence: Synthetic oligonucleotide
  Target: FXN; (-) strand; PAM type: NNNNGHTT; PAM sequence: TGGGGTTT
ttttgtatttttagtagaga

SEQ ID NO: 7315 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgtctcagcctccagagtag

SEQ ID NO: 7316 - DNA, 20 bp, Artificial Sequence
  Description of Artificial Sequence: Synthetic oligonucleotide
  Target: FXN; (-) strand; PAM type: NNNNGHTT; PAM sequence: AAGAGATT
aatctccacctcctgggttc

SEQ ID NO: 7317 - DNA, 20 bp, Artificial Sequence
  Description of Artificial Sequence: Synthetic oligonucleotide
  Target: FXN; (-) strand; PAM type: NNNNGHTT; PAM sequence: TCTTGCTT
tattattatttgagacagag

SEQ ID NO: 7318 - DNA, 20 bp, Artificial Sequence
  Description of Artificial Sequence: Synthetic oligonucleotide
  Target: FXN; (-) strand; PAM type: NNNNGHTT; PAM sequence: TAGTGTTT
agcccataggcatcaaaggg

SEQ ID NO: 7319 - DNA, 20 bp, Artificial Sequence
  Description of Artificial Sequence: Synthetic oligonucleotide
  Target: FXN; (-) strand; PAM type: NNNNGHTT; PAM sequence: CCAAGATT
ctatccagtccaaaattctg

SEQ ID NO: 7320 - DNA, 20 bp, Artificial Sequence
  Description of Artificial Sequence: Synthetic oligonucleotide
  Target: FXN; (-) strand; PAM type: NNNNGHTT; PAM sequence: TTTTGATT
tgcaaagtatctggagatgc

SEQ ID NO: 7321 - DNA, 20 bp, Artificial Sequence
  Description of Artificial Sequence: Synthetic oligonucleotide
  Target: FXN; (-) strand; PAM type: NNNNGHTT; PAM sequence: AGATGCTT
tccccctgcaaagtatctgg

SEQ ID NO: 7322 - DNA, 20 bp, Artificial Sequence
  Description of Artificial Sequence: Synthetic oligonucleotide
  Target: FXN; (-) strand; PAM type: NNNNGHTT; PAM sequence: AGCTGCTT
gtgtttaattaattctaggc

SEQ ID NO: 7323 - DNA, 20 bp, Artificial Sequence
  Description of Artificial Sequence: Synthetic oligonucleotide
  Target: FXN; (-) strand; PAM type: NNNNGHTT; PAM sequence: CTGTGTTT
tctggatgagagacatcctt

SEQ ID NO: 7324 - DNA, 20 bp, Artificial Sequence
  Description of Artificial Sequence: Synthetic oligonucleotide
  Target: FXN; (-) strand; PAM type: NNNNGHTT; PAM sequence: ATCTGATT
aatagggtggaggaggtggg

SEQ ID NO: 7325 - DNA, 20 bp, Artificial Sequence
  Description of Artificial Sequence: Synthetic oligonucleotide
  Target: FXN; (-) strand; PAM type: NNNNGHTT; PAM sequence: GGGAGATT
aacaggtgtgagtgttgagt

SEQ ID NO: 7326 - DNA, 20 bp, Artificial Sequence
  Description of Artificial Sequence: Synthetic oligonucleotide
  Target: FXN; (-) strand; PAM type: NNNNGHTT; PAM sequence: ACATGTTT
tttgtgaatcgtgaagagag

SEQ ID NO: 7327 - DNA, 20 bp, Artificial Sequence
  Description of Artificial Sequence: Synthetic oligonucleotide
  Target: FXN; (-) strand; PAM type: NNNNGHTT; PAM sequence: CTATGATT
gagctcaaggctgcagtgag

SEQ ID NO: 7328 - DNA, 20 bp, Artificial Sequence
  Description of Artificial Sequence: Synthetic oligonucleotide
  Target: FXN; (-) strand; PAM type: NNNNGHTT; PAM sequence: ATATGCTT
aagttttcttcacattttat

SEQ ID NO: 7329 - DNA, 20 bp, Artificial Sequence
  Description of Artificial Sequence: Synthetic oligonucleotide
  Target: FXN; (-) strand; PAM type: NNNNGHTT; PAM sequence: GAAAGTTT
tacaaagggatgcaaattgt

SEQ ID NO: 7330 - DNA, 20 bp, Artificial Sequence
  Description of Artificial Sequence: Synthetic oligonucleotide
  Target: FXN; (-) strand; PAM type: NNNNGHTT; PAM sequence: GATAGATT
accgtgccttgcctattgtt

SEQ ID NO: 7331 - DNA, 20 bp, Artificial Sequence
  Description of Artificial Sequence: Synthetic oligonucleotide
  Target: FXN; (-) strand; PAM type: NNNNGHTT; PAM sequence: GGGGGTTT
ttttgtattttttgtagaaa

SEQ ID NO: 7332 - DNA, 20 bp, Artificial Sequence
  Description of Artificial Sequence: Synthetic oligonucleotide
  Target: FXN; (-) strand; PAM type: NNNNGHTT; PAM sequence: GCTAGTTT
ggtgtgcaccaccacaccca

SEQ ID NO: 7333 - DNA, 20 bp, Artificial Sequence
  Description of Artificial Sequence: Synthetic oligonucleotide
  Target: FXN; (-) strand; PAM type: NNNNGHTT; PAM sequence: CCTGGCTT
ctggagtgcagtggtgtggt

SEQ ID NO: 7334 - DNA, 20 bp, Artificial Sequence
  Description of Artificial Sequence: Synthetic oligonucleotide
  Target: FXN; (-) strand; PAM type: NNNNGHTT; PAM sequence: GTTTGTTT
tccacccgcctcatttattt

SEQ ID NO: 7335 - DNA, 20 bp, Artificial Sequence
  Description of Artificial Sequence: Synthetic oligonucleotide
  Target: FXN; (-) strand; PAM type: NNNNGHTT; PAM sequence: ATTTGTTT
gtgatccacccgcctcattt

SEQ ID NO: 7336 - DNA, 20 bp, Artificial Sequence
  Description of Artificial Sequence: Synthetic oligonucleotide
  Target: FXN; (-) strand; PAM type: NNNNGHTT; PAM sequence: ACGGGTTT
tttttttttttttagtagag

SEQ ID NO: 7337 - DNA, 20 bp, Artificial Sequence
  Description of Artificial Sequence: Synthetic oligonucleotide
  Target: FXN; (-) strand; PAM type: NNNNGHTT; PAM sequence: CCCGGTTT
gctcactgcaagctctgcct

SEQ ID NO: 7338 - DNA, 20 bp, Artificial Sequence
  Description of Artificial Sequence: Synthetic oligonucleotide
  Target: FXN; (-) strand; PAM type: NNNNGHTT; PAM sequence: GATTGATT
atagattttattgattgatt

SEQ ID NO: 7339 - DNA, 20 bp, Artificial Sequence
  Description of Artificial Sequence: Synthetic oligonucleotide
  Target: FXN; (-) strand; PAM type: NNNNGHTT; PAM sequence: GATTGATT
gttaatagattttattgatt

SEQ ID NO: 7340 - DNA, 20 bp, Artificial Sequence
  Description of Artificial Sequence: Synthetic oligonucleotide
  Target: FXN; (-) strand; PAM type: NNNNGHTT; PAM sequence: GATTGATT
tattgttaatagattttatt

SEQ ID NO: 7341 - DNA, 20 bp, Artificial Sequence
  Description of Artificial Sequence: Synthetic oligonucleotide
  Target: FXN; (-) strand; PAM type: NNNNGHTT; PAM sequence: TATTGATT
taaatattgttaatagattt

SEQ ID NO: 7342 - DNA, 20 bp, Artificial Sequence
  Description of Artificial Sequence: Synthetic oligonucleotide
  Target: FXN; (-) strand; PAM type: NNNNGHTT; PAM sequence: AATAGATT
agtgcacaataaatattgtt

SEQ ID NO: 7343 - DNA, 20 bp, Artificial Sequence
  Description of Artificial Sequence: Synthetic oligonucleotide
  Target: FXN; (-) strand; PAM type: NNNNGHTT; PAM sequence: TAAAGTTT
ataaaatgagttaagccctg

SEQ ID NO: 7344 - DNA, 20 bp, Artificial Sequence
  Description of Artificial Sequence: Synthetic oligonucleotide
  Target: FXN; (-) strand; PAM type: NNNNGHTT; PAM sequence: ATAGGATT
tttataaaagttcctacttc

SEQ ID NO: 7345 - DNA, 20 bp, Artificial Sequence
  Description of Artificial Sequence: Synthetic oligonucleotide
  Target: FXN; (-) strand; PAM type: NNNNGHTT; PAM sequence: ATGCGTTT
ctctgtgccttgtttataaa

SEQ ID NO: 7346 - DNA, 20 bp, Artificial Sequence
  Description of Artificial Sequence: Synthetic oligonucleotide
  Target: FXN; (-) strand; PAM type: NNNNGHTT; PAM sequence: CCTTGTTT
agttaattaacctctctgtg

SEQ ID NO: 7347 - DNA, 20 bp, Artificial Sequence
  Description of Artificial Sequence: Synthetic oligonucleotide
  Target: FXN; (-) strand; PAM type: NNNNGHTT; PAM sequence: ATGGGTTT
gaggctgcttggccgccggt

SEQ ID NO: 7348 - DNA, 20 bp, Artificial Sequence
  Description of Artificial Sequence: Synthetic oligonucleotide
  Target: FXN; (-) strand; PAM type: NNNNGHTT; PAM sequence: GGCTGCTT
tgggtgcatgcacaaattga

SEQ ID NO: 7349 - DNA, 20 bp, Artificial Sequence
  Description of Artificial Sequence: Synthetic oligonucleotide
  Target: FXN; (-) strand; PAM type: NNNNGHTT; PAM sequence: CGCCGCTT
gagactgcagcctggtggcc

SEQ ID NO: 7350 - DNA, 20 bp, Artificial Sequence
  Description of Artificial Sequence: Synthetic oligonucleotide
  Target: FXN; (-) strand; PAM type: NNNNGHTT; PAM sequence: GCCTGCTT
gcatttaacaaaaatggaga

SEQ ID NO: 7351 - DNA, 20 bp, Artificial Sequence
  Description of Artificial Sequence: Synthetic oligonucleotide
  Target: FXN; (-) strand; PAM type: NNNNGHTT; PAM sequence: CCCAGCTT
ttagacctcaggaagaactt

SEQ ID NO: 7352 - DNA, 20 bp, Artificial Sequence
  Description of Artificial Sequence: Synthetic oligonucleotide
  Target: FXN; (-) strand; PAM type: NNNNGHTT; PAM sequence: GGCCGCTT
accagagaagggagttgcaa

SEQ ID NO: 7353 - DNA, 20 bp, Artificial Sequence
  Description of Artificial Sequence: Synthetic oligonucleotide
  Target: FXN; (-) strand; PAM type: NNNNGHTT; PAM sequence: GAAAGTTT
tctagctattctgcagctct

SEQ ID NO: 7354 - DNA, 20 bp, Artificial Sequence
  Description of Artificial Sequence: Synthetic oligonucleotide
  Target: FXN; (-) strand; PAM type: NNNNGHTT; PAM sequence: GTCAGTTT
gaatctggaataaaggtcgg

SEQ ID NO: 7355 - DNA, 20 bp, Artificial Sequence
  Description of Artificial Sequence: Synthetic oligonucleotide
  Target: FXN; (-) strand; PAM type: NNNNGHTT; PAM sequence: TTGGGTTT
ctcatccccacagccattct

SEQ ID NO: 7356 - DNA, 20 bp, Artificial Sequence
  Description of Artificial Sequence: Synthetic oligonucleotide
  Target: FXN; (-) strand; PAM type: NNNNGHTT; PAM sequence: TATGGCTT
actccggagagcaacacaaa

SEQ ID NO: 7357 - DNA, 20 bp, Artificial Sequence
  Description of Artificial Sequence: Synthetic oligonucleotide
  Target: FXN; (-) strand; PAM type: NNNNGHTT; PAM sequence: CAAAGTTT
taagcactggcaaccaatcc

SEQ ID NO: 7358 - DNA, 20 bp, Artificial Sequence
  Description of Artificial Sequence: Synthetic oligonucleotide
  Target: FXN; (-) strand; PAM type: NNNNGHTT; PAM sequence: CTGAGATT
ttcctaggcctcccaaagtg

SEQ ID NO: 7359 - DNA, 20 bp, Artificial Sequence
  Description of Artificial Sequence: Synthetic oligonucleotide
  Target: FXN; (-) strand; PAM type: NNNNGHTT; PAM sequence: CTGGGTTT
tttgtattttttagtagata

SEQ ID NO: 7360 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgccgcagcctctggagtag

SEQ ID NO: 7361 - DNA, 20 bp, Artificial Sequence
  Description of Artificial Sequence: Synthetic oligonucleotide
  Target: FXN; (-) strand; PAM type: NNNNGHTT; PAM sequence: AAGCGATT
aacctctgcctcccgggctc

SEQ ID NO: 7362 - DNA, 20 bp, Artificial Sequence
  Description of Artificial Sequence: Synthetic oligonucleotide
  Target: FXN; (-) strand; PAM type: NNNNGHTT; PAM sequence: CTTGGCTT
gccggagtgcattgggcgat

SEQ ID NO: 7363 - DNA, 20 bp, Artificial Sequence
  Description of Artificial Sequence: Synthetic oligonucleotide
  Target: FXN; (-) strand; PAM type: NNNNGHTT; PAM sequence: GTCTGCTT
acagaagccaagtaataaat

SEQ ID NO: 7364 - DNA, 20 bp, Artificial Sequence
  Description of Artificial Sequence: Synthetic oligonucleotide
  Target: FXN; (-) strand; PAM type: NNNNGHTT; PAM sequence: GTGTGTTT
gggcggcagcgccaagttgg

SEQ ID NO: 7365 - DNA, 20 bp, Artificial Sequence
  Description of Artificial Sequence: Synthetic oligonucleotide
  Target: FXN; (-) strand; PAM type: NNNNGHTT; PAM sequence: ATGTGATT
ggaacagacaggttaaacaa

SEQ ID NO: 7366 - DNA, 20 bp, Artificial Sequence
  Description of Artificial Sequence: Synthetic oligonucleotide
  Target: FXN; (-) strand; PAM type: NNNNGHTT; PAM sequence: CAGGGCTT
tagggtcaatccaggacagt

SEQ ID NO: 7367 - DNA, 20 bp, Artificial Sequence
  Description of Artificial Sequence: Synthetic oligonucleotide
  Target: FXN; (-) strand; PAM type: NNNNGHTT; PAM sequence: GGGAGCTT
gatgaattttggagaccagg

SEQ ID NO: 7368 - DNA, 20 bp, Artificial Sequence
  Description of Artificial Sequence: Synthetic oligonucleotide
  Target: FXN; (-) strand; PAM type: NNNNGHTT; PAM sequence: CTCAGTTT
ggaagaggccttcaagtgaa

SEQ ID NO: 7369 - DNA, 20 bp, Artificial Sequence
  Description of Artificial Sequence: Synthetic oligonucleotide
  Target: FXN; (-) strand; PAM type: NNNNGHTT; PAM sequence: AGCTGCTT
ccattctgtttctgttgaac

SEQ ID NO: 7370 - DNA, 20 bp, Artificial Sequence
  Description of Artificial Sequence: Synthetic oligonucleotide
  Target: FXN; (-) strand; PAM type: NNNNGHTT; PAM sequence: TTCTGTTT
aattatgtgtgtggctccca

SEQ ID NO: 7371 - DNA, 20 bp, Artificial Sequence
  Description of Artificial Sequence: Synthetic oligonucleotide
  Target: FXN; (-) strand; PAM type: NNNNGHTT; PAM sequence: AAATGATT
ttgaataaatatattgttga

SEQ ID NO: 7372 - DNA, 20 bp, Artificial Sequence
  Description of Artificial Sequence: Synthetic oligonucleotide
  Target: FXN; (-) strand; PAM type: NNNNGHTT; PAM sequence: TACTGATT
ctcattactgatttttaaaa

SEQ ID NO: 7373 - DNA, 20 bp, Artificial Sequence
  Description of Artificial Sequence: Synthetic oligonucleotide
  Target: FXN; (-) strand; PAM type: NNNNGHTT; PAM sequence: TACTGATT
gccaccgtgcctggtctcat

SEQ ID NO: 7374 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
cgcctcggcctcccaaagtc

SEQ ID NO: 7375 - DNA, 20 bp, Artificial Sequence
  Description of Artificial Sequence: Synthetic oligonucleotide
  Target: FXN; (-) strand; PAM type: NNNNGHTT; PAM sequence: TGGGGTTT
gagctagtttttagtagaga

SEQ ID NO: 7376 - DNA, 20 bp, Artificial Sequence
  Description of Artificial Sequence: Synthetic oligonucleotide
  Target: FXN; (-) strand; PAM type: NNNNGHTT; PAM sequence: GCTAGTTT
ggcacccaccaccatgctga

SEQ ID NO: 7377 - DNA, 20 bp, Artificial Sequence
  Description of Artificial Sequence: Synthetic oligonucleotide
  Target: FXN; (-) strand; PAM type: NNNNGHTT; PAM sequence: AAGTGATT
aacctctgcctcctgggctc

SEQ ID NO: 7378 - DNA, 20 bp, Artificial Sequence
  Description of Artificial Sequence: Synthetic oligonucleotide
  Target: FXN; (-) strand; PAM type: NNNNGHTT; PAM sequence: TACTGATT
gagtatgcaagatatcttat

SEQ ID NO: 7379 - DNA, 20 bp, Artificial Sequence
  Description of Artificial Sequence: Synthetic oligonucleotide
  Target: FXN; (-) strand; PAM type: NNNNGHTT; PAM sequence: GTGTGTTT
ccagcctaggagacatttaa

SEQ ID NO: 7380 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
catctcagcctcccaaagtg

SEQ ID NO: 7381 - DNA, 20 bp, Artificial Sequence
  Description of Artificial Sequence: Synthetic oligonucleotide
  Target: FXN; (-) strand; PAM type: NNNNGHTT; PAM sequence: CGGGGTTT
ttttgtatttttagtagaga

SEQ ID NO: 7382 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgcctcagcctcctgagtag

SEQ ID NO: 7383 - DNA, 20 bp, Artificial Sequence
  Description of Artificial Sequence: Synthetic oligonucleotide
  Target: FXN; (-) strand; PAM type: NNNNGHTT; PAM sequence: CCTGGATT
gtggctaatgggactgagga

SEQ ID NO: 7384 - DNA, 20 bp, Artificial Sequence
  Description of Artificial Sequence: Synthetic oligonucleotide
  Target: FXN; (-) strand; PAM type: NNNNGHTT; PAM sequence: TGTGGATT
gtgcttttaaaagccgtttc

SEQ ID NO: 7385 - DNA, 20 bp, Artificial Sequence
  Description of Artificial Sequence: Synthetic oligonucleotide
  Target: FXN; (-) strand; PAM type: NNNNGHTT; PAM sequence: AGCCGTTT
tgtggggctgtgcttttaaa

SEQ ID NO: 7386 - DNA, 20 bp, Artificial Sequence
  Description of Artificial Sequence: Synthetic oligonucleotide
  Target: FXN; (-) strand; PAM type: NNNNGHTT; PAM sequence: CTGTGCTT
tggggctgggggctgtgggg

SEQ ID NO: 7387 - DNA, 20 bp, Artificial Sequence
  Description of Artificial Sequence: Synthetic oligonucleotide
  Target: FXN; (-) strand; PAM type: NNNNGHTT; PAM sequence: CCCAGTTT
attttttaccatataaattg

SEQ ID NO: 7388 - DNA, 20 bp, Artificial Sequence
  Description of Artificial Sequence: Synthetic oligonucleotide
  Target: FXN; (-) strand; PAM type: NNNNGHTT; PAM sequence: TTAGGCTT
tatcatgggagtgaaactag

SEQ ID NO: 7389 - DNA, 20 bp, Artificial Sequence
  Description of Artificial Sequence: Synthetic oligonucleotide
  Target: FXN; (-) strand; PAM type: NNNNGHTT; PAM sequence: CATAGATT
caataatggattaatccatt

SEQ ID NO: 7390 - DNA, 20 bp, Artificial Sequence
  Description of Artificial Sequence: Synthetic oligonucleotide
  Target: FXN; (-) strand; PAM type: NNNNGHTT; PAM sequence: AATGGATT
atgaaggttcttccctcaat

SEQ ID NO: 7391 - DNA, 20 bp, Artificial Sequence
  Description of Artificial Sequence: Synthetic oligonucleotide
  Target: FXN; (-) strand; PAM type: NNNNGHTT; PAM sequence: GAATGTTT
gagacagcatgctatggttt

SEQ ID NO: 7392 - DNA, 20 bp, Artificial Sequence
  Description of Artificial Sequence: Synthetic oligonucleotide
  Target: FXN; (-) strand; PAM type: NNNNGHTT; PAM sequence: TATGGTTT
tcatttaagagacagcatgc

SEQ ID NO: 7393 - DNA, 20 bp, Artificial Sequence
  Description of Artificial Sequence: Synthetic oligonucleotide
  Target: FXN; (-) strand; PAM type: NNNNGHTT; PAM sequence: AGGAGCTT
catgcagaagtggatgccac

SEQ ID NO: 7394 - DNA, 20 bp, Artificial Sequence
  Description of Artificial Sequence: Synthetic oligonucleotide
  Target: FXN; (-) strand; PAM type: NNNNGHTT; PAM sequence: ACCTGCTT
tgaaagtgagtgagggtata

SEQ ID NO: 7395 - DNA, 20 bp, Artificial Sequence
  Description of Artificial Sequence: Synthetic oligonucleotide
  Target: FXN; (-) strand; PAM type: NNNNGHTT; PAM sequence: AAATGATT
aattgtctgcaagacaataa

SEQ ID NO: 7396 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgcctcggcctcccaaagtg

SEQ ID NO: 7397 - DNA, 20 bp, Artificial Sequence
  Description of Artificial Sequence: Synthetic oligonucleotide
  Target: FXN; (-) strand; PAM type: NNNNGHTT; PAM sequence: TGGGGTTT
ttttgtatttttagtagaga

SEQ ID NO: 7398 - DNA, 20 bp, Artificial Sequence
  Description of Artificial Sequence: Synthetic oligonucleotide
  Target: FXN; (-) strand; PAM type: NNNNGHTT; PAM sequence: ATTAGTTT
tgcagaccatagcatttatt

SEQ ID NO: 7399 - DNA, 20 bp, Artificial Sequence
  Description of Artificial Sequence: Synthetic oligonucleotide
  Target: FXN; (-) strand; PAM type: NNNNGHTT; PAM sequence: TTAGGTTT
tcctaatatcactttggtga

SEQ ID NO: 7400 - DNA, 20 bp, Artificial Sequence
  Description of Artificial Sequence: Synthetic oligonucleotide
  Target: FXN; (-) strand; PAM type: NNNNGHTT; PAM sequence: TGGTGATT
cccacctcctaatatcactt

SEQ ID NO: 7401 - DNA, 20 bp, Artificial Sequence
  Description of Artificial Sequence: Synthetic oligonucleotide
  Target: FXN; (-) strand; PAM type: NNNNGHTT; PAM sequence: GCCAGTTT
agctttggtgtctggtgagg

SEQ ID NO: 7402 - DNA, 20 bp, Artificial Sequence
  Description of Artificial Sequence: Synthetic oligonucleotide
  Target: FXN; (-) strand; PAM type: NNNNGHTT; PAM sequence: AACAGCTT
aaatccaagatcaatgcacc

SEQ ID NO: 7403 - DNA, 20 bp, Artificial Sequence
  Description of Artificial Sequence: Synthetic oligonucleotide
  Target: FXN; (-) strand; PAM type: NNNNGHTT; PAM sequence: ATGTGTTT
gtggcttataaacaatagaa

SEQ ID NO: 7404 - DNA, 20 bp, Artificial Sequence
  Description of Artificial Sequence: Synthetic oligonucleotide
  Target: FXN; (-) strand; PAM type: NNNNGHTT; PAM sequence: GGTGGCTT
taacaaaataccagccactg

SEQ ID NO: 7405 - DNA, 20 bp, Artificial Sequence
  Description of Artificial Sequence: Synthetic oligonucleotide
  Target: FXN; (-) strand; PAM type: NNNNGHTT; PAM sequence: GGCAGATT
cgatgaacagaattcgggct

SEQ ID NO: 7406 - DNA, 20 bp, Artificial Sequence
  Description of Artificial Sequence: Synthetic oligonucleotide
  Target: FXN; (-) strand; PAM type: NNNNGHTT; PAM sequence: CATGGATT
taccttgtatataagcaata

SEQ ID NO: 7407 - DNA, 20 bp, Artificial Sequence
  Description of Artificial Sequence: Synthetic oligonucleotide
  Target: FXN; (-) strand; PAM type: NNNNGHTT; PAM sequence: GTGTGATT
cacctaaaggaacctggata

SEQ ID NO: 7408 - DNA, 20 bp, Artificial Sequence
  Description of Artificial Sequence: Synthetic oligonucleotide
  Target: FXN; (-) strand; PAM type: NNNNGHTT; PAM sequence: AGTTGATT
accacttttggcatcaaatg

SEQ ID NO: 7409 - DNA, 20 bp, Artificial Sequence
  Description of Artificial Sequence: Synthetic oligonucleotide
  Target: FXN; (-) strand; PAM type: NNNNGHTT; PAM sequence: CCCAGCTT
cctggatggccagcagggag

SEQ ID NO: 7410 - DNA, 20 bp, Artificial Sequence
  Description of Artificial Sequence: Synthetic oligonucleotide
  Target: FXN; (-) strand; PAM type: NNNNGHTT; PAM sequence: GATAGTTT
atgcatttgaggaaatatta

SEQ ID NO: 7411 - DNA, 20 bp, Artificial Sequence
  Description of Artificial Sequence: Synthetic oligonucleotide
  Target: FXN; (-) strand; PAM type: NNNNGHTT; PAM sequence: TGAGGCTT
catggtaggcttgcctagct

SEQ ID NO: 7412 - DNA, 20 bp, Artificial Sequence
  Description of Artificial Sequence: Synthetic oligonucleotide
  Target: FXN; (-) strand; PAM type: NNNNGHTT; PAM sequence: CCTAGCTT
cacaagtcatggtaggcttg

SEQ ID NO: 7413 - DNA, 20 bp, Artificial Sequence
  Description of Artificial Sequence: Synthetic oligonucleotide
  Target: FXN; (-) strand; PAM type: NNNNGHTT; PAM sequence: GTAGGCTT
cccttggaccacaagtcatg

SEQ ID NO: 7414 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
caccttggcctcccaaagtg

SEQ ID NO: 7415 - DNA, 20 bp, Artificial Sequence
  Description of Artificial Sequence: Synthetic oligonucleotide
  Target: FXN; (-) strand; PAM type: NNNNGHTT; PAM sequence: ACAGGTTT
tttttgtgtttttaggagag

SEQ ID NO: 7416 - DNA, 20 bp, Artificial Sequence
  Description of Artificial Sequence: Synthetic oligonucleotide
  Target: FXN; (-) strand; PAM type: NNNNGHTT; PAM sequence: TTGTGTTT
cctccatgcccagctaattt

SEQ ID NO: 7417 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgcctcagcctcctgagtag

SEQ ID NO: 7418 - DNA, 20 bp, Artificial Sequence
  Description of Artificial Sequence: Synthetic oligonucleotide
  Target: FXN; (-) strand; PAM type: NNNNGHTT; PAM sequence: AAGTGATT
aacctccgcctcccgggttc

SEQ ID NO: 7419 - DNA, 20 bp, Artificial Sequence
  Description of Artificial Sequence: Synthetic oligonucleotide
  Target: FXN; (-) strand; PAM type: NNNNGHTT; PAM sequence: CTAGGCTT
ctggaatgcagtggcacaat

SEQ ID NO: 7420 - DNA, 20 bp, Artificial Sequence
  Description of Artificial Sequence: Synthetic oligonucleotide
  Target: FXN; (-) strand; PAM type: NNNNGHTT; PAM sequence: CAAAGCTT
tctgttctgcttgagggagg

SEQ ID NO: 7421 - DNA, 20 bp, Artificial Sequence
  Description of Artificial Sequence: Synthetic oligonucleotide
  Target: FXN; (-) strand; PAM type: NNNNGHTT; PAM sequence: TTCTGCTT
ctaagggaggctccattctg

SEQ ID NO: 7422 - DNA, 20 bp, Artificial Sequence
  Description of Artificial Sequence: Synthetic oligonucleotide
  Target: FXN; (-) strand; PAM type: NNNNGHTT; PAM sequence: CTCAGTTT
actgctaaaccttttggaac

SEQ ID NO: 7423 - DNA, 20 bp, Artificial Sequence
  Description of Artificial Sequence: Synthetic oligonucleotide
  Target: FXN; (-) strand; PAM type: NNNNGHTT; PAM sequence: ACCTGCTT
tactccttgctttatattct

SEQ ID NO: 7424 - DNA, 20 bp, Artificial Sequence
  Description of Artificial Sequence: Synthetic oligonucleotide
  Target: FXN; (-) strand; PAM type: NNNNGHTT; PAM sequence: CCTTGCTT
aagaaccgttgccaaatact

SEQ ID NO: 7425 - DNA, 20 bp, Artificial Sequence
  Description of Artificial Sequence: Synthetic oligonucleotide
  Target: FXN; (-) strand; PAM type: NNNNGHTT; PAM sequence: GGCTGTTT
acaagtagaagtctttcttc

SEQ ID NO: 7426 - DNA, 20 bp, Artificial Sequence
  Description of Artificial Sequence: Synthetic oligonucleotide
  Target: FXN; (-) strand; PAM type: NNNNGHTT; PAM sequence: TAGAGATT
tgtgtgtgtgtttaatttaa

SEQ ID NO: 7427 - DNA, 20 bp, Artificial Sequence
  Description of Artificial Sequence: Synthetic oligonucleotide
  Target: FXN; (-) strand; PAM type: NNNNGHTT; PAM sequence: GTGTGTTT
ctgtttttgtttgtgtgtgt

SEQ ID NO: 7428 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
gataccttcacaatagctgt

SEQ ID NO: 7429 - DNA, 20 bp, Artificial Sequence
  Description of Artificial Sequence: Synthetic oligonucleotide
  Target: FXN; (-) strand; PAM type: NNNNGHTT; PAM sequence: AGCTGTTT
gtcgctgataccttcacaat

SEQ ID NO: 7430 - DNA, 20 bp, Artificial Sequence
  Description of Artificial Sequence: Synthetic oligonucleotide
  Target: FXN; (-) strand; PAM type: NNNNGHTT; PAM sequence: GGAAGTTT
gaatgtggggctcacctcag

SEQ ID NO: 7431 - DNA, 20 bp, Artificial Sequence
  Description of Artificial Sequence: Synthetic oligonucleotide
  Target: FXN; (-) strand; PAM type: NNNNGHTT; PAM sequence: AATTGTTT
agtctgtgcacagtggaagg

SEQ ID NO: 7432 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
acagacattaagtggcagag

SEQ ID NO: 7433 - DNA, 20 bp, Artificial Sequence
  Description of Artificial Sequence: Synthetic oligonucleotide
  Target: FXN; (-) strand; PAM type: NNNNGHTT; PAM sequence: TTGTGTTT
cgaatgaggatcaactatag

SEQ ID NO: 7434 - DNA, 20 bp, Artificial Sequence
  Description of Artificial Sequence: Synthetic oligonucleotide
  Target: FXN; (-) strand; PAM type: NNNNGHTT; PAM sequence: TACTGATT
cgaccccaaaaggctagggg

SEQ ID NO: 7435 - DNA, 20 bp, Artificial Sequence
  Description of Artificial Sequence: Synthetic oligonucleotide
  Target: FXN; (-) strand; PAM type: NNNNGHTT; PAM sequence: CACAGTTT
taatcagactgtgaaaagga

SEQ ID NO: 7436 - DNA, 20 bp, Artificial Sequence
  Description of Artificial Sequence: Synthetic oligonucleotide
  Target: FXN; (-) strand; PAM type: NNNNGHTT; PAM sequence: CAAAGCTT
gcaccttaactcatgcctga

SEQ ID NO: 7437 - DNA, 20 bp, Artificial Sequence
  Description of Artificial Sequence: Synthetic oligonucleotide
  Target: FXN; (-) strand; PAM type: NNNNGHTT; PAM sequence: CTATGATT
gaggtagaggctgcagtgag

SEQ ID NO: 7438 - DNA, 20 bp, Artificial Sequence
  Description of Artificial Sequence: Synthetic oligonucleotide
  Target: FXN; (-) strand; PAM type: NNNNGHTT; PAM sequence: GATTGCTT
tcaggaggccgaggtgggag

SEQ ID NO: 7439 - DNA, 20 bp, Artificial Sequence
  Description of Artificial Sequence: Synthetic oligonucleotide
  Target: FXN; (-) strand; PAM type: NNNNGHTT; PAM sequence: GGAGGATT
ctactcaggaggccgaggtg

SEQ ID NO: 7440 - DNA, 20 bp, Artificial Sequence
  Description of Artificial Sequence: Synthetic oligonucleotide
  Target: FXN; (-) strand; PAM type: NNNNGHTT; PAM sequence: AATTGCTT
tcaggaggctgaggcagaag

SEQ ID NO: 7441 - DNA, 20 bp, Artificial Sequence
  Description of Artificial Sequence: Synthetic oligonucleotide
  Target: FXN; (-) strand; PAM type: NNNNGHTT; PAM sequence: TGCAGTTT
tggttcgtgcctataatctc

SEQ ID NO: 7442 - DNA, 20 bp, Artificial Sequence
  Description of Artificial Sequence: Synthetic oligonucleotide
  Target: FXN; (-) strand; PAM type: NNNNGHTT; PAM sequence: AAGAGTTT
tgggaggattacttgagctc

SEQ ID NO: 7443 - DNA, 20 bp, Artificial Sequence
  Description of Artificial Sequence: Synthetic oligonucleotide
  Target: FXN; (-) strand; PAM type: NNNNGHTT; PAM sequence: GGAGGATT
cactttgggaggccaaggtg

SEQ ID NO: 7444 - DNA, 20 bp, Artificial Sequence
  Description of Artificial Sequence: Synthetic oligonucleotide
  Target: FXN; (-) strand; PAM type: NNNNGHTT; PAM sequence: AGTTGATT
acaccttatgtaatatatat

SEQ ID NO: 7445 - DNA, 20 bp, Artificial Sequence
  Description of Artificial Sequence: Synthetic oligonucleotide
  Target: FXN; (-) strand; PAM type: NNNNGHTT; PAM sequence: TTCTGTTT
cgatcaatatataaccttat

SEQ ID NO: 7446 - DNA, 20 bp, Artificial Sequence
  Description of Artificial Sequence: Synthetic oligonucleotide
  Target: FXN; (-) strand; PAM type: NNNNGHTT; PAM sequence: ATCTGCTT
cacattctacagtgttctcc

SEQ ID NO: 7447 - DNA, 20 bp, Artificial Sequence
  Description of Artificial Sequence: Synthetic oligonucleotide
  Target: FXN; (-) strand; PAM type: NNNNGHTT; PAM sequence: TAAGGTTT
gggctttaagagattggtga

SEQ ID NO: 7448 - DNA, 20 bp, Artificial Sequence
  Description of Artificial Sequence: Synthetic oligonucleotide
  Target: FXN; (-) strand; PAM type: NNNNGHTT; PAM sequence: AAGAGATT
ggaaggcaccgaagggcttt

SEQ ID NO: 7449 - DNA, 20 bp, Artificial Sequence
  Description of Artificial Sequence: Synthetic oligonucleotide
  Target: FXN; (-) strand; PAM type: NNNNGHTT; PAM sequence: AAGGGCTT
gtcatcctgggaaggcaccg

SEQ ID NO: 7450 - DNA, 20 bp, Artificial Sequence
  Description of Artificial Sequence: Synthetic oligonucleotide
  Target: FXN; (-) strand; PAM type: NNNNGHTT; PAM sequence: AGTTGATT
catccaggtgacagggtctg

SEQ ID NO: 7451 - DNA, 20 bp, Artificial Sequence
  Description of Artificial Sequence: Synthetic oligonucleotide
  Target: FXN; (-) strand; PAM type: NNNNGHTT; PAM sequence: TGTTGATT
ctgcaggacagaatgtgacc

SEQ ID NO: 7452 - DNA, 20 bp, Artificial Sequence
  Description of Artificial Sequence: Synthetic oligonucleotide
  Target: FXN; (-) strand; PAM type: NNNNGHTT; PAM sequence: AGAAGATT
gcagaatcctgctgaagtcc

SEQ ID NO: 7453 - DNA, 20 bp, Artificial Sequence
  Description of Artificial Sequence: Synthetic oligonucleotide
  Target: FXN; (-) strand; PAM type: NNNNGHTT; PAM sequence: ACCAGTTT
gtcagctcctcaactgcacc

SEQ ID NO: 7454 - DNA, 20 bp, Artificial Sequence
  Description of Artificial Sequence: Synthetic oligonucleotide
  Target: FXN; (-) strand; PAM type: NNNNGHTT; PAM sequence: CCGTGTTT
ctccctgtgtctctctaagc

SEQ ID NO: 7455 - DNA, 20 bp, Artificial Sequence
  Description of Artificial Sequence: Synthetic oligonucleotide
  Target: FXN; (-) strand; PAM type: NNNNGHTT; PAM sequence: CAGTGATT
taccttcttttagtgcatta

SEQ ID NO: 7456 - DNA, 20 bp, Artificial Sequence
  Description of Artificial Sequence: Synthetic oligonucleotide
  Target: FXN; (-) strand; PAM type: NNNNGHTT; PAM sequence: TTAGGATT
aagtattttaggaatatttc

SEQ ID NO: 7457 - DNA, 20 bp, Artificial Sequence
  Description of Artificial Sequence: Synthetic oligonucleotide
  Target: FXN; (-) strand; PAM type: NNNNGHTT; PAM sequence: CTCAGCTT
gcctcaagtgatctgccctc

SEQ ID NO: 7458 - DNA, 20 bp, Artificial Sequence
  Description of Artificial Sequence: Synthetic oligonucleotide
  Target: FXN; (-) strand; PAM type: NNNNGHTT; PAM sequence: CGGGGTTT
ttttgtatttttagtagaga

SEQ ID NO: 7459 - DNA, 20 bp, Artificial Sequence
  Description of Artificial Sequence: Synthetic oligonucleotide
  Target: FXN; (-) strand; PAM type: NNNNGHTT; PAM sequence: ACCCGATT
ttacaggcacccgccaccgc

SEQ ID NO: 7460 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgcctcagcctcccgcgtag

SEQ ID NO: 7461 - DNA, 20 bp, Artificial Sequence
  Description of Artificial Sequence: Synthetic oligonucleotide
  Target: FXN; (-) strand; PAM type: NNNNGHTT; PAM sequence: GAGTGATT
aacccccgcctcccgggttc

SEQ ID NO: 7462 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
ttttttttttggtttttgtt

SEQ ID NO: 7463 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
ctgaagtttttttttttggt

SEQ ID NO: 7464 - DNA, 20 bp, Artificial Sequence
  Description of Artificial Sequence: Synthetic oligonucleotide
  Target: FXN; (-) strand; PAM type: NNNNGHTT; PAM sequence: TTTGGTTT
atcatgctgaagtttttttt

SEQ ID NO: 7465 - DNA, 20 bp, Artificial Sequence
  Description of Artificial Sequence: Synthetic oligonucleotide
  Target: FXN; (-) strand; PAM type: NNNNGHTT; PAM sequence: TGAAGTTT
ttttggttaaataatcatgc

SEQ ID NO: 7466 - DNA, 20 bp, Artificial Sequence
  Description of Artificial Sequence: Synthetic oligonucleotide
  Target: FXN; (-) strand; PAM type: NNNNGHTT; PAM sequence: GCTAGTTT
gctttgtacccctcacccaa

SEQ ID NO: 7467 - DNA, 20 bp, Artificial Sequence
  Description of Artificial Sequence: Synthetic oligonucleotide
  Target: FXN; (-) strand; PAM type: NNNNGHTT; PAM sequence: GGATGCTT
agcacttttaaagaaaggca

SEQ ID NO: 7468 - DNA, 20 bp, Artificial Sequence
  Description of Artificial Sequence: Synthetic oligonucleotide
  Target: FXN; (-) strand; PAM type: NNNNGHTT; PAM sequence: TACAGCTT
catgcccacttggccactgc

SEQ ID NO: 7469 - DNA, 20 bp, Artificial Sequence
  Description of Artificial Sequence: Synthetic oligonucleotide
  Target: FXN; (-) strand; PAM type: NNNNGHTT; PAM sequence: AGTAGATT
cacagatctctccacatgac

SEQ ID NO: 7470 - DNA, 20 bp, Artificial Sequence
  Description of Artificial Sequence: Synthetic oligonucleotide
  Target: FXN; (-) strand; PAM type: NNNNGHTT; PAM sequence: GCAAGCTT
caccatacattcccttcagg

SEQ ID NO: 7471 - DNA, 20 bp, Artificial Sequence
  Description of Artificial Sequence: Synthetic oligonucleotide
  Target: FXN; (-) strand; PAM type: NNNNGHTT; PAM sequence: CCCGGTTT
tcttctcctctcccctggtt

SEQ ID NO: 7472 - DNA, 20 bp, Artificial Sequence
  Description of Artificial Sequence: Synthetic oligonucleotide
  Target: FXN; (-) strand; PAM type: NNNNGHTT; PAM sequence: TGTTGCTT
tttctaagaaaaagggaata

SEQ ID NO: 7473 - DNA, 20 bp, Artificial Sequence
  Description of Artificial Sequence: Synthetic oligonucleotide
  Target: FXN; (-) strand; PAM type: NNNNGHTT; PAM sequence: CTCTGCTT
tcaaattcatcaaatagaca

SEQ ID NO: 7474 - DNA, 20 bp, Artificial Sequence
  Description of Artificial Sequence: Synthetic oligonucleotide
  Target: FXN; (-) strand; PAM type: NNNNGHTT; PAM sequence: TCCAGATT
taccctgggtggcccaaagt

SEQ ID NO: 7475 - DNA, 20 bp, Artificial Sequence
  Description of Artificial Sequence: Synthetic oligonucleotide
  Target: FXN; (-) strand; PAM type: NNNNGHTT; PAM sequence: AGGTGTTT
gaagatacctatgacgtgga

SEQ ID NO: 7476 - DNA, 20 bp, Artificial Sequence
  Description of Artificial Sequence: Synthetic oligonucleotide
  Target: FXN; (-) strand; PAM type: NNNNGHTT; PAM sequence: CTAAGATT
tcagtcacatggaaagatgc

SEQ ID NO: 7477 - DNA, 20 bp, Artificial Sequence
  Description of Artificial Sequence: Synthetic oligonucleotide
  Target: FXN; (-) strand; PAM type: NNNNGHTT; PAM sequence: AATGGATT
caacagtaggggatgggtta

SEQ ID NO: 7478 - DNA, 20 bp, Artificial Sequence
  Description of Artificial Sequence: Synthetic oligonucleotide
  Target: FXN; (-) strand; PAM type: NNNNGHTT; PAM sequence: ATTGGTTT
gagaggaggacacaaacgtt

SEQ ID NO: 7479 - DNA, 20 bp, Artificial Sequence
  Description of Artificial Sequence: Synthetic oligonucleotide
  Target: FXN; (-) strand; PAM type: NNNNGHTT; PAM sequence: CTGTGCTT
aaatgccacttccagccctt

SEQ ID NO: 7480 - DNA, 20 bp, Artificial Sequence
  Description of Artificial Sequence: Synthetic oligonucleotide
  Target: FXN; (-) strand; PAM type: NNNNGHTT; PAM sequence: GCCGGCTT
ctttccatggggaatgccgt

SEQ ID NO: 7481 - DNA, 20 bp, Artificial Sequence
  Description of Artificial Sequence: Synthetic oligonucleotide
  Target: FXN; (-) strand; PAM type: NNNNGHTT; PAM sequence: GACAGCTT
ggtagactgtagccgtgcct

SEQ ID NO: 7482 - DNA, 20 bp, Artificial Sequence
  Description of Artificial Sequence: Synthetic oligonucleotide
  Target: FXN; (-) strand; PAM type: NNNNGHTT; PAM sequence: CAGGGATT
agcctctcgagaggctgaag

SEQ ID NO: 7483 - DNA, 20 bp, Artificial Sequence
  Description of Artificial Sequence: Synthetic oligonucleotide
  Target: FXN; (-) strand; PAM type: NNNNGHTT; PAM sequence: GTGTGATT
actccagcctgggtctcagg

SEQ ID NO: 7484 - DNA, 20 bp, Artificial Sequence
  Description of Artificial Sequence: Synthetic oligonucleotide
  Target: FXN; (-) strand; PAM type: NNNNGHTT; PAM sequence: GATTGCTT
tcaggaggctgaggcaggag

SEQ ID NO: 7485 - DNA, 20 bp, Artificial Sequence
  Description of Artificial Sequence: Synthetic oligonucleotide
  Target: FXN; (-) strand; PAM type: NNNNGHTT; PAM sequence: GGAGGATT
ctactcaggaggctgaggca

SEQ ID NO: 7486 - DNA, 20 bp, Artificial Sequence
  Description of Artificial Sequence: Synthetic oligonucleotide
  Target: FXN; (-) strand; PAM type: NNNNGHTT; PAM sequence: TATTGTTT
gcattgctggtctccaatct

SEQ ID NO: 7487 - DNA, 20 bp, Artificial Sequence
  Description of Artificial Sequence: Synthetic oligonucleotide
  Target: FXN; (-) strand; PAM type: NNNNGHTT; PAM sequence: TAAGGCTT
ccgcactcagccagagaagc

SEQ ID NO: 7488 - DNA, 20 bp, Artificial Sequence
  Description of Artificial Sequence: Synthetic oligonucleotide
  Target: FXN; (-) strand; PAM type: NNNNGHTT; PAM sequence: CAGGGTTT
ttttgtatttttagtagaga

SEQ ID NO: 7489 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgcctcaggctcccgagtag

SEQ ID NO: 7490 - DNA, 20 bp, Artificial Sequence
  Description of Artificial Sequence: Synthetic oligonucleotide
  Target: FXN; (-) strand; PAM type: NNNNGHTT; PAM sequence: AAGCGATT
agcctccatctcctgggttt

SEQ ID NO: 7491 - DNA, 20 bp, Artificial Sequence
  Description of Artificial Sequence: Synthetic oligonucleotide
  Target: FXN; (-) strand; PAM type: NNNNGHTT; PAM sequence: CTGGGTTT
ctcactgcagcctccatctc

SEQ ID NO: 7492 - DNA, 20 bp, Artificial Sequence
  Description of Artificial Sequence: Synthetic oligonucleotide
  Target: FXN; (-) strand; PAM type: NNNNGHTT; PAM sequence: TGTTGCTT
cctgaataccggtggcttct

SEQ ID NO: 7493 - DNA, 20 bp, Artificial Sequence
  Description of Artificial Sequence: Synthetic oligonucleotide
  Target: FXN; (-) strand; PAM type: NNNNGHTT; PAM sequence: GGTGGCTT
gtagaatgttcctgaatacc

SEQ ID NO: 7494 - DNA, 20 bp, Artificial Sequence
  Description of Artificial Sequence: Synthetic oligonucleotide
  Target: FXN; (-) strand; PAM type: NNNNGHTT; PAM sequence: GTGTGCTT
ctacacatggcaggtcaagg

SEQ ID NO: 7495 - DNA, 20 bp, Artificial Sequence
  Description of Artificial Sequence: Synthetic oligonucleotide
  Target: FXN; (-) strand; PAM type: NNNNGHTT; PAM sequence: GTGTGTTT
gagtgagctggagagaaagg

SEQ ID NO: 7496 - DNA, 20 bp, Artificial Sequence
  Description of Artificial Sequence: Synthetic oligonucleotide
  Target: FXN; (-) strand; PAM type: NNNNGHTT; PAM sequence: GTGTGTTT
agagtggttggcctgatagg

SEQ ID NO: 7497 - DNA, 20 bp, Artificial Sequence
  Description of Artificial Sequence: Synthetic oligonucleotide
  Target: FXN; (-) strand; PAM type: NNNNGHTT; PAM sequence: ACTGGATT
aatgtggggaaggctacctg

SEQ ID NO: 7498 - DNA, 20 bp, Artificial Sequence
  Description of Artificial Sequence: Synthetic oligonucleotide
  Target: FXN; (-) strand; PAM type: NNNNGHTT; PAM sequence: TACAGATT
tagacaattactgtaagaca

SEQ ID NO: 7499 - DNA, 20 bp, Artificial Sequence
  Description of Artificial Sequence: Synthetic oligonucleotide
  Target: FXN; (-) strand; PAM type: NNNNGHTT; PAM sequence: GAAAGTTT
atcagacaactccactatct

SEQ ID NO: 7500 - DNA, 20 bp, Artificial Sequence
  Description of Artificial Sequence: Synthetic oligonucleotide
  Target: FXN; (-) strand; PAM type: NNNNGHTT; PAM sequence: AAGAGCTT
attataataaacatccttgt

SEQ ID NO: 7501 - DNA, 20 bp, Artificial Sequence
  Description of Artificial Sequence: Synthetic oligonucleotide
  Target: FXN; (-) strand; PAM type: NNNNGHTT; PAM sequence: GTTAGTTT
gcattatacattttaaaatg

SEQ ID NO: 7502 - DNA, 20 bp, Artificial Sequence
  Description of Artificial Sequence: Synthetic oligonucleotide
  Target: FXN; (-) strand; PAM type: NNNNGHTT; PAM sequence: TAGGGTTT
ggagtgattgctaatatgaa

SEQ ID NO: 7503 - DNA, 20 bp, Artificial Sequence
  Description of Artificial Sequence: Synthetic oligonucleotide
  Target: FXN; (-) strand; PAM type: NNNNGHTT; PAM sequence: GAGTGATT
tagggaaaggcggaatgggg

SEQ ID NO: 7504 - DNA, 20 bp, Artificial Sequence
  Description of Artificial Sequence: Synthetic oligonucleotide
  Target: FXN; (-) strand; PAM type: NNNNGHTT; PAM sequence: CTGGGTTT
agaaagtagattagtgattg

SEQ ID NO: 7505 - DNA, 20 bp, Artificial Sequence
  Description of Artificial Sequence: Synthetic oligonucleotide
  Target: FXN; (-) strand; PAM type: NNNNGHTT; PAM sequence: TAGTGATT
cacagagacagaaagtagat

SEQ ID NO: 7506 - DNA, 20 bp, Artificial Sequence
  Description of Artificial Sequence: Synthetic oligonucleotide
  Target: FXN; (-) strand; PAM type: NNNNGHTT; PAM sequence: AGTAGATT
ttaaatccacagagacagaa

SEQ ID NO: 7507 - DNA, 20 bp, Artificial Sequence
  Description of Artificial Sequence: Synthetic oligonucleotide
  Target: FXN; (-) strand; PAM type: NNNNGHTT; PAM sequence: GTATGCTT
ttttacaaattcatcaagct

SEQ ID NO: 7508 - DNA, 20 bp, Artificial Sequence
  Description of Artificial Sequence: Synthetic oligonucleotide
  Target: FXN; (-) strand; PAM type: NNNNGHTT; PAM sequence: TTGAGCTT
ggctggtaacattctatgtc

SEQ ID NO: 7509 - DNA, 20 bp, Artificial Sequence
  Description of Artificial Sequence: Synthetic oligonucleotide
  Target: FXN; (-) strand; PAM type: NNNNGHTT; PAM sequence: GCTTGCTT
tgactagaagtgagcaggca

SEQ ID NO: 7510 - DNA, 20 bp, Artificial Sequence
  Description of Artificial Sequence: Synthetic oligonucleotide
  Target: FXN; (-) strand; PAM type: NNNNGHTT; PAM sequence: GGCAGCTT
ttaatgactagaagtgagca

SEQ ID NO: 7511 - DNA, 20 bp, Artificial Sequence
  Description of Artificial Sequence: Synthetic oligonucleotide
  Target: FXN; (-) strand; PAM type: NNNNGHTT; PAM sequence: GACAGTTT
aacatgtttatacttaatga

SEQ ID NO: 7512 - DNA, 20 bp, Artificial Sequence
  Description of Artificial Sequence: Synthetic oligonucleotide
  Target: FXN; (-) strand; PAM type: NNNNGHTT; PAM sequence: ACATGTTT
aaatacacaagtatacacaa

SEQ ID NO: 7513 - DNA, 20 bp, Artificial Sequence
  Description of Artificial Sequence: Synthetic oligonucleotide
  Target: FXN; (-) strand; PAM type: NNNNGHTT; PAM sequence: CGGGGTTT
ttttgtatttttagtagaga

SEQ ID NO: 7514 - DNA, 20 bp, Artificial Sequence
  Description of Artificial Sequence: Synthetic oligonucleotide
  Target: FXN; (-) strand; PAM type: NNNNGHTT; PAM sequence: AATTGCTT
tcgggaggctgaggcaggag

SEQ ID NO: 7515 - DNA, 20 bp, Artificial Sequence
  Description of Artificial Sequence: Synthetic oligonucleotide
  Target: FXN; (-) strand; PAM type: NNNNGHTT; PAM sequence: ACCAGCTT
cctgaggttaggagttcgag

SEQ ID NO: 7516 - DNA, 20 bp, Artificial Sequence
  Description of Artificial Sequence: Synthetic oligonucleotide
  Target: FXN; (-) strand; PAM type: NNNNGHTT; PAM sequence: GAAAGATT
ggtttatgtataatatcaaa

SEQ ID NO: 7517 - DNA, 20 bp, Artificial Sequence
  Description of Artificial Sequence: Synthetic oligonucleotide
  Target: FXN; (-) strand; PAM type: NNNNGHTT; PAM sequence: TGTGGTTT
cttactgaaagacattttgg

SEQ ID NO: 7518 - DNA, 20 bp, Artificial Sequence
  Description of Artificial Sequence: Synthetic oligonucleotide
  Target: FXN; (-) strand; PAM type: NNNNGHTT; PAM sequence: GCAAGATT
cttcactgtctcagaaccaa

SEQ ID NO: 7519 - DNA, 20 bp, Artificial Sequence
  Description of Artificial Sequence: Synthetic oligonucleotide
  Target: FXN; (-) strand; PAM type: NNNNGHTT; PAM sequence: TTTAGATT
tattggagatttttttaata

SEQ ID NO: 7520 - DNA, 20 bp, Artificial Sequence
  Description of Artificial Sequence: Synthetic oligonucleotide
  Target: FXN; (-) strand; PAM type: NNNNGHTT; PAM sequence: TGGAGATT
gaatgccatctaaaatctat

SEQ ID NO: 7521 - DNA, 20 bp, Artificial Sequence
  Description of Artificial Sequence: Synthetic oligonucleotide
  Target: FXN; (-) strand; PAM type: NNNNGHTT; PAM sequence: ATCAGATT
tttatccttctaaagatatg

SEQ ID NO: 7522 - DNA, 20 bp, Artificial Sequence
  Description of Artificial Sequence: Synthetic oligonucleotide
  Target: FXN; (-) strand; PAM type: NNNNGHTT; PAM sequence: CACTGTTT
tctgattcagtaaatgctat

SEQ ID NO: 7523 - DNA, 20 bp, Artificial Sequence
  Description of Artificial Sequence: Synthetic oligonucleotide
  Target: FXN; (-) strand; PAM type: NNNNGHTT; PAM sequence: TTCTGATT
aaaaccccaaaaaacagtta

SEQ ID NO: 7524 - DNA, 20 bp, Artificial Sequence
  Description of Artificial Sequence: Synthetic oligonucleotide
  Target: FXN; (-) strand; PAM type: NNNNGHTT; PAM sequence: CTGGGCTT
actaaaaatacaaaaattag

SEQ ID NO: 7525 - DNA, 20 bp, Artificial Sequence
  Description of Artificial Sequence: Synthetic oligonucleotide
  Target: FXN; (-) strand; PAM type: NNNNGHTT; PAM sequence: AGGAGTTT
taggtggctcacctgaggtc

SEQ ID NO: 7526 - DNA, 20 bp, Artificial Sequence
  Description of Artificial Sequence: Synthetic oligonucleotide
  Target: FXN; (-) strand; PAM type: NNNNGHTT; PAM sequence: CCGAGATT
gaggcggagcttgcagtgag

SEQ ID NO: 7527 - DNA, 20 bp, Artificial Sequence
  Description of Artificial Sequence: Synthetic oligonucleotide
  Target: FXN; (-) strand; PAM type: NNNNGHTT; PAM sequence: CGGAGCTT
aatggcgtgaacctgggagg

SEQ ID NO: 7528 - DNA, 20 bp, Artificial Sequence
  Description of Artificial Sequence: Synthetic oligonucleotide
  Target: FXN; (-) strand; PAM type: NNNNGHTT; PAM sequence: TTAGGATT
tgcctcagcttctcgaaatg

SEQ ID NO: 7529 - DNA, 20 bp, Artificial Sequence
  Description of Artificial Sequence: Synthetic oligonucleotide
  Target: FXN; (-) strand; PAM type: NNNNGHTT; PAM sequence: CTCAGCTT
tcaagtgatccaccacgtgc

SEQ ID NO: 7530 - DNA, 20 bp, Artificial Sequence
  Description of Artificial Sequence: Synthetic oligonucleotide
  Target: FXN; (-) strand; PAM type: NNNNGHTT; PAM sequence: AAAAGTTT
gaaaataacatgtaaaaagt

SEQ ID NO: 7531 - DNA, 20 bp, Artificial Sequence
  Description of Artificial Sequence: Synthetic oligonucleotide
  Target: FXN; (-) strand; PAM type: NNNNGHTT; PAM sequence: AAATGCTT
aaacccaaaacatgattacc

SEQ ID NO: 7532 - DNA, 20 bp, Artificial Sequence
  Description of Artificial Sequence: Synthetic oligonucleotide
  Target: FXN; (-) strand; PAM type: NNNNGHTT; PAM sequence: ACATGATT
gaggaagcacaaaacccaaa

SEQ ID NO: 7533 - DNA, 20 bp, Artificial Sequence
  Description of Artificial Sequence: Synthetic oligonucleotide
  Target: FXN; (-) strand; PAM type: NNNNGHTT; PAM sequence: CAGCGTTT
aaaaactctgctaaagagtc

SEQ ID NO: 7534 - DNA, 20 bp, Artificial Sequence
  Description of Artificial Sequence: Synthetic oligonucleotide
  Target: FXN; (-) strand; PAM type: NNNNGHTT; PAM sequence: TATGGCTT
catcatagtcctcaaacgtg

SEQ ID NO: 7535 - DNA, 20 bp, Artificial Sequence
  Description of Artificial Sequence: Synthetic oligonucleotide
  Target: FXN; (-) strand; PAM type: NNNNGHTT; PAM sequence: TGATGCTT
acctacaactacatgctact

SEQ ID NO: 7536 - DNA, 20 bp, Artificial Sequence
  Description of Artificial Sequence: Synthetic oligonucleotide
  Target: FXN; (-) strand; PAM type: NNNNGHTT; PAM sequence: GCGTGATT
acccaggctggagtgcagtg

SEQ ID NO: 7537 - DNA, 20 bp, Artificial Sequence
  Description of Artificial Sequence: Synthetic oligonucleotide
  Target: FXN; (-) strand; PAM type: NNNNGHTT; PAM sequence: TGCAGCTT
caagcctggtagagctggac

SEQ ID NO: 7538 - DNA, 20 bp, Artificial Sequence
  Description of Artificial Sequence: Synthetic oligonucleotide
  Target: FXN; (-) strand; PAM type: NNNNGHTT; PAM sequence: CTCTGATT
aaatacacactcaggcccct

SEQ ID NO: 7539 - DNA, 20 bp, Artificial Sequence
  Description of Artificial Sequence: Synthetic oligonucleotide
  Target: FXN; (-) strand; PAM type: NNNNGHTT; PAM sequence: TCTAGTTT
ccctactgaagaactacggg

SEQ ID NO: 7540 - DNA, 20 bp, Artificial Sequence
  Description of Artificial Sequence: Synthetic oligonucleotide
  Target: FXN; (-) strand; PAM type: NNNNGHTT; PAM sequence: ATATGCTT
cccaggtgagcttttcaaaa

SEQ ID NO: 7541 - DNA, 20 bp, Artificial Sequence
  Description of Artificial Sequence: Synthetic oligonucleotide
  Target: FXN; (-) strand; PAM type: NNNNGHTT; PAM sequence: GTGAGCTT
gatacacattagaatcccag

SEQ ID NO: 7542 - DNA, 20 bp, Artificial Sequence
  Description of Artificial Sequence: Synthetic oligonucleotide
  Target: FXN; (-) strand; PAM type: NNNNGHTT; PAM sequence: TGGAGCTT
ctgcatattggaatcatctg

SEQ ID NO: 7543 - DNA, 20 bp, Artificial Sequence
  Description of Artificial Sequence: Synthetic oligonucleotide
  Target: FXN; (-) strand; PAM type: NNNNGHTT; PAM sequence: CCGAGATT
ccaggaagcggagcagtgag

SEQ ID NO: 7544 - DNA, 20 bp, Artificial Sequence
  Description of Artificial Sequence: Synthetic oligonucleotide
  Target: FXN; (-) strand; PAM type: NNNNGHTT; PAM sequence: AACTGCTT
tcgggaggctgaggcaggag

SEQ ID NO: 7545 - DNA, 20 bp, Artificial Sequence
  Description of Artificial Sequence: Synthetic oligonucleotide
  Target: FXN; (-) strand; PAM type: NNNNGHTT; PAM sequence: TAATGTTT
tggcttctaggatctggggc

SEQ ID NO: 7546 - DNA, 20 bp, Artificial Sequence
  Description of Artificial Sequence: Synthetic oligonucleotide
  Target: FXN; (-) strand; PAM type: NNNNGHTT; PAM sequence: CCTGGCTT
tcgataaagaccagcacttc

SEQ ID NO: 7547 - DNA, 20 bp, Artificial Sequence
  Description of Artificial Sequence: Synthetic oligonucleotide
  Target: FXN; (-) strand; PAM type: NNNNGHTT; PAM sequence: GAGGGATT
caacccagaaaaccatcttt

SEQ ID NO: 7548 - DNA, 20 bp, Artificial Sequence
  Description of Artificial Sequence: Synthetic oligonucleotide
  Target: FXN; (-) strand; PAM type: NNNNGHTT; PAM sequence: AACTGCTT
ttgggaggttgaggcaggag

SEQ ID NO: 7549 - DNA, 20 bp, Artificial Sequence
  Description of Artificial Sequence: Synthetic oligonucleotide
  Target: FXN; (-) strand; PAM type: NNNNGHTT; PAM sequence: GGAGGATT
cactttgggaggctgaggtg

SEQ ID NO: 7550 - DNA, 20 bp, Artificial Sequence
  Description of Artificial Sequence: Synthetic oligonucleotide
  Target: FXN; (-) strand; PAM type: NNNNGHTT; PAM sequence: AGAGGATT
gtattagtcaattgccatca

SEQ ID NO: 7551 - DNA, 20 bp, Artificial Sequence
  Description of Artificial Sequence: Synthetic oligonucleotide
  Target: FXN; (-) strand; PAM type: NNNNGHTT; PAM sequence: GCACGCTT
tccatgattgaatccaaaat

SEQ ID NO: 7552 - DNA, 20 bp, Artificial Sequence
  Description of Artificial Sequence: Synthetic oligonucleotide
  Target: FXN; (-) strand; PAM type: NNNNGHTT; PAM sequence: CCATGATT
gctgattgtcctcaacaatt

SEQ ID NO: 7553 - DNA, 20 bp, Artificial Sequence
  Description of Artificial Sequence: Synthetic oligonucleotide
  Target: FXN; (-) strand; PAM type: NNNNGHTT; PAM sequence: GGCTGATT
ttctatcgctttagtctgat

SEQ ID NO: 7554 - DNA, 20 bp, Artificial Sequence
  Description of Artificial Sequence: Synthetic oligonucleotide
  Target: FXN; (-) strand; PAM type: NNNNGHTT; PAM sequence: TATCGCTT
gcaatttccaatactatttc

SEQ ID NO: 7555 - DNA, 20 bp, Artificial Sequence
  Description of Artificial Sequence: Synthetic oligonucleotide
  Target: FXN; (-) strand; PAM type: NNNNGHTT; PAM sequence: TCAGGCTT
ttccctcactgtccttatag

SEQ ID NO: 7556 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
tccctgctccattgctcctt

SEQ ID NO: 7557 - DNA, 20 bp, Artificial Sequence
  Description of Artificial Sequence: Synthetic oligonucleotide
  Target: FXN; (-) strand; PAM type: NNNNGHTT; PAM sequence: GTCAGTTT
gtggatgctcaagttggtag

SEQ ID NO: 7558 - DNA, 20 bp, Artificial Sequence
  Description of Artificial Sequence: Synthetic oligonucleotide
  Target: FXN; (-) strand; PAM type: NNNNGHTT; PAM sequence: CTTGGTTT
gggcagagtttagcctgcaa

SEQ ID NO: 7559 - DNA, 20 bp, Artificial Sequence
  Description of Artificial Sequence: Synthetic oligonucleotide
  Target: FXN; (-) strand; PAM type: NNNNGHTT; PAM sequence: CAGAGTTT
tcaatgtctgcatgtgtggg

SEQ ID NO: 7560 - DNA, 20 bp, Artificial Sequence
  Description of Artificial Sequence: Synthetic oligonucleotide
  Target: FXN; (-) strand; PAM type: NNNNGHTT; PAM sequence: TGTAGCTT
acaggtttcatgactgtttt

SEQ ID NO: 7561 - DNA, 20 bp, Artificial Sequence
  Description of Artificial Sequence: Synthetic oligonucleotide
  Target: FXN; (-) strand; PAM type: NNNNGHTT; PAM sequence: GACTGTTT
cctataaaaacaggtttcat

SEQ ID NO: 7562 - DNA, 20 bp, Artificial Sequence
  Description of Artificial Sequence: Synthetic oligonucleotide
  Target: FXN; (-) strand; PAM type: NNNNGHTT; PAM sequence: ACAGGTTT
gcttcactaatcctataaaa

SEQ ID NO: 7563 - DNA, 20 bp, Artificial Sequence
  Description of Artificial Sequence: Synthetic oligonucleotide
  Target: FXN; (-) strand; PAM type: NNNNGHTT; PAM sequence: TGGGGCTT
gcaaagtactctggtcaaac

SEQ ID NO: 7564 - DNA, 20 bp, Artificial Sequence
  Description of Artificial Sequence: Synthetic oligonucleotide
  Target: FXN; (-) strand; PAM type: NNNNGHTT; PAM sequence: ATTTGCTT
agctgctagaatattggcac

SEQ ID NO: 7565 - DNA, 20 bp, Artificial Sequence
  Description of Artificial Sequence: Synthetic oligonucleotide
  Target: FXN; (-) strand; PAM type: NNNNGHTT; PAM sequence: CTAGGCTT
ctccagcctgggtgacagag

SEQ ID NO: 7566 - DNA, 20 bp, Artificial Sequence
  Description of Artificial Sequence: Synthetic oligonucleotide
  Target: FXN; (-) strand; PAM type: NNNNGHTT; PAM sequence: AATCGCTT
tcaggaggttgaggcgggag

SEQ ID NO: 7567 - DNA, 20 bp, Artificial Sequence
  Description of Artificial Sequence: Synthetic oligonucleotide
  Target: FXN; (-) strand; PAM type: NNNNGHTT; PAM sequence: AGGAGTTT
cgggtggatcacttgagatc

SEQ ID NO: 7568 - DNA, 20 bp, Artificial Sequence
  Description of Artificial Sequence: Synthetic oligonucleotide
  Target: FXN; (-) strand; PAM type: NNNNGHTT; PAM sequence: CTATGATT
aagcttgaggctgcagtgag

SEQ ID NO: 7569 - DNA, 20 bp, Artificial Sequence
  Description of Artificial Sequence: Synthetic oligonucleotide
  Target: FXN; (-) strand; PAM type: NNNNGHTT; PAM sequence: AGAAGCTT
tggaacgatcacttgagccc

SEQ ID NO: 7570 - DNA, 20 bp, Artificial Sequence
  Description of Artificial Sequence: Synthetic oligonucleotide
  Target: FXN; (-) strand; PAM type: NNNNGHTT; PAM sequence: AGGAGTTT
tgagagaatcgcttgaggcc

SEQ ID NO: 7571 - DNA, 20 bp, Artificial Sequence
  Description of Artificial Sequence: Synthetic oligonucleotide
  Target: FXN; (-) strand; PAM type: NNNNGHTT; PAM sequence: AATCGCTT
ttgggaggccgaggtgagag

SEQ ID NO: 7572 - DNA, 20 bp, Artificial Sequence
  Description of Artificial Sequence: Synthetic oligonucleotide
  Target: FXN; (-) strand; PAM type: NNNNGHTT; PAM sequence: CGGTGCTT
ctggcacacacctgtaatcc

SEQ ID NO: 7573 - DNA, 20 bp, Artificial Sequence
  Description of Artificial Sequence: Synthetic oligonucleotide
  Target: FXN; (-) strand; PAM type: NNNNGHTT; PAM sequence: TATAGATT
atagtcctcctttctaaatt

SEQ ID NO: 7574 - DNA, 20 bp, Artificial Sequence
  Description of Artificial Sequence: Synthetic oligonucleotide
  Target: FXN; (-) strand; PAM type: NNNNGHTT; PAM sequence: CTCTGCTT
ttttcagttatggccagagg

SEQ ID NO: 7575 - DNA, 20 bp, Artificial Sequence
  Description of Artificial Sequence: Synthetic oligonucleotide
  Target: FXN; (-) strand; PAM type: NNNNGHTT; PAM sequence: GCTTGTTT
ctttgccccttcttggaagt

SEQ ID NO: 7576 - DNA, 20 bp, Artificial Sequence
  Description of Artificial Sequence: Synthetic oligonucleotide
  Target: FXN; (-) strand; PAM type: NNNNGHTT; PAM sequence: AAGTGCTT
ttccctttgccccttcttgg

SEQ ID NO: 7577 - DNA, 20 bp, Artificial Sequence
  Description of Artificial Sequence: Synthetic oligonucleotide
  Target: FXN; (-) strand; PAM type: NNNNGHTT; PAM sequence: GTATGCTT
tcccataatctgttgaatat

SEQ ID NO: 7578 - DNA, 20 bp, Artificial Sequence
  Description of Artificial Sequence: Synthetic oligonucleotide
  Target: FXN; (-) strand; PAM type: NNNNGHTT; PAM sequence: GTTAGCTT
atgggagacatgctgcacac

SEQ ID NO: 7579 - DNA, 20 bp, Artificial Sequence
  Description of Artificial Sequence: Synthetic oligonucleotide
  Target: FXN; (-) strand; PAM type: NNNNGHTT; PAM sequence: TTAAGTTT
ccctgtaatacatgttagtg

SEQ ID NO: 7580 - DNA, 20 bp, Artificial Sequence
  Description of Artificial Sequence: Synthetic oligonucleotide
  Target: FXN; (-) strand; PAM type: NNNNGHTT; PAM sequence: TCCTGCTT
ctcccagtcttaagtgatgc

SEQ ID NO: 7581 - DNA, 20 bp, Artificial Sequence
  Description of Artificial Sequence: Synthetic oligonucleotide
  Target: FXN; (-) strand; PAM type: NNNNGHTT; PAM sequence: AGTGGTTT
taattctgcccttccttttt

SEQ ID NO: 7582 - DNA, 20 bp, Artificial Sequence
  Description of Artificial Sequence: Synthetic oligonucleotide
  Target: FXN; (-) strand; PAM type: NNNNGHTT; PAM sequence: GTTGGATT
cactttgggaggccaaagca

SEQ ID NO: 7583 - DNA, 20 bp, Artificial Sequence
  Description of Artificial Sequence: Synthetic oligonucleotide
  Target: FXN; (-) strand; PAM type: NNNNGHTT; PAM sequence: ATTAGTTT
ctattccctccctaactgcc

SEQ ID NO: 7584 - DNA, 20 bp, Artificial Sequence
  Description of Artificial Sequence: Synthetic oligonucleotide
  Target: FXN; (-) strand; PAM type: NNNNGHTT; PAM sequence: TTAAGTTT
agagatatctaaaaaaaatt

SEQ ID NO: 7585 - DNA, 20 bp, Artificial Sequence
  Description of Artificial Sequence: Synthetic oligonucleotide
  Target: FXN; (-) strand; PAM type: NNNNGHTT; PAM sequence: AATTGATT
aggttttgtcgcctggttca

SEQ ID NO: 7586 - DNA, 20 bp, Artificial Sequence
  Description of Artificial Sequence: Synthetic oligonucleotide
  Target: FXN; (-) strand; PAM type: NNNNGHTT; PAM sequence: GAAGGTTT
ctgacccactactgggagca

SEQ ID NO: 7587 - DNA, 20 bp, Artificial Sequence
  Description of Artificial Sequence: Synthetic oligonucleotide
  Target: FXN; (-) strand; PAM type: NNNNGHTT; PAM sequence: AAATGATT
ttaagcatttgctaattagt

SEQ ID NO: 7588 - DNA, 20 bp, Artificial Sequence
  Description of Artificial Sequence: Synthetic oligonucleotide
  Target: FXN; (-) strand; PAM type: NNNNGHTT; PAM sequence: TTTAGCTT
gatggcagccactgtatagc

SEQ ID NO: 7589 - DNA, 20 bp, Artificial Sequence
  Description of Artificial Sequence: Synthetic oligonucleotide
  Target: FXN; (-) strand; PAM type: NNNNGHTT; PAM sequence: TATAGCTT
actatagatggcagccactg

SEQ ID NO: 7590 - DNA, 20 bp, Artificial Sequence
  Description of Artificial Sequence: Synthetic oligonucleotide
  Target: FXN; (-) strand; PAM type: NNNNGHTT; PAM sequence: GAAGGCTT
tgtctgcttggagtatctag

SEQ ID NO: 7591 - DNA, 20 bp, Artificial Sequence
  Description of Artificial Sequence: Synthetic oligonucleotide
  Target: FXN; (-) strand; PAM type: NNNNGHTT; PAM sequence: GTCTGCTT
agggagaaaggaaggaccgt

SEQ ID NO: 7592 - DNA, 20 bp, Artificial Sequence
  Description of Artificial Sequence: Synthetic oligonucleotide
  Target: FXN; (-) strand; PAM type: NNNNGHTT; PAM sequence: GCATGTTT
gctgagaggcatcaacgaaa

SEQ ID NO: 7593 - DNA, 20 bp, Artificial Sequence
  Description of Artificial Sequence: Synthetic oligonucleotide
  Target: FXN; (-) strand; PAM type: NNNNGHTT; PAM sequence: TACTGCTT
cctcttgggtgtatctggat

SEQ ID NO: 7594 - DNA, 20 bp, Artificial Sequence
  Description of Artificial Sequence: Synthetic oligonucleotide
  Target: FXN; (-) strand; PAM type: NNNNGHTT; PAM sequence: TCTGGATT
cagatgtcctcttgggtgta

SEQ ID NO: 7595 - DNA, 20 bp, Artificial Sequence
  Description of Artificial Sequence: Synthetic oligonucleotide
  Target: FXN; (-) strand; PAM type: NNNNGHTT; PAM sequence: GGCAGATT
ggtgactctaacagtctcca

SEQ ID NO: 7596 - DNA, 20 bp, Artificial Sequence
  Description of Artificial Sequence: Synthetic oligonucleotide
  Target: FXN; (-) strand; PAM type: NNNNGHTT; PAM sequence: ATCAGATT
ggagagggaccagagcagtc

SEQ ID NO: 7597 - DNA, 20 bp, Artificial Sequence
  Description of Artificial Sequence: Synthetic oligonucleotide
  Target: FXN; (-) strand; PAM type: NNNNGHTT; PAM sequence: GGAAGTTT
tttttttaacaggtgagtat

SEQ ID NO: 7598 - DNA, 20 bp, Artificial Sequence
  Description of Artificial Sequence: Synthetic oligonucleotide
  Target: FXN; (-) strand; PAM type: NNNNGHTT; PAM sequence: TAAAGTTT
taaaactctgttaatttgtt

SEQ ID NO: 7599 - DNA, 20 bp, Artificial Sequence
  Description of Artificial Sequence: Synthetic oligonucleotide
  Target: FXN; (-) strand; PAM type: NNNNGHTT; PAM sequence: ATTTGTTT
tgctgaataaaactctgtta

SEQ ID NO: 7600 - DNA, 20 bp, Artificial Sequence
  Description of Artificial Sequence: Synthetic oligonucleotide
  Target: FXN; (-) strand; PAM type: NNNNGHTT; PAM sequence: TCCCGATT
acctattctggttgcagcct

SEQ ID NO: 7601 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
cgcctcggcctcccaaagtg

SEQ ID NO: 7602 - DNA, 20 bp, Artificial Sequence
  Description of Artificial Sequence: Synthetic oligonucleotide
  Target: FXN; (-) strand; PAM type: NNNNGHTT; PAM sequence: CAGGGTTT
ttttgcatttttagtagaga

SEQ ID NO: 7603 - DNA, 20 bp, Artificial Sequence
  Description of Artificial Sequence: Synthetic oligonucleotide
  Target: FXN; (-) strand; PAM type: NNNNGHTT; PAM sequence: CTAAGTTT
gtgcctgccaccacgcccgg

SEQ ID NO: 7604 - DNA, 20 bp, Artificial Sequence
  Description of Artificial Sequence: Synthetic oligonucleotide
  Target: FXN; (-) strand; PAM type: NNNNGHTT; PAM sequence: GGCTGTTT
caccaagctgtaaccaacct

SEQ ID NO: 7605 - DNA, 20 bp, Artificial Sequence
  Description of Artificial Sequence: Synthetic oligonucleotide
  Target: FXN; (-) strand; PAM type: NNNNGHTT; PAM sequence: CCAAGTTT
aaggcggccaactgttcaaa

SEQ ID NO: 7606 - DNA, 20 bp, Artificial Sequence
  Description of Artificial Sequence: Synthetic oligonucleotide
  Target: FXN; (-) strand; PAM type: NNNNGHTT; PAM sequence: CCGAGTTT
atctactcttgtaccaatca

SEQ ID NO: 7607 - DNA, 20 bp, Artificial Sequence
  Description of Artificial Sequence: Synthetic oligonucleotide
  Target: FXN; (-) strand; PAM type: NNNNGHTT; PAM sequence: AAGGGCTT
cctattttgagttcggatct

SEQ ID NO: 7608 - DNA, 20 bp, Artificial Sequence
  Description of Artificial Sequence: Synthetic oligonucleotide
  Target: FXN; (-) strand; PAM type: NNNNGHTT; PAM sequence: TCCAGCTT
ctcagggggctgcagacact

SEQ ID NO: 7609 - DNA, 20 bp, Artificial Sequence
  Description of Artificial Sequence: Synthetic oligonucleotide
  Target: FXN; (-) strand; PAM type: NNNNGHTT; PAM sequence: TTGGGATT
tctgagcaggggtttttaac

SEQ ID NO: 7610 - DNA, 20 bp, Artificial Sequence
  Description of Artificial Sequence: Synthetic oligonucleotide
  Target: FXN; (-) strand; PAM type: NNNNGHTT; PAM sequence: AGGGGTTT
aaaagatgctgcctctgagc

SEQ ID NO: 7611 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
cgccttggcctcccaaagtg

SEQ ID NO: 7612 - DNA, 20 bp, Artificial Sequence
  Description of Artificial Sequence: Synthetic oligonucleotide
  Target: FXN; (-) strand; PAM type: NNNNGHTT; PAM sequence: CGGGGTTT
ttgtatttttttagtagaga

SEQ ID NO: 7613 - DNA, 20 bp, Artificial Sequence
  Description of Artificial Sequence: Synthetic oligonucleotide
  Target: FXN; (-) strand; PAM type: NNNNGHTT; PAM sequence: CTCAGCTT
ggttcacgccattctcctgc

SEQ ID NO: 7614 - DNA, 20 bp, Artificial Sequence
  Description of Artificial Sequence: Synthetic oligonucleotide
  Target: FXN; (-) strand; PAM type: NNNNGHTT; PAM sequence: AGCAGTTT
ggggaatagtcaaaatatgt

SEQ ID NO: 7615 - DNA, 20 bp, Artificial Sequence
  Description of Artificial Sequence: Synthetic oligonucleotide
  Target: FXN; (-) strand; PAM type: NNNNGHTT; PAM sequence: GAGGGCTT
ctacaaatagaccagataaa

SEQ ID NO: 7616 - DNA, 20 bp, Artificial Sequence
  Description of Artificial Sequence: Synthetic oligonucleotide
  Target: FXN; (-) strand; PAM type: NNNNGHTT; PAM sequence: TAATGCTT
attagttcagcagaaattct

SEQ ID NO: 7617 - DNA, 20 bp, Artificial Sequence
  Description of Artificial Sequence: Synthetic oligonucleotide
  Target: FXN; (-) strand; PAM type: NNNNGHTT; PAM sequence: AATAGATT
ccaccagtctgttcactgta

SEQ ID NO: 7618 - DNA, 20 bp, Artificial Sequence
  Description of Artificial Sequence: Synthetic oligonucleotide
  Target: FXN; (-) strand; PAM type: NNNNGHTT; PAM sequence: GCTTGCTT
gcattcagagctgcctgact

SEQ ID NO: 7619 - DNA, 20 bp, Artificial Sequence
  Description of Artificial Sequence: Synthetic oligonucleotide
  Target: FXN; (-) strand; PAM type: NNNNGHTT; PAM sequence: GACTGCTT
ctctgcattcagagctgcct

SEQ ID NO: 7620 - DNA, 20 bp, Artificial Sequence
  Description of Artificial Sequence: Synthetic oligonucleotide
  Target: FXN; (-) strand; PAM type: NNNNGHTT; PAM sequence: TGGTGCTT
ctgtgggtcccattgcctcg

SEQ ID NO: 7621 - DNA, 20 bp, Artificial Sequence
  Description of Artificial Sequence: Synthetic oligonucleotide
  Target: FXN; (-) strand; PAM type: NNNNGHTT; PAM sequence: GATAGCTT
gggagggggaaggggggagg

SEQ ID NO: 7622 - DNA, 20 bp, Artificial Sequence
  Description of Artificial Sequence: Synthetic oligonucleotide
  Target: FXN; (-) strand; PAM type: NNNNGHTT; PAM sequence: ACTGGATT
agctcatccaacaatgatag

SEQ ID NO: 7623 - DNA, 20 bp, Artificial Sequence
  Description of Artificial Sequence: Synthetic oligonucleotide
  Target: FXN; (-) strand; PAM type: NNNNGHTT; PAM sequence: CAGAGTTT
tatttcccactcctctcata

SEQ ID NO: 7624 - DNA, 20 bp, Artificial Sequence
  Description of Artificial Sequence: Synthetic oligonucleotide
  Target: FXN; (-) strand; PAM type: NNNNGHTT; PAM sequence: AGGAGTTT
ttcttaaaactgtataattc

SEQ ID NO: 7625 - DNA, 20 bp, Artificial Sequence
  Description of Artificial Sequence: Synthetic oligonucleotide
  Target: FXN; (-) strand; PAM type: NNNNGHTT; PAM sequence: AAAAGTTT
tctctcaaaaacaaataaat

SEQ ID NO: 7626 - DNA, 20 bp, Artificial Sequence
  Description of Artificial Sequence: Synthetic oligonucleotide
  Target: FXN; (-) strand; PAM type: NNNNGHTT; PAM sequence: CAGAGATT
tgggagaatcgcttgagcct

SEQ ID NO: 7627 - DNA, 20 bp, Artificial Sequence
  Description of Artificial Sequence: Synthetic oligonucleotide
  Target: FXN; (-) strand; PAM type: NNNNGHTT; PAM sequence: AATCGCTT
ttggtaggctgaggtgggag

SEQ ID NO: 7628 - DNA, 20 bp, Artificial Sequence
  Description of Artificial Sequence: Synthetic oligonucleotide
  Target: FXN; (-) strand; PAM type: NNNNGHTT; PAM sequence: CCTTGTTT
gactgggcaacatggtaaaa

SEQ ID NO: 7629 - DNA, 20 bp, Artificial Sequence
  Description of Artificial Sequence: Synthetic oligonucleotide
  Target: FXN; (-) strand; PAM type: NNNNGHTT; PAM sequence: GATCGCTT
tcgggagcccaaggagggag

SEQ ID NO: 7630 - DNA, 20 bp, Artificial Sequence
  Description of Artificial Sequence: Synthetic oligonucleotide
  Target: FXN; (-) strand; PAM type: NNNNGHTT; PAM sequence: TCATGCTT
ctgaggctgcatgtggtgac

SEQ ID NO: 7631 - DNA, 20 bp, Artificial Sequence
  Description of Artificial Sequence: Synthetic oligonucleotide
  Target: FXN; (-) strand; PAM type: NNNNGHTT; PAM sequence: AAAAGTTT
tgactatatttcatttattt

SEQ ID NO: 7632 - DNA, 20 bp, Artificial Sequence
  Description of Artificial Sequence: Synthetic oligonucleotide
  Target: FXN; (-) strand; PAM type: NNNNGHTT; PAM sequence: TACTGTTT
tttttcctgaaacccatttt

SEQ ID NO: 7633 - DNA, 20 bp, Artificial Sequence
  Description of Artificial Sequence: Synthetic oligonucleotide
  Target: FXN; (-) strand; PAM type: NNNNGHTT; PAM sequence: GTTTGTTT
tgggattatacaatacgtaa

SEQ ID NO: 7634 - DNA, 20 bp, Artificial Sequence
  Description of Artificial Sequence: Synthetic oligonucleotide
  Target: FXN; (-) strand; PAM type: NNNNGHTT; PAM sequence: GTAAGTTT
gggctgggattatacaatac

SEQ ID NO: 7635 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
gaaagcattttttaaaaggg

SEQ ID NO: 7636 - DNA, 20 bp, Artificial Sequence
  Description of Artificial Sequence: Synthetic oligonucleotide
  Target: FXN; (-) strand; PAM type: NNNNGHTT; PAM sequence: GCCAGTTT
tgtccttttatgagttgact

SEQ ID NO: 7637 - DNA, 20 bp, Artificial Sequence
  Description of Artificial Sequence: Synthetic oligonucleotide
  Target: FXN; (-) strand; PAM type: NNNNGHTT; PAM sequence: CTGTGATT
atacatttatggtggtgttt

SEQ ID NO: 7638 - DNA, 20 bp, Artificial Sequence
  Description of Artificial Sequence: Synthetic oligonucleotide
  Target: FXN; (-) strand; PAM type: NNNNGHTT; PAM sequence: TGGTGTTT
taaaaattatacatttatgg

SEQ ID NO: 7639 - DNA, 20 bp, Artificial Sequence
  Description of Artificial Sequence: Synthetic oligonucleotide
  Target: FXN; (-) strand; PAM type: NNNNGHTT; PAM sequence: AGATGTTT
tatgattttgactaaaaaaa

SEQ ID NO: 7640 - DNA, 20 bp, Artificial Sequence
  Description of Artificial Sequence: Synthetic oligonucleotide
  Target: FXN; (-) strand; PAM type: NNNNGHTT; PAM sequence: CTATGATT
cacctgtctactttctattt

SEQ ID NO: 7641 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tacctcggcctcccaaagtg

SEQ ID NO: 7642 - DNA, 20 bp, Artificial Sequence
  Description of Artificial Sequence: Synthetic oligonucleotide
  Target: FXN; (-) strand; PAM type: NNNNGHTT; PAM sequence: GCTGGTTT
ggtctcgctatattgaccag

SEQ ID NO: 7643 - DNA, 20 bp, Artificial Sequence
  Description of Artificial Sequence: Synthetic oligonucleotide
  Target: FXN; (-) strand; PAM type: NNNNGHTT; PAM sequence: GTTTGTTT
tcagctgccagtttttgttt

SEQ ID NO: 7644 - DNA, 20 bp, Artificial Sequence
  Description of Artificial Sequence: Synthetic oligonucleotide
  Target: FXN; (-) strand; PAM type: NNNNGHTT; PAM sequence: GTTTGTTT
ggtatcagctgccagttttt

SEQ ID NO: 7645 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
ctcaggtatcagctgccagt

SEQ ID NO: 7646 - DNA, 20 bp, Artificial Sequence
  Description of Artificial Sequence: Synthetic oligonucleotide
  Target: FXN; (-) strand; PAM type: NNNNGHTT; PAM sequence: GCCAGTTT
ttcactctcaggtatcagct

SEQ ID NO: 7647 - DNA, 20 bp, Artificial Sequence
  Description of Artificial Sequence: Synthetic oligonucleotide
  Target: FXN; (-) strand; PAM type: NNNNGHTT; PAM sequence: TCCAGTTT
ttggcggtaggattcattat

SEQ ID NO: 7648 - DNA, 20 bp, Artificial Sequence
  Description of Artificial Sequence: Synthetic oligonucleotide
  Target: FXN; (-) strand; PAM type: NNNNGHTT; PAM sequence: GTAGGATT
cttgactacaattgttggcg

SEQ ID NO: 7649 - DNA, 20 bp, Artificial Sequence
  Description of Artificial Sequence: Synthetic oligonucleotide
  Target: FXN; (-) strand; PAM type: NNNNGHTT; PAM sequence: AATTGTTT
ggtgtttggcactttgtgta

SEQ ID NO: 7650 - DNA, 20 bp, Artificial Sequence
  Description of Artificial Sequence: Synthetic oligonucleotide
  Target: FXN; (-) strand; PAM type: NNNNGHTT; PAM sequence: TGGTGTTT
ggttcctactgtgccaggct

SEQ ID NO: 7651 - DNA, 20 bp, Artificial Sequence
  Description of Artificial Sequence: Synthetic oligonucleotide
  Target: FXN; (-) strand; PAM type: NNNNGHTT; PAM sequence: CCAGGCTT
tttactcggttcctactgtg

SEQ ID NO: 7652 - DNA, 20 bp, Artificial Sequence
  Description of Artificial Sequence: Synthetic oligonucleotide
  Target: FXN; (-) strand; PAM type: NNNNGHTT; PAM sequence: TTCTGATT
ttttttaaaataacatcttt

SEQ ID NO: 7653 - DNA, 20 bp, Artificial Sequence
  Description of Artificial Sequence: Synthetic oligonucleotide
  Target: FXN; (-) strand; PAM type: NNNNGHTT; PAM sequence: GATGGCTT
ttgggaggccgaggcaggca

SEQ ID NO: 7654 - DNA, 20 bp, Artificial Sequence
  Description of Artificial Sequence: Synthetic oligonucleotide
  Target: FXN; (-) strand; PAM type: NNNNGHTT; PAM sequence: GAATGATT
ccatccaatcgagaggctct

SEQ ID NO: 7655 - DNA, 20 bp, Artificial Sequence
  Description of Artificial Sequence: Synthetic oligonucleotide
  Target: FXN; (-) strand; PAM type: NNNNGHTT; PAM sequence: CAAGGCTT
aagcttctcagatactcctc

SEQ ID NO: 7656 - DNA, 20 bp, Artificial Sequence
  Description of Artificial Sequence: Synthetic oligonucleotide
  Target: FXN; (-) strand; PAM type: NNNNGHTT; PAM sequence: ACAAGCTT
agactcttcccacgcatcta

SEQ ID NO: 7657 - DNA, 20 bp, Artificial Sequence
  Description of Artificial Sequence: Synthetic oligonucleotide
  Target: FXN; (-) strand; PAM type: NNNNGHTT; PAM sequence: TGAAGTTT
tagaaggcagaaactccaga

SEQ ID NO: 7658 - DNA, 20 bp, Artificial Sequence
  Description of Artificial Sequence: Synthetic oligonucleotide
  Target: FXN; (-) strand; PAM type: NNNNGHTT; PAM sequence: ATTAGCTT
tttgcttgtcttaggagagc

SEQ ID NO: 7659 - DNA, 20 bp, Artificial Sequence
  Description of Artificial Sequence: Synthetic oligonucleotide
  Target: FXN; (-) strand; PAM type: NNNNGHTT; PAM sequence: CTTTGCTT
ggaagtatgcaaaccatctg

SEQ ID NO: 7660 - DNA, 20 bp, Artificial Sequence
  Description of Artificial Sequence: Synthetic oligonucleotide
  Target: FXN; (-) strand; PAM type: NNNNGHTT; PAM sequence: ATCTGCTT
ggtaaggaagtatgcaaacc

SEQ ID NO: 7661 - DNA, 20 bp, Artificial Sequence
  Description of Artificial Sequence: Synthetic oligonucleotide
  Target: FXN; (-) strand; PAM type: NNNNGHTT; PAM sequence: GCTGGTTT
tggtgctggcatctgggact

SEQ ID NO: 7662 - DNA, 20 bp, Artificial Sequence
  Description of Artificial Sequence: Synthetic oligonucleotide
  Target: FXN; (-) strand; PAM type: NNNNGHTT; PAM sequence: TAGAGCTT
cataatgatgttgtatctca

SEQ ID NO: 7663 - DNA, 20 bp, Artificial Sequence
  Description of Artificial Sequence: Synthetic oligonucleotide
  Target: FXN; (-) strand; PAM type: NNNNGHTT; PAM sequence: ATAGGATT
gctttgctttcagaatcaga

SEQ ID NO: 7664 - DNA, 20 bp, Artificial Sequence
  Description of Artificial Sequence: Synthetic oligonucleotide
  Target: FXN; (-) strand; PAM type: NNNNGHTT; PAM sequence: CTTTGCTT
aggagtttgtgtaggaagag

SEQ ID NO: 7665 - DNA, 20 bp, Artificial Sequence
  Description of Artificial Sequence: Synthetic oligonucleotide
  Target: FXN; (-) strand; PAM type: NNNNGHTT; PAM sequence: AAGAGCTT
gaaataggagtttgtgtagg

SEQ ID NO: 7666 - DNA, 20 bp, Artificial Sequence
  Description of Artificial Sequence: Synthetic oligonucleotide
  Target: FXN; (-) strand; PAM type: NNNNGHTT; PAM sequence: AGGAGTTT
gtcttttagtatttagaaat

SEQ ID NO: 7667 - DNA, 20 bp, Artificial Sequence
  Description of Artificial Sequence: Synthetic oligonucleotide
  Target: FXN; (-) strand; PAM type: NNNNGHTT; PAM sequence: TCATGTTT
agcactttgtcatcattgct

SEQ ID NO: 7668 - DNA, 20 bp, Artificial Sequence
  Description of Artificial Sequence: Synthetic oligonucleotide
  Target: FXN; (-) strand; PAM type: NNNNGHTT; PAM sequence: CATTGCTT
aaaagttagcactttgtcat

SEQ ID NO: 7669 - DNA, 20 bp, Artificial Sequence
  Description of Artificial Sequence: Synthetic oligonucleotide
  Target: FXN; (-) strand; PAM type: NNNNGHTT; PAM sequence: AGGGGATT
gacagttaagacaccactct

SEQ ID NO: 7670 - DNA, 20 bp, Artificial Sequence
  Description of Artificial Sequence: Synthetic oligonucleotide
  Target: FXN; (-) strand; PAM type: NNNNGHTT; PAM sequence: CCCAGTTT
cataggttcctagatctcca

SEQ ID NO: 7671 - DNA, 20 bp, Artificial Sequence
  Description of Artificial Sequence: Synthetic oligonucleotide
  Target: FXN; (-) strand; PAM type: NNNNGHTT; PAM sequence: GTCTGCTT
gccagatttgcttgtttggc

SEQ ID NO: 7672 - DNA, 20 bp, Artificial Sequence
  Description of Artificial Sequence: Synthetic oligonucleotide
  Target: FXN; (-) strand; PAM type: NNNNGHTT; PAM sequence: GCTTGTTT
tggagaagatagccagattt

SEQ ID NO: 7673 - DNA, 20 bp, Artificial Sequence
  Description of Artificial Sequence: Synthetic oligonucleotide
  Target: FXN; (-) strand; PAM type: NNNNGHTT; PAM sequence: ATTTGCTT
tggatggagaagatagccag

SEQ ID NO: 7674 - DNA, 20 bp, Artificial Sequence
  Description of Artificial Sequence: Synthetic oligonucleotide
  Target: FXN; (-) strand; PAM type: NNNNGHTT; PAM sequence: GCCAGATT
atacctggatggagaagata

SEQ ID NO: 7675 - DNA, 20 bp, Artificial Sequence
  Description of Artificial Sequence: Synthetic oligonucleotide
  Target: FXN; (-) strand; PAM type: NNNNGHTT; PAM sequence: TTGGGATT
tacctcagcctctcaaagtg

SEQ ID NO: 7676 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
ggccttggcctcccaaagtg

SEQ ID NO: 7677 - DNA, 20 bp, Artificial Sequence
  Description of Artificial Sequence: Synthetic oligonucleotide
  Target: FXN; (-) strand; PAM type: NNNNGHTT; PAM sequence: TGGGGCTT
ttttatatttttagtagagg

SEQ ID NO: 7678 - DNA, 20 bp, Artificial Sequence
  Description of Artificial Sequence: Synthetic oligonucleotide
  Target: FXN; (-) strand; PAM type: NNNNGHTT; PAM sequence: GCCTGCTT
tcagatcttaatatcctgat

SEQ ID NO: 7679 - DNA, 20 bp, Artificial Sequence
  Description of Artificial Sequence: Synthetic oligonucleotide
  Target: FXN; (-) strand; PAM type: NNNNGHTT; PAM sequence: GCTGGATT
aatagaggaaaactgtctag

SEQ ID NO: 7680 - DNA, 20 bp, Artificial Sequence
  Description of Artificial Sequence: Synthetic oligonucleotide
  Target: FXN; (-) strand; PAM type: NNNNGHTT; PAM sequence: AGTAGCTT
tcaaacgctacaaggtcaaa

SEQ ID NO: 7681 - DNA, 20 bp, Artificial Sequence
  Description of Artificial Sequence: Synthetic oligonucleotide
  Target: FXN; (-) strand; PAM type: NNNNGHTT; PAM sequence: ACTTGCTT
caagtagaggtcaaacttta

SEQ ID NO: 7682 - DNA, 20 bp, Artificial Sequence
  Description of Artificial Sequence: Synthetic oligonucleotide
  Target: FXN; (-) strand; PAM type: NNNNGHTT; PAM sequence: GAGGGATT
cacatcaatggaaaaggcag

SEQ ID NO: 7683 - DNA, 20 bp, Artificial Sequence
  Description of Artificial Sequence: Synthetic oligonucleotide
  Target: FXN; (-) strand; PAM type: NNNNGHTT; PAM sequence: TCTAGATT
ccaacacaatcttttattcc

SEQ ID NO: 7684 - DNA, 20 bp, Artificial Sequence
  Description of Artificial Sequence: Synthetic oligonucleotide
  Target: FXN; (-) strand; PAM type: NNNNGHTT; PAM sequence: TCAGGCTT
atgtctctccctgcatgttc

SEQ ID NO: 7685 - DNA, 20 bp, Artificial Sequence
  Description of Artificial Sequence: Synthetic oligonucleotide
  Target: FXN; (-) strand; PAM type: NNNNGHTT; PAM sequence: GAACGTTT
taatgaatgactggatctga

SEQ ID NO: 7686 - DNA, 20 bp, Artificial Sequence
  Description of Artificial Sequence: Synthetic oligonucleotide
  Target: FXN; (-) strand; PAM type: NNNNGHTT; PAM sequence: GCTAGTTT
agtctttcaaagaattctat

SEQ ID NO: 7687 - DNA, 20 bp, Artificial Sequence
  Description of Artificial Sequence: Synthetic oligonucleotide
  Target: FXN; (-) strand; PAM type: NNNNGHTT; PAM sequence: TGCTGTTT
agaatgacagtgatttctag

SEQ ID NO: 7688 - DNA, 20 bp, Artificial Sequence
  Description of Artificial Sequence: Synthetic oligonucleotide
  Target: FXN; (-) strand; PAM type: NNNNGHTT; PAM sequence: CAGTGATT
ttagggccttcctagaatga

SEQ ID NO: 7689 - DNA, 20 bp, Artificial Sequence
  Description of Artificial Sequence: Synthetic oligonucleotide
  Target: FXN; (-) strand; PAM type: NNNNGHTT; PAM sequence: GGACGTTT
agtgtgtccaaatacgatat

SEQ ID NO: 7690 - DNA, 20 bp, Artificial Sequence
  Description of Artificial Sequence: Synthetic oligonucleotide
  Target: FXN; (-) strand; PAM type: NNNNGHTT; PAM sequence: CCATGCTT
cagcagatctttccaaattc

SEQ ID NO: 7691 - DNA, 20 bp, Artificial Sequence
  Description of Artificial Sequence: Synthetic oligonucleotide
  Target: FXN; (-) strand; PAM type: NNNNGHTT; PAM sequence: GCCCGCTT
actgagagcttgtcctcagg

SEQ ID NO: 7692 - DNA, 20 bp, Artificial Sequence
  Description of Artificial Sequence: Synthetic oligonucleotide
  Target: FXN; (-) strand; PAM type: NNNNGHTT; PAM sequence: GAGAGCTT
ccacttcccacagaagcact

SEQ ID NO: 7693 - DNA, 20 bp, Artificial Sequence
  Description of Artificial Sequence: Synthetic oligonucleotide
  Target: FXN; (-) strand; PAM type: NNNNGHTT; PAM sequence: AGGGGTTT
acaacctcctgctcctctac

SEQ ID NO: 7694 - DNA, 20 bp, Artificial Sequence
  Description of Artificial Sequence: Synthetic oligonucleotide
  Target: FXN; (-) strand; PAM type: NNNNGHTT; PAM sequence: AACAGCTT
tgaggctttgatattgacac

SEQ ID NO: 7695 - DNA, 20 bp, Artificial Sequence
  Description of Artificial Sequence: Synthetic oligonucleotide
  Target: FXN; (-) strand; PAM type: NNNNGHTT; PAM sequence: TGAGGCTT
tgttgttgttgttgttgttt

SEQ ID NO: 7696 - DNA, 20 bp, Artificial Sequence
  Description of Artificial Sequence: Synthetic oligonucleotide
  Target: FXN; (-) strand; PAM type: NNNNGHTT; PAM sequence: TGTTGTTT
catgtttttgttgttgttgt

SEQ ID NO: 7697 - DNA, 20 bp, Artificial Sequence
  Description of Artificial Sequence: Synthetic oligonucleotide
  Target: FXN; (-) strand; PAM type: NNNNGHTT; PAM sequence: TCATGTTT
gatctttattgttgataatt

SEQ ID NO: 7698 - DNA, 20 bp, Artificial Sequence
  Description of Artificial Sequence: Synthetic oligonucleotide
  Target: FXN; (-) strand; PAM type: NNNNGHTT; PAM sequence: TCTTGCTT
agtaagtgggtaaagaccct

SEQ ID NO: 7699 - DNA, 20 bp, Artificial Sequence
  Description of Artificial Sequence: Synthetic oligonucleotide
  Target: FXN; (-) strand; PAM type: NNNNGHTT; PAM sequence: CCCTGTTT
agaggctaagtcattttggg

SEQ ID NO: 7700 - DNA, 20 bp, Artificial Sequence
  Description of Artificial Sequence: Synthetic oligonucleotide
  Target: FXN; (-) strand; PAM type: NNNNGHTT; PAM sequence: CTGTGTTT
tgagctccttgaagatggga

SEQ ID NO: 7701 - DNA, 20 bp, Artificial Sequence
  Description of Artificial Sequence: Synthetic oligonucleotide
  Target: FXN; (-) strand; PAM type: NNNNGHTT; PAM sequence: GCTAGATT
acaaagagtctgtctccctt

SEQ ID NO: 7702 - DNA, 20 bp, Artificial Sequence
  Description of Artificial Sequence: Synthetic oligonucleotide
  Target: FXN; (-) strand; PAM type: NNNNGHTT; PAM sequence: TCAAGCTT
tctgaggctcgttaccaatt

SEQ ID NO: 7703 - DNA, 20 bp, Artificial Sequence
  Description of Artificial Sequence: Synthetic oligonucleotide
  Target: FXN; (-) strand; PAM type: NNNNGHTT; PAM sequence: CCCTGATT
catgttctagaaaattgtgt

SEQ ID NO: 7704 - DNA, 20 bp, Artificial Sequence
  Description of Artificial Sequence: Synthetic oligonucleotide
  Target: FXN; (-) strand; PAM type: NNNNGHTT; PAM sequence: CTAAGATT
taggttccttggcactagtc

SEQ ID NO: 7705 - DNA, 20 bp, Artificial Sequence
  Description of Artificial Sequence: Synthetic oligonucleotide
  Target: FXN; (-) strand; PAM type: NNNNGHTT; PAM sequence: CTCAGCTT
cttgggccgattctcccctt

SEQ ID NO: 7706 - DNA, 20 bp, Artificial Sequence
  Description of Artificial Sequence: Synthetic oligonucleotide
  Target: FXN; (-) strand; PAM type: NNNNGHTT; PAM sequence: GGCCGATT
tttctgtggatctcaccttg

SEQ ID NO: 7707 - DNA, 20 bp, Artificial Sequence
  Description of Artificial Sequence: Synthetic oligonucleotide
  Target: FXN; (-) strand; PAM type: NNNNGHTT; PAM sequence: GAGGGTTT
tcatttggaaccctcgaaca

SEQ ID NO: 7708 - DNA, 20 bp, Artificial Sequence
  Description of Artificial Sequence: Synthetic oligonucleotide
  Target: FXN; (-) strand; PAM type: NNNNGHTT; PAM sequence: TCATGCTT
aagttcaggaggcctgcttt

SEQ ID NO: 7709 - DNA, 20 bp, Artificial Sequence
  Description of Artificial Sequence: Synthetic oligonucleotide
  Target: FXN; (-) strand; PAM type: NNNNGHTT; PAM sequence: GCCTGCTT
cactcggggaagttcaggag

SEQ ID NO: 7710 - DNA, 20 bp, Artificial Sequence
  Description of Artificial Sequence: Synthetic oligonucleotide
  Target: FXN; (-) strand; PAM type: NNNNGHTT; PAM sequence: TGCAGTTT
gtgccgtcattcagatagtc

SEQ ID NO: 7711 - DNA, 20 bp, Artificial Sequence
  Description of Artificial Sequence: Synthetic oligonucleotide
  Target: FXN; (-) strand; PAM type: NNNNGHTT; PAM sequence: TGCGGTTT
atttcttggtcaggcagctc

SEQ ID NO: 7712 - DNA, 20 bp, Artificial Sequence
  Description of Artificial Sequence: Synthetic oligonucleotide
  Target: FXN; (-) strand; PAM type: NNNNGHTT; PAM sequence: CATTGCTT
ccttcttcttcgcctgcaag

SEQ ID NO: 7713 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgccttggcctcccaaagtg

SEQ ID NO: 7714 - DNA, 20 bp, Artificial Sequence
  Description of Artificial Sequence: Synthetic oligonucleotide
  Target: FXN; (-) strand; PAM type: NNNNGHTT; PAM sequence: CAGGGTTT
ttttgtatttttagtagaga

SEQ ID NO: 7715 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgtctcagtctcccaagcag

SEQ ID NO: 7716 - DNA, 20 bp, Artificial Sequence
  Description of Artificial Sequence: Synthetic oligonucleotide
  Target: FXN; (-) strand; PAM type: NNNNGHTT; PAM sequence: GCACGATT
gcccaggatggagtgctgtg

SEQ ID NO: 7717 - DNA, 20 bp, Artificial Sequence
  Description of Artificial Sequence: Synthetic oligonucleotide
  Target: FXN; (-) strand; PAM type: NNNNGHTT; PAM sequence: GCCTGTTT
gcttcactccaacattcatg

SEQ ID NO: 7718 - DNA, 20 bp, Artificial Sequence
  Description of Artificial Sequence: Synthetic oligonucleotide
  Target: FXN; (-) strand; PAM type: NNNNGHTT; PAM sequence: AGTTGCTT
ccgcttagcacgaggaggcc

SEQ ID NO: 7719 - DNA, 20 bp, Artificial Sequence
  Description of Artificial Sequence: Synthetic oligonucleotide
  Target: FXN; (-) strand; PAM type: NNNNGHTT; PAM sequence: AGCCGCTT
gagtggaaagaactcacagt

SEQ ID NO: 7720 - DNA, 20 bp, Artificial Sequence
  Description of Artificial Sequence: Synthetic oligonucleotide
  Target: FXN; (-) strand; PAM type: NNNNGHTT; PAM sequence: TCTGGTTT
gaagcggggagaccaccatg

SEQ ID NO: 7721 - DNA, 20 bp, Artificial Sequence
  Description of Artificial Sequence: Synthetic oligonucleotide
  Target: FXN; (-) strand; PAM type: NNNNGHTT; PAM sequence: TTTGGATT
ctctccaagctctttactcc

SEQ ID NO: 7722 - DNA, 20 bp, Artificial Sequence
  Description of Artificial Sequence: Synthetic oligonucleotide
  Target: FXN; (-) strand; PAM type: NNNNGHTT; PAM sequence: TCACGTTT
ggactcccgctatggcctca

SEQ ID NO: 7723 - DNA, 20 bp, Artificial Sequence
  Description of Artificial Sequence: Synthetic oligonucleotide
  Target: FXN; (-) strand; PAM type: NNNNGHTT; PAM sequence: CCTTGCTT
gtggttcaagttttcatgca

SEQ ID NO: 7724 - DNA, 20 bp, Artificial Sequence
  Description of Artificial Sequence: Synthetic oligonucleotide
  Target: FXN; (-) strand; PAM type: NNNNGHTT; PAM sequence: TCAAGTTT
atgggtgtgacacatgtggt

SEQ ID NO: 7725 - DNA, 20 bp, Artificial Sequence
  Description of Artificial Sequence: Synthetic oligonucleotide
  Target: FXN; (-) strand; PAM type: NNNNGHTT; PAM sequence: CCAGGTTT
gtctttcttcaattcctggg

SEQ ID NO: 7726 - DNA, 20 bp, Artificial Sequence
  Description of Artificial Sequence: Synthetic oligonucleotide
  Target: FXN; (-) strand; PAM type: NNNNGHTT; PAM sequence: CCGTGCTT
aggattacaggtgtgagcta

SEQ ID NO: 7727 - DNA, 20 bp, Artificial Sequence
  Description of Artificial Sequence: Synthetic oligonucleotide
  Target: FXN; (-) strand; PAM type: NNNNGHTT; PAM sequence: CTAGGATT
tgcgtcagcttcccaaagtg

SEQ ID NO: 7728 - DNA, 20 bp, Artificial Sequence
  Description of Artificial Sequence: Synthetic oligonucleotide
  Target: FXN; (-) strand; PAM type: NNNNGHTT; PAM sequence: GTCAGCTT
agctcaagccatctgcctgc

SEQ ID NO: 7729 - DNA, 20 bp, Artificial Sequence
  Description of Artificial Sequence: Synthetic oligonucleotide
  Target: FXN; (-) strand; PAM type: NNNNGHTT; PAM sequence: CGGGGTTT
ttttgtatttttggtagaga

SEQ ID NO: 7730 - DNA, 20 bp, Artificial Sequence
  Description of Artificial Sequence: Synthetic oligonucleotide
  Target: FXN; (-) strand; PAM type: NNNNGHTT; PAM sequence: GGCCGTTT
gcggccctccagccttcctg

SEQ ID NO: 7731 - DNA, 20 bp, Artificial Sequence
  Description of Artificial Sequence: Synthetic oligonucleotide
  Target: FXN; (-) strand; PAM type: NNNNGHTT; PAM sequence: GCTGGTTT
ggaacttggtctcatggtca

SEQ ID NO: 7732 - DNA, 20 bp, Artificial Sequence
  Description of Artificial Sequence: Synthetic oligonucleotide
  Target: FXN; (-) strand; PAM type: NNNNGHTT; PAM sequence: TGGTGTTT
ttaaaggcagcagcactggc

SEQ ID NO: 7733 - DNA, 20 bp, Artificial Sequence
  Description of Artificial Sequence: Synthetic oligonucleotide
  Target: FXN; (-) strand; PAM type: NNNNGHTT; PAM sequence: AAGTGCTT
attaacaagagatcagtcaa

SEQ ID NO: 7734 - DNA, 20 bp, Artificial Sequence
  Description of Artificial Sequence: Synthetic oligonucleotide
  Target: FXN; (-) strand; PAM type: NNNNGHTT; PAM sequence: ACGAGTTT
tgggaggattgcttgaagcc

SEQ ID NO: 7735 - DNA, 20 bp, Artificial Sequence
  Description of Artificial Sequence: Synthetic oligonucleotide
  Target: FXN; (-) strand; PAM type: NNNNGHTT; PAM sequence: GATTGCTT
ttgggaggctgatgtgggag

SEQ ID NO: 7736 - DNA, 20 bp, Artificial Sequence
  Description of Artificial Sequence: Synthetic oligonucleotide
  Target: FXN; (-) strand; PAM type: NNNNGHTT; PAM sequence: GGAGGATT
cactttgggaggctgatgtg

SEQ ID NO: 7737 - DNA, 20 bp, Artificial Sequence
  Description of Artificial Sequence: Synthetic oligonucleotide
  Target: FXN; (-) strand; PAM type: NNNNGHTT; PAM sequence: TGCTGATT
cgcaaggtgggaggtaagac

SEQ ID NO: 7738 - DNA, 20 bp, Artificial Sequence
  Description of Artificial Sequence: Synthetic oligonucleotide
  Target: FXN; (-) strand; PAM type: NNNNGHTT; PAM sequence: TGGGGCTT
ctgcattatcaaccaaatgc

SEQ ID NO: 7739 - DNA, 20 bp, Artificial Sequence
  Description of Artificial Sequence: Synthetic oligonucleotide
  Target: FXN; (-) strand; PAM type: NNNNGHTT; PAM sequence: CAAGGATT
agcttgggcaataaaagtat

SEQ ID NO: 7740 - DNA, 20 bp, Artificial Sequence
  Description of Artificial Sequence: Synthetic oligonucleotide
  Target: FXN; (-) strand; PAM type: NNNNGHTT; PAM sequence: GGAAGCTT
aggatgaggtcaccaggaag

SEQ ID NO: 7741 - DNA, 20 bp, Artificial Sequence
  Description of Artificial Sequence: Synthetic oligonucleotide
  Target: FXN; (-) strand; PAM type: NNNNGHTT; PAM sequence: GAGGGCTT
agtctgcctgagcactcaag

SEQ ID NO: 7742 - DNA, 20 bp, Artificial Sequence
  Description of Artificial Sequence: Synthetic oligonucleotide
  Target: FXN; (-) strand; PAM type: NNNNGHTT; PAM sequence: GGATGATT
ccacttcctcatggcctcat

SEQ ID NO: 7743 - DNA, 20 bp, Artificial Sequence
  Description of Artificial Sequence: Synthetic oligonucleotide
  Target: FXN; (-) strand; PAM type: NNNNGHTT; PAM sequence: GCTGGCTT
ttcgtgtggacagatcggag

SEQ ID NO: 7744 - DNA, 20 bp, Artificial Sequence
  Description of Artificial Sequence: Synthetic oligonucleotide
  Target: FXN; (-) strand; PAM type: NNNNGHTT; PAM sequence: CGTTGCTT
agtgaataatggcacatgca

SEQ ID NO: 7745 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
ttttatttgtatcatttttg

SEQ ID NO: 7746 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
ttggtttttatttgtatcat

SEQ ID NO: 7747 - DNA, 20 bp, Artificial Sequence
  Description of Artificial Sequence: Synthetic oligonucleotide
  Target: FXN; (-) strand; PAM type: NNNNGHTT; PAM sequence: ATTGGTTT
atgctgttaatagttgttat

SEQ ID NO: 7748 - DNA, 20 bp, Artificial Sequence
  Description of Artificial Sequence: Synthetic oligonucleotide
  Target: FXN; (-) strand; PAM type: NNNNGHTT; PAM sequence: TCCAGATT
tctgtatgctttaagtcatc

SEQ ID NO: 7749 - DNA, 20 bp, Artificial Sequence
  Description of Artificial Sequence: Synthetic oligonucleotide
  Target: FXN; (-) strand; PAM type: NNNNGHTT; PAM sequence: GTATGCTT
taacctaggcacatccttct

SEQ ID NO: 7750 - DNA, 20 bp, Artificial Sequence
  Description of Artificial Sequence: Synthetic oligonucleotide
  Target: FXN; (-) strand; PAM type: NNNNGHTT; PAM sequence: CCTAGCTT
ttgtgcaaccactacctctg

SEQ ID NO: 7751 - DNA, 20 bp, Artificial Sequence
  Description of Artificial Sequence: Synthetic oligonucleotide
  Target: FXN; (-) strand; PAM type: NNNNGHTT; PAM sequence: CAGTGTTT
tgatacctgctatgctggag

SEQ ID NO: 7752 - DNA, 20 bp, Artificial Sequence
  Description of Artificial Sequence: Synthetic oligonucleotide
  Target: FXN; (-) strand; PAM type: NNNNGHTT; PAM sequence: TCCAGCTT
ccaggtatcacactttgatc

SEQ ID NO: 7753 - DNA, 20 bp, Artificial Sequence
  Description of Artificial Sequence: Synthetic oligonucleotide
  Target: FXN; (-) strand; PAM type: NNNNGHTT; PAM sequence: GAATGATT
atcttctggaacaattccaa

SEQ ID NO: 7754 - DNA, 20 bp, Artificial Sequence
  Description of Artificial Sequence: Synthetic oligonucleotide
  Target: FXN; (-) strand; PAM type: NNNNGHTT; PAM sequence: CACTGATT
gcacagcccttcagatgaac

SEQ ID NO: 7755 - DNA, 20 bp, Artificial Sequence
  Description of Artificial Sequence: Synthetic oligonucleotide
  Target: FXN; (-) strand; PAM type: NNNNGHTT; PAM sequence: TAACGCTT
agtttttcccagtccagtca

SEQ ID NO: 7756 - DNA, 20 bp, Artificial Sequence
  Description of Artificial Sequence: Synthetic oligonucleotide
  Target: FXN; (-) strand; PAM type: NNNNGHTT; PAM sequence: CCCAGTTT
cacgccgtcgtgggagtaca

SEQ ID NO: 7757 - DNA, 20 bp, Artificial Sequence
  Description of Artificial Sequence: Synthetic oligonucleotide
  Target: FXN; (-) strand; PAM type: NNNNGHTT; PAM sequence: TAAGGCTT
gacaagtccagtttggtttt

SEQ ID NO: 7758 - DNA, 20 bp, Artificial Sequence
  Description of Artificial Sequence: Synthetic oligonucleotide
  Target: FXN; (-) strand; PAM type: NNNNGHTT; PAM sequence: TTTGGTTT
gccaaggaagacaagtccag

SEQ ID NO: 7759 - DNA, 20 bp, Artificial Sequence
  Description of Artificial Sequence: Synthetic oligonucleotide
  Target: FXN; (-) strand; PAM type: NNNNGHTT; PAM sequence: TCCAGTTT
aataggccaaggaagacaag

SEQ ID NO: 7760 - DNA, 20 bp, Artificial Sequence
  Description of Artificial Sequence: Synthetic oligonucleotide
  Target: FXN; (-) strand; PAM type: NNNNGHTT; PAM sequence: GATAGCTT
tgaagctggggtcttggcct

SEQ ID NO: 7761 - DNA, 20 bp, Artificial Sequence
  Description of Artificial Sequence: Synthetic oligonucleotide
  Target: FXN; (-) strand; PAM type: NNNNGHTT; PAM sequence: TTTTGCTT
ggaatttttccttcttatta

SEQ ID NO: 7762 - DNA, 20 bp, Artificial Sequence
  Description of Artificial Sequence: Synthetic oligonucleotide
  Target: FXN; (-) strand; PAM type: NNNNGHTT; PAM sequence: AAGTGCTT
ttcaatgctaaagagctcag

SEQ ID NO: 7763 - DNA, 20 bp, Artificial Sequence
  Description of Artificial Sequence: Synthetic oligonucleotide
  Target: FXN; (-) strand; PAM type: NNNNGHTT; PAM sequence: AGTTGCTT
agaaatgatcttcccgtgtg

SEQ ID NO: 7764 - DNA, 20 bp, Artificial Sequence
  Description of Artificial Sequence: Synthetic oligonucleotide
  Target: FXN; (-) strand; PAM type: NNNNGHTT; PAM sequence: AGCTGATT
attttttgcattcttgtagc

SEQ ID NO: 7765 - DNA, 20 bp, Artificial Sequence
  Description of Artificial Sequence: Synthetic oligonucleotide
  Target: FXN; (-) strand; PAM type: NNNNGHTT; PAM sequence: GGAAGATT
tttcctcttttcttgtcttt

SEQ ID NO: 7766 - DNA, 20 bp, Artificial Sequence
  Description of Artificial Sequence: Synthetic oligonucleotide
  Target: FXN; (-) strand; PAM type: NNNNGHTT; PAM sequence: AACGGCTT
tacatcactcagctcatgaa

SEQ ID NO: 7767 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
gcacctcctcagctccatga

SEQ ID NO: 7768 - DNA, 20 bp, Artificial Sequence
  Description of Artificial Sequence: Synthetic oligonucleotide
  Target: FXN; (-) strand; PAM type: NNNNGHTT; PAM sequence: CCATGATT
tacaaggcacctcctcagct

SEQ ID NO: 7769 - DNA, 20 bp, Artificial Sequence
  Description of Artificial Sequence: Synthetic oligonucleotide
  Target: FXN; (-) strand; PAM type: NNNNGHTT; PAM sequence: TCATGTTT
tccttcctttatctgcccct

SEQ ID NO: 7770 - DNA, 20 bp, Artificial Sequence
  Description of Artificial Sequence: Synthetic oligonucleotide
  Target: FXN; (-) strand; PAM type: NNNNGHTT; PAM sequence: GGTTGCTT
gaattagaactagcctgtta

SEQ ID NO: 7771 - DNA, 20 bp, Artificial Sequence
  Description of Artificial Sequence: Synthetic oligonucleotide
  Target: FXN; (-) strand; PAM type: NNNNGHTT; PAM sequence: TATAGCTT
accaataacaatgtttccta

SEQ ID NO: 7772 - DNA, 20 bp, Artificial Sequence
  Description of Artificial Sequence: Synthetic oligonucleotide
  Target: FXN; (-) strand; PAM type: NNNNGHTT; PAM sequence: CAATGTTT
cgatagggcaacaccaataa

SEQ ID NO: 7773 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
caccttggcctccaaaagtg

SEQ ID NO: 7774 - DNA, 20 bp, Artificial Sequence
  Description of Artificial Sequence: Synthetic oligonucleotide
  Target: FXN; (-) strand; PAM type: NNNNGHTT; PAM sequence: CGGGGTTT
ttttgtatttttagtagaga

SEQ ID NO: 7775 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
cgcttcagcctcccaagtag

SEQ ID NO: 7776 - DNA, 20 bp, Artificial Sequence
  Description of Artificial Sequence: Synthetic oligonucleotide
  Target: FXN; (-) strand; PAM type: NNNNGHTT; PAM sequence: TTCCGCTT
cctctgggttcaagcgattc

SEQ ID NO: 7777 - DNA, 20 bp, Artificial Sequence
  Description of Artificial Sequence: Synthetic oligonucleotide
  Target: FXN; (-) strand; PAM type: NNNNGHTT; PAM sequence: AAGCGATT
caacctccacctctgggttc

SEQ ID NO: 7778 - DNA, 20 bp, Artificial Sequence
  Description of Artificial Sequence: Synthetic oligonucleotide
  Target: FXN; (-) strand; PAM type: NNNNGHTT; PAM sequence: CAGAGTTT
ttgttattattattttgaga

SEQ ID NO: 7779 - DNA, 20 bp, Artificial Sequence
  Description of Artificial Sequence: Synthetic oligonucleotide
  Target: FXN; (-) strand; PAM type: NNNNGHTT; PAM sequence: ATACGATT
aaatgaggtaatgtggtata

SEQ ID NO: 7780 - DNA, 20 bp, Artificial Sequence
  Description of Artificial Sequence: Synthetic oligonucleotide
  Target: FXN; (-) strand; PAM type: NNNNGHTT; PAM sequence: TGTTGCTT
attttaatgtcctggaggct

SEQ ID NO: 7781 - DNA, 20 bp, Artificial Sequence
  Description of Artificial Sequence: Synthetic oligonucleotide
  Target: FXN; (-) strand; PAM type: NNNNGHTT; PAM sequence: GGAGGCTT
tgcatgaattttaatgtcct

SEQ ID NO: 7782 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
cgtctcagcctcctgagtac

SEQ ID NO: 7783 - DNA, 20 bp, Artificial Sequence
  Description of Artificial Sequence: Synthetic oligonucleotide
  Target: FXN; (-) strand; PAM type: NNNNGHTT; PAM sequence: ATGTGTTT
tcccagcttgacttaatgga

SEQ ID NO: 7784 - DNA, 20 bp, Artificial Sequence
  Description of Artificial Sequence: Synthetic oligonucleotide
  Target: FXN; (-) strand; PAM type: NNNNGHTT; PAM sequence: CCCAGCTT
tataggtatatgccactgct

SEQ ID NO: 7785 - DNA, 20 bp, Artificial Sequence
  Description of Artificial Sequence: Synthetic oligonucleotide
  Target: FXN; (-) strand; PAM type: NNNNGHTT; PAM sequence: CCTGGCTT
gcccaggctgatctccaatt

SEQ ID NO: 7786 - DNA, 20 bp, Artificial Sequence
  Description of Artificial Sequence: Synthetic oligonucleotide
  Target: FXN; (-) strand; PAM type: NNNNGHTT; PAM sequence: ATAGGTTT
tttatactgttttattatta

SEQ ID NO: 7787 - DNA, 20 bp, Artificial Sequence
  Description of Artificial Sequence: Synthetic oligonucleotide
  Target: FXN; (-) strand; PAM type: NNNNGHTT; PAM sequence: TACTGTTT
acctatttagcttttgttta

SEQ ID NO: 7788 - DNA, 20 bp, Artificial Sequence
  Description of Artificial Sequence: Synthetic oligonucleotide
  Target: FXN; (-) strand; PAM type: NNNNGHTT; PAM sequence: TTTTGTTT
aaatattttacctatttagc

SEQ ID NO: 7789 - DNA, 20 bp, Artificial Sequence
  Description of Artificial Sequence: Synthetic oligonucleotide
  Target: FXN; (-) strand; PAM type: NNNNGHTT; PAM sequence: TTTAGCTT
cagaaaaaatattttaccta

SEQ ID NO: 7790 - DNA, 20 bp, Artificial Sequence
  Description of Artificial Sequence: Synthetic oligonucleotide
  Target: FXN; (-) strand; PAM type: NNNNGHTT; PAM sequence: CCCAGATT
ccacaaggaccccataagag

SEQ ID NO: 7791 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgcctcagcctcccaaagtg

SEQ ID NO: 7792 - DNA, 20 bp, Artificial Sequence
  Description of Artificial Sequence: Synthetic oligonucleotide
  Target: FXN; (-) strand; PAM type: NNNNGHTT; PAM sequence: ACGGGATT
ttttaatatttttagtagag

SEQ ID NO: 7793 - DNA, 20 bp, Artificial Sequence
  Description of Artificial Sequence: Synthetic oligonucleotide
  Target: FXN; (-) strand; PAM type: NNNNGHTT; PAM sequence: CAGCGATT
aacctccaccccccaggtta

SEQ ID NO: 7794 - DNA, 20 bp, Artificial Sequence
  Description of Artificial Sequence: Synthetic oligonucleotide
  Target: FXN; (-) strand; PAM type: NNNNGHTT; PAM sequence: ATGTGTTT
tcttcccctggctgctgttc

SEQ ID NO: 7795 - DNA, 20 bp, Artificial Sequence
  Description of Artificial Sequence: Synthetic oligonucleotide
  Target: FXN; (-) strand; PAM type: NNNNGHTT; PAM sequence: TTTTGATT
gtttgcttgacagaatatga

SEQ ID NO: 7796 - DNA, 20 bp, Artificial Sequence
  Description of Artificial Sequence: Synthetic oligonucleotide
  Target: FXN; (-) strand; PAM type: NNNNGHTT; PAM sequence: ATATGATT
tttccagtttgcttgacaga

SEQ ID NO: 7797 - DNA, 20 bp, Artificial Sequence
  Description of Artificial Sequence: Synthetic oligonucleotide
  Target: FXN; (-) strand; PAM type: NNNNGHTT; PAM sequence: GTTTGCTT
cacacagtggtacttttcca

SEQ ID NO: 7798 - DNA, 20 bp, Artificial Sequence
  Description of Artificial Sequence: Synthetic oligonucleotide
  Target: FXN; (-) strand; PAM type: NNNNGHTT; PAM sequence: TCCAGTTT
ggtacacacagtggtacttt

SEQ ID NO: 7799 - DNA, 20 bp, Artificial Sequence
  Description of Artificial Sequence: Synthetic oligonucleotide
  Target: FXN; (-) strand; PAM type: NNNNGHTT; PAM sequence: CTAAGATT
aaaggggaaaaaaaagtttt

SEQ ID NO: 7800 - DNA, 20 bp, Artificial Sequence
  Description of Artificial Sequence: Synthetic oligonucleotide
  Target: FXN; (-) strand; PAM type: NNNNGHTT; PAM sequence: AAAAGTTT
aaaaaatagaaaggggaaaa

SEQ ID NO: 7801 - DNA, 20 bp, Artificial Sequence
  Description of Artificial Sequence: Synthetic oligonucleotide
  Target: FXN; (-) strand; PAM type: NNNNGHTT; PAM sequence: CTTTGATT
gaggtcgaggctgccatgag

SEQ ID NO: 7802 - DNA, 20 bp, Artificial Sequence
  Description of Artificial Sequence: Synthetic oligonucleotide
  Target: FXN; (-) strand; PAM type: NNNNGHTT; PAM sequence: ATGAGCTT
ccagggaggtcgaggctgcc

SEQ ID NO: 7803 - DNA, 20 bp, Artificial Sequence
  Description of Artificial Sequence: Synthetic oligonucleotide
  Target: FXN; (-) strand; PAM type: NNNNGHTT; PAM sequence: GGAGGATT
tatggaggtgcacacctgtg

SEQ ID NO: 7804 - DNA, 20 bp, Artificial Sequence
  Description of Artificial Sequence: Synthetic oligonucleotide
  Target: FXN; (-) strand; PAM type: NNNNGHTT; PAM sequence: AAAAGCTT
aagaaggtaaaaataataga

SEQ ID NO: 7805 - DNA, 20 bp, Artificial Sequence
  Description of Artificial Sequence: Synthetic oligonucleotide
  Target: FXN; (-) strand; PAM type: NNNNGHTT; PAM sequence: TTGTGATT
gtttcgattaaattctaaat

SEQ ID NO: 7806 - DNA, 20 bp, Artificial Sequence
  Description of Artificial Sequence: Synthetic oligonucleotide
  Target: FXN; (-) strand; PAM type: NNNNGHTT; PAM sequence: TTTCGATT
caaacaagtaagaggcagag

SEQ ID NO: 7807 - DNA, 20 bp, Artificial Sequence
  Description of Artificial Sequence: Synthetic oligonucleotide
  Target: FXN; (-) strand; PAM type: NNNNGHTT; PAM sequence: CAGAGTTT
gtctacaaacaagtaagagg

SEQ ID NO: 7808 - DNA, 20 bp, Artificial Sequence
  Description of Artificial Sequence: Synthetic oligonucleotide
  Target: FXN; (-) strand; PAM type: NNNNGHTT; PAM sequence: TATAGATT
catgttagatatctccattt

SEQ ID NO: 7809 - DNA, 20 bp, Artificial Sequence
  Description of Artificial Sequence: Synthetic oligonucleotide
  Target: FXN; (-) strand; PAM type: NNNNGHTT; PAM sequence: TTGTGCTT
gagtacttctcacatcagga

SEQ ID NO: 7810 - DNA, 20 bp, Artificial Sequence
  Description of Artificial Sequence: Synthetic oligonucleotide
  Target: FXN; (-) strand; PAM type: NNNNGHTT; PAM sequence: TCAGGATT
tgaactgagtacttctcaca

SEQ ID NO: 7811 - DNA, 20 bp, Artificial Sequence
  Description of Artificial Sequence: Synthetic oligonucleotide
  Target: FXN; (-) strand; PAM type: NNNNGHTT; PAM sequence: TTTTGATT
gaagttaagtaaactgagta

SEQ ID NO: 7812 - DNA, 20 bp, Artificial Sequence
  Description of Artificial Sequence: Synthetic oligonucleotide
  Target: FXN; (-) strand; PAM type: NNNNGHTT; PAM sequence: AATAGTTT
tcaaattttaaattggctaa

SEQ ID NO: 7813 - DNA, 20 bp, Artificial Sequence
  Description of Artificial Sequence: Synthetic oligonucleotide
  Target: FXN; (-) strand; PAM type: NNNNGHTT; PAM sequence: AAGCGATT
gtgtgtaccttggaagcgta

SEQ ID NO: 7814 - DNA, 20 bp, Artificial Sequence
  Description of Artificial Sequence: Synthetic oligonucleotide
  Target: FXN; (-) strand; PAM type: NNNNGHTT; PAM sequence: TTTAGTTT
ccttgctggcatgtagctgt

SEQ ID NO: 7815 - DNA, 20 bp, Artificial Sequence
  Description of Artificial Sequence: Synthetic oligonucleotide
  Target: FXN; (-) strand; PAM type: NNNNGHTT; PAM sequence: AGCTGTTT
tttctcccttgctggcatgt

SEQ ID NO: 7816 - DNA, 20 bp, Artificial Sequence
  Description of Artificial Sequence: Synthetic oligonucleotide
  Target: FXN; (-) strand; PAM type: NNNNGHTT; PAM sequence: CGTCGTTT
tatacacaaagtcatgaact

SEQ ID NO: 7817 - DNA, 20 bp, Artificial Sequence
  Description of Artificial Sequence: Synthetic oligonucleotide
  Target: FXN; (-) strand; PAM type: NNNNGHTT; PAM sequence: AATTGCTT
ctcgggaggctgaggcagag

SEQ ID NO: 7818 - DNA, 20 bp, Artificial Sequence
  Description of Artificial Sequence: Synthetic oligonucleotide
  Target: FXN; (-) strand; PAM type: NNNNGHTT; PAM sequence: GGTGGATT
cactttgggaggcggaggca

SEQ ID NO: 7819 - DNA, 20 bp, Artificial Sequence
  Description of Artificial Sequence: Synthetic oligonucleotide
  Target: FXN; (-) strand; PAM type: NNNNGHTT; PAM sequence: CAAAGATT
cctggctaattaagataaac

SEQ ID NO: 7820 - DNA, 20 bp, Artificial Sequence
  Description of Artificial Sequence: Synthetic oligonucleotide
  Target: FXN; (-) strand; PAM type: NNNNGHTT; PAM sequence: CTGAGTTT
gatgcagggatataagtgag

SEQ ID NO: 7821 - DNA, 20 bp, Artificial Sequence
  Description of Artificial Sequence: Synthetic oligonucleotide
  Target: FXN; (-) strand; PAM type: NNNNGHTT; PAM sequence: CTTGGATT
gagaagatggaacatatgag

SEQ ID NO: 7822 - DNA, 20 bp, Artificial Sequence
  Description of Artificial Sequence: Synthetic oligonucleotide
  Target: FXN; (-) strand; PAM type: NNNNGHTT; PAM sequence: ATGAGCTT
agccagagaagatggaacat

SEQ ID NO: 7823 - DNA, 20 bp, Artificial Sequence
  Description of Artificial Sequence: Synthetic oligonucleotide
  Target: FXN; (-) strand; PAM type: NNNNGHTT; PAM sequence: TGATGTTT
ccaattttactgctgggtgc

SEQ ID NO: 7824 - DNA, 20 bp, Artificial Sequence
  Description of Artificial Sequence: Synthetic oligonucleotide
  Target: FXN; (-) strand; PAM type: NNNNGHTT; PAM sequence: CTGGGATT
tgcctcagcctctcaaagtg

SEQ ID NO: 7825 - DNA, 20 bp, Artificial Sequence
  Description of Artificial Sequence: Synthetic oligonucleotide
  Target: FXN; (-) strand; PAM type: NNNNGHTT; PAM sequence: CGGGGTTT
ttttgtatttttagtagagg

SEQ ID NO: 7826 - DNA, 20 bp, Artificial Sequence
  Description of Artificial Sequence: Synthetic oligonucleotide
  Target: FXN; (-) strand; PAM type: NNNNGHTT; PAM sequence: TGGAGTTT
cgggaattacatttttttaa

SEQ ID NO: 7827 - DNA, 20 bp, Artificial Sequence
  Description of Artificial Sequence: Synthetic oligonucleotide
  Target: FXN; (-) strand; PAM type: NNNNGHTT; PAM sequence: TAGGGTTT
tttaaagtttttctttctct

SEQ ID NO: 7828 - DNA, 20 bp, Artificial Sequence
  Description of Artificial Sequence: Synthetic oligonucleotide
  Target: FXN; (-) strand; PAM type: NNNNGHTT; PAM sequence: TAAAGTTT
ttttgagctttggagggatt

SEQ ID NO: 7829 - DNA, 20 bp, Artificial Sequence
  Description of Artificial Sequence: Synthetic oligonucleotide
  Target: FXN; (-) strand; PAM type: NNNNGHTT; PAM sequence: GAGGGATT
tctattacttttgagctttg

SEQ ID NO: 7830 - DNA, 20 bp, Artificial Sequence
  Description of Artificial Sequence: Synthetic oligonucleotide
  Target: FXN; (-) strand; PAM type: NNNNGHTT; PAM sequence: TTGAGCTT
ctcatctgtttctattactt

SEQ ID NO: 7831 - DNA, 20 bp, Artificial Sequence
  Description of Artificial Sequence: Synthetic oligonucleotide
  Target: FXN; (-) strand; PAM type: NNNNGHTT; PAM sequence: ATCTGTTT
gaaatcctgactccaaactc

SEQ ID NO: 7832 - DNA, 20 bp, Artificial Sequence
  Description of Artificial Sequence: Synthetic oligonucleotide
  Target: FXN; (-) strand; PAM type: NNNNGHTT; PAM sequence: GACGGTTT
gatcaggtggctatgctctg

SEQ ID NO: 7833 - DNA, 20 bp, Artificial Sequence
  Description of Artificial Sequence: Synthetic oligonucleotide
  Target: FXN; (-) strand; PAM type: NNNNGHTT; PAM sequence: GGATGTTT
caggagagggcagatttaag

SEQ ID NO: 7834 - DNA, 20 bp, Artificial Sequence
  Description of Artificial Sequence: Synthetic oligonucleotide
  Target: FXN; (-) strand; PAM type: NNNNGHTT; PAM sequence: GGCAGATT
actggggacgggcaggagag

SEQ ID NO: 7835 - DNA, 20 bp, Artificial Sequence
  Description of Artificial Sequence: Synthetic oligonucleotide
  Target: FXN; (-) strand; PAM type: NNNNGHTT; PAM sequence: GAAAGCTT
agacaagagattgcctttct

SEQ ID NO: 7836 - DNA, 20 bp, Artificial Sequence
  Description of Artificial Sequence: Synthetic oligonucleotide
  Target: FXN; (-) strand; PAM type: NNNNGHTT; PAM sequence: AAGAGATT
cctgcttaggttttacagac

SEQ ID NO: 7837 - DNA, 20 bp, Artificial Sequence
  Description of Artificial Sequence: Synthetic oligonucleotide
  Target: FXN; (-) strand; PAM type: NNNNGHTT; PAM sequence: TTAGGTTT
aaacttggccttggtcctgc

SEQ ID NO: 7838 - DNA, 20 bp, Artificial Sequence
  Description of Artificial Sequence: Synthetic oligonucleotide
  Target: FXN; (-) strand; PAM type: NNNNGHTT; PAM sequence: TCCTGCTT
gctaagaaacttggccttgg

SEQ ID NO: 7839 - DNA, 20 bp, Artificial Sequence
  Description of Artificial Sequence: Synthetic oligonucleotide
  Target: FXN; (-) strand; PAM type: NNNNGHTT; PAM sequence: TTGGGATT
acacttagggatctggggat

SEQ ID NO: 7840 - DNA, 20 bp, Artificial Sequence
  Description of Artificial Sequence: Synthetic oligonucleotide
  Target: FXN; (-) strand; PAM type: NNNNGHTT; PAM sequence: TGGGGATT
gcacagcacacttagggatc

SEQ ID NO: 7841 - DNA, 20 bp, Artificial Sequence
  Description of Artificial Sequence: Synthetic oligonucleotide
  Target: FXN; (-) strand; PAM type: NNNNGHTT; PAM sequence: AGGAGTTT
aggcagaggctgagtggagg

SEQ ID NO: 7842 - DNA, 20 bp, Artificial Sequence
  Description of Artificial Sequence: Synthetic oligonucleotide
  Target: FXN; (-) strand; PAM type: NNNNGHTT; PAM sequence: TAGAGTTT
ctcttggagttggggttatt

SEQ ID NO: 7843 - DNA, 20 bp, Artificial Sequence
  Description of Artificial Sequence: Synthetic oligonucleotide
  Target: FXN; (-) strand; PAM type: NNNNGHTT; PAM sequence: TCAAGTTT
taaaaatgtccttaggaggt

SEQ ID NO: 7844 - DNA, 20 bp, Artificial Sequence
  Description of Artificial Sequence: Synthetic oligonucleotide
  Target: FXN; (+) strand; PAM type: NNNNGHTT; PAM sequence: GTTAGCTT
tacactaaattcctcccaca

SEQ ID NO: 7845 - DNA, 20 bp, Artificial Sequence
  Description of Artificial Sequence: Synthetic oligonucleotide
  Target: FXN; (+) strand; PAM type: NNNNGHTT; PAM sequence: GGTGGTTT
actgtcataacctttacaaa

SEQ ID NO: 7846 - DNA, 20 bp, Artificial Sequence
  Description of Artificial Sequence: Synthetic oligonucleotide
  Target: FXN; (+) strand; PAM type: NNNNGHTT; PAM sequence: ACATGCTT
ggctatatttcagatacatc

SEQ ID NO: 7847 - DNA, 20 bp, Artificial Sequence
  Description of Artificial Sequence: Synthetic oligonucleotide
  Target: FXN; (+) strand; PAM type: NNNNGHTT; PAM sequence: ACATGTTT
gttcattatctacatcattc

SEQ ID NO: 7848 - DNA, 20 bp, Artificial Sequence
  Description of Artificial Sequence: Synthetic oligonucleotide
  Target: FXN; (+) strand; PAM type: NNNNGHTT; PAM sequence: TATTGATT
atatttattgactttggaat

SEQ ID NO: 7849 - DNA, 20 bp, Artificial Sequence
  Description of Artificial Sequence: Synthetic oligonucleotide
  Target: FXN; (+) strand; PAM type: NNNNGHTT; PAM sequence: TGTGGATT
tatcaaattgcattccagag

SEQ ID NO: 7850 - DNA, 20 bp, Artificial Sequence
  Description of Artificial Sequence: Synthetic oligonucleotide
  Target: FXN; (+) strand; PAM type: NNNNGHTT; PAM sequence: AGCTGTTT
atcagtctcctgggacaaac

SEQ ID NO: 7851 - DNA, 20 bp, Artificial Sequence
  Description of Artificial Sequence: Synthetic oligonucleotide
  Target: FXN; (+) strand; PAM type: NNNNGHTT; PAM sequence: GTGGGATT
aatcaatccaagcaaatgca

SEQ ID NO: 7852 - DNA, 20 bp, Artificial Sequence
  Description of Artificial Sequence: Synthetic oligonucleotide
  Target: FXN; (+) strand; PAM type: NNNNGHTT; PAM sequence: TAAGGTTT
tgagtgagaatttggagact

SEQ ID NO: 7853 - DNA, 20 bp, Artificial Sequence
  Description of Artificial Sequence: Synthetic oligonucleotide
  Target: FXN; (+) strand; PAM type: NNNNGHTT; PAM sequence: AGAGGATT
cttaaggtttggtcatctgt

SEQ ID NO: 7854 - DNA, 20 bp, Artificial Sequence
  Description of Artificial Sequence: Synthetic oligonucleotide
  Target: FXN; (+) strand; PAM type: NNNNGHTT; PAM sequence: TTGGGTTT
gtttggtcatctgtagagga

SEQ ID NO: 7855 - DNA, 20 bp, Artificial Sequence
  Description of Artificial Sequence: Synthetic oligonucleotide
  Target: FXN; (+) strand; PAM type: NNNNGHTT; PAM sequence: TCTTGTTT
ctgtagaggattgggttttg

SEQ ID NO: 7856 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
gaggattgggttttgtcttg

SEQ ID NO: 7857 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
tgggttttgtcttgttttgt

SEQ ID NO: 7858 - DNA, 20 bp, Artificial Sequence
  Description of Artificial Sequence: Synthetic oligonucleotide
  Target: FXN; (+) strand; PAM type: NNNNGHTT; PAM sequence: CAAGGTTT
gtttttgttttggtgtcctg

SEQ ID NO: 7859 - DNA, 20 bp, Artificial Sequence
  Description of Artificial Sequence: Synthetic oligonucleotide
  Target: FXN; (+) strand; PAM type: NNNNGHTT; PAM sequence: CAGTGATT
ttaccccattcccttagcaa

SEQ ID NO: 7860 - DNA, 20 bp, Artificial Sequence
  Description of Artificial Sequence: Synthetic oligonucleotide
  Target: FXN; (+) strand; PAM type: NNNNGHTT; PAM sequence: GAAAGTTT
aggcacacctgtgggaatat

SEQ ID NO: 7861 - DNA, 20 bp, Artificial Sequence
  Description of Artificial Sequence: Synthetic oligonucleotide
  Target: FXN; (+) strand; PAM type: NNNNGHTT; PAM sequence: TTTGGTTT
cacctgtgggaatatgaaag

SEQ ID NO: 7862 - DNA, 20 bp, Artificial Sequence
  Description of Artificial Sequence: Synthetic oligonucleotide
  Target: FXN; (+) strand; PAM type: NNNNGHTT; PAM sequence: AAAGGATT
tatgaaagtttggtttcata

SEQ ID NO: 7863 - DNA, 20 bp, Artificial Sequence
  Description of Artificial Sequence: Synthetic oligonucleotide
  Target: FXN; (+) strand; PAM type: NNNNGHTT; PAM sequence: ACTGGATT
taataaattacctaaaacat

SEQ ID NO: 7864 - DNA, 20 bp, Artificial Sequence
  Description of Artificial Sequence: Synthetic oligonucleotide
  Target: FXN; (+) strand; PAM type: NNNNGHTT; PAM sequence: CAGAGATT
atgaaaacatcttttctgcc

SEQ ID NO: 7865 - DNA, 20 bp, Artificial Sequence
  Description of Artificial Sequence: Synthetic oligonucleotide
  Target: FXN; (+) strand; PAM type: NNNNGHTT; PAM sequence: CCTTGTTT
catggaacacataaggcata

SEQ ID NO: 7866 - DNA, 20 bp, Artificial Sequence
  Description of Artificial Sequence: Synthetic oligonucleotide
  Target: FXN; (+) strand; PAM type: NNNNGHTT; PAM sequence: TAAGGATT
tgtttctgctccatgatgtc

SEQ ID NO: 7867 - DNA, 20 bp, Artificial Sequence
  Description of Artificial Sequence: Synthetic oligonucleotide
  Target: FXN; (+) strand; PAM type: NNNNGHTT; PAM sequence: CATTGTTT
gggggcctcagctctctcta

SEQ ID NO: 7868 - DNA, 20 bp, Artificial Sequence
  Description of Artificial Sequence: Synthetic oligonucleotide
  Target: FXN; (+) strand; PAM type: NNNNGHTT; PAM sequence: GCTAGTTT
tacattgtttctctactttg

SEQ ID NO: 7869 - DNA, 20 bp, Artificial Sequence
  Description of Artificial Sequence: Synthetic oligonucleotide
  Target: FXN; (+) strand; PAM type: NNNNGHTT; PAM sequence: TTTGGATT
tgtttctctactttggctag

SEQ ID NO: 7870 - DNA, 20 bp, Artificial Sequence
  Description of Artificial Sequence: Synthetic oligonucleotide
  Target: FXN; (+) strand; PAM type: NNNNGHTT; PAM sequence: GGTTGCTT
tttgggaggctgaggtggga

SEQ ID NO: 7871 - DNA, 20 bp, Artificial Sequence
  Description of Artificial Sequence: Synthetic oligonucleotide
  Target: FXN; (+) strand; PAM type: NNNNGHTT; PAM sequence: ACTTGATT
gaggctgaggcaggaggatc

SEQ ID NO: 7872 - DNA, 20 bp, Artificial Sequence
  Description of Artificial Sequence: Synthetic oligonucleotide
  Target: FXN; (+) strand; PAM type: NNNNGHTT; PAM sequence: CTCTGTTT
gcctgggtaacagaatgaga

SEQ ID NO: 7873 - DNA, 20 bp, Artificial Sequence
  Description of Artificial Sequence: Synthetic oligonucleotide
  Target: FXN; (+) strand; PAM type: NNNNGHTT; PAM sequence: AATAGCTT
cacttgttctaggaactaca

SEQ ID NO: 7874 - DNA, 20 bp, Artificial Sequence
  Description of Artificial Sequence: Synthetic oligonucleotide
  Target: FXN; (+) strand; PAM type: NNNNGHTT; PAM sequence: GAGAGCTT
gggagagctaaggtgggcaa

SEQ ID NO: 7875 - DNA, 20 bp, Artificial Sequence
  Description of Artificial Sequence: Synthetic oligonucleotide
  Target: FXN; (+) strand; PAM type: NNNNGHTT; PAM sequence: GTTAGATT
ggtgaaagcagagggctatg

SEQ ID NO: 7876 - DNA, 20 bp, Artificial Sequence
  Description of Artificial Sequence: Synthetic oligonucleotide
  Target: FXN; (+) strand; PAM type: NNNNGHTT; PAM sequence: TTGAGATT
ggctatggttagattcacat

SEQ ID NO: 7877 - DNA, 20 bp, Artificial Sequence
  Description of Artificial Sequence: Synthetic oligonucleotide
  Target: FXN; (+) strand; PAM type: NNNNGHTT; PAM sequence: TTTAGATT
ggttagattcacatttgaga

SEQ ID NO: 7878 - DNA, 20 bp, Artificial Sequence
  Description of Artificial Sequence: Synthetic oligonucleotide
  Target: FXN; (+) strand; PAM type: NNNNGHTT; PAM sequence: TTTAGATT
tcacatttgagatttagatt

SEQ ID NO: 7879 - DNA, 20 bp, Artificial Sequence
  Description of Artificial Sequence: Synthetic oligonucleotide
  Target: FXN; (+) strand; PAM type: NNNNGHTT; PAM sequence: ACTGGCTT
aaaatgatcaccctggtgac

SEQ ID NO: 7880 - DNA, 20 bp, Artificial Sequence
  Description of Artificial Sequence: Synthetic oligonucleotide
  Target: FXN; (+) strand; PAM type: NNNNGHTT; PAM sequence: CAGTGCTT
gcccaaggcctatgctacca

SEQ ID NO: 7881 - DNA, 20 bp, Artificial Sequence
  Description of Artificial Sequence: Synthetic oligonucleotide
  Target: FXN; (+) strand; PAM type: NNNNGHTT; PAM sequence: CATGGATT
acctggaggtcttgttaaac

SEQ ID NO: 7882 - DNA, 20 bp, Artificial Sequence
  Description of Artificial Sequence: Synthetic oligonucleotide
  Target: FXN; (+) strand; PAM type: NNNNGHTT; PAM sequence: CAGAGATT
attgctgggccttgaaaccc

SEQ ID NO: 7883 - DNA, 20 bp, Artificial Sequence
  Description of Artificial Sequence: Synthetic oligonucleotide
  Target: FXN; (+) strand; PAM type: NNNNGHTT; PAM sequence: TTCTGATT
gggccttgaaaccccagaga

SEQ ID NO: 7884 - DNA, 20 bp, Artificial Sequence
  Description of Artificial Sequence: Synthetic oligonucleotide
  Target: FXN; (+) strand; PAM type: NNNNGHTT; PAM sequence: ACAAGTTT
cctgagaatttgtatttcta

SEQ ID NO: 7885 - DNA, 20 bp, Artificial Sequence
  Description of Artificial Sequence: Synthetic oligonucleotide
  Target: FXN; (+) strand; PAM type: NNNNGHTT; PAM sequence: CCCAGCTT
ctttgcccacgccacggtgc

SEQ ID NO: 7886 - DNA, 20 bp, Artificial Sequence
  Description of Artificial Sequence: Synthetic oligonucleotide
  Target: FXN; (+) strand; PAM type: NNNNGHTT; PAM sequence: GCCTGATT
cccagcttcttaccaagtgt

SEQ ID NO: 7887 - DNA, 20 bp, Artificial Sequence
  Description of Artificial Sequence: Synthetic oligonucleotide
  Target: FXN; (+) strand; PAM type: NNNNGHTT; PAM sequence: TGGAGATT
aatctcttgaacccaggagg

SEQ ID NO: 7888 - DNA, 20 bp, Artificial Sequence
  Description of Artificial Sequence: Synthetic oligonucleotide
  Target: FXN; (+) strand; PAM type: NNNNGHTT; PAM sequence: TGCAGCTT
ataataataataactaatga

SEQ ID NO: 7889 - DNA, 20 bp, Artificial Sequence
  Description of Artificial Sequence: Synthetic oligonucleotide
  Target: FXN; (+) strand; PAM type: NNNNGHTT; PAM sequence: TATGGTTT
atgcctatgggctctccctt

SEQ ID NO: 7890 - DNA, 20 bp, Artificial Sequence
  Description of Artificial Sequence: Synthetic oligonucleotide
  Target: FXN; (+) strand; PAM type: NNNNGHTT; PAM sequence: GAGGGCTT
tctccctttatggtttcaag

SEQ ID NO: 7891 - DNA, 20 bp, Artificial Sequence
  Description of Artificial Sequence: Synthetic oligonucleotide
  Target: FXN; (+) strand; PAM type: NNNNGHTT; PAM sequence: GGATGTTT
gggctgtcctgcacatcaca

SEQ ID NO: 7892 - DNA, 20 bp, Artificial Sequence
  Description of Artificial Sequence: Synthetic oligonucleotide
  Target: FXN; (+) strand; PAM type: NNNNGHTT; PAM sequence: AAATGATT
ccagatactttgcaggggga

SEQ ID NO: 7893 - DNA, 20 bp, Artificial Sequence
  Description of Artificial Sequence: Synthetic oligonucleotide
  Target: FXN; (+) strand; PAM type: NNNNGHTT; PAM sequence: CCTTGATT
cacttcttccatgaatactt

SEQ ID NO: 7894 - DNA, 20 bp, Artificial Sequence
  Description of Artificial Sequence: Synthetic oligonucleotide
  Target: FXN; (+) strand; PAM type: NNNNGHTT; PAM sequence: GTTAGTTT
cccactcaacactcacacct

SEQ ID NO: 7895 - DNA, 20 bp, Artificial Sequence
  Description of Artificial Sequence: Synthetic oligonucleotide
  Target: FXN; (+) strand; PAM type: NNNNGHTT; PAM sequence: TCACGATT
gtatgtaaacatgtctctct

SEQ ID NO: 7896 - DNA, 20 bp, Artificial Sequence
  Description of Artificial Sequence: Synthetic oligonucleotide
  Target: FXN; (+) strand; PAM type: NNNNGHTT; PAM sequence: AGTGGCTT
tctctcttcacgattcacaa

SEQ ID NO: 7897 - DNA, 20 bp, Artificial Sequence
  Description of Artificial Sequence: Synthetic oligonucleotide
  Target: FXN; (+) strand; PAM type: NNNNGHTT; PAM sequence: GATCGTTT
ttgtgaggcccaggcgggca

SEQ ID NO: 7898 - DNA, 20 bp, Artificial Sequence
  Description of Artificial Sequence: Synthetic oligonucleotide
  Target: FXN; (+) strand; PAM type: NNNNGHTT; PAM sequence: GACTGCTT
ttggaaggctgaaatgggaa

SEQ ID NO: 7899 - DNA, 20 bp, Artificial Sequence
  Description of Artificial Sequence: Synthetic oligonucleotide
  Target: FXN; (+) strand; PAM type: NNNNGHTT; PAM sequence: CAGAGCTT
aatggcgtgaaaccgggagg

SEQ ID NO: 7900 - DNA, 20 bp, Artificial Sequence
  Description of Artificial Sequence: Synthetic oligonucleotide
  Target: FXN; (+) strand; PAM type: NNNNGHTT; PAM sequence: CAGGGCTT
cctgtccaaaaaaaacttta

SEQ ID NO: 7901 - DNA, 20 bp, Artificial Sequence
  Description of Artificial Sequence: Synthetic oligonucleotide
  Target: FXN; (+) strand; PAM type: NNNNGHTT; PAM sequence: TACAGATT
cagctaggaagtgggcagag

SEQ ID NO: 7902 - DNA, 20 bp, Artificial Sequence
  Description of Artificial Sequence: Synthetic oligonucleotide
  Target: FXN; (+) strand; PAM type: NNNNGHTT; PAM sequence: TCCTGTTT
gacagcagctcccaagttcc

SEQ ID NO: 7903 - DNA, 20 bp, Artificial Sequence
  Description of Artificial Sequence: Synthetic oligonucleotide
  Target: FXN; (+) strand; PAM type: NNNNGHTT; PAM sequence: CCGTGCTT
tcaggggtcctggttgcact

SEQ ID NO: 7904 - DNA, 20 bp, Artificial Sequence
  Description of Artificial Sequence: Synthetic oligonucleotide
  Target: FXN; (+) strand; PAM type: NNNNGHTT; PAM sequence: ACTGGCTT
gttctcccggttgcatttac

SEQ ID NO: 7905 - DNA, 20 bp, Artificial Sequence
  Description of Artificial Sequence: Synthetic oligonucleotide
  Target: FXN; (+) strand; PAM type: NNNNGHTT; PAM sequence: TTCTGCTT
ccggttgcatttacactggc

SEQ ID NO: 7906 - DNA, 20 bp, Artificial Sequence
  Description of Artificial Sequence: Synthetic oligonucleotide
  Target: FXN; (+) strand; PAM type: NNNNGHTT; PAM sequence: CCATGCTT
cgaggggtgtgcggctgtct

SEQ ID NO: 7907 - DNA, 20 bp, Artificial Sequence
  Description of Artificial Sequence: Synthetic oligonucleotide
  Target: FXN; (+) strand; PAM type: NNNNGHTT; PAM sequence: ACTTGTTT
cttgtcacttctctgcgata

SEQ ID NO: 7908 - DNA, 20 bp, Artificial Sequence
  Description of Artificial Sequence: Synthetic oligonucleotide
  Target: FXN; (+) strand; PAM type: NNNNGHTT; PAM sequence: GTGTGTTT
atagcgtgtgtgttgtgtgt

SEQ ID NO: 7909 - DNA, 20 bp, Artificial Sequence
  Description of Artificial Sequence: Synthetic oligonucleotide
  Target: FXN; (+) strand; PAM type: NNNNGHTT; PAM sequence: GCTGGATT
gcacacctaatattttcaag

SEQ ID NO: 7910 - DNA, 20 bp, Artificial Sequence
  Description of Artificial Sequence: Synthetic oligonucleotide
  Target: FXN; (+) strand; PAM type: NNNNGHTT; PAM sequence: AAATGCTT
aggctggatttttttgaacg

SEQ ID NO: 7911 - DNA, 20 bp, Artificial Sequence
  Description of Artificial Sequence: Synthetic oligonucleotide
  Target: FXN; (+) strand; PAM type: NNNNGHTT; PAM sequence: CCTGGCTT
atagctagagcagcaggggc

SEQ ID NO: 7912 - DNA, 20 bp, Artificial Sequence
  Description of Artificial Sequence: Synthetic oligonucleotide
  Target: FXN; (+) strand; PAM type: NNNNGHTT; PAM sequence: TCCAGATT
gaaactgacccgacctttat

SEQ ID NO: 7913 - DNA, 20 bp, Artificial Sequence
  Description of Artificial Sequence: Synthetic oligonucleotide
  Target: FXN; (+) strand; PAM type: NNNNGHTT; PAM sequence: GGGGGATT
ccgcagagctgtgtgacctt

SEQ ID NO: 7914 - DNA, 20 bp, Artificial Sequence
  Description of Artificial Sequence: Synthetic oligonucleotide
  Target: FXN; (+) strand; PAM type: NNNNGHTT; PAM sequence: CGTGGCTT
ttcccctaacctctctgaga

SEQ ID NO: 7915 - DNA, 20 bp, Artificial Sequence
  Description of Artificial Sequence: Synthetic oligonucleotide
  Target: FXN; (+) strand; PAM type: NNNNGHTT; PAM sequence: CTTTGTTT
ctaacctctctgagacgtgg

SEQ ID NO: 7916 - DNA, 20 bp, Artificial Sequence
  Description of Artificial Sequence: Synthetic oligonucleotide
  Target: FXN; (+) strand; PAM type: NNNNGHTT; PAM sequence: TGAGGATT
cccattttgcggacctggtg

SEQ ID NO: 7917 - DNA, 20 bp, Artificial Sequence
  Description of Artificial Sequence: Synthetic oligonucleotide
  Target: FXN; (+) strand; PAM type: NNNNGHTT; PAM sequence: CACGGCTT
aatatctgacccagttacgc

SEQ ID NO: 7918 - DNA, 20 bp, Artificial Sequence
  Description of Artificial Sequence: Synthetic oligonucleotide
  Target: FXN; (+) strand; PAM type: NNNNGHTT; PAM sequence: GGAAGATT
aagaatggctgtggggatga

SEQ ID NO: 7919 - DNA, 20 bp, Artificial Sequence
  Description of Artificial Sequence: Synthetic oligonucleotide
  Target: FXN; (+) strand; PAM type: NNNNGHTT; PAM sequence: GGGTGTTT
gatgccaaggaagtggtaga

SEQ ID NO: 7920 - DNA, 20 bp, Artificial Sequence
  Description of Artificial Sequence: Synthetic oligonucleotide
  Target: FXN; (+) strand; PAM type: NNNNGHTT; PAM sequence: CGGAGTTT
gccatatttgtgttgctctc

SEQ ID NO: 7921 - DNA, 20 bp, Artificial Sequence
  Description of Artificial Sequence: Synthetic oligonucleotide
  Target: FXN; (+) strand; PAM type: NNNNGHTT; PAM sequence: TTAGGCTT
tgctctccggagtttgtact

SEQ ID NO: 7922 - DNA, 20 bp, Artificial Sequence
  Description of Artificial Sequence: Synthetic oligonucleotide
  Target: FXN; (+) strand; PAM type: NNNNGHTT; PAM sequence: TTGTGTTT
cacgtgttatttggcccaca

SEQ ID NO: 7923 - DNA, 20 bp, Artificial Sequence
  Description of Artificial Sequence: Synthetic oligonucleotide
  Target: FXN; (+) strand; PAM type: NNNNGHTT; PAM sequence: TTGGGATT
acattgtgtttgaagaaact

SEQ ID NO: 7924 - DNA, 20 bp, Artificial Sequence
  Description of Artificial Sequence: Synthetic oligonucleotide
  Target: FXN; (+) strand; PAM type: NNNNGHTT; PAM sequence: CAGTGCTT
gaaactttgggattggttgc

SEQ ID NO: 7925 - DNA, 20 bp, Artificial Sequence
  Description of Artificial Sequence: Synthetic oligonucleotide
  Target: FXN; (+) strand; PAM type: NNNNGHTT; PAM sequence: AATGGATT
ttaaaagttaggacttagaa

SEQ ID NO: 7926 - DNA, 20 bp, Artificial Sequence
  Description of Artificial Sequence: Synthetic oligonucleotide
  Target: FXN; (+) strand; PAM type: NNNNGHTT; PAM sequence: AATCGCTT
tccagaggctgcggcaggag

SEQ ID NO: 7927 - DNA, 20 bp, Artificial Sequence
  Description of Artificial Sequence: Synthetic oligonucleotide
  Target: FXN; (+) strand; PAM type: NNNNGHTT; PAM sequence: AATGGATT
taaataaaaataaaaaataa

SEQ ID NO: 7928 - DNA, 20 bp, Artificial Sequence
  Description of Artificial Sequence: Synthetic oligonucleotide
  Target: FXN; (+) strand; PAM type: NNNNGHTT; PAM sequence: CTTGGCTT
aggaaagcagacatttatta

SEQ ID NO: 7929 - DNA, 20 bp, Artificial Sequence
  Description of Artificial Sequence: Synthetic oligonucleotide
  Target: FXN; (+) strand; PAM type: NNNNGHTT; PAM sequence: TTGGGCTT
actatctgagctgccacgta

SEQ ID NO: 7930 - DNA, 20 bp, Artificial Sequence
  Description of Artificial Sequence: Synthetic oligonucleotide
  Target: FXN; (+) strand; PAM type: NNNNGHTT; PAM sequence: TTGTGTTT
agcatgggttgtcagcagag

SEQ ID NO: 7931 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
gggttgtcagcagagttgtg

SEQ ID NO: 7932 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
gtcagcagagttgtgttttg

SEQ ID NO: 7933 - DNA, 20 bp, Artificial Sequence
  Description of Artificial Sequence: Synthetic oligonucleotide
  Target: FXN; (+) strand; PAM type: NNNNGHTT; PAM sequence: CAGAGTTT
tttgttttgtttttttgaga

SEQ ID NO: 7934 - DNA, 20 bp, Artificial Sequence
  Description of Artificial Sequence: Synthetic oligonucleotide
  Target: FXN; (+) strand; PAM type: NNNNGHTT; PAM sequence: AAGTGATT
aacctctgcctcctgggttc

SEQ ID NO: 7935 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcagcctcccgagtag

SEQ ID NO: 7936 - DNA, 20 bp, Artificial Sequence
  Description of Artificial Sequence: Synthetic oligonucleotide
  Target: FXN; (+) strand; PAM type: NNNNGHTT; PAM sequence: GACAGATT
aattttgtatttttagtaga

SEQ ID NO: 7937 - DNA, 20 bp, Artificial Sequence
  Description of Artificial Sequence: Synthetic oligonucleotide
  Target: FXN; (+) strand; PAM type: NNNNGHTT; PAM sequence: CAGAGTTT
ccaccgcgtctggccatcag

SEQ ID NO: 7938 - DNA, 20 bp, Artificial Sequence
  Description of Artificial Sequence: Synthetic oligonucleotide
  Target: FXN; (+) strand; PAM type: NNNNGHTT; PAM sequence: TACAGTTT
aggagaatgacaagaggtgg

SEQ ID NO: 7939 - DNA, 20 bp, Artificial Sequence
  Description of Artificial Sequence: Synthetic oligonucleotide
  Target: FXN; (+) strand; PAM type: NNNNGHTT; PAM sequence: CTGGGTTT
tgccgcccaggaggtggaca

SEQ ID NO: 7940 - DNA, 20 bp, Artificial Sequence
  Description of Artificial Sequence: Synthetic oligonucleotide
  Target: FXN; (+) strand; PAM type: NNNNGHTT; PAM sequence: ATTTGTTT
ttctatactgaattaatcac

SEQ ID NO: 7941 - DNA, 20 bp, Artificial Sequence
  Description of Artificial Sequence: Synthetic oligonucleotide
  Target: FXN; (+) strand; PAM type: NNNNGHTT; PAM sequence: TCCTGTTT
agtggcaactggggccacca

SEQ ID NO: 7942 - DNA, 20 bp, Artificial Sequence
  Description of Artificial Sequence: Synthetic oligonucleotide
  Target: FXN; (+) strand; PAM type: NNNNGHTT; PAM sequence: CCTGGATT
tattttaaagccctgactgt

SEQ ID NO: 7943 - DNA, 20 bp, Artificial Sequence
  Description of Artificial Sequence: Synthetic oligonucleotide
  Target: FXN; (+) strand; PAM type: NNNNGHTT; PAM sequence: CCAAGATT
gaggcagaggttgcagtgag

SEQ ID NO: 7944 - DNA, 20 bp, Artificial Sequence
  Description of Artificial Sequence: Synthetic oligonucleotide
  Target: FXN; (+) strand; PAM type: NNNNGHTT; PAM sequence: GGGGGATT
ttgcagtgagccaagatttt

SEQ ID NO: 7945 - DNA, 20 bp, Artificial Sequence
  Description of Artificial Sequence: Synthetic oligonucleotide
  Target: FXN; (+) strand; PAM type: NNNNGHTT; PAM sequence: AGGAGTTT
tgggcggatcacctgaggtc

SEQ ID NO: 7946 - DNA, 20 bp, Artificial Sequence
  Description of Artificial Sequence: Synthetic oligonucleotide
  Target: FXN; (+) strand; PAM type: NNNNGHTT; PAM sequence: AATTGCTT
tcaggaggctgaggcaggat

SEQ ID NO: 7947 - DNA, 20 bp, Artificial Sequence
  Description of Artificial Sequence: Synthetic oligonucleotide
  Target: FXN; (+) strand; PAM type: NNNNGHTT; PAM sequence: AACGGCTT
cagaaccaagaatccacaga

SEQ ID NO: 7948 - DNA, 20 bp, Artificial Sequence
  Description of Artificial Sequence: Synthetic oligonucleotide
  Target: FXN; (+) strand; PAM type: NNNNGHTT; PAM sequence: CTCTGATT
tacctggaggctgggaagga

SEQ ID NO: 7949 - DNA, 20 bp, Artificial Sequence
  Description of Artificial Sequence: Synthetic oligonucleotide
  Target: FXN; (+) strand; PAM type: NNNNGHTT; PAM sequence: CTATGTTT
ctctgattccacgaggcagc

SEQ ID NO: 7950 - DNA, 20 bp, Artificial Sequence
  Description of Artificial Sequence: Synthetic oligonucleotide
  Target: FXN; (+) strand; PAM type: NNNNGHTT; PAM sequence: TAACGTTT
tgtgacaggggctgcatctt

SEQ ID NO: 7951 - DNA, 20 bp, Artificial Sequence
  Description of Artificial Sequence: Synthetic oligonucleotide
  Target: FXN; (+) strand; PAM type: NNNNGHTT; PAM sequence: GACAGCTT
gtttcctcttaaatactgga

SEQ ID NO: 7952 - DNA, 20 bp, Artificial Sequence
  Description of Artificial Sequence: Synthetic oligonucleotide
  Target: FXN; (+) strand; PAM type: NNNNGHTT; PAM sequence: TAACGTTT
atgtgacggggctgcgtctt

SEQ ID NO: 7953 - DNA, 20 bp, Artificial Sequence
  Description of Artificial Sequence: Synthetic oligonucleotide
  Target: FXN; (+) strand; PAM type: NNNNGHTT; PAM sequence: GACAGCTT
gtttcctcttaaataccgga

SEQ ID NO: 7954 - DNA, 20 bp, Artificial Sequence
  Description of Artificial Sequence: Synthetic oligonucleotide
  Target: FXN; (+) strand; PAM type: NNNNGHTT; PAM sequence: GGATGTTT
gcttcgagaaggagataact

SEQ ID NO: 7955 - DNA, 20 bp, Artificial Sequence
  Description of Artificial Sequence: Synthetic oligonucleotide
  Target: FXN; (+) strand; PAM type: NNNNGHTT; PAM sequence: TGTTGCTT
atgtttcttagtccattttc

SEQ ID NO: 7956 - DNA, 20 bp, Artificial Sequence
  Description of Artificial Sequence: Synthetic oligonucleotide
  Target: FXN; (+) strand; PAM type: NNNNGHTT; PAM sequence: ACTAGTTT
ttcttttcttataaagccta

SEQ ID NO: 7957 - DNA, 20 bp, Artificial Sequence
  Description of Artificial Sequence: Synthetic oligonucleotide
  Target: FXN; (+) strand; PAM type: NNNNGHTT; PAM sequence: AATGGATT
tgataacccattaatctatg

SEQ ID NO: 7958 - DNA, 20 bp, Artificial Sequence
  Description of Artificial Sequence: Synthetic oligonucleotide
  Target: FXN; (+) strand; PAM type: NNNNGHTT; PAM sequence: CACCGCTT
aagaaccttcatgacccagt

SEQ ID NO: 7959 - DNA, 20 bp, Artificial Sequence
  Description of Artificial Sequence: Synthetic oligonucleotide
  Target: FXN; (+) strand; PAM type: NNNNGHTT; PAM sequence: TTAAGTTT
caatactgccacatcgggaa

SEQ ID NO: 7960 - DNA, 20 bp, Artificial Sequence
  Description of Artificial Sequence: Synthetic oligonucleotide
  Target: FXN; (+) strand; PAM type: NNNNGHTT; PAM sequence: ATGAGTTT
atcgggaattaagtttcaac

SEQ ID NO: 7961 - DNA, 20 bp, Artificial Sequence
  Description of Artificial Sequence: Synthetic oligonucleotide
  Target: FXN; (+) strand; PAM type: NNNNGHTT; PAM sequence: GGCAGCTT
atccacttctgcatgccttg

SEQ ID NO: 7962 - DNA, 20 bp, Artificial Sequence
  Description of Artificial Sequence: Synthetic oligonucleotide
  Target: FXN; (+) strand; PAM type: NNNNGHTT; PAM sequence: TTTGGCTT
cacctgtgatcctatgacct

SEQ ID NO: 7963 - DNA, 20 bp, Artificial Sequence
  Description of Artificial Sequence: Synthetic oligonucleotide
  Target: FXN; (+) strand; PAM type: NNNNGHTT; PAM sequence: ACAAGTTT
ttgtcttgcagacaatttac

SEQ ID NO: 7964 - DNA, 20 bp, Artificial Sequence
  Description of Artificial Sequence: Synthetic oligonucleotide
  Target: FXN; (+) strand; PAM type: NNNNGHTT; PAM sequence: CAGAGCTT
aatggcgtgaacccgggagg

SEQ ID NO: 7965 - DNA, 20 bp, Artificial Sequence
  Description of Artificial Sequence: Synthetic oligonucleotide
  Target: FXN; (+) strand; PAM type: NNNNGHTT; PAM sequence: TACTGCTT
aataaataaataaatattta

SEQ ID NO: 7966 - DNA, 20 bp, Artificial Sequence
  Description of Artificial Sequence: Synthetic oligonucleotide
  Target: FXN; (+) strand; PAM type: NNNNGHTT; PAM sequence: GCATGTTT
aataataaatgctatggtct

SEQ ID NO: 7967 - DNA, 20 bp, Artificial Sequence
  Description of Artificial Sequence: Synthetic oligonucleotide
  Target: FXN; (+) strand; PAM type: NNNNGHTT; PAM sequence: ATATGATT
gaggtatgagggtggagccc

SEQ ID NO: 7968 - DNA, 20 bp, Artificial Sequence
  Description of Artificial Sequence: Synthetic oligonucleotide
  Target: FXN; (+) strand; PAM type: NNNNGHTT; PAM sequence: TTGGGATT
tgagggtggagcccatatga

SEQ ID NO: 7969 - DNA, 20 bp, Artificial Sequence
  Description of Artificial Sequence: Synthetic oligonucleotide
  Target: FXN; (+) strand; PAM type: NNNNGHTT; PAM sequence: CTTGGATT
aaagctgttggtgcattgat

SEQ ID NO: 7970 - DNA, 20 bp, Artificial Sequence
  Description of Artificial Sequence: Synthetic oligonucleotide
  Target: FXN; (+) strand; PAM type: NNNNGHTT; PAM sequence: TATTGTTT
gactctaagaaacacatttc

SEQ ID NO: 7971 - DNA, 20 bp, Artificial Sequence
  Description of Artificial Sequence: Synthetic oligonucleotide
  Target: FXN; (+) strand; PAM type: NNNNGHTT; PAM sequence: ATTTGTTT
acaccaggttaagagataga

SEQ ID NO: 7972 - DNA, 20 bp, Artificial Sequence
  Description of Artificial Sequence: Synthetic oligonucleotide
  Target: FXN; (+) strand; PAM type: NNNNGHTT; PAM sequence: TAGAGTTT
tcatcgtaccctccttttct

SEQ ID NO: 7973 - DNA, 20 bp, Artificial Sequence
  Description of Artificial Sequence: Synthetic oligonucleotide
  Target: FXN; (+) strand; PAM type: NNNNGHTT; PAM sequence: TATTGCTT
tgtatctcccccaatccatg

SEQ ID NO: 7974 - DNA, 20 bp, Artificial Sequence
  Description of Artificial Sequence: Synthetic oligonucleotide
  Target: FXN; (+) strand; PAM type: NNNNGHTT; PAM sequence: TATGGCTT
ttctgctgtatctgttctgc

SEQ ID NO: 7975 - DNA, 20 bp, Artificial Sequence
  Description of Artificial Sequence: Synthetic oligonucleotide
  Target: FXN; (+) strand; PAM type: NNNNGHTT; PAM sequence: CACTGTTT
ggcttgccccttttgttcaa

SEQ ID NO: 7976 - DNA, 20 bp, Artificial Sequence
  Description of Artificial Sequence: Synthetic oligonucleotide
  Target: FXN; (+) strand; PAM type: NNNNGHTT; PAM sequence: GGTTGATT
ggttcctttaggtgacattt

SEQ ID NO: 7977 - DNA, 20 bp, Artificial Sequence
  Description of Artificial Sequence: Synthetic oligonucleotide
  Target: FXN; (+) strand; PAM type: NNNNGHTT; PAM sequence: TCCTGATT
cctcccctgcgaggtatggg

SEQ ID NO: 7978 - DNA, 20 bp, Artificial Sequence
  Description of Artificial Sequence: Synthetic oligonucleotide
  Target: FXN; (+) strand; PAM type: NNNNGHTT; PAM sequence: TGTGGTTT
ctgattcactcttcaagtgc

SEQ ID NO: 7979 - DNA, 20 bp, Artificial Sequence
  Description of Artificial Sequence: Synthetic oligonucleotide
  Target: FXN; (+) strand; PAM type: NNNNGHTT; PAM sequence: CAATGATT
agtccttaccagggggtagg

SEQ ID NO: 7980 - DNA, 20 bp, Artificial Sequence
  Description of Artificial Sequence: Synthetic oligonucleotide
  Target: FXN; (+) strand; PAM type: NNNNGHTT; PAM sequence: GGTGGCTT
agagggagacatggctgcca

SEQ ID NO: 7981 - DNA, 20 bp, Artificial Sequence
  Description of Artificial Sequence: Synthetic oligonucleotide
  Target: FXN; (+) strand; PAM type: NNNNGHTT; PAM sequence: GGTGGCTT
cactcatcatggccaggtgc

SEQ ID NO: 7982 - DNA, 20 bp, Artificial Sequence
  Description of Artificial Sequence: Synthetic oligonucleotide
  Target: FXN; (+) strand; PAM type: NNNNGHTT; PAM sequence: CCTAGATT
gaggcggaggttgcaataag

SEQ ID NO: 7983 - DNA, 20 bp, Artificial Sequence
  Description of Artificial Sequence: Synthetic oligonucleotide
  Target: FXN; (+) strand; PAM type: NNNNGHTT; PAM sequence: CCAAGCTT
tcatcctatgaccttgacct

SEQ ID NO: 7984 - DNA, 20 bp, Artificial Sequence
  Description of Artificial Sequence: Synthetic oligonucleotide
  Target: FXN; (+) strand; PAM type: NNNNGHTT; PAM sequence: GGAAGTTT
agcctcccttaggcagaggc

SEQ ID NO: 7985 - DNA, 20 bp, Artificial Sequence
  Description of Artificial Sequence: Synthetic oligonucleotide
  Target: FXN; (+) strand; PAM type: NNNNGHTT; PAM sequence: TCTTGTTT
tacttggggtatttctgttc

SEQ ID NO: 7986 - DNA, 20 bp, Artificial Sequence
  Description of Artificial Sequence: Synthetic oligonucleotide
  Target: FXN; (+) strand; PAM type: NNNNGHTT; PAM sequence: TGAGGTTT
ttgttttatgctcacggttg

SEQ ID NO: 7987 - DNA, 20 bp, Artificial Sequence
  Description of Artificial Sequence: Synthetic oligonucleotide
  Target: FXN; (+) strand; PAM type: NNNNGHTT; PAM sequence: AAAGGTTT
aggagtaaactgaggttcca

SEQ ID NO: 7988 - DNA, 20 bp, Artificial Sequence
  Description of Artificial Sequence: Synthetic oligonucleotide
  Target: FXN; (+) strand; PAM type: NNNNGHTT; PAM sequence: TTATGATT
tatttggcaacggttctttt

SEQ ID NO: 7989 - DNA, 20 bp, Artificial Sequence
  Description of Artificial Sequence: Synthetic oligonucleotide
  Target: FXN; (+) strand; PAM type: NNNNGHTT; PAM sequence: TAAGGTTT
gtatcagcgactaagacaac

SEQ ID NO: 7990 - DNA, 20 bp, Artificial Sequence
  Description of Artificial Sequence: Synthetic oligonucleotide
  Target: FXN; (+) strand; PAM type: NNNNGHTT; PAM sequence: GGATGTTT
attctcagacacttttcctt

SEQ ID NO: 7991 - DNA, 20 bp, Artificial Sequence
  Description of Artificial Sequence: Synthetic oligonucleotide
  Target: FXN; (+) strand; PAM type: NNNNGHTT; PAM sequence: CACTGCTT
ttttccttggatgttttgag

SEQ ID NO: 7992 - DNA, 20 bp, Artificial Sequence
  Description of Artificial Sequence: Synthetic oligonucleotide
  Target: FXN; (+) strand; PAM type: NNNNGHTT; PAM sequence: GACAGCTT
gtgcacagactctggggcca

SEQ ID NO: 7993 - DNA, 20 bp, Artificial Sequence
  Description of Artificial Sequence: Synthetic oligonucleotide
  Target: FXN; (+) strand; PAM type: NNNNGHTT; PAM sequence: GTCAGTTT
ggcaagttaccctttggtgc

SEQ ID NO: 7994 - DNA, 20 bp, Artificial Sequence
  Description of Artificial Sequence: Synthetic oligonucleotide
  Target: FXN; (+) strand; PAM type: NNNNGHTT; PAM sequence: GGTCGTTT
cagtacccctagccttttgg

SEQ ID NO: 7995 - DNA, 20 bp, Artificial Sequence
  Description of Artificial Sequence: Synthetic oligonucleotide
  Target: FXN; (+) strand; PAM type: NNNNGHTT; PAM sequence: GTCTGATT
taaactgtgtccttttcaca

SEQ ID NO: 7996 - DNA, 20 bp, Artificial Sequence
  Description of Artificial Sequence: Synthetic oligonucleotide
  Target: FXN; (+) strand; PAM type: NNNNGHTT; PAM sequence: CCATGTTT
ttttcacagtctgattagtg

SEQ ID NO: 7997 - DNA, 20 bp, Artificial Sequence
  Description of Artificial Sequence: Synthetic oligonucleotide
  Target: FXN; (+) strand; PAM type: NNNNGHTT; PAM sequence: TTCAGATT
gtctgattagtgccatgttt

SEQ ID NO: 7998 - DNA, 20 bp, Artificial Sequence
  Description of Artificial Sequence: Synthetic oligonucleotide
  Target: FXN; (+) strand; PAM type: NNNNGHTT; PAM sequence: TTATGCTT
gtgccatgtttttcagattt

SEQ ID NO: 7999 - DNA, 20 bp, Artificial Sequence
  Description of Artificial Sequence: Synthetic oligonucleotide
  Target: FXN; (+) strand; PAM type: NNNNGHTT; PAM sequence: CAAAGTTT
aattgtctccaagtgtagtg

SEQ ID NO: 8000 - DNA, 20 bp, Artificial Sequence
  Description of Artificial Sequence: Synthetic oligonucleotide
  Target: FXN; (+) strand; PAM type: NNNNGHTT; PAM sequence: AGAAGCTT
agagaaaatgcatgtgttag

SEQ ID NO: 8001 - DNA, 20 bp, Artificial Sequence
  Description of Artificial Sequence: Synthetic oligonucleotide
  Target: FXN; (+) strand; PAM type: NNNNGHTT; PAM sequence: TGTTGTTT
atcaattaatttgttgttgt

SEQ ID NO: 8002 - DNA, 20 bp, Artificial Sequence
  Description of Artificial Sequence: Synthetic oligonucleotide
  Target: FXN; (+) strand; PAM type: NNNNGHTT; PAM sequence: TAATGTTT
tacaccccaccacacccaga

SEQ ID NO: 8003 - DNA, 20 bp, Artificial Sequence
  Description of Artificial Sequence: Synthetic oligonucleotide
  Target: FXN; (+) strand; PAM type: NNNNGHTT; PAM sequence: CCCGGATT
gctcactgcaacctccacct

SEQ ID NO: 8004 - DNA, 20 bp, Artificial Sequence
  Description of Artificial Sequence: Synthetic oligonucleotide
  Target: FXN; (+) strand; PAM type: NNNNGHTT; PAM sequence: CACAGATT
tgcctcagcctcctgagtag

SEQ ID NO: 8005 - DNA, 20 bp, Artificial Sequence
  Description of Artificial Sequence: Synthetic oligonucleotide
  Target: FXN; (+) strand; PAM type: NNNNGHTT; PAM sequence: TTGTGTTT
tcatcacgccttgctaattt

SEQ ID NO: 8006 - DNA, 20 bp, Artificial Sequence
  Description of Artificial Sequence: Synthetic oligonucleotide
  Target: FXN; (+) strand; PAM type: NNNNGHTT; PAM sequence: CGGGGTTT
ttttgtgtttttagtagagg

SEQ ID NO: 8007 - DNA, 20 bp, Artificial Sequence
  Description of Artificial Sequence: Synthetic oligonucleotide
  Target: FXN; (+) strand; PAM type: NNNNGHTT; PAM sequence: CAGAGATT
cgcctccgcctcccaaactg

SEQ ID NO: 8008 - DNA, 20 bp, Artificial Sequence
  Description of Artificial Sequence: Synthetic oligonucleotide
  Target: FXN; (+) strand; PAM type: NNNNGHTT; PAM sequence: TCATGTTT
acgaaccacaatgcccggcc

SEQ ID NO: 8009 - DNA, 20 bp, Artificial Sequence
  Description of Artificial Sequence: Synthetic oligonucleotide
  Target: FXN; (+) strand; PAM type: NNNNGHTT; PAM sequence: CGGGGATT
caccttggcctcccaaagtg

SEQ ID NO: 8010 - DNA, 20 bp, Artificial Sequence
  Description of Artificial Sequence: Synthetic oligonucleotide
  Target: FXN; (+) strand; PAM type: NNNNGHTT; PAM sequence: GATCGATT
cagaaataaggttatatatt

SEQ ID NO: 8011 - DNA, 20 bp, Artificial Sequence
  Description of Artificial Sequence: Synthetic oligonucleotide
  Target: FXN; (+) strand; PAM type: NNNNGHTT; PAM sequence: AGCAGCTT
ttggtaacaatgttgtgacc

SEQ ID NO: 8012 - DNA, 20 bp, Artificial Sequence
  Description of Artificial Sequence: Synthetic oligonucleotide
  Target: FXN; (+) strand; PAM type: NNNNGHTT; PAM sequence: GAGTGTTT
ctataaataatttgctcgtt

SEQ ID NO: 8013 - DNA, 20 bp, Artificial Sequence
  Description of Artificial Sequence: Synthetic oligonucleotide
  Target: FXN; (+) strand; PAM type: NNNNGHTT; PAM sequence: ACAGGATT
gtaataagagtacgtccctc

SEQ ID NO: 8014 - DNA, 20 bp, Artificial Sequence
  Description of Artificial Sequence: Synthetic oligonucleotide
  Target: FXN; (+) strand; PAM type: NNNNGHTT; PAM sequence: ATGTGTTT
cctctcacttcttcagagac

SEQ ID NO: 8015 - DNA, 20 bp, Artificial Sequence
  Description of Artificial Sequence: Synthetic oligonucleotide
  Target: FXN; (+) strand; PAM type: NNNNGHTT; PAM sequence: GCCCGTTT
tccccatccactgtccccca

SEQ ID NO: 8016 - DNA, 20 bp, Artificial Sequence
  Description of Artificial Sequence: Synthetic oligonucleotide
  Target: FXN; (+) strand; PAM type: NNNNGHTT; PAM sequence: CTGAGTTT
tgccttctgccttctctttt

SEQ ID NO: 8017 - DNA, 20 bp, Artificial Sequence
  Description of Artificial Sequence: Synthetic oligonucleotide
  Target: FXN; (+) strand; PAM type: NNNNGHTT; PAM sequence: GTCTGATT
cttgtgccccagtggctctt

SEQ ID NO: 8018 - DNA, 20 bp, Artificial Sequence
  Description of Artificial Sequence: Synthetic oligonucleotide
  Target: FXN; (+) strand; PAM type: NNNNGHTT; PAM sequence: GCAGGATT
gccaaatcttctggacttca

SEQ ID NO: 8019 - DNA, 20 bp, Artificial Sequence
  Description of Artificial Sequence: Synthetic oligonucleotide
  Target: FXN; (+) strand; PAM type: NNNNGHTT; PAM sequence: ACAGGATT
accactagccacatgtggcc

SEQ ID NO: 8020 - DNA, 20 bp, Artificial Sequence
  Description of Artificial Sequence: Synthetic oligonucleotide
  Target: FXN; (+) strand; PAM type: NNNNGHTT; PAM sequence: TGTGGCTT
tttaaatgtaaatagctacg

SEQ ID NO: 8021 - DNA, 20 bp, Artificial Sequence
  Description of Artificial Sequence: Synthetic oligonucleotide
  Target: FXN; (+) strand; PAM type: NNNNGHTT; PAM sequence: ACGGGCTT
tggctagcctattggaaaac

SEQ ID NO: 8022 - DNA, 20 bp, Artificial Sequence
  Description of Artificial Sequence: Synthetic oligonucleotide
  Target: FXN; (+) strand; PAM type: NNNNGHTT; PAM sequence: GCATGATT
aaccaaaaaaaaaaacttca

SEQ ID NO: 8023 - DNA, 20 bp, Artificial Sequence
  Description of Artificial Sequence: Synthetic oligonucleotide
  Target: FXN; (+) strand; PAM type: NNNNGHTT; PAM sequence: ACTAGCTT
aaaagtgaatttactccgaa

SEQ ID NO: 8024 - DNA, 20 bp, Artificial Sequence
  Description of Artificial Sequence: Synthetic oligonucleotide
  Target: FXN; (+) strand; PAM type: NNNNGHTT; PAM sequence: TGCTGCTT
atcctgcctttctttaaaag

SEQ ID NO: 8025 - DNA, 20 bp, Artificial Sequence
  Description of Artificial Sequence: Synthetic oligonucleotide
  Target: FXN; (+) strand; PAM type: NNNNGHTT; PAM sequence: GCATGCTT
ctgtagcagtggccaagtgg

SEQ ID NO: 8026 - DNA, 20 bp, Artificial Sequence
  Description of Artificial Sequence: Synthetic oligonucleotide
  Target: FXN; (+) strand; PAM type: NNNNGHTT; PAM sequence: ATGGGTTT
ctggaggtgaaagttccgtg

SEQ ID NO: 8027 - DNA, 20 bp, Artificial Sequence
  Description of Artificial Sequence: Synthetic oligonucleotide
  Target: FXN; (+) strand; PAM type: NNNNGHTT; PAM sequence: GTTTGCTT
aggtgaaagttccgtgatgg

SEQ ID NO: 8028 - DNA, 20 bp, Artificial Sequence
  Description of Artificial Sequence: Synthetic oligonucleotide
  Target: FXN; (+) strand; PAM type: NNNNGHTT; PAM sequence: AAAAGCTT
ctggaagagcatacagttag

SEQ ID NO: 8029 - DNA, 20 bp, Artificial Sequence
  Description of Artificial Sequence: Synthetic oligonucleotide
  Target: FXN; (+) strand; PAM type: NNNNGHTT; PAM sequence: TTTGGCTT
atagtaacgtacttcttaac

SEQ ID NO: 8030 - DNA, 20 bp, Artificial Sequence
  Description of Artificial Sequence: Synthetic oligonucleotide
  Target: FXN; (+) strand; PAM type: NNNNGHTT; PAM sequence: ACCAGATT
ttcgaaccaacgtggcctca

SEQ ID NO: 8031 - DNA, 20 bp, Artificial Sequence
  Description of Artificial Sequence: Synthetic oligonucleotide
  Target: FXN; (+) strand; PAM type: NNNNGHTT; PAM sequence: CCTGGTTT
ccctgcctctcccattagaa

SEQ ID NO: 8032 - DNA, 20 bp, Artificial Sequence
  Description of Artificial Sequence: Synthetic oligonucleotide
  Target: FXN; (+) strand; PAM type: NNNNGHTT; PAM sequence: ATTAGATT
attatttttaatgaaatagt

SEQ ID NO: 8033 - DNA, 20 bp, Artificial Sequence
  Description of Artificial Sequence: Synthetic oligonucleotide
  Target: FXN; (+) strand; PAM type: NNNNGHTT; PAM sequence: GGTTGTTT
cccctactgttggacattca

SEQ ID NO: 8034 - DNA, 20 bp, Artificial Sequence
  Description of Artificial Sequence: Synthetic oligonucleotide
  Target: FXN; (+) strand; PAM type: NNNNGHTT; PAM sequence: CAGAGTTT
ttggacattcaggttgtttc

SEQ ID NO: 8035 - DNA, 20 bp, Artificial Sequence
  Description of Artificial Sequence: Synthetic oligonucleotide
  Target: FXN; (+) strand; PAM type: NNNNGHTT; PAM sequence: TAACGTTT
tatttaatagctcaaaccaa

SEQ ID NO: 8036 - DNA, 20 bp, Artificial Sequence
  Description of Artificial Sequence: Synthetic oligonucleotide
  Target: FXN; (+) strand; PAM type: NNNNGHTT; PAM sequence: TCCAGCTT
gaattaggaactacactcat

SEQ ID NO: 8037 - DNA, 20 bp, Artificial Sequence
  Description of Artificial Sequence: Synthetic oligonucleotide
  Target: FXN; (+) strand; PAM type: NNNNGHTT; PAM sequence: TCCAGTTT
gaactacactcattccagct

SEQ ID NO: 8038 - DNA, 20 bp, Artificial Sequence
  Description of Artificial Sequence: Synthetic oligonucleotide
  Target: FXN; (+) strand; PAM type: NNNNGHTT; PAM sequence: CCAAGATT
caccacagccacctccgagt

SEQ ID NO: 8039 - DNA, 20 bp, Artificial Sequence
  Description of Artificial Sequence: Synthetic oligonucleotide
  Target: FXN; (+) strand; PAM type: NNNNGHTT; PAM sequence: CCCAGCTT
tgacatgcagtctcctctct

SEQ ID NO: 8040 - DNA, 20 bp, Artificial Sequence
  Description of Artificial Sequence: Synthetic oligonucleotide
  Target: FXN; (+) strand; PAM type: NNNNGHTT; PAM sequence: AATGGCTT
tcctctctcccagctttagg

SEQ ID NO: 8041 - DNA, 20 bp, Artificial Sequence
  Description of Artificial Sequence: Synthetic oligonucleotide
  Target: FXN; (+) strand; PAM type: NNNNGHTT; PAM sequence: CCCTGCTT
gagcatgttcctccacaaat

SEQ ID NO: 8042 - DNA, 20 bp, Artificial Sequence
  Description of Artificial Sequence: Synthetic oligonucleotide
  Target: FXN; (+) strand; PAM type: NNNNGHTT; PAM sequence: AACAGTTT
acagcccacttcctgctaat

SEQ ID NO: 8043 - DNA, 20 bp, Artificial Sequence
  Description of Artificial Sequence: Synthetic oligonucleotide
  Target: FXN; (+) strand; PAM type: NNNNGHTT; PAM sequence: GGGTGTTT
taacagtttggggttccaca

SEQ ID NO: 8044 - DNA, 20 bp, Artificial Sequence
  Description of Artificial Sequence: Synthetic oligonucleotide
  Target: FXN; (+) strand; PAM type: NNNNGHTT; PAM sequence: CGGGGTTT
ttttgtatttttagtaaaga

SEQ ID NO: 8045 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
cgcctcggcctcccaaagtg

SEQ ID NO: 8046 - DNA, 20 bp, Artificial Sequence
  Description of Artificial Sequence: Synthetic oligonucleotide
  Target: FXN; (+) strand; PAM type: NNNNGHTT; PAM sequence: GTAGGCTT
agactcatttttctttgaga

SEQ ID NO: 8047 - DNA, 20 bp, Artificial Sequence
  Description of Artificial Sequence: Synthetic oligonucleotide
  Target: FXN; (+) strand; PAM type: NNNNGHTT; PAM sequence: GTAGGCTT
agagtaggcttttcccaaaa

SEQ ID NO: 8048 - DNA, 20 bp, Artificial Sequence
  Description of Artificial Sequence: Synthetic oligonucleotide
  Target: FXN; (+) strand; PAM type: NNNNGHTT; PAM sequence: ATAAGATT
ccttgaagtcaagttaaaca

SEQ ID NO: 8049 - DNA, 20 bp, Artificial Sequence
  Description of Artificial Sequence: Synthetic oligonucleotide
  Target: FXN; (+) strand; PAM type: NNNNGHTT; PAM sequence: CCTGGTTT
gagaccagcaatgccctcag

SEQ ID NO: 8050 - DNA, 20 bp, Artificial Sequence
  Description of Artificial Sequence: Synthetic oligonucleotide
  Target: FXN; (+) strand; PAM type: NNNNGHTT; PAM sequence: CCTTGTTT
ttttgcagcaggactgagtc

SEQ ID NO: 8051 - DNA, 20 bp, Artificial Sequence
  Description of Artificial Sequence: Synthetic oligonucleotide
  Target: FXN; (+) strand; PAM type: NNNNGHTT; PAM sequence: CTTAGCTT
aagtctttgctgttcaaagc

SEQ ID NO: 8052 - DNA, 20 bp, Artificial Sequence
  Description of Artificial Sequence: Synthetic oligonucleotide
  Target: FXN; (+) strand; PAM type: NNNNGHTT; PAM sequence: AATCGCTT
tcgggagcctgaggcaggag

SEQ ID NO: 8053 - DNA, 20 bp, Artificial Sequence
  Description of Artificial Sequence: Synthetic oligonucleotide
  Target: FXN; (+) strand; PAM type: NNNNGHTT; PAM sequence: CTTAGATT
aaaaaagaaaaaaaaaaggc

SEQ ID NO: 8054 - DNA, 20 bp, Artificial Sequence
  Description of Artificial Sequence: Synthetic oligonucleotide
  Target: FXN; (+) strand; PAM type: NNNNGHTT; PAM sequence: CCACGTTT
tagattctccctttgacttt

SEQ ID NO: 8055 - DNA, 20 bp, Artificial Sequence
  Description of Artificial Sequence: Synthetic oligonucleotide
  Target: FXN; (+) strand; PAM type: NNNNGHTT; PAM sequence: CCTGGCTT
tgctccatttcattccatct

SEQ ID NO: 8056 - DNA, 20 bp, Artificial Sequence
  Description of Artificial Sequence: Synthetic oligonucleotide
  Target: FXN; (+) strand; PAM type: NNNNGHTT; PAM sequence: CTCAGATT
gccctccaggttatctgaga

SEQ ID NO: 8057 - DNA, 20 bp, Artificial Sequence
  Description of Artificial Sequence: Synthetic oligonucleotide
  Target: FXN; (+) strand; PAM type: NNNNGHTT; PAM sequence: GAGGGCTT
atctgagactcagatttcca

SEQ ID NO: 8058 - DNA, 20 bp, Artificial Sequence
  Description of Artificial Sequence: Synthetic oligonucleotide
  Target: FXN; (+) strand; PAM type: NNNNGHTT; PAM sequence: GCATGTTT
tcaaagaggcactgcatgct

SEQ ID NO: 8059 - DNA, 20 bp, Artificial Sequence
  Description of Artificial Sequence: Synthetic oligonucleotide
  Target: FXN; (+) strand; PAM type: NNNNGHTT; PAM sequence: TGAGGTTT
ggcactgcatgctgcatgtt

SEQ ID NO: 8060 - DNA, 20 bp, Artificial Sequence
  Description of Artificial Sequence: Synthetic oligonucleotide
  Target: FXN; (+) strand; PAM type: NNNNGHTT; PAM sequence: TTTTGCTT
gcatgctgcatgtttgaggt

SEQ ID NO: 8061 - DNA, 20 bp, Artificial Sequence
  Description of Artificial Sequence: Synthetic oligonucleotide
  Target: FXN; (+) strand; PAM type: NNNNGHTT; PAM sequence: CTCGGCTT
tggtggcatccatttccagc

SEQ ID NO: 8062 - DNA, 20 bp, Artificial Sequence
  Description of Artificial Sequence: Synthetic oligonucleotide
  Target: FXN; (+) strand; PAM type: NNNNGHTT; PAM sequence: TGCTGCTT
tcctcccccagcagactctc

SEQ ID NO: 8063 - DNA, 20 bp, Artificial Sequence
  Description of Artificial Sequence: Synthetic oligonucleotide
  Target: FXN; (+) strand; PAM type: NNNNGHTT; PAM sequence: GCCCGCTT
ctgccatgtgtaggaagaca

SEQ ID NO: 8064 - DNA, 20 bp, Artificial Sequence
  Description of Artificial Sequence: Synthetic oligonucleotide
  Target: FXN; (+) strand; PAM type: NNNNGHTT; PAM sequence: TTACGTTT
gtataaagtcggttgtgtcc

SEQ ID NO: 8065 - DNA, 20 bp, Artificial Sequence
  Description of Artificial Sequence: Synthetic oligonucleotide
  Target: FXN; (+) strand; PAM type: NNNNGHTT; PAM sequence: GGATGTTT
gggcacaaaagctcttacaa

SEQ ID NO: 8066 - DNA, 20 bp, Artificial Sequence
  Description of Artificial Sequence: Synthetic oligonucleotide
  Target: FXN; (+) strand; PAM type: NNNNGHTT; PAM sequence: AAGGGTTT
cattttaaaatgtataatgc

SEQ ID NO: 8067 - DNA, 20 bp, Artificial Sequence
  Description of Artificial Sequence: Synthetic oligonucleotide
  Target: FXN; (+) strand; PAM type: NNNNGHTT; PAM sequence: ACAAGATT
caagggtttttagtatattc

SEQ ID NO: 8068 - DNA, 20 bp, Artificial Sequence
  Description of Artificial Sequence: Synthetic oligonucleotide
  Target: FXN; (+) strand; PAM type: NNNNGHTT; PAM sequence: TGTGGATT
actaatctactttctgtctc

SEQ ID NO: 8069 - DNA, 20 bp, Artificial Sequence
  Description of Artificial Sequence: Synthetic oligonucleotide
  Target: FXN; (+) strand; PAM type: NNNNGHTT; PAM sequence: TACAGCTT
aatgtatctagtcacaagca

SEQ ID NO: 8070 - DNA, 20 bp, Artificial Sequence
  Description of Artificial Sequence: Synthetic oligonucleotide
  Target: FXN; (+) strand; PAM type: NNNNGHTT; PAM sequence: TTCTGATT
ttaacccttcagagtaacta

SEQ ID NO: 8071 - DNA, 20 bp, Artificial Sequence
  Description of Artificial Sequence: Synthetic oligonucleotide
  Target: FXN; (+) strand; PAM type: NNNNGHTT; PAM sequence: CATAGATT
actattctgattaccaatag

SEQ ID NO: 8072 - DNA, 20 bp, Artificial Sequence
  Description of Artificial Sequence: Synthetic oligonucleotide
  Target: FXN; (+) strand; PAM type: NNNNGHTT; PAM sequence: TGTTGTTT
tagcatagattagttctgcc

SEQ ID NO: 8073 - DNA, 20 bp, Artificial Sequence
  Description of Artificial Sequence: Synthetic oligonucleotide
  Target: FXN; (+) strand; PAM type: NNNNGHTT; PAM sequence: ACATGTTT
aactgtctcattaagtataa

SEQ ID NO: 8074 - DNA, 20 bp, Artificial Sequence
  Description of Artificial Sequence: Synthetic oligonucleotide
  Target: FXN; (+) strand; PAM type: NNNNGHTT; PAM sequence: TGATGTTT
tgtatttctttctatcacaa

SEQ ID NO: 8075 - DNA, 20 bp, Artificial Sequence
  Description of Artificial Sequence: Synthetic oligonucleotide
  Target: FXN; (+) strand; PAM type: NNNNGHTT; PAM sequence: GTGAGATT
tttctatcacaatgatgttt

SEQ ID NO: 8076 - DNA, 20 bp, Artificial Sequence
  Description of Artificial Sequence: Synthetic oligonucleotide
  Target: FXN; (+) strand; PAM type: NNNNGHTT; PAM sequence: GGCAGTTT
atattacaaaggaatacttg

SEQ ID NO: 8077 - DNA, 20 bp, Artificial Sequence
  Description of Artificial Sequence: Synthetic oligonucleotide
  Target: FXN; (+) strand; PAM type: NNNNGHTT; PAM sequence: TCCAGTTT
aaaggaatacttgggcagtt

SEQ ID NO: 8078 - DNA, 20 bp, Artificial Sequence
  Description of Artificial Sequence: Synthetic oligonucleotide
  Target: FXN; (+) strand; PAM type: NNNNGHTT; PAM sequence: CGGAGCTT
aatggcgtgaacccgggagg

SEQ ID NO: 8079 - DNA, 20 bp, Artificial Sequence
  Description of Artificial Sequence: Synthetic oligonucleotide
  Target: FXN; (+) strand; PAM type: NNNNGHTT; PAM sequence: GCTTGCTT
gcgtgaacccgggaggcgga

SEQ ID NO: 8080 - DNA, 20 bp, Artificial Sequence
  Description of Artificial Sequence: Synthetic oligonucleotide
  Target: FXN; (+) strand; PAM type: NNNNGHTT; PAM sequence: AACAGTTT
aactttagtagatactgtcc

SEQ ID NO: 8081 - DNA, 20 bp, Artificial Sequence
  Description of Artificial Sequence: Synthetic oligonucleotide
  Target: FXN; (+) strand; PAM type: NNNNGHTT; PAM sequence: AAGTGATT
tactgtccaacagttttcca

SEQ ID NO: 8082 - DNA, 20 bp, Artificial Sequence
  Description of Artificial Sequence: Synthetic oligonucleotide
  Target: FXN; (+) strand; PAM type: NNNNGHTT; PAM sequence: AGTTGCTT
cagcagtatctgaaaagtct

SEQ ID NO: 8083 - DNA, 20 bp, Artificial Sequence
  Description of Artificial Sequence: Synthetic oligonucleotide
  Target: FXN; (+) strand; PAM type: NNNNGHTT; PAM sequence: TGGAGTTT
ctctttttttttttttgaga

SEQ ID NO: 8084 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcagcctcccgagtag

SEQ ID NO: 8085 - DNA, 20 bp, Artificial Sequence
  Description of Artificial Sequence: Synthetic oligonucleotide
  Target: FXN; (+) strand; PAM type: NNNNGHTT; PAM sequence: CAGGGTTT
ttttgtatttttagtagaga

SEQ ID NO: 8086 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
cgcctcggcctcccgaagtg

SEQ ID NO: 8087 - DNA, 20 bp, Artificial Sequence
  Description of Artificial Sequence: Synthetic oligonucleotide
  Target: FXN; (+) strand; PAM type: NNNNGHTT; PAM sequence: CAGGGTTT
attttattttactttaaaga

SEQ ID NO: 8088 - DNA, 20 bp, Artificial Sequence
  Description of Artificial Sequence: Synthetic oligonucleotide
  Target: FXN; (+) strand; PAM type: NNNNGHTT; PAM sequence: CTCAGATT
agagacggggtctctgttgt

SEQ ID NO: 8089 - DNA, 20 bp, Artificial Sequence
  Description of Artificial Sequence: Synthetic oligonucleotide
  Target: FXN; (+) strand; PAM type: NNNNGHTT; PAM sequence: ATTAGATT
tttagatacagaaaattcta

SEQ ID NO: 8090 - DNA, 20 bp, Artificial Sequence
  Description of Artificial Sequence: Synthetic oligonucleotide
  Target: FXN; (+) strand; PAM type: NNNNGHTT; PAM sequence: TCTTGCTT
gaacacaaaatacaggtgaa

SEQ ID NO: 8091 - DNA, 20 bp, Artificial Sequence
  Description of Artificial Sequence: Synthetic oligonucleotide
  Target: FXN; (+) strand; PAM type: NNNNGHTT; PAM sequence: AATAGATT
taaatattaaaaaaatctcc

SEQ ID NO: 8092 - DNA, 20 bp, Artificial Sequence
  Description of Artificial Sequence: Synthetic oligonucleotide
  Target: FXN; (+) strand; PAM type: NNNNGHTT; PAM sequence: AACTGTTT
agcatttactgaatcagaat

SEQ ID NO: 8093 - DNA, 20 bp, Artificial Sequence
  Description of Artificial Sequence: Synthetic oligonucleotide
  Target: FXN; (+) strand; PAM type: NNNNGHTT; PAM sequence: TGGGGTTT
gaatcagaataactgttttt

SEQ ID NO: 8094 - DNA, 20 bp, Artificial Sequence
  Description of Artificial Sequence: Synthetic oligonucleotide
  Target: FXN; (+) strand; PAM type: NNNNGHTT; PAM sequence: CGGAGTTT
ttttggggttttctttgaga

SEQ ID NO: 8095 - DNA, 20 bp, Artificial Sequence
  Description of Artificial Sequence: Synthetic oligonucleotide
  Target: FXN; (+) strand; PAM type: NNNNGHTT; PAM sequence: CCTGGATT
gctcactgcaacctccgccc

SEQ ID NO: 8096 - DNA, 20 bp, Artificial Sequence
  Description of Artificial Sequence: Synthetic oligonucleotide
  Target: FXN; (+) strand; PAM type: NNNNGHTT; PAM sequence: AAGAGATT
aacctccgccccctggattc

SEQ ID NO: 8097 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcagcctcccgagtag

SEQ ID NO: 8098 - DNA, 20 bp, Artificial Sequence
  Description of Artificial Sequence: Synthetic oligonucleotide
  Target: FXN; (+) strand; PAM type: NNNNGHTT; PAM sequence: CGAGGTTT
ttttgtatttttagtagagg

SEQ ID NO: 8099 - DNA, 20 bp, Artificial Sequence
  Description of Artificial Sequence: Synthetic oligonucleotide
  Target: FXN; (+) strand; PAM type: NNNNGHTT; PAM sequence: CTAGGATT
cgcctcagcctcccaaaatg

SEQ ID NO: 8100 - DNA, 20 bp, Artificial Sequence
  Description of Artificial Sequence: Synthetic oligonucleotide
  Target: FXN; (+) strand; PAM type: NNNNGHTT; PAM sequence: CGGGGTTT
ctcattgcaacctccacctc

SEQ ID NO: 8101 - DNA, 20 bp, Artificial Sequence
  Description of Artificial Sequence: Synthetic oligonucleotide
  Target: FXN; (+) strand; PAM type: NNNNGHTT; PAM sequence: CAGTGATT
aacctccacctccggggttt

SEQ ID NO: 8102 - DNA, 20 bp, Artificial Sequence
  Description of Artificial Sequence: Synthetic oligonucleotide
  Target: FXN; (+) strand; PAM type: NNNNGHTT; PAM sequence: CAGGGTTT
ttttgtatttttagtagaga

SEQ ID NO: 8103 - DNA, 20 bp, Artificial Sequence
  Description of Artificial Sequence: Synthetic oligonucleotide
  Target: FXN; (+) strand; PAM type: NNNNGHTT; PAM sequence: GCTAGTTT
ggttttgccatattggcctg

SEQ ID NO: 8104 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tacctcggcctccgaaagtc

SEQ ID NO: 8105 - DNA, 20 bp, Artificial Sequence
  Description of Artificial Sequence: Synthetic oligonucleotide
  Target: FXN; (+) strand; PAM type: NNNNGHTT; PAM sequence: GCCTGCTT
tgcctctgggaatgggggct

SEQ ID NO: 8106 - DNA, 20 bp, Artificial Sequence
  Description of Artificial Sequence: Synthetic oligonucleotide
  Target: FXN; (+) strand; PAM type: NNNNGHTT; PAM sequence: TGCTGTTT
tctttctgtaaccccttctg

SEQ ID NO: 8107 - DNA, 20 bp, Artificial Sequence
  Description of Artificial Sequence: Synthetic oligonucleotide
  Target: FXN; (+) strand; PAM type: NNNNGHTT; PAM sequence: CGGGGTTT
ttttgtattttcagtagaga

SEQ ID NO: 8108 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcggcctcccagagtg

SEQ ID NO: 8109 - DNA, 20 bp, Artificial Sequence
  Description of Artificial Sequence: Synthetic oligonucleotide
  Target: FXN; (+) strand; PAM type: NNNNGHTT; PAM sequence: TCATGTTT
aaaatggaagcatttggtaa

SEQ ID NO: 8110 - DNA, 20 bp, Artificial Sequence
  Description of Artificial Sequence: Synthetic oligonucleotide
  Target: FXN; (+) strand; PAM type: NNNNGHTT; PAM sequence: TTGGGTTT
aagcatttggtaatcatgtt

SEQ ID NO: 8111 - DNA, 20 bp, Artificial Sequence
  Description of Artificial Sequence: Synthetic oligonucleotide
  Target: FXN; (+) strand; PAM type: NNNNGHTT; PAM sequence: TTGTGCTT
tggtaatcatgttttgggtt

SEQ ID NO: 8112 - DNA, 20 bp, Artificial Sequence
  Description of Artificial Sequence: Synthetic oligonucleotide
  Target: FXN; (+) strand; PAM type: NNNNGHTT; PAM sequence: CAGAGTTT
ggaaacgctggactctttag

SEQ ID NO: 8113 - DNA, 20 bp, Artificial Sequence
  Description of Artificial Sequence: Synthetic oligonucleotide
  Target: FXN; (+) strand; PAM type: NNNNGHTT; PAM sequence: ACACGTTT
agaccttgcagacaagccat

SEQ ID NO: 8114 - DNA, 20 bp, Artificial Sequence
  Description of Artificial Sequence: Synthetic oligonucleotide
  Target: FXN; (+) strand; PAM type: NNNNGHTT; PAM sequence: TTCTGTTT
cctcttgacttcttttattt

SEQ ID NO: 8115 - DNA, 20 bp, Artificial Sequence
  Description of Artificial Sequence: Synthetic oligonucleotide
  Target: FXN; (+) strand; PAM type: NNNNGHTT; PAM sequence: GTAGGATT
caagtagcatgtagttgtag

SEQ ID NO: 8116 - DNA, 20 bp, Artificial Sequence
  Description of Artificial Sequence: Synthetic oligonucleotide
  Target: FXN; (+) strand; PAM type: NNNNGHTT; PAM sequence: CTAGGCTT
ataagatagataagacaaga

SEQ ID NO: 8117 - DNA, 20 bp, Artificial Sequence
  Description of Artificial Sequence: Synthetic oligonucleotide
  Target: FXN; (+) strand; PAM type: NNNNGHTT; PAM sequence: CCAGGCTT
caagctgcagtccagctcta

SEQ ID NO: 8118 - DNA, 20 bp, Artificial Sequence
  Description of Artificial Sequence: Synthetic oligonucleotide
  Target: FXN; (+) strand; PAM type: NNNNGHTT; PAM sequence: TCCAGCTT
agcctctctgagcctcattt

SEQ ID NO: 8119 - DNA, 20 bp, Artificial Sequence
  Description of Artificial Sequence: Synthetic oligonucleotide
  Target: FXN; (+) strand; PAM type: NNNNGHTT; PAM sequence: TTTAGATT
agataactgcccaaaagtta

SEQ ID NO: 8120 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
catatttttgaaaagctcac

SEQ ID NO: 8121 - DNA, 20 bp, Artificial Sequence
  Description of Artificial Sequence: Synthetic oligonucleotide
  Target: FXN; (+) strand; PAM type: NNNNGHTT; PAM sequence: TAGAGATT
gtatccctaggtcttattcc

SEQ ID NO: 8122 - DNA, 20 bp, Artificial Sequence
  Description of Artificial Sequence: Synthetic oligonucleotide
  Target: FXN; (+) strand; PAM type: NNNNGHTT; PAM sequence: TTTTGATT
ctaggtcttattcctagaga

SEQ ID NO: 8123 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
ggcatgacctgggcagggca

SEQ ID NO: 8124 - DNA, 20 bp, Artificial Sequence
  Description of Artificial Sequence: Synthetic oligonucleotide
  Target: FXN; (+) strand; PAM type: NNNNGHTT; PAM sequence: AGATGATT
ctgggatttttaagctccac

SEQ ID NO: 8125 - DNA, 20 bp, Artificial Sequence
  Description of Artificial Sequence: Synthetic oligonucleotide
  Target: FXN; (+) strand; PAM type: NNNNGHTT; PAM sequence: ACTTGTTT
aatatgcagctagtatgaga

SEQ ID NO: 8126 - DNA, 20 bp, Artificial Sequence
  Description of Artificial Sequence: Synthetic oligonucleotide
  Target: FXN; (+) strand; PAM type: NNNNGHTT; PAM sequence: CTCCGCTT
ggcgcaatctcggctcactg

SEQ ID NO: 8127 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcagcctcccgagtag

SEQ ID NO: 8128 - DNA, 20 bp, Artificial Sequence
  Description of Artificial Sequence: Synthetic oligonucleotide
  Target: FXN; (+) strand; PAM type: NNNNGHTT; PAM sequence: CGGGGTTT
tttttgcattttagtaaaga

SEQ ID NO: 8129 - DNA, 20 bp, Artificial Sequence
  Description of Artificial Sequence: Synthetic oligonucleotide
  Target: FXN; (+) strand; PAM type: NNNNGHTT; PAM sequence: CAAAGTTT
gtccacccccatcagccttc

SEQ ID NO: 8130 - DNA, 20 bp, Artificial Sequence
  Description of Artificial Sequence: Synthetic oligonucleotide
  Target: FXN; (+) strand; PAM type: NNNNGHTT; PAM sequence: GGCAGATT
ttatcgactggccaccaggt

SEQ ID NO: 8131 - DNA, 20 bp, Artificial Sequence
  Description of Artificial Sequence: Synthetic oligonucleotide
  Target: FXN; (+) strand; PAM type: NNNNGHTT; PAM sequence: TTGGGTTT
atttgggcaagggtctgcct

SEQ ID NO: 8132 - DNA, 20 bp, Artificial Sequence
  Description of Artificial Sequence: Synthetic oligonucleotide
  Target: FXN; (+) strand; PAM type: NNNNGHTT; PAM sequence: TATTGCTT
tctgcctttgggtttagaat

SEQ ID NO: 8133 - DNA, 20 bp, Artificial Sequence
  Description of Artificial Sequence: Synthetic oligonucleotide
  Target: FXN; (+) strand; PAM type: NNNNGHTT; PAM sequence: GATGGTTT
gtgggagaaaatccctcaaa

SEQ ID NO: 8134 - DNA, 20 bp, Artificial Sequence
  Description of Artificial Sequence: Synthetic oligonucleotide
  Target: FXN; (+) strand; PAM type: NNNNGHTT; PAM sequence: GTTGGTTT
aaagatggttttctgggttg

SEQ ID NO: 8135 - DNA, 20 bp, Artificial Sequence
  Description of Artificial Sequence: Synthetic oligonucleotide
  Target: FXN; (+) strand; PAM type: NNNNGHTT; PAM sequence: GTTTGTTT
atggttttctgggttggttg

SEQ ID NO: 8136 - DNA, 20 bp, Artificial Sequence
  Description of Artificial Sequence: Synthetic oligonucleotide
  Target: FXN; (+) strand; PAM type: NNNNGHTT; PAM sequence: GTCTGTTT
ctgggttggttggtttgttt

SEQ ID NO: 8137 - DNA, 20 bp, Artificial Sequence
  Description of Artificial Sequence: Synthetic oligonucleotide
  Target: FXN; (+) strand; PAM type: NNNNGHTT; PAM sequence: GTTTGTTT
gttggttggtttgtttgtct

SEQ ID NO: 8138 - DNA, 20 bp, Artificial Sequence
  Description of Artificial Sequence: Synthetic oligonucleotide
  Target: FXN; (+) strand; PAM type: NNNNGHTT; PAM sequence: GTTTGTTT
gttggtttgtttgtctgttt

SEQ ID NO: 8139 - DNA, 20 bp, Artificial Sequence
  Description of Artificial Sequence: Synthetic oligonucleotide
  Target: FXN; (+) strand; PAM type: NNNNGHTT; PAM sequence: CAGTGTTT
ttttgtatttttagtagaga

SEQ ID NO: 8140 - DNA, 20 bp, Artificial Sequence
  Description of Artificial Sequence: Synthetic oligonucleotide
  Target: FXN; (+) strand; PAM type: NNNNGHTT; PAM sequence: GCTGGTTT
tgtttcaccacgttggccag

SEQ ID NO: 8141 - DNA, 20 bp, Artificial Sequence
  Description of Artificial Sequence: Synthetic oligonucleotide
  Target: FXN; (+) strand; PAM type: NNNNGHTT; PAM sequence: CTAGGATT
cacctcagcctcccaaagtg

SEQ ID NO: 8142 - DNA, 20 bp, Artificial Sequence
  Description of Artificial Sequence: Synthetic oligonucleotide
  Target: FXN; (+) strand; PAM type: NNNNGHTT; PAM sequence: TTTGGATT
aaatgtcacgaagcgtgcat

SEQ ID NO: 8143 - DNA, 20 bp, Artificial Sequence
  Description of Artificial Sequence: Synthetic oligonucleotide
  Target: FXN; (+) strand; PAM type: NNNNGHTT; PAM sequence: GAAGGATT
aaaaggagcaatggagcagg

SEQ ID NO: 8144 - DNA, 20 bp, Artificial Sequence
  Description of Artificial Sequence: Synthetic oligonucleotide
  Target: FXN; (+) strand; PAM type: NNNNGHTT; PAM sequence: AGTAGATT
gaaggattgaatgcctttca

SEQ ID NO: 8145 - DNA, 20 bp, Artificial Sequence
  Description of Artificial Sequence: Synthetic oligonucleotide
  Target: FXN; (+) strand; PAM type: NNNNGHTT; PAM sequence: CAGGGCTT
aaaatgcagtagtgcctggg

SEQ ID NO: 8146 - DNA, 20 bp, Artificial Sequence
  Description of Artificial Sequence: Synthetic oligonucleotide
  Target: FXN; (+) strand; PAM type: NNNNGHTT; PAM sequence: AAGTGCTT
agtgcctgggcagggcttta

SEQ ID NO: 8147 - DNA, 20 bp, Artificial Sequence
  Description of Artificial Sequence: Synthetic oligonucleotide
  Target: FXN; (+) strand; PAM type: NNNNGHTT; PAM sequence: GGCTGCTT
caggcagccctagagggccg

SEQ ID NO: 8148 - DNA, 20 bp, Artificial Sequence
  Description of Artificial Sequence: Synthetic oligonucleotide
  Target: FXN; (+) strand; PAM type: NNNNGHTT; PAM sequence: CATTGATT
actctgcccacacatgcaga

SEQ ID NO: 8149 - DNA, 20 bp, Artificial Sequence
  Description of Artificial Sequence: Synthetic oligonucleotide
  Target: FXN; (+) strand; PAM type: NNNNGHTT; PAM sequence: ACCTGTTT
gctacaaaaacagtcatgaa

SEQ ID NO: 8150 - DNA, 20 bp, Artificial Sequence
  Description of Artificial Sequence: Synthetic oligonucleotide
  Target: FXN; (+) strand; PAM type: NNNNGHTT; PAM sequence: ATAGGATT
cagtcatgaaacctgttttt

SEQ ID NO: 8151 - DNA, 20 bp, Artificial Sequence
  Description of Artificial Sequence: Synthetic oligonucleotide
  Target: FXN; (+) strand; PAM type: NNNNGHTT; PAM sequence: CCCAGTTT
ttttataggattagtgaagc

SEQ ID NO: 8152 - DNA, 20 bp, Artificial Sequence
  Description of Artificial Sequence: Synthetic oligonucleotide
  Target: FXN; (+) strand; PAM type: NNNNGHTT; PAM sequence: GAATGTTT
ttgaccagagtactttgcat

SEQ ID NO: 8153 - DNA, 20 bp, Artificial Sequence
  Description of Artificial Sequence: Synthetic oligonucleotide
  Target: FXN; (+) strand; PAM type: NNNNGHTT; PAM sequence: CTGCGTTT
atgtgccaatattctagcag

SEQ ID NO: 8154 - DNA, 20 bp, Artificial Sequence
  Description of Artificial Sequence: Synthetic oligonucleotide
  Target: FXN; (+) strand; PAM type: NNNNGHTT; PAM sequence: TTTGGTTT
ccaatattctagcagctgcg

SEQ ID NO: 8155 - DNA, 20 bp, Artificial Sequence
  Description of Artificial Sequence: Synthetic oligonucleotide
  Target: FXN; (+) strand; PAM type: NNNNGHTT; PAM sequence: AAGCGATT
aacctctgcctcccaggttc

SEQ ID NO: 8156 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
cgcctcaacctcctgagtag

SEQ ID NO: 8157 - DNA, 20 bp, Artificial Sequence
  Description of Artificial Sequence: Synthetic oligonucleotide
  Target: FXN; (+) strand; PAM type: NNNNGHTT; PAM sequence: CTAAGTTT
acatgtaccacaatacaggg

SEQ ID NO: 8158 - DNA, 20 bp, Artificial Sequence
  Description of Artificial Sequence: Synthetic oligonucleotide
  Target: FXN; (+) strand; PAM type: NNNNGHTT; PAM sequence: TGGGGTTT
ttttgtatttttagtagaaa

SEQ ID NO: 8159 - DNA, 20 bp, Artificial Sequence
  Description of Artificial Sequence: Synthetic oligonucleotide
  Target: FXN; (+) strand; PAM type: NNNNGHTT; PAM sequence: TTTGGTTT
gcacctggcaaaagtcatct

SEQ ID NO: 8160 - DNA, 20 bp, Artificial Sequence
  Description of Artificial Sequence: Synthetic oligonucleotide
  Target: FXN; (+) strand; PAM type: NNNNGHTT; PAM sequence: TCAAGCTT
aatcatagctcactgcagcc

SEQ ID NO: 8161 - DNA, 20 bp, Artificial Sequence
  Description of Artificial Sequence: Synthetic oligonucleotide
  Target: FXN; (+) strand; PAM type: NNNNGHTT; PAM sequence: CTATGTTT
tattttatttatgggtctcg

SEQ ID NO: 8162 - DNA, 20 bp, Artificial Sequence
  Description of Artificial Sequence: Synthetic oligonucleotide
  Target: FXN; (+) strand; PAM type: NNNNGHTT; PAM sequence: AAGCGATT
ggtctcaaactcctggcctc

SEQ ID NO: 8163 - DNA, 20 bp, Artificial Sequence
  Description of Artificial Sequence: Synthetic oligonucleotide
  Target: FXN; (+) strand; PAM type: NNNNGHTT; PAM sequence: CCGGGATT
cacctcggcctcccaaagca

SEQ ID NO: 8164 - DNA, 20 bp, Artificial Sequence
  Description of Artificial Sequence: Synthetic oligonucleotide
  Target: FXN; (+) strand; PAM type: NNNNGHTT; PAM sequence: AACAGATT
gtagctaagcatacatattc

SEQ ID NO: 8165 - DNA, 20 bp, Artificial Sequence
  Description of Artificial Sequence: Synthetic oligonucleotide
  Target: FXN; (+) strand; PAM type: NNNNGHTT; PAM sequence: AAGTGATT
aacctccacctcctgggttc

SEQ ID NO: 8166 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcagcctcccgagtag

SEQ ID NO: 8167 - DNA, 20 bp, Artificial Sequence
  Description of Artificial Sequence: Synthetic oligonucleotide
  Target: FXN; (+) strand; PAM type: NNNNGHTT; PAM sequence: CTGGGTTT
ttttatatttttagtagaga

SEQ ID NO: 8168 - DNA, 20 bp, Artificial Sequence
  Description of Artificial Sequence: Synthetic oligonucleotide
  Target: FXN; (+) strand; PAM type: NNNNGHTT; PAM sequence: AACTGCTT
ctcctgacctcaggtaatcc

SEQ ID NO: 8169 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgctttggcctcccaaagtg

SEQ ID NO: 8170 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
ttacaggcagctccaaagtg

SEQ ID NO: 8171 - DNA, 20 bp, Artificial Sequence
  Description of Artificial Sequence: Synthetic oligonucleotide
  Target: FXN; (+) strand; PAM type: NNNNGHTT; PAM sequence: GCTAGTTT
gaaataatttttttgaaagg

SEQ ID NO: 8172 - DNA, 20 bp, Artificial Sequence
  Description of Artificial Sequence: Synthetic oligonucleotide
  Target: FXN; (+) strand; PAM type: NNNNGHTT; PAM sequence: TCCTGTTT
tagggagggaatagaacgag

SEQ ID NO: 8173 - DNA, 20 bp, Artificial Sequence
  Description of Artificial Sequence: Synthetic oligonucleotide
  Target: FXN; (+) strand; PAM type: NNNNGHTT; PAM sequence: GATAGTTT
tgggctccccttggccaaaa

SEQ ID NO: 8174 - DNA, 20 bp, Artificial Sequence
  Description of Artificial Sequence: Synthetic oligonucleotide
  Target: FXN; (+) strand; PAM type: NNNNGHTT; PAM sequence: GGGAGCTT
gatagtttgttgagtcagtt

SEQ ID NO: 8175 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
agtcagttgggagcttagaa

SEQ ID NO: 8176 - DNA, 20 bp, Artificial Sequence
  Description of Artificial Sequence: Synthetic oligonucleotide
  Target: FXN; (+) strand; PAM type: NNNNGHTT; PAM sequence: TCCTGATT
agtagtgggtcagagaacct

SEQ ID NO: 8177 - DNA, 20 bp, Artificial Sequence
  Description of Artificial Sequence: Synthetic oligonucleotide
  Target: FXN; (+) strand; PAM type: NNNNGHTT; PAM sequence: CTGAGATT
gaaccttcctgattcctgcc

SEQ ID NO: 8178 - DNA, 20 bp, Artificial Sequence
  Description of Artificial Sequence: Synthetic oligonucleotide
  Target: FXN; (+) strand; PAM type: NNNNGHTT; PAM sequence: GTAGGCTT
ctgaagacaacattaggcta

SEQ ID NO: 8179 - DNA, 20 bp, Artificial Sequence
  Description of Artificial Sequence: Synthetic oligonucleotide
  Target: FXN; (+) strand; PAM type: NNNNGHTT; PAM sequence: TCCAGATT
aacattaggctagtaggctt

SEQ ID NO: 8180 - DNA, 20 bp, Artificial Sequence
  Description of Artificial Sequence: Synthetic oligonucleotide
  Target: FXN; (+) strand; PAM type: NNNNGHTT; PAM sequence: AAATGCTT
caaatcatttactaattagc

SEQ ID NO: 8181 - DNA, 20 bp, Artificial Sequence
  Description of Artificial Sequence: Synthetic oligonucleotide
  Target: FXN; (+) strand; PAM type: NNNNGHTT; PAM sequence: TGTAGATT
ctaattagcaaatgcttaag

SEQ ID NO: 8182 - DNA, 20 bp, Artificial Sequence
  Description of Artificial Sequence: Synthetic oligonucleotide
  Target: FXN; (+) strand; PAM type: NNNNGHTT; PAM sequence: TATAGTTT
gctatacagtggctgccatc

SEQ ID NO: 8183 - DNA, 20 bp, Artificial Sequence
  Description of Artificial Sequence: Synthetic oligonucleotide
  Target: FXN; (+) strand; PAM type: NNNNGHTT; PAM sequence: TTGTGATT
ctgccatctatagtttggac

SEQ ID NO: 8184 - DNA, 20 bp, Artificial Sequence
  Description of Artificial Sequence: Synthetic oligonucleotide
  Target: FXN; (+) strand; PAM type: NNNNGHTT; PAM sequence: TCCTGATT
ctgtaccctagagtatgaat

SEQ ID NO: 8185 - DNA, 20 bp, Artificial Sequence
  Description of Artificial Sequence: Synthetic oligonucleotide
  Target: FXN; (+) strand; PAM type: NNNNGHTT; PAM sequence: TCATGTTT
tgctaactaatttatgtatt

SEQ ID NO: 8186 - DNA, 20 bp, Artificial Sequence
  Description of Artificial Sequence: Synthetic oligonucleotide
  Target: FXN; (+) strand; PAM type: NNNNGHTT; PAM sequence: TTGAGCTT
atgtttgataatattattac

SEQ ID NO: 8187 - DNA, 20 bp, Artificial Sequence
  Description of Artificial Sequence: Synthetic oligonucleotide
  Target: FXN; (+) strand; PAM type: NNNNGHTT; PAM sequence: TATTGATT
catagtagggacttaataaa

SEQ ID NO: 8188 - DNA, 20 bp, Artificial Sequence
  Description of Artificial Sequence: Synthetic oligonucleotide
  Target: FXN; (+) strand; PAM type: NNNNGHTT; PAM sequence: ACATGCTT
gtaaatgagacttttccaaa

SEQ ID NO: 8189 - DNA, 20 bp, Artificial Sequence
  Description of Artificial Sequence: Synthetic oligonucleotide
  Target: FXN; (+) strand; PAM type: NNNNGHTT; PAM sequence: AGTGGCTT
tctgtggagtgggagactta

SEQ ID NO: 8190 - DNA, 20 bp, Artificial Sequence
  Description of Artificial Sequence: Synthetic oligonucleotide
  Target: FXN; (+) strand; PAM type: NNNNGHTT; PAM sequence: TAAGGATT
tggcatcttagatattttaa

SEQ ID NO: 8191 - DNA, 20 bp, Artificial Sequence
  Description of Artificial Sequence: Synthetic oligonucleotide
  Target: FXN; (+) strand; PAM type: NNNNGHTT; PAM sequence: ATTTGCTT
tcttagatattttaataagg

SEQ ID NO: 8192 - DNA, 20 bp, Artificial Sequence
  Description of Artificial Sequence: Synthetic oligonucleotide
  Target: FXN; (+) strand; PAM type: NNNNGHTT; PAM sequence: CAGAGTTT
aaaaactttaaacaaattaa

SEQ ID NO: 8193 - DNA, 20 bp, Artificial Sequence
  Description of Artificial Sequence: Synthetic oligonucleotide
  Target: FXN; (+) strand; PAM type: NNNNGHTT; PAM sequence: GAATGATT
acagagttttattcagcaaa

SEQ ID NO: 8194 - DNA, 20 bp, Artificial Sequence
  Description of Artificial Sequence: Synthetic oligonucleotide
  Target: FXN; (+) strand; PAM type: NNNNGHTT; PAM sequence: AGAGGATT
acggtgtgccacgtggttgg

SEQ ID NO: 8195 - DNA, 20 bp, Artificial Sequence
  Description of Artificial Sequence: Synthetic oligonucleotide
  Target: FXN; (+) strand; PAM type: NNNNGHTT; PAM sequence: TTAGGATT
gccacgtggttggagaggat

SEQ ID NO: 8196 - DNA, 20 bp, Artificial Sequence
  Description of Artificial Sequence: Synthetic oligonucleotide
  Target: FXN; (+) strand; PAM type: NNNNGHTT; PAM sequence: CGGAGCTT
aatggtgtgaacctgggagg

SEQ ID NO: 8197 - DNA, 20 bp, Artificial Sequence
  Description of Artificial Sequence: Synthetic oligonucleotide
  Target: FXN; (+) strand; PAM type: NNNNGHTT; PAM sequence: TACAGCTT
acagaaacagccaggttggt

SEQ ID NO: 8198 - DNA, 20 bp, Artificial Sequence
  Description of Artificial Sequence: Synthetic oligonucleotide
  Target: FXN; (+) strand; PAM type: NNNNGHTT; PAM sequence: TGGTGTTT
cagccaggttggttacagct

SEQ ID NO: 8199 - DNA, 20 bp, Artificial Sequence
  Description of Artificial Sequence: Synthetic oligonucleotide
  Target: FXN; (+) strand; PAM type: NNNNGHTT; PAM sequence: CTTGGTTT
agcttggtgtttgccttaaa

SEQ ID NO: 8200 - DNA, 20 bp, Artificial Sequence
  Description of Artificial Sequence: Synthetic oligonucleotide
  Target: FXN; (+) strand; PAM type: NNNNGHTT; PAM sequence: CTTTGATT
tggtttgaacagttggccgc

SEQ ID NO: 8201 - DNA, 20 bp, Artificial Sequence
  Description of Artificial Sequence: Synthetic oligonucleotide
  Target: FXN; (+) strand; PAM type: NNNNGHTT; PAM sequence: CGGTGATT
gcctttgattagccaaaact

SEQ ID NO: 8202 - DNA, 20 bp, Artificial Sequence
  Description of Artificial Sequence: Synthetic oligonucleotide
  Target: FXN; (+) strand; PAM type: NNNNGHTT; PAM sequence: AGTAGATT
aactcggtgattggtacaag

SEQ ID NO: 8203 - DNA, 20 bp, Artificial Sequence
  Description of Artificial Sequence: Synthetic oligonucleotide
  Target: FXN; (+) strand; PAM type: NNNNGHTT; PAM sequence: GGCAGTTT
gaactcaaaataggtaagga

SEQ ID NO: 8204 - DNA, 20 bp, Artificial Sequence
  Description of Artificial Sequence: Synthetic oligonucleotide
  Target: FXN; (+) strand; PAM type: NNNNGHTT; PAM sequence: TCCAGCTT
aacatactcaggagtaccat

SEQ ID NO: 8205 - DNA, 20 bp, Artificial Sequence
  Description of Artificial Sequence: Synthetic oligonucleotide
  Target: FXN; (+) strand; PAM type: NNNNGHTT; PAM sequence: AAGGGATT
aaccaccacctcctgggctc

SEQ ID NO: 8206 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcagtctcccgagtaa

SEQ ID NO: 8207 - DNA, 20 bp, Artificial Sequence
  Description of Artificial Sequence: Synthetic oligonucleotide
  Target: FXN; (+) strand; PAM type: NNNNGHTT; PAM sequence: TGGGGTTT
ttttgtatttttagtagaga

SEQ ID NO: 8208 - DNA, 20 bp, Artificial Sequence
  Description of Artificial Sequence: Synthetic oligonucleotide
  Target: FXN; (+) strand; PAM type: NNNNGHTT; PAM sequence: TCTGGCTT
ttggatatggagacaaagga

SEQ ID NO: 8209 - DNA, 20 bp, Artificial Sequence
  Description of Artificial Sequence: Synthetic oligonucleotide
  Target: FXN; (+) strand; PAM type: NNNNGHTT; PAM sequence: CCTGGATT
caaaggatctggcttagcat

SEQ ID NO: 8210 - DNA, 20 bp, Artificial Sequence
  Description of Artificial Sequence: Synthetic oligonucleotide
  Target: FXN; (+) strand; PAM type: NNNNGHTT; PAM sequence: TGCAGTTT
gatatctaacttttgcgagc

SEQ ID NO: 8211 - DNA, 20 bp, Artificial Sequence
  Description of Artificial Sequence: Synthetic oligonucleotide
  Target: FXN; (+) strand; PAM type: NNNNGHTT; PAM sequence: TTCAGATT
agtgacattaacctcctctc

SEQ ID NO: 8212 - DNA, 20 bp, Artificial Sequence
  Description of Artificial Sequence: Synthetic oligonucleotide
  Target: FXN; (+) strand; PAM type: NNNNGHTT; PAM sequence: CAGAGCTT
aatggcgtgaacccgggagg

SEQ ID NO: 8213 - DNA, 20 bp, Artificial Sequence
  Description of Artificial Sequence: Synthetic oligonucleotide
  Target: FXN; (+) strand; PAM type: NNNNGHTT; PAM sequence: CTCAGATT
atgcacactcccaaaataga

SEQ ID NO: 8214 - DNA, 20 bp, Artificial Sequence
  Description of Artificial Sequence: Synthetic oligonucleotide
  Target: FXN; (+) strand; PAM type: NNNNGHTT; PAM sequence: GCTAGTTT
atttctgctgaactaatgca

SEQ ID NO: 8215 - DNA, 20 bp, Artificial Sequence
  Description of Artificial Sequence: Synthetic oligonucleotide
  Target: FXN; (+) strand; PAM type: NNNNGHTT; PAM sequence: AATAGTTT
tgtcaccactttccttccaa

SEQ ID NO: 8216 - DNA, 20 bp, Artificial Sequence
  Description of Artificial Sequence: Synthetic oligonucleotide
  Target: FXN; (+) strand; PAM type: NNNNGHTT; PAM sequence: TGGGGTTT
ggtgggaggaagttgagcat

SEQ ID NO: 8217 - DNA, 20 bp, Artificial Sequence
  Description of Artificial Sequence: Synthetic oligonucleotide
  Target: FXN; (+) strand; PAM type: NNNNGHTT; PAM sequence: AGGTGCTT
agacagatctcctgctgcta

SEQ ID NO: 8218 - DNA, 20 bp, Artificial Sequence
  Description of Artificial Sequence: Synthetic oligonucleotide
  Target: FXN; (+) strand; PAM type: NNNNGHTT; PAM sequence: AATAGCTT
agaaggtgccagggggtgaa

SEQ ID NO: 8219 - DNA, 20 bp, Artificial Sequence
  Description of Artificial Sequence: Synthetic oligonucleotide
  Target: FXN; (+) strand; PAM type: NNNNGHTT; PAM sequence: ATTTGCTT
ggagctagaagggctctcac

SEQ ID NO: 8220 - DNA, 20 bp, Artificial Sequence
  Description of Artificial Sequence: Synthetic oligonucleotide
  Target: FXN; (+) strand; PAM type: NNNNGHTT; PAM sequence: AAAAGATT
cctgatacctggagtcactc

SEQ ID NO: 8221 - DNA, 20 bp, Artificial Sequence
  Description of Artificial Sequence: Synthetic oligonucleotide
  Target: FXN; (+) strand; PAM type: NNNNGHTT; PAM sequence: TTTGGCTT
tccgataggaaaaagtcaat

SEQ ID NO: 8222 - DNA, 20 bp, Artificial Sequence
  Description of Artificial Sequence: Synthetic oligonucleotide
  Target: FXN; (+) strand; PAM type: NNNNGHTT; PAM sequence: CCCTGATT
tcagtggttgcatgtgcacc

SEQ ID NO: 8223 - DNA, 20 bp, Artificial Sequence
  Description of Artificial Sequence: Synthetic oligonucleotide
  Target: FXN; (+) strand; PAM type: NNNNGHTT; PAM sequence: GCTGGATT
ctcagtcctctgccctttct

SEQ ID NO: 8224 - DNA, 20 bp, Artificial Sequence
  Description of Artificial Sequence: Synthetic oligonucleotide
  Target: FXN; (+) strand; PAM type: NNNNGHTT; PAM sequence: CAATGATT
ccacaaagagaacaaattac

SEQ ID NO: 8225 - DNA, 20 bp, Artificial Sequence
  Description of Artificial Sequence: Synthetic oligonucleotide
  Target: FXN; (+) strand; PAM type: NNNNGHTT; PAM sequence: TGTTGATT
acaaattaccaatgattgtg

SEQ ID NO: 8226 - DNA, 20 bp, Artificial Sequence
  Description of Artificial Sequence: Synthetic oligonucleotide
  Target: FXN; (+) strand; PAM type: NNNNGHTT; PAM sequence: CAGTGTTT
cacctatgagtgagaatatg

SEQ ID NO: 8227 - DNA, 20 bp, Artificial Sequence
  Description of Artificial Sequence: Synthetic oligonucleotide
  Target: FXN; (+) strand; PAM type: NNNNGHTT; PAM sequence: GTTTGATT
tatgagtgagaatatgcagt

SEQ ID NO: 8228 - DNA, 20 bp, Artificial Sequence
  Description of Artificial Sequence: Synthetic oligonucleotide
  Target: FXN; (+) strand; PAM type: NNNNGHTT; PAM sequence: GATAGTTT
gtttgattttttgttcttgc

SEQ ID NO: 8229 - DNA, 20 bp, Artificial Sequence
  Description of Artificial Sequence: Synthetic oligonucleotide
  Target: FXN; (+) strand; PAM type: NNNNGHTT; PAM sequence: TGATGATT
ttgcgatagtttactgagaa

SEQ ID NO: 8230 - DNA, 20 bp, Artificial Sequence
  Description of Artificial Sequence: Synthetic oligonucleotide
  Target: FXN; (+) strand; PAM type: NNNNGHTT; PAM sequence: TCCAGTTT
gtttactgagaatgatgatt

SEQ ID NO: 8231 - DNA, 20 bp, Artificial Sequence
  Description of Artificial Sequence: Synthetic oligonucleotide
  Target: FXN; (+) strand; PAM type: NNNNGHTT; PAM sequence: CGGGGTTT
ggaaatagtattaacgggtg

SEQ ID NO: 8232 - DNA, 20 bp, Artificial Sequence
  Description of Artificial Sequence: Synthetic oligonucleotide
  Target: FXN; (+) strand; PAM type: NNNNGHTT; PAM sequence: TGATGTTT
tagctggaattagatagtgg

SEQ ID NO: 8233 - DNA, 20 bp, Artificial Sequence
  Description of Artificial Sequence: Synthetic oligonucleotide
  Target: FXN; (+) strand; PAM type: NNNNGHTT; PAM sequence: TACAGTTT
tactaaaaactcctgaatta

SEQ ID NO: 8234 - DNA, 20 bp, Artificial Sequence
  Description of Artificial Sequence: Synthetic oligonucleotide
  Target: FXN; (+) strand; PAM type: NNNNGHTT; PAM sequence: ATTTGTTT
gttttaagaaacttttattt

SEQ ID NO: 8235 - DNA, 20 bp, Artificial Sequence
  Description of Artificial Sequence: Synthetic oligonucleotide
  Target: FXN; (+) strand; PAM type: NNNNGHTT; PAM sequence: AAGCGATT
agcctcaatctctgaggctc

SEQ ID NO: 8236 - DNA, 20 bp, Artificial Sequence
  Description of Artificial Sequence: Synthetic oligonucleotide
  Target: FXN; (+) strand; PAM type: NNNNGHTT; PAM sequence: CAAGGTTT
tttgtaattttttgtaaaaa

SEQ ID NO: 8237 - DNA, 20 bp, Artificial Sequence
  Description of Artificial Sequence: Synthetic oligonucleotide
  Target: FXN; (+) strand; PAM type: NNNNGHTT; PAM sequence: CTCAGTTT
catgagtcaccacatgcagc

SEQ ID NO: 8238 - DNA, 20 bp, Artificial Sequence
  Description of Artificial Sequence: Synthetic oligonucleotide
  Target: FXN; (+) strand; PAM type: NNNNGHTT; PAM sequence: ATGGGTTT
gtcataccaaaacagtaaaa

SEQ ID NO: 8239 - DNA, 20 bp, Artificial Sequence
  Description of Artificial Sequence: Synthetic oligonucleotide
  Target: FXN; (+) strand; PAM type: NNNNGHTT; PAM sequence: AAATGTTT
aaaatgggtttcaggaaaaa

SEQ ID NO: 8240 - DNA, 20 bp, Artificial Sequence
  Description of Artificial Sequence: Synthetic oligonucleotide
  Target: FXN; (+) strand; PAM type: NNNNGHTT; PAM sequence: AAATGCTT
ataatcccagcccttttaaa

SEQ ID NO: 8241 - DNA, 20 bp, Artificial Sequence
  Description of Artificial Sequence: Synthetic oligonucleotide
  Target: FXN; (+) strand; PAM type: NNNNGHTT; PAM sequence: TTATGATT
actcataaaaggacaaatac

SEQ ID NO: 8242 - DNA, 20 bp, Artificial Sequence
  Description of Artificial Sequence: Synthetic oligonucleotide
  Target: FXN; (+) strand; PAM type: NNNNGHTT; PAM sequence: TAGAGTTT
aaattagtgtctaatgggca

SEQ ID NO: 8243 - DNA, 20 bp, Artificial Sequence
  Description of Artificial Sequence: Synthetic oligonucleotide
  Target: FXN; (+) strand; PAM type: NNNNGHTT; PAM sequence: ATGTGCTT
aatatggtaaatttagcgtt

SEQ ID NO: 8244 - DNA, 20 bp, Artificial Sequence
  Description of Artificial Sequence: Synthetic oligonucleotide
  Target: FXN; (+) strand; PAM type: NNNNGHTT; PAM sequence: AGAAGTTT
taggaggatcacttgaggcc

SEQ ID NO: 8245 - DNA, 20 bp, Artificial Sequence
  Description of Artificial Sequence: Synthetic oligonucleotide
  Target: FXN; (+) strand; PAM type: NNNNGHTT; PAM sequence: AGGGGTTT
tcagaggatcacttgagcat

SEQ ID NO: 8246 - DNA, 20 bp, Artificial Sequence
  Description of Artificial Sequence: Synthetic oligonucleotide
  Target: FXN; (+) strand; PAM type: NNNNGHTT; PAM sequence: ATGGGATT
atatcttttatcgctggtta

SEQ ID NO: 8247 - DNA, 20 bp, Artificial Sequence
  Description of Artificial Sequence: Synthetic oligonucleotide
  Target: FXN; (+) strand; PAM type: NNNNGHTT; PAM sequence: GAATGCTT
gctggttaatgggattgaga

SEQ ID NO: 8248 - DNA, 20 bp, Artificial Sequence
  Description of Artificial Sequence: Synthetic oligonucleotide
  Target: FXN; (+) strand; PAM type: NNNNGHTT; PAM sequence: CCTGGATT
tgtctttggacccacagaga

SEQ ID NO: 8249 - DNA, 20 bp, Artificial Sequence
  Description of Artificial Sequence: Synthetic oligonucleotide
  Target: FXN; (+) strand; PAM type: NNNNGHTT; PAM sequence: TTAAGATT
ggacccacagagacctggat

SEQ ID NO: 8250 - DNA, 20 bp, Artificial Sequence
  Description of Artificial Sequence: Synthetic oligonucleotide
  Target: FXN; (+) strand; PAM type: NNNNGHTT; PAM sequence: CTCTGTTT
gagtactctttactatgaac

SEQ ID NO: 8251 - DNA, 20 bp, Artificial Sequence
  Description of Artificial Sequence: Synthetic oligonucleotide
  Target: FXN; (+) strand; PAM type: NNNNGHTT; PAM sequence: ATTTGTTT
cgtctccatcatttctatac

SEQ ID NO: 8252 - DNA, 20 bp, Artificial Sequence
  Description of Artificial Sequence: Synthetic oligonucleotide
  Target: FXN; (+) strand; PAM type: NNNNGHTT; PAM sequence: CTTTGTTT
cctctggaatttcaataact

SEQ ID NO: 8253 - DNA, 20 bp, Artificial Sequence
  Description of Artificial Sequence: Synthetic oligonucleotide
  Target: FXN; (+) strand; PAM type: NNNNGHTT; PAM sequence: TTGGGTTT
tttcaataactctttgtttt

SEQ ID NO: 8254 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
aactctttgttttttgggtt

SEQ ID NO: 8255 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
tttgttttttgggttttttg

SEQ ID NO: 8256 - DNA, 20 bp, Artificial Sequence
  Description of Artificial Sequence: Synthetic oligonucleotide
  Target: FXN; (+) strand; PAM type: NNNNGHTT; PAM sequence: TTTTGCTT
tttttgggttttttgttttg

SEQ ID NO: 8257 - DNA, 20 bp, Artificial Sequence
  Description of Artificial Sequence: Synthetic oligonucleotide
  Target: FXN; (+) strand; PAM type: NNNNGHTT; PAM sequence: CTTTGCTT
gggttttttgttttgttttg

SEQ ID NO: 8258 - DNA, 20 bp, Artificial Sequence
  Description of Artificial Sequence: Synthetic oligonucleotide
  Target: FXN; (+) strand; PAM type: NNNNGHTT; PAM sequence: CAGGGTTT
ttttgcatttttagtagaga

SEQ ID NO: 8259 - DNA, 20 bp, Artificial Sequence
  Description of Artificial Sequence: Synthetic oligonucleotide
  Target: FXN; (+) strand; PAM type: NNNNGHTT; PAM sequence: CTGTGTTT
tgcctggcctaaatagctct

SEQ ID NO: 8260 - DNA, 20 bp, Artificial Sequence
  Description of Artificial Sequence: Synthetic oligonucleotide
  Target: FXN; (+) strand; PAM type: NNNNGHTT; PAM sequence: TCTCGATT
tataagaatcattcagagcc

SEQ ID NO: 8261 - DNA, 20 bp, Artificial Sequence
  Description of Artificial Sequence: Synthetic oligonucleotide
  Target: FXN; (+) strand; PAM type: NNNNGHTT; PAM sequence: GCAGGCTT
catgcacaagatggggaaca

SEQ ID NO: 8262 - DNA, 20 bp, Artificial Sequence
  Description of Artificial Sequence: Synthetic oligonucleotide
  Target: FXN; (+) strand; PAM type: NNNNGHTT; PAM sequence: CCCTGCTT
atggggaacagcaggcttcc

SEQ ID NO: 8263 - DNA, 20 bp, Artificial Sequence
  Description of Artificial Sequence: Synthetic oligonucleotide
  Target: FXN; (+) strand; PAM type: NNNNGHTT; PAM sequence: AGCTGTTT
atacagagaactagccctgt

SEQ ID NO: 8264 - DNA, 20 bp, Artificial Sequence
  Description of Artificial Sequence: Synthetic oligonucleotide
  Target: FXN; (+) strand; PAM type: NNNNGHTT; PAM sequence: GAGTGTTT
aaaggactcttttgttgaaa

SEQ ID NO: 8265 - DNA, 20 bp, Artificial Sequence
  Description of Artificial Sequence: Synthetic oligonucleotide
  Target: FXN; (+) strand; PAM type: NNNNGHTT; PAM sequence: AGAAGCTT
aagccttggaggagtatctg

SEQ ID NO: 8266 - DNA, 20 bp, Artificial Sequence
  Description of Artificial Sequence: Synthetic oligonucleotide
  Target: FXN; (+) strand; PAM type: NNNNGHTT; PAM sequence: TGGAGTTT
tggaaataaaaaacttcatc

SEQ ID NO: 8267 - DNA, 20 bp, Artificial Sequence
  Description of Artificial Sequence: Synthetic oligonucleotide
  Target: FXN; (+) strand; PAM type: NNNNGHTT; PAM sequence: GATGGTTT
ctcctaagacaagcaaagca

SEQ ID NO: 8268 - DNA, 20 bp, Artificial Sequence
  Description of Artificial Sequence: Synthetic oligonucleotide
  Target: FXN; (+) strand; PAM type: NNNNGHTT; PAM sequence: TGATGTTT
tgtaatagacttgtcatgtc

SEQ ID NO: 8269 - DNA, 20 bp, Artificial Sequence
  Description of Artificial Sequence: Synthetic oligonucleotide
  Target: FXN; (+) strand; PAM type: NNNNGHTT; PAM sequence: CCGAGCTT
gagacaggtcacttaactct

SEQ ID NO: 8270 - DNA, 20 bp, Artificial Sequence
  Description of Artificial Sequence: Synthetic oligonucleotide
  Target: FXN; (+) strand; PAM type: NNNNGHTT; PAM sequence: TTATGATT
ctctatgagatacaacatca

SEQ ID NO: 8271 - DNA, 20 bp, Artificial Sequence
  Description of Artificial Sequence: Synthetic oligonucleotide
  Target: FXN; (+) strand; PAM type: NNNNGHTT; PAM sequence: TTCTGATT
catcattatgattaatccta

SEQ ID NO: 8272 - DNA, 20 bp, Artificial Sequence
  Description of Artificial Sequence: Synthetic oligonucleotide
  Target: FXN; (+) strand; PAM type: NNNNGHTT; PAM sequence: TCTTGTTT
atgacaaagtgctaactttt

SEQ ID NO: 8273 - DNA, 20 bp, Artificial Sequence
  Description of Artificial Sequence: Synthetic oligonucleotide
  Target: FXN; (+) strand; PAM type: NNNNGHTT; PAM sequence: TTATGCTT
tttttcttgttttaatttct

SEQ ID NO: 8274 - DNA, 20 bp, Artificial Sequence
  Description of Artificial Sequence: Synthetic oligonucleotide
  Target: FXN; (+) strand; PAM type: NNNNGHTT; PAM sequence: GCAGGCTT
aaataaagtcacagctgggt

SEQ ID NO: 8275 - DNA, 20 bp, Artificial Sequence
  Description of Artificial Sequence: Synthetic oligonucleotide
  Target: FXN; (+) strand; PAM type: NNNNGHTT; PAM sequence: AGGAGTTT
cctgtggatcacttgagctc

SEQ ID NO: 8276 - DNA, 20 bp, Artificial Sequence
  Description of Artificial Sequence: Synthetic oligonucleotide
  Target: FXN; (+) strand; PAM type: NNNNGHTT; PAM sequence: AAAAGTTT
gcctgtctcattctcagtag

SEQ ID NO: 8277 - DNA, 20 bp, Artificial Sequence
  Description of Artificial Sequence: Synthetic oligonucleotide
  Target: FXN; (+) strand; PAM type: NNNNGHTT; PAM sequence: AGTAGCTT
ggatattaagatctgaagtg

SEQ ID NO: 8278 - DNA, 20 bp, Artificial Sequence
  Description of Artificial Sequence: Synthetic oligonucleotide
  Target: FXN; (+) strand; PAM type: NNNNGHTT; PAM sequence: GACAGTTT
acttttccaaatccagccta

SEQ ID NO: 8279 - DNA, 20 bp, Artificial Sequence
  Description of Artificial Sequence: Synthetic oligonucleotide
  Target: FXN; (+) strand; PAM type: NNNNGHTT; PAM sequence: TAGCGTTT
agaagctacttttgaccttg

SEQ ID NO: 8280 - DNA, 20 bp, Artificial Sequence
  Description of Artificial Sequence: Synthetic oligonucleotide
  Target: FXN; (+) strand; PAM type: NNNNGHTT; PAM sequence: TAAAGTTT
actttgtcttcaaagcaagt

SEQ ID NO: 8281 - DNA, 20 bp, Artificial Sequence
  Description of Artificial Sequence: Synthetic oligonucleotide
  Target: FXN; (+) strand; PAM type: NNNNGHTT; PAM sequence: ACTTGTTT
caagttaaagtttgacctct

SEQ ID NO: 8282 - DNA, 20 bp, Artificial Sequence
  Description of Artificial Sequence: Synthetic oligonucleotide
  Target: FXN; (+) strand; PAM type: NNNNGHTT; PAM sequence: ATGTGCTT
ccctcctgccttttccattg

SEQ ID NO: 8283 - DNA, 20 bp, Artificial Sequence
  Description of Artificial Sequence: Synthetic oligonucleotide
  Target: FXN; (+) strand; PAM type: NNNNGHTT; PAM sequence: AAAAGATT
tgctttcaatctagaggaat

SEQ ID NO: 8284 - DNA, 20 bp, Artificial Sequence
  Description of Artificial Sequence: Synthetic oligonucleotide
  Target: FXN; (+) strand; PAM type: NNNNGHTT; PAM sequence: TAATGCTT
atttattattctgtgatctc

SEQ ID NO: 8285 - DNA, 20 bp, Artificial Sequence
  Description of Artificial Sequence: Synthetic oligonucleotide
  Target: FXN; (+) strand; PAM type: NNNNGHTT; PAM sequence: GTGTGTTT
tgctttgttcagaataaata

SEQ ID NO: 8286 - DNA, 20 bp, Artificial Sequence
  Description of Artificial Sequence: Synthetic oligonucleotide
  Target: FXN; (+) strand; PAM type: NNNNGHTT; PAM sequence: CACAGATT
attctaggaaggccctaatt

SEQ ID NO: 8287 - DNA, 20 bp, Artificial Sequence
  Description of Artificial Sequence: Synthetic oligonucleotide
  Target: FXN; (+) strand; PAM type: NNNNGHTT; PAM sequence: ATTGGTTT
ggccctaattcacagattgt

SEQ ID NO: 8288 - DNA, 20 bp, Artificial Sequence
  Description of Artificial Sequence: Synthetic oligonucleotide
  Target: FXN; (+) strand; PAM type: NNNNGHTT; PAM sequence: GGAGGATT
cagttagtgtgctggaggtt

SEQ ID NO: 8289 - DNA, 20 bp, Artificial Sequence
  Description of Artificial Sequence: Synthetic oligonucleotide
  Target: FXN; (+) strand; PAM type: NNNNGHTT; PAM sequence: CTGTGCTT
gtcattcttcctgaccctgg

SEQ ID NO: 8290 - DNA, 20 bp, Artificial Sequence
  Description of Artificial Sequence: Synthetic oligonucleotide
  Target: FXN; (+) strand; PAM type: NNNNGHTT; PAM sequence: AGTGGCTT
agcgatcacttttggggatc

SEQ ID NO: 8291 - DNA, 20 bp, Artificial Sequence
  Description of Artificial Sequence: Synthetic oligonucleotide
  Target: FXN; (+) strand; PAM type: NNNNGHTT; PAM sequence: TGCCGTTT
ttggaaagatctgctgagca

SEQ ID NO: 8292 - DNA, 20 bp, Artificial Sequence
  Description of Artificial Sequence: Synthetic oligonucleotide
  Target: FXN; (+) strand; PAM type: NNNNGHTT; PAM sequence: CGCCGTTT
tcaggcccctccccttcctg

SEQ ID NO: 8293 - DNA, 20 bp, Artificial Sequence
  Description of Artificial Sequence: Synthetic oligonucleotide
  Target: FXN; (+) strand; PAM type: NNNNGHTT; PAM sequence: CAGTGCTT
gggccctgaggacaagctct

SEQ ID NO: 8294 - DNA, 20 bp, Artificial Sequence
  Description of Artificial Sequence: Synthetic oligonucleotide
  Target: FXN; (+) strand; PAM type: NNNNGHTT; PAM sequence: ACAGGATT
gtagctgtacctgcgaaggc

SEQ ID NO: 8295 - DNA, 20 bp, Artificial Sequence
  Description of Artificial Sequence: Synthetic oligonucleotide
  Target: FXN; (+) strand; PAM type: NNNNGHTT; PAM sequence: CGCAGTTT
aggattccgcgggaagatcc

SEQ ID NO: 8296 - DNA, 20 bp, Artificial Sequence
  Description of Artificial Sequence: Synthetic oligonucleotide
  Target: FXN; (+) strand; PAM type: NNNNGHTT; PAM sequence: CATTGTTT
ccgcagtttcgggccgtcgt

SEQ ID NO: 8297 - DNA, 20 bp, Artificial Sequence
  Description of Artificial Sequence: Synthetic oligonucleotide
  Target: FXN; (+) strand; PAM type: NNNNGHTT; PAM sequence: AAAAGATT
agtccccatactctctgtgg

SEQ ID NO: 8298 - DNA, 20 bp, Artificial Sequence
  Description of Artificial Sequence: Synthetic oligonucleotide
  Target: FXN; (+) strand; PAM type: NNNNGHTT; PAM sequence: GTCTGCTT
acaataaagatcatccttga

SEQ ID NO: 8299 - DNA, 20 bp, Artificial Sequence
  Description of Artificial Sequence: Synthetic oligonucleotide
  Target: FXN; (+) strand; PAM type: NNNNGHTT; PAM sequence: CTCAGCTT
aaatgctccattcaccactc

SEQ ID NO: 8300 - DNA, 20 bp, Artificial Sequence
  Description of Artificial Sequence: Synthetic oligonucleotide
  Target: FXN; (+) strand; PAM type: NNNNGHTT; PAM sequence: TTCTGCTT
tccattcaccactcctcagc

SEQ ID NO: 8301 - DNA, 20 bp, Artificial Sequence
  Description of Artificial Sequence: Synthetic oligonucleotide
  Target: FXN; (+) strand; PAM type: NNNNGHTT; PAM sequence: TCTGGTTT
accactcctcagcttctgct

SEQ ID NO: 8302 - DNA, 20 bp, Artificial Sequence
  Description of Artificial Sequence: Synthetic oligonucleotide
  Target: FXN; (+) strand; PAM type: NNNNGHTT; PAM sequence: AGGGGCTT
ttcagaggtctctgtattgg

SEQ ID NO: 8303 - DNA, 20 bp, Artificial Sequence
  Description of Artificial Sequence: Synthetic oligonucleotide
  Target: FXN; (+) strand; PAM type: NNNNGHTT; PAM sequence: CCGGGCTT
cagactctttgtaggtggga

SEQ ID NO: 8304 - DNA, 20 bp, Artificial Sequence
  Description of Artificial Sequence: Synthetic oligonucleotide
  Target: FXN; (+) strand; PAM type: NNNNGHTT; PAM sequence: GGAAGCTT
cgggcttccctgcagcagaa

SEQ ID NO: 8305 - DNA, 20 bp, Artificial Sequence
  Description of Artificial Sequence: Synthetic oligonucleotide
  Target: FXN; (+) strand; PAM type: NNNNGHTT; PAM sequence: CCCTGCTT
gacacggggctatgacctgg

SEQ ID NO: 8306 - DNA, 20 bp, Artificial Sequence
  Description of Artificial Sequence: Synthetic oligonucleotide
  Target: FXN; (+) strand; PAM type: NNNNGHTT; PAM sequence: TTCTGTTT
attgcataaataatgtcact

SEQ ID NO: 8307 - DNA, 20 bp, Artificial Sequence
  Description of Artificial Sequence: Synthetic oligonucleotide
  Target: FXN; (+) strand; PAM type: NNNNGHTT; PAM sequence: CCTTGTTT
ttctacaatgactgatgggc

SEQ ID NO: 8308 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
aatgactgatgggcccttgt

SEQ ID NO: 8309 - DNA, 20 bp, Artificial Sequence
  Description of Artificial Sequence: Synthetic oligonucleotide
  Target: FXN; (+) strand; PAM type: NNNNGHTT; PAM sequence: TGGTGATT
acaccccacagggttccgag

SEQ ID NO: 8310 - DNA, 20 bp, Artificial Sequence
  Description of Artificial Sequence: Synthetic oligonucleotide
  Target: FXN; (+) strand; PAM type: NNNNGHTT; PAM sequence: CCTTGATT
tgaccatgccagaggccagt

SEQ ID NO: 8311 - DNA, 20 bp, Artificial Sequence
  Description of Artificial Sequence: Synthetic oligonucleotide
  Target: FXN; (+) strand; PAM type: NNNNGHTT; PAM sequence: GTTAGTTT
gtcctcgtgtcaggacctag

SEQ ID NO: 8312 - DNA, 20 bp, Artificial Sequence
  Description of Artificial Sequence: Synthetic oligonucleotide
  Target: FXN; (+) strand; PAM type: NNNNGHTT; PAM sequence: GCATGCTT
actgatgcaaagtgcgtcct

SEQ ID NO: 8313 - DNA, 20 bp, Artificial Sequence
  Description of Artificial Sequence: Synthetic oligonucleotide
  Target: FXN; (+) strand; PAM type: NNNNGHTT; PAM sequence: CAATGCTT
aagaaattgcgagacagaag

SEQ ID NO: 8314 - DNA, 20 bp, Artificial Sequence
  Description of Artificial Sequence: Synthetic oligonucleotide
  Target: FXN; (+) strand; PAM type: NNNNGHTT; PAM sequence: AGGAGTTT
caggcggatcacttgaggtc

SEQ ID NO: 8315 - DNA, 20 bp, Artificial Sequence
  Description of Artificial Sequence: Synthetic oligonucleotide
  Target: FXN; (+) strand; PAM type: NNNNGHTT; PAM sequence: AGCTGCTT
tggcaggcacctgtaatccc

SEQ ID NO: 8316 - DNA, 20 bp, Artificial Sequence
  Description of Artificial Sequence: Synthetic oligonucleotide
  Target: FXN; (+) strand; PAM type: NNNNGHTT; PAM sequence: AATTGCTT
ttgggagactgagacaggag

SEQ ID NO: 8317 - DNA, 20 bp, Artificial Sequence
  Description of Artificial Sequence: Synthetic oligonucleotide
  Target: FXN; (+) strand; PAM type: NNNNGHTT; PAM sequence: CCCCGCTT
gaaaccagacatggtggtct

SEQ ID NO: 8318 - DNA, 20 bp, Artificial Sequence
  Description of Artificial Sequence: Synthetic oligonucleotide
  Target: FXN; (+) strand; PAM type: NNNNGHTT; PAM sequence: AAGAGCTT
tgaagaaatccaaaggagta

SEQ ID NO: 8319 - DNA, 20 bp, Artificial Sequence
  Description of Artificial Sequence: Synthetic oligonucleotide
  Target: FXN; (+) strand; PAM type: NNNNGHTT; PAM sequence: GATGGCTT
ttgggaagctgacgcaggca

SEQ ID NO: 8320 - DNA, 20 bp, Artificial Sequence
  Description of Artificial Sequence: Synthetic oligonucleotide
  Target: FXN; (+) strand; PAM type: NNNNGHTT; PAM sequence: GAAGGATT
ctactcaggaggctgaggtg

SEQ ID NO: 8321 - DNA, 20 bp, Artificial Sequence
  Description of Artificial Sequence: Synthetic oligonucleotide
  Target: FXN; (+) strand; PAM type: NNNNGHTT; PAM sequence: GAGGGCTT
agggaggcaggtaacgatgc

SEQ ID NO: 8322 - DNA, 20 bp, Artificial Sequence
  Description of Artificial Sequence: Synthetic oligonucleotide
  Target: FXN; (+) strand; PAM type: NNNNGHTT; PAM sequence: GCTGGTTT
ggcttggatgcagaacacca

SEQ ID NO: 8323 - DNA, 20 bp, Artificial Sequence
  Description of Artificial Sequence: Synthetic oligonucleotide
  Target: FXN; (+) strand; PAM type: NNNNGHTT; PAM sequence: GTTTGATT
tggatgcagaacaccagctg

SEQ ID NO: 8324 - DNA, 20 bp, Artificial Sequence
  Description of Artificial Sequence: Synthetic oligonucleotide
  Target: FXN; (+) strand; PAM type: NNNNGHTT; PAM sequence: TTCTGTTT
cagaacaccagctggtttga

SEQ ID NO: 8325 - DNA, 20 bp, Artificial Sequence
  Description of Artificial Sequence: Synthetic oligonucleotide
  Target: FXN; (+) strand; PAM type: NNNNGHTT; PAM sequence: TGAAGTTT
gatgctgcagttgctcttat

SEQ ID NO: 8326 - DNA, 20 bp, Artificial Sequence
  Description of Artificial Sequence: Synthetic oligonucleotide
  Target: FXN; (+) strand; PAM type: NNNNGHTT; PAM sequence: GTTTGATT
ctgcagttgctcttattgaa

SEQ ID NO: 8327 - DNA, 20 bp, Artificial Sequence
  Description of Artificial Sequence: Synthetic oligonucleotide
  Target: FXN; (+) strand; PAM type: NNNNGHTT; PAM sequence: GGTTGTTT
ggcactatttttcaaataaa

SEQ ID NO: 8328 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
gttgtttaatataaaaaaaa

SEQ ID NO: 8329 - DNA, 20 bp, Artificial Sequence
  Description of Artificial Sequence: Synthetic oligonucleotide
  Target: FXN; (+) strand; PAM type: NNNNGHTT; PAM sequence: TTCTGATT
tatctttcatctggctgcat

SEQ ID NO: 8330 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
catctggctgcatttctgat

SEQ ID NO: 8331 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
ggctgcatttctgatttttg

SEQ ID NO: 8332 - DNA, 20 bp, Artificial Sequence
  Description of Artificial Sequence: Synthetic oligonucleotide
  Target: FXN; (+) strand; PAM type: NNNNGHTT; PAM sequence: CGTGGCTT
gcctaggttggtctgaaact

SEQ ID NO: 8333 - DNA, 20 bp, Artificial Sequence
  Description of Artificial Sequence: Synthetic oligonucleotide
  Target: FXN; (+) strand; PAM type: NNNNGHTT; PAM sequence: GCCTGTTT
gggtgtgagccactgcagca

SEQ ID NO: 8334 - DNA, 20 bp, Artificial Sequence
  Description of Artificial Sequence: Synthetic oligonucleotide
  Target: FXN; (+) strand; PAM type: NNNNGHTT; PAM sequence: TTTTGTTT
ccactgcagcagcctgtttt

SEQ ID NO: 8335 - DNA, 20 bp, Artificial Sequence
  Description of Artificial Sequence: Synthetic oligonucleotide
  Target: FXN; (+) strand; PAM type: NNNNGHTT; PAM sequence: GTTTGTTT
tgcagcagcctgtttttttt

SEQ ID NO: 8336 - DNA, 20 bp, Artificial Sequence
  Description of Artificial Sequence: Synthetic oligonucleotide
  Target: FXN; (+) strand; PAM type: NNNNGHTT; PAM sequence: GTTTGTTT
gcagcctgttttttttgttt

SEQ ID NO: 8337 - DNA, 20 bp, Artificial Sequence
  Description of Artificial Sequence: Synthetic oligonucleotide
  Target: FXN; (+) strand; PAM type: NNNNGHTT; PAM sequence: ACAAGTTT
tgtttgttttttttaatttg

SEQ ID NO: 8338 - DNA, 20 bp, Artificial Sequence
  Description of Artificial Sequence: Synthetic oligonucleotide
  Target: FXN; (+) strand; PAM type: NNNNGHTT; PAM sequence: TTGGGCTT
tagggccaaggggacggtcc

SEQ ID NO: 8339 - DNA, 20 bp, Artificial Sequence
  Description of Artificial Sequence: Synthetic oligonucleotide
  Target: FXN; (+) strand; PAM type: NNNNGHTT; PAM sequence: TGTGGTTT
gggacggtccttgggcttgg

SEQ ID NO: 8340 - DNA, 20 bp, Artificial Sequence
  Description of Artificial Sequence: Synthetic oligonucleotide
  Target: FXN; (+) strand; PAM type: NNNNGHTT; PAM sequence: GATGGTTT
agtccttttcctgtgaccct

SEQ ID NO: 8341 - DNA, 20 bp, Artificial Sequence
  Description of Artificial Sequence: Synthetic oligonucleotide
  Target: FXN; (+) strand; PAM type: NNNNGHTT; PAM sequence: CCAAGCTT
atccttgatacttttattgc

SEQ ID NO: 8342 - DNA, 20 bp, Artificial Sequence
  Description of Artificial Sequence: Synthetic oligonucleotide
  Target: FXN; (+) strand; PAM type: NNNNGHTT; PAM sequence: ATGAGCTT
catgtgccattattcactgg

SEQ ID NO: 8343 - DNA, 20 bp, Artificial Sequence
  Description of Artificial Sequence: Synthetic oligonucleotide
  Target: FXN; (+) strand; PAM type: NNNNGHTT; PAM sequence: ATATGTTT
ttaacactgaattaagaaaa

SEQ ID NO: 8344 - DNA, 20 bp, Artificial Sequence
  Description of Artificial Sequence: Synthetic oligonucleotide
  Target: FXN; (+) strand; PAM type: NNNNGHTT; PAM sequence: AATAGTTT
gaaaaatatgttttaaaaat

SEQ ID NO: 8345 - DNA, 20 bp, Artificial Sequence
  Description of Artificial Sequence: Synthetic oligonucleotide
  Target: FXN; (+) strand; PAM type: NNNNGHTT; PAM sequence: AGGTGATT
tgttttaaaaataatagttt

SEQ ID NO: 8346 - DNA, 20 bp, Artificial Sequence
  Description of Artificial Sequence: Synthetic oligonucleotide
  Target: FXN; (+) strand; PAM type: NNNNGHTT; PAM sequence: AACTGTTT
gagaggaaggaatggggaat

SEQ ID NO: 8347 - DNA, 20 bp, Artificial Sequence
  Description of Artificial Sequence: Synthetic oligonucleotide
  Target: FXN; (+) strand; PAM type: NNNNGHTT; PAM sequence: ATCTGATT
tgtgtatctgtgggttccac

SEQ ID NO: 8348 - DNA, 20 bp, Artificial Sequence
  Description of Artificial Sequence: Synthetic oligonucleotide
  Target: FXN; (+) strand; PAM type: NNNNGHTT; PAM sequence: CACGGATT
atatcagggacttgagtacc

SEQ ID NO: 8349 - DNA, 20 bp, Artificial Sequence
  Description of Artificial Sequence: Synthetic oligonucleotide
  Target: FXN; (+) strand; PAM type: NNNNGHTT; PAM sequence: AGATGTTT
gtctccttttggggtgatgc

SEQ ID NO: 8350 - DNA, 20 bp, Artificial Sequence
  Description of Artificial Sequence: Synthetic oligonucleotide
  Target: FXN; (+) strand; PAM type: NNNNGHTT; PAM sequence: AAATGTTT
gagacttatcagtaagggtc

SEQ ID NO: 8351 - DNA, 20 bp, Artificial Sequence
  Description of Artificial Sequence: Synthetic oligonucleotide
  Target: FXN; (+) strand; PAM type: NNNNGHTT; PAM sequence: TCAGGTTT
agtaagggtcaaatgttttt

SEQ ID NO: 8352 - DNA, 20 bp, Artificial Sequence
  Description of Artificial Sequence: Synthetic oligonucleotide
  Target: FXN; (+) strand; PAM type: NNNNGHTT; PAM sequence: TAGAGCTT
gctcattttgtgttattttc

SEQ ID NO: 8353 - DNA, 20 bp, Artificial Sequence
  Description of Artificial Sequence: Synthetic oligonucleotide
  Target: FXN; (+) strand; PAM type: NNNNGHTT; PAM sequence: ATTTGTTT
gtgctgtggaattactatgc

SEQ ID NO: 8354 - DNA, 20 bp, Artificial Sequence
  Description of Artificial Sequence: Synthetic oligonucleotide
  Target: FXN; (+) strand; PAM type: NNNNGHTT; PAM sequence: AGATGCTT
tccttggcctattccggaaa

SEQ ID NO: 8355 - DNA, 20 bp, Artificial Sequence
  Description of Artificial Sequence: Synthetic oligonucleotide
  Target: FXN; (+) strand; PAM type: NNNNGHTT; PAM sequence: CCCCGTTT
aaaagatgcttgatgcccag

SEQ ID NO: 8356 - DNA, 20 bp, Artificial Sequence
  Description of Artificial Sequence: Synthetic oligonucleotide
  Target: FXN; (+) strand; PAM type: NNNNGHTT; PAM sequence: CCCAGCTT
aaaagctatcaggccaagac

SEQ ID NO: 8357 - DNA, 20 bp, Artificial Sequence
  Description of Artificial Sequence: Synthetic oligonucleotide
  Target: FXN; (+) strand; PAM type: NNNNGHTT; PAM sequence: GTCTGTTT
agcttcattatgcagctgag

SEQ ID NO: 8358 - DNA, 20 bp, Artificial Sequence
  Description of Artificial Sequence: Synthetic oligonucleotide
  Target: FXN; (+) strand; PAM type: NNNNGHTT; PAM sequence: TGTTGTTT
ggtctgttttttgttgttgt

SEQ ID NO: 8359 - DNA, 20 bp, Artificial Sequence
  Description of Artificial Sequence: Synthetic oligonucleotide
  Target: FXN; (+) strand; PAM type: NNNNGHTT; PAM sequence: TCCTGCTT
ttgttgtttattttttttat

SEQ ID NO: 8360 - DNA, 20 bp, Artificial Sequence
  Description of Artificial Sequence: Synthetic oligonucleotide
  Target: FXN; (+) strand; PAM type: NNNNGHTT; PAM sequence: TTCTGATT
cctcctaccttgcccccaag

SEQ ID NO: 8361 - DNA, 20 bp, Artificial Sequence
  Description of Artificial Sequence: Synthetic oligonucleotide
  Target: FXN; (+) strand; PAM type: NNNNGHTT; PAM sequence: GGAAGATT
ttctgatttttaatttctat

SEQ ID NO: 8362 - DNA, 20 bp, Artificial Sequence
  Description of Artificial Sequence: Synthetic oligonucleotide
  Target: FXN; (+) strand; PAM type: NNNNGHTT; PAM sequence: TTTGGATT
ttaatttctatggaagattt

SEQ ID NO: 8363 - DNA, 20 bp, Artificial Sequence
  Description of Artificial Sequence: Synthetic oligonucleotide
  Target: FXN; (+) strand; PAM type: NNNNGHTT; PAM sequence: GTCGGATT
tatggaagattttttggatt

SEQ ID NO: 8364 - DNA, 20 bp, Artificial Sequence
  Description of Artificial Sequence: Synthetic oligonucleotide
  Target: FXN; (+) strand; PAM type: NNNNGHTT; PAM sequence: GAAGGATT
gtcttcactcttcattcttt

SEQ ID NO: 8365 - DNA, 20 bp, Artificial Sequence
  Description of Artificial Sequence: Synthetic oligonucleotide
  Target: FXN; (+) strand; PAM type: NNNNGHTT; PAM sequence: AAATGTTT
cacattaaagggtagcctac

SEQ ID NO: 8366 - DNA, 20 bp, Artificial Sequence
  Description of Artificial Sequence: Synthetic oligonucleotide
  Target: FXN; (+) strand; PAM type: NNNNGHTT; PAM sequence: TCAGGCTT
agggtagcctacaaatgttt

SEQ ID NO: 8367 - DNA, 20 bp, Artificial Sequence
  Description of Artificial Sequence: Synthetic oligonucleotide
  Target: FXN; (+) strand; PAM type: NNNNGHTT; PAM sequence: TGCTGTTT
ggttgtccagggagacctag

SEQ ID NO: 8368 - DNA, 20 bp, Artificial Sequence
  Description of Artificial Sequence: Synthetic oligonucleotide
  Target: FXN; (+) strand; PAM type: NNNNGHTT; PAM sequence: AGCCGTTT
gacaagaaaagaggaaaaaa

SEQ ID NO: 8369 - DNA, 20 bp, Artificial Sequence
  Description of Artificial Sequence: Synthetic oligonucleotide
  Target: FXN; (+) strand; PAM type: NNNNGHTT; PAM sequence: ACAAGTTT
aagtagttgtccctttgtgg

SEQ ID NO: 8370 - DNA, 20 bp, Artificial Sequence
  Description of Artificial Sequence: Synthetic oligonucleotide
  Target: FXN; (+) strand; PAM type: NNNNGHTT; PAM sequence: CTCTGCTT
gtttcccaaattccctggac

SEQ ID NO: 8371 - DNA, 20 bp, Artificial Sequence
  Description of Artificial Sequence: Synthetic oligonucleotide
  Target: FXN; (+) strand; PAM type: NNNNGHTT; PAM sequence: GGTTGATT
taaatgagagaatagagtat

SEQ ID NO: 8372 - DNA, 20 bp, Artificial Sequence
  Description of Artificial Sequence: Synthetic oligonucleotide
  Target: FXN; (+) strand; PAM type: NNNNGHTT; PAM sequence: AACAGTTT
tagatgaggggatgacaaag

SEQ ID NO: 8373 - DNA, 20 bp, Artificial Sequence
  Description of Artificial Sequence: Synthetic oligonucleotide
  Target: FXN; (+) strand; PAM type: NNNNGHTT; PAM sequence: TCGTGATT
ttgttattggtgttgcccta

SEQ ID NO: 8374 - DNA, 20 bp, Artificial Sequence
  Description of Artificial Sequence: Synthetic oligonucleotide
  Target: FXN; (+) strand; PAM type: NNNNGHTT; PAM sequence: AATCGCTT
ttgggaggctgaagcggaag

SEQ ID NO: 8375 - DNA, 20 bp, Artificial Sequence
  Description of Artificial Sequence: Synthetic oligonucleotide
  Target: FXN; (+) strand; PAM type: NNNNGHTT; PAM sequence: GAAGGATT
atattattttcttacttaaa

SEQ ID NO: 8376 - DNA, 20 bp, Artificial Sequence
  Description of Artificial Sequence: Synthetic oligonucleotide
  Target: FXN; (+) strand; PAM type: NNNNGHTT; PAM sequence: AATTGCTT
tcaggaggctgagacgggag

SEQ ID NO: 8377 - DNA, 20 bp, Artificial Sequence
  Description of Artificial Sequence: Synthetic oligonucleotide
  Target: FXN; (+) strand; PAM type: NNNNGHTT; PAM sequence: GAGGGTTT
gtctcaaaaaaaaaaaaaag

SEQ ID NO: 8378 - DNA, 20 bp, Artificial Sequence
  Description of Artificial Sequence: Synthetic oligonucleotide
  Target: FXN; (+) strand; PAM type: NNNNGHTT; PAM sequence: AGAAGTTT
aaaaggagggtttattaatg

SEQ ID NO: 8379 - DNA, 20 bp, Artificial Sequence
  Description of Artificial Sequence: Synthetic oligonucleotide
  Target: FXN; (+) strand; PAM type: NNNNGHTT; PAM sequence: AAAGGCTT
agtttgtattaatatgtagc

SEQ ID NO: 8380 - DNA, 20 bp, Artificial Sequence
  Description of Artificial Sequence: Synthetic oligonucleotide
  Target: FXN; (+) strand; PAM type: NNNNGHTT; PAM sequence: GGAGGATT
ctgcacaggaggctgagaca

SEQ ID NO: 8381 - DNA, 20 bp, Artificial Sequence
  Description of Artificial Sequence: Synthetic oligonucleotide
  Target: FXN; (+) strand; PAM type: NNNNGHTT; PAM sequence: GATTGCTT
acaggaggctgagacaggag

SEQ ID NO: 8382 - DNA, 20 bp, Artificial Sequence
  Description of Artificial Sequence: Synthetic oligonucleotide
  Target: FXN; (+) strand; PAM type: NNNNGHTT; PAM sequence: AAATGTTT
ttattttttgagtctgatgg

SEQ ID NO: 8383 - DNA, 20 bp, Artificial Sequence
  Description of Artificial Sequence: Synthetic oligonucleotide
  Target: FXN; (+) strand; PAM type: NNNNGHTT; PAM sequence: ACATGTTT
gagaaaataaataacatcat

SEQ ID NO: 8384 - DNA, 20 bp, Artificial Sequence
  Description of Artificial Sequence: Synthetic oligonucleotide
  Target: FXN; (+) strand; PAM type: NNNNGHTT; PAM sequence: ATGTGTTT
ataacatcatacatgtttgt

SEQ ID NO: 8385 - DNA, 20 bp, Artificial Sequence
  Description of Artificial Sequence: Synthetic oligonucleotide
  Target: FXN; (+) strand; PAM type: NNNNGHTT; PAM sequence: TCTTGCTT
catgtttgtatgtgtttgca

SEQ ID NO: 8386 - DNA, 20 bp, Artificial Sequence
  Description of Artificial Sequence: Synthetic oligonucleotide
  Target: FXN; (+) strand; PAM type: NNNNGHTT; PAM sequence: GAAAGTTT
gtttgcatcttgcttctact

SEQ ID NO: 8387 - DNA, 20 bp, Artificial Sequence
  Description of Artificial Sequence: Synthetic oligonucleotide
  Target: FXN; (+) strand; PAM type: NNNNGHTT; PAM sequence: ATTGGTTT
tcattttacatatagctcta

SEQ ID NO: 8388 - DNA, 20 bp, Artificial Sequence
  Description of Artificial Sequence: Synthetic oligonucleotide
  Target: FXN; (+) strand; PAM type: NNNNGHTT; PAM sequence: GTTTGATT
tttacatatagctctaattg

SEQ ID NO: 8389 - DNA, 20 bp, Artificial Sequence
  Description of Artificial Sequence: Synthetic oligonucleotide
  Target: FXN; (+) strand; PAM type: NNNNGHTT; PAM sequence: ATGAGTTT
tccagtcatccatgtgaagg

SEQ ID NO: 8390 - DNA, 20 bp, Artificial Sequence
  Description of Artificial Sequence: Synthetic oligonucleotide
  Target: FXN; (+) strand; PAM type: NNNNGHTT; PAM sequence: CTGGGCTT
tcatggcagcctcgacctcc

SEQ ID NO: 8391 - DNA, 20 bp, Artificial Sequence
  Description of Artificial Sequence: Synthetic oligonucleotide
  Target: FXN; (+) strand; PAM type: NNNNGHTT; PAM sequence: TGGGGTTT
ttgtgtattttttgtagaga

SEQ ID NO: 8392 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcgtcctcccaagatg

SEQ ID NO: 8393 - DNA, 20 bp, Artificial Sequence
  Description of Artificial Sequence: Synthetic oligonucleotide
  Target: FXN; (+) strand; PAM type: NNNNGHTT; PAM sequence: GAAAGCTT
tgtgccacaggtgttcatca

SEQ ID NO: 8394 - DNA, 20 bp, Artificial Sequence
  Description of Artificial Sequence: Synthetic oligonucleotide
  Target: FXN; (+) strand; PAM type: NNNNGHTT; PAM sequence: CTGGGTTT
tgaggtgtgtaaaagagaac

SEQ ID NO: 8395 - DNA, 20 bp, Artificial Sequence
  Description of Artificial Sequence: Synthetic oligonucleotide
  Target: FXN; (+) strand; PAM type: NNNNGHTT; PAM sequence: ACTTGTTT
taatcgaaactctgcctctt

SEQ ID NO: 8396 - DNA, 20 bp, Artificial Sequence
  Description of Artificial Sequence: Synthetic oligonucleotide
  Target: FXN; (+) strand; PAM type: NNNNGHTT; PAM sequence: TCATGTTT
tgtagacactgacagtggcc

SEQ ID NO: 8397 - DNA, 20 bp, Artificial Sequence
  Description of Artificial Sequence: Synthetic oligonucleotide
  Target: FXN; (+) strand; PAM type: NNNNGHTT; PAM sequence: CTCAGTTT
ccttgaacttaatcaaaata

SEQ ID NO: 8398 - DNA, 20 bp, Artificial Sequence
  Description of Artificial Sequence: Synthetic oligonucleotide
  Target: FXN; (+) strand; PAM type: NNNNGHTT; PAM sequence: ATTAGATT
ctcagtttacttaacttcgt

SEQ ID NO: 8399 - DNA, 20 bp, Artificial Sequence
  Description of Artificial Sequence: Synthetic oligonucleotide
  Target: FXN; (+) strand; PAM type: NNNNGHTT; PAM sequence: TTCTGATT
ttacttaacttcgtattaga

SEQ ID NO: 8400 - DNA, 20 bp, Artificial Sequence
  Description of Artificial Sequence: Synthetic oligonucleotide
  Target: FXN; (+) strand; PAM type: NNNNGHTT; PAM sequence: CCATGCTT
accatttatcgtgtgcctta

SEQ ID NO: 8401 - DNA, 20 bp, Artificial Sequence
  Description of Artificial Sequence: Synthetic oligonucleotide
  Target: FXN; (+) strand; PAM type: NNNNGHTT; PAM sequence: GACAGTTT
ttttagccaatttaaaattt

SEQ ID NO: 8402 - DNA, 20 bp, Artificial Sequence
  Description of Artificial Sequence: Synthetic oligonucleotide
  Target: FXN; (+) strand; PAM type: NNNNGHTT; PAM sequence: ATAGGTTT
ttgacagtttgcattaaatt

SEQ ID NO: 8403 - DNA, 20 bp, Artificial Sequence
  Description of Artificial Sequence: Synthetic oligonucleotide
  Target: FXN; (+) strand; PAM type: NNNNGHTT; PAM sequence: ATATGCTT
cattaaattataggtttaca

SEQ ID NO: 8404 - DNA, 20 bp, Artificial Sequence
  Description of Artificial Sequence: Synthetic oligonucleotide
  Target: FXN; (+) strand; PAM type: NNNNGHTT; PAM sequence: AGATGCTT
tacctgccccaaattctgac

SEQ ID NO: 8405 - DNA, 20 bp, Artificial Sequence
  Description of Artificial Sequence: Synthetic oligonucleotide
  Target: FXN; (+) strand; PAM type: NNNNGHTT; PAM sequence: TGGAGTTT
aagacccatgttcatagtga

SEQ ID NO: 8406 - DNA, 20 bp, Artificial Sequence
  Description of Artificial Sequence: Synthetic oligonucleotide
  Target: FXN; (+) strand; PAM type: NNNNGHTT; PAM sequence: AATCGCTT
atgcaaggttgccaaggaaa

SEQ ID NO: 8407 - DNA, 20 bp, Artificial Sequence
  Description of Artificial Sequence: Synthetic oligonucleotide
  Target: FXN; (+) strand; PAM type: NNNNGHTT; PAM sequence: TTACGCTT
gttgccaaggaaaaatcgct

SEQ ID NO: 8408 - DNA, 20 bp, Artificial Sequence
  Description of Artificial Sequence: Synthetic oligonucleotide
  Target: FXN; (+) strand; PAM type: NNNNGHTT; PAM sequence: GTTGGATT
gtaattttagtccgtgtcca

SEQ ID NO: 8409 - DNA, 20 bp, Artificial Sequence
  Description of Artificial Sequence: Synthetic oligonucleotide
  Target: FXN; (+) strand; PAM type: NNNNGHTT; PAM sequence: CAAAGTTT
ggagaaaggggaaggagggg

SEQ ID NO: 8410 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctcagcctcccgagtag

SEQ ID NO: 8411 - DNA, 20 bp, Artificial Sequence
  Description of Artificial Sequence: Synthetic oligonucleotide
  Target: FXN; (+) strand; PAM type: NNNNGHTT; PAM sequence: CGGGGTTT
ttttgtatttttagtagaga

SEQ ID NO: 8412 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
tgcctccgcctcccaaagtg

SEQ ID NO: 8413 - DNA, 20 bp, Artificial Sequence
  Description of Artificial Sequence: Synthetic oligonucleotide
  Target: FXN; (+) strand; PAM type: NNNNGHTT; PAM sequence: TTTGGTTT
gccagaaatgccttctaatc

SEQ ID NO: 8414 - DNA, 20 bp, Artificial Sequence
  Description of Artificial Sequence: Synthetic oligonucleotide
  Target: FXN; (+) strand; PAM type: NNNNGHTT; PAM sequence: TATAGTTT
tgttccatcttctctggctg

SEQ ID NO: 8415 - DNA, 20 bp, Artificial Sequence
  Description of Artificial Sequence: Synthetic oligonucleotide
  Target: FXN; (+) strand; PAM type: NNNNGHTT; PAM sequence: AACAGATT
taaggaatggaaggcaccag

SEQ ID NO: 8416 - DNA, 20 bp, Artificial Sequence
  Description of Artificial Sequence: Synthetic oligonucleotide
  Target: FXN; (+) strand; PAM type: NNNNGHTT; PAM sequence: AAATGTTT
gcaccagaacagatttattg

SEQ ID NO: 8417 - DNA, 20 bp, Artificial Sequence
  Description of Artificial Sequence: Synthetic oligonucleotide
  Target: FXN; (+) strand; PAM type: NNNNGHTT; PAM sequence: TGAAGATT
ttattgaaatgtttattagc

SEQ ID NO: 8418 - DNA, 20 bp, Artificial Sequence
  Description of Artificial Sequence: Synthetic oligonucleotide
  Target: FXN; (+) strand; PAM type: NNNNGHTT; PAM sequence: CAAAGATT
ccagcagtaaaattggctct

SEQ ID NO: 8419 - DNA, 20 bp, Artificial Sequence
  Description of Artificial Sequence: Synthetic oligonucleotide
  Target: FXN; (+) strand; PAM type: NNNNGHTT; PAM sequence: TTGTGTTT
gaagggcctctgctgtccac

SEQ ID NO: 8420 - DNA, 20 bp, Artificial Sequence
  Description of Artificial Sequence: Synthetic oligonucleotide
  Target: FXN; (+) strand; PAM type: NNNNGHTT; PAM sequence: AATTGTTT
aacgccacatcttgacctca

SEQ ID NO: 8421 - DNA, 20 bp, Artificial Sequence
  Description of Artificial Sequence: Synthetic oligonucleotide
  Target: FXN; (+) strand; PAM type: NNNNGHTT; PAM sequence: AATTGCTT
tcgggaggctgaggcaggag

SEQ ID NO: 8422 - DNA, 20 bp, Artificial Sequence
  Description of Artificial Sequence: Synthetic oligonucleotide
  Target: FXN; (+) strand; PAM type: NNNNGHTT; PAM sequence: CCGAGATT
gtggtggaggttgcagtgag

SEQ ID NO: 8423 - DNA, 20 bp, Artificial Sequence
  Description of Artificial Sequence: Synthetic oligonucleotide
  Target: FXN; (+) strand; PAM type: NNNNGHTT; PAM sequence: CTGAGATT
accgcactctatgatgctag

SEQ ID NO: 8424 - DNA, 20 bp, Artificial Sequence
  Description of Artificial Sequence: Synthetic oligonucleotide
  Target: FXN; (+) strand; PAM type: NNNNGHTT; PAM sequence: AATGGCTT
ctgagatttttccaaaagaa

SEQ ID NO: 8425 - DNA, 20 bp, Artificial Sequence
  Description of Artificial Sequence: Synthetic oligonucleotide
  Target: FXN; (+) strand; PAM type: NNNNGHTT; PAM sequence: ATGAGTTT
ctcaaaagtaatagaaacag

SEQ ID NO: 8426 - DNA, 20 bp, Artificial Sequence
  Description of Artificial Sequence: Synthetic oligonucleotide
  Target: FXN; (+) strand; PAM type: NNNNGHTT; PAM sequence: TCAGGATT
agaaacagatgagtttggag

SEQ ID NO: 8427 - DNA, 20 bp, Artificial Sequence
  Description of Artificial Sequence: Synthetic oligonucleotide
  Target: FXN; (+) strand; PAM type: NNNNGHTT; PAM sequence: GTAAGATT
tttggagtcaggatttctct

SEQ ID NO: 8428 - DNA, 20 bp, Artificial Sequence
  Description of Artificial Sequence: Synthetic oligonucleotide
  Target: FXN; (+) strand; PAM type: NNNNGHTT; PAM sequence: CAGAGATT
tctccaggtgccactgttga

SEQ ID NO: 8429 - DNA, 20 bp, Artificial Sequence
  Description of Artificial Sequence: Synthetic oligonucleotide
  Target: FXN; (+) strand; PAM type: NNNNGHTT; PAM sequence: CTGGGATT
agcatagccacctgatcctg

SEQ ID NO: 8430 - DNA, 20 bp, Artificial Sequence
  Description of Artificial Sequence: Synthetic oligonucleotide
  Target: FXN; (+) strand; PAM type: NNNNGHTT; PAM sequence: GAAAGTTT
gtccatcagcagttcccctt

SEQ ID NO: 8431 - DNA, 20 bp, Artificial Sequence
  Description of Artificial Sequence: Synthetic oligonucleotide
  Target: FXN; (+) strand; PAM type: NNNNGHTT; PAM sequence: AGGAGCTT
tttttcacctgcatttttgc

SEQ ID NO: 8432 - DNA, 20 bp, Artificial Sequence
  Description of Artificial Sequence: Synthetic oligonucleotide
  Target: FXN; (+) strand; PAM type: NNNNGHTT; PAM sequence: GTAAGCTT
ctagctacacagtctccagg

SEQ ID NO: 8433 - DNA, 20 bp, Artificial Sequence
  Description of Artificial Sequence: Synthetic oligonucleotide
  Target: FXN; (+) strand; PAM type: NNNNGHTT; PAM sequence: CCAAGTTT
aaacctaagcaggaccaagg

SEQ ID NO: 8434 - DNA, 20 bp, Artificial Sequence
  Description of Artificial Sequence: Synthetic oligonucleotide
  Target: FXN; (+) strand; PAM type: NNNNGHTT; PAM sequence: ATGTGCTT
caagtttcttagcctgaaaa

SEQ ID NO: 8435 - DNA, 20 bp, Artificial Sequence
  Description of Artificial Sequence: Synthetic oligonucleotide
  Target: FXN; (+) strand; PAM type: NNNNGHTT; PAM sequence: TTATGCTT
ggcactgactctacatataa

SEQ ID NO: 8436 - DNA, 20 bp, Artificial Sequence
  Description of Artificial Sequence: Synthetic oligonucleotide
  Target: FXN; (+) strand; PAM type: NNNNGHTT; PAM sequence: TGCTGTTT
tggctctcagacttggccag

SEQ ID NO: 8437 - DNA, 20 bp, Artificial Sequence
  Description of Artificial Sequence: Synthetic oligonucleotide
  Target: FXN; (+) strand; PAM type: NNNNGHTT; PAM sequence: GGTAGATT
ccccacatctctgcctgggg

SEQ ID NO: 8438 - DNA, 20 bp, Artificial Sequence
  Description of Artificial Sequence: Synthetic oligonucleotide
  Target: FXN; (+) strand; PAM type: NNNNGHTT; PAM sequence: CCTTGATT
ctcagcctctgcctggatgc

SEQ ID NO: 8439 - DNA, 20 bp, Artificial Sequence
  Description of Artificial Sequence: Synthetic oligonucleotide
  Target: FXN; (+) strand; PAM type: NNNNGHTT; PAM sequence: CCATGTTT
tgttccatgtcctcagcata

SEQ ID NO: 8440 - DNA, 20 bp, Artificial Sequence
  Description of Artificial Sequence: Synthetic oligonucleotide
  Target: FXN; (+) strand; PAM type: NNNNGHTT; PAM sequence: CCCTGCTT
actgacctaccatgtgtcac

SEQ ID NO: 8441 - DNA, 20 bp, Artificial Sequence
  Description of Artificial Sequence: Synthetic oligonucleotide
  Target: FXN; (+) strand; PAM type: NNNNGHTT; PAM sequence: ATATGTTT
caaataaatgtgttataatt

SEQ ID NO: 8442 - DNA, 20 bp, Artificial Sequence
  Description of Artificial Sequence: Synthetic oligonucleotide
  Target: FXN; (-) strand; PAM type: NRG; PAM sequence: AAG
gtatagtttcactttgaagc

SEQ ID NO: 8443 - DNA, 20 bp, Artificial Sequence
  Description of Artificial Sequence: Synthetic oligonucleotide
  Target: FXN; (-) strand; PAM type: NRG; PAM sequence: AAG
tagtgtatagtttcactttg

SEQ ID NO: 8444 - DNA, 20 bp, Artificial Sequence
  Description of Artificial Sequence: Synthetic oligonucleotide
  Target: FXN; (-) strand; PAM type: NRG; PAM sequence: TAG
tgtgggaggaatttagtgta

SEQ ID NO: 8445 - DNA, 20 bp, Artificial Sequence
  Description of Artificial Sequence: Synthetic oligonucleotide
  Target: FXN; (-) strand; PAM type: NRG; PAM sequence: TAG
agctaactgtgggaggaatt

SEQ ID NO: 8446 - DNA, 20 bp, Artificial Sequence
  Description of Artificial Sequence: Synthetic oligonucleotide
  Target: FXN; (-) strand; PAM type: NRG; PAM sequence: AGG
cacgccaagctaactgtggg

SEQ ID NO: 8447 - DNA, 20 bp, Artificial Sequence
  Description of Artificial Sequence: Synthetic oligonucleotide
  Target: FXN; (-) strand; PAM type: NRG; PAM sequence: GAG
ccacgccaagctaactgtgg

SEQ ID NO: 8448 - DNA, 20 bp, Artificial Sequence
  Description of Artificial Sequence: Synthetic oligonucleotide
  Target: FXN; (-) strand; PAM type: NRG; PAM sequence: GGG
ggccacgccaagctaactgt

SEQ ID NO: 8449 - DNA, 20 bp, Artificial Sequence
  Description of Artificial Sequence: Synthetic oligonucleotide
  Target: FXN; (-) strand; PAM type: NRG; PAM sequence: TGG
aggccacgccaagctaactg

SEQ ID NO: 8450 - DNA, 20 bp, Artificial Sequence
  Description of Artificial Sequence: Synthetic oligonucleotide
  Target: FXN; (-) strand; PAM type: NRG; PAM sequence: AAG
catataacaaaggccacgcc

SEQ ID NO: 8451 - DNA, 20 bp, Artificial Sequence
  Description of Artificial Sequence: Synthetic oligonucleotide
  Target: FXN; (-) strand; PAM type: NRG; PAM sequence: AGG
tattcctgggcatataacaa

SEQ ID NO: 8452 - DNA, 20 bp, Artificial Sequence
  Description of Artificial Sequence: Synthetic oligonucleotide
  Target: FXN; (-) strand; PAM type: NRG; PAM sequence: AAG
ttattcctgggcatataaca

SEQ ID NO: 8453 - DNA, 20 bp, Artificial Sequence
  Description of Artificial Sequence: Synthetic oligonucleotide
  Target: FXN; (-) strand; PAM type: NRG; PAM sequence: GGG
ggctgtcctcacttattcct

SEQ ID NO: 8454 - DNA, 20 bp, Artificial Sequence
  Description of Artificial Sequence: Synthetic oligonucleotide
  Target: FXN; (-) strand; PAM type: NRG; PAM sequence: TGG
tggctgtcctcacttattcc

SEQ ID NO: 8455 - DNA, 20 bp, Artificial Sequence
  Description of Artificial Sequence: Synthetic oligonucleotide
  Target: FXN; (-) strand; PAM type: NRG; PAM sequence: TGG
ttgcttctagtctcataggc

SEQ ID NO: 8456 - DNA, 20 bp, Artificial Sequence
  Description of Artificial Sequence: Synthetic oligonucleotide
  Target: FXN; (-) strand; PAM type: NRG; PAM sequence: AGG
catcttgcttctagtctcat

SEQ ID NO: 8457 - DNA, 20 bp, Artificial Sequence
  Description of Artificial Sequence: Synthetic oligonucleotide
  Target: FXN; (-) strand; PAM type: NRG; PAM sequence: TAG
ccatcttgcttctagtctca

SEQ ID NO: 8458 - DNA, 20 bp, Artificial Sequence
  Description of Artificial Sequence: Synthetic oligonucleotide
  Target: FXN; (-) strand; PAM type: NRG; PAM sequence: TAG
ggctgactccatcttgcttc

SEQ ID NO: 8459 - DNA, 20 bp, Artificial Sequence
  Description of Artificial Sequence: Synthetic oligonucleotide
  Target: FXN; (-) strand; PAM type: NRG; PAM sequence: TGG
acagtgagagaaatttagct

SEQ ID NO: 8460 - DNA, 20 bp, Artificial Sequence
  Description of Artificial Sequence: Synthetic oligonucleotide
  Target: FXN; (-) strand; PAM type: NRG; PAM sequence: TAG
ttatgacagtgagagaaatt

SEQ ID NO: 8461 - DNA, 20 bp, Artificial Sequence
  Description of Artificial Sequence: Synthetic oligonucleotide
  Target: FXN; (-) strand; PAM type: NRG; PAM sequence: GAG
tgtaaaggttatgacagtga

SEQ ID NO: 8462 - DNA, 20 bp, Artificial Sequence
  Description of Artificial Sequence: Synthetic oligonucleotide
  Target: FXN; (-) strand; PAM type: NRG; PAM sequence: GAG
tttgtaaaggttatgacagt

SEQ ID NO: 8463 - DNA, 20 bp, Artificial Sequence
  Description of Artificial Sequence: Synthetic oligonucleotide
  Target: FXN; (-) strand; PAM type: NRG; PAM sequence: CAG
cacctttgtaaaggttatga

SEQ ID NO: 8464 - DNA, 20 bp, Artificial Sequence
  Description of Artificial Sequence: Synthetic oligonucleotide
  Target: FXN; (-) strand; PAM type: NRG; PAM sequence: AGG
taatgaaaccacctttgtaa

SEQ ID NO: 8465 - DNA, 20 bp, Artificial Sequence
  Description of Artificial Sequence: Synthetic oligonucleotide
  Target: FXN; (-) strand; PAM type: NRG; PAM sequence: AAG
ctaatgaaaccacctttgta

SEQ ID NO: 8466 - DNA, 20 bp, Artificial Sequence
  Description of Artificial Sequence: Synthetic oligonucleotide
  Target: FXN; (-) strand; PAM type: NRG; PAM sequence: AGG
agtcattcttgttttaacta

SEQ ID NO: 8467 - DNA, 20 bp, Artificial Sequence
  Description of Artificial Sequence: Synthetic oligonucleotide
  Target: FXN; (-) strand; PAM type: NRG; PAM sequence: AAG
gagtcattcttgttttaact

SEQ ID NO: 8468 - DNA, 20 bp, Artificial Sequence
  Description of Artificial Sequence: Synthetic oligonucleotide
  Target: FXN; (-) strand; PAM type: NRG; PAM sequence: GAG
tctgaaatatagcctttaga

SEQ ID NO: 8469 - DNA, 20 bp, Artificial Sequence
  Description of Artificial Sequence: Synthetic oligonucleotide
  Target: FXN; (-) strand; PAM type: NRG; PAM sequence: GAG
tatctgaaatatagccttta

SEQ ID NO: 8470 - DNA, 20 bp, Artificial Sequence
  Description of Artificial Sequence: Synthetic oligonucleotide
  Target: FXN; (-) strand; PAM type: NRG; PAM sequence: TAG
tgtatctgaaatatagcctt

SEQ ID NO: 8471 - DNA, 20 bp, Artificial Sequence
  Description of Artificial Sequence: Synthetic oligonucleotide
  Target: FXN; (-) strand; PAM type: NRG; PAM sequence: TAG
catgtgatgtatctgaaata

SEQ ID NO: 8472 - DNA, 20 bp, Artificial Sequence
  Description of Artificial Sequence: Synthetic oligonucleotide
  Target: FXN; (-) strand; PAM type: NRG; PAM sequence: AAG
ttgaggggacaagaggaaag

SEQ ID NO: 8473 - DNA, 20 bp, Artificial Sequence
  Description of Artificial Sequence: Synthetic oligonucleotide
  Target: FXN; (-) strand; PAM type: NRG; PAM sequence: AAG
ctgttgaggggacaagagga

SEQ ID NO: 8474 - DNA, 20 bp, Artificial Sequence
  Description of Artificial Sequence: Synthetic oligonucleotide
  Target: FXN; (-) strand; PAM type: NRG; PAM sequence: AGG
cttactgttgaggggacaag

SEQ ID NO: 8475 - DNA, 20 bp, Artificial Sequence
  Description of Artificial Sequence: Synthetic oligonucleotide
  Target: FXN; (-) strand; PAM type: NRG; PAM sequence: GAG
gcttactgttgaggggacaa

SEQ ID NO: 8476 - DNA, 20 bp, Artificial Sequence
  Description of Artificial Sequence: Synthetic oligonucleotide
  Target: FXN; (-) strand; PAM type: NRG; PAM sequence: AAG
ttgcttactgttgaggggac

SEQ ID NO: 8477 - DNA, 20 bp, Artificial Sequence
  Description of Artificial Sequence: Synthetic oligonucleotide
  Target: FXN; (-) strand; PAM type: NRG; PAM sequence: GGG
tcttcttgcttactgttgag

SEQ ID NO: 8478 - DNA, 20 bp, Artificial Sequence
  Description of Artificial Sequence: Synthetic oligonucleotide
  Target: FXN; (-) strand; PAM type: NRG; PAM sequence: GGG
ctcttcttgcttactgttga

SEQ ID NO: 8479 - DNA, 20 bp, Artificial Sequence
  Description of Artificial Sequence: Synthetic oligonucleotide
  Target: FXN; (-) strand; PAM type: NRG; PAM sequence: AGG
actcttcttgcttactgttg

SEQ ID NO: 8480 - DNA, 20 bp, Artificial Sequence
  Description of Artificial Sequence: Synthetic oligonucleotide
  Target: FXN; (-) strand; PAM type: NRG; PAM sequence: GAG
tactcttcttgcttactgtt

SEQ ID NO: 8481 - DNA, 20 bp, Artificial Sequence
  Description of Artificial Sequence: Synthetic oligonucleotide
  Target: FXN; (-) strand; PAM type: NRG; PAM sequence: AGG
attaagggagcttcaggcag

SEQ ID NO: 8482 - DNA, 20 bp, Artificial Sequence
  Description of Artificial Sequence: Synthetic oligonucleotide
  Target: FXN; (-) strand; PAM type: NRG; PAM sequence: GAG
gattaagggagcttcaggca

SEQ ID NO: 8483 - DNA, 20 bp, Artificial Sequence
  Description of Artificial Sequence: Synthetic oligonucleotide
  Target: FXN; (-) strand; PAM type: NRG; PAM sequence: CAG
cagattaagggagcttcagg

SEQ ID NO: 8484 - DNA, 20 bp, Artificial Sequence
  Description of Artificial Sequence: Synthetic oligonucleotide
  Target: FXN; (-) strand; PAM type: NRG; PAM sequence: AGG
tgacagattaagggagcttc

SEQ ID NO: 8485 - DNA, 20 bp, Artificial Sequence
  Description of Artificial Sequence: Synthetic oligonucleotide
  Target: FXN; (-) strand; PAM type: NRG; PAM sequence: CAG
ctgacagattaagggagctt

SEQ ID NO: 8486 - DNA, 20 bp, Artificial Sequence
  Description of Artificial Sequence: Synthetic oligonucleotide
  Target: FXN; (-) strand; PAM type: NRG; PAM sequence: GAG
tgtgatctgacagattaagg

SEQ ID NO: 8487 - DNA, 20 bp, Artificial Sequence
  Description of Artificial Sequence: Synthetic oligonucleotide
  Target: FXN; (-) strand; PAM type: NRG; PAM sequence: GGG
tctgtgatctgacagattaa

SEQ ID NO: 8488 - DNA, 20 bp, Artificial Sequence
  Description of Artificial Sequence: Synthetic oligonucleotide
  Target: FXN; (-) strand; PAM type: NRG; PAM sequence: AGG
atctgtgatctgacagatta

SEQ ID NO: 8489 - DNA, 20 bp, Artificial Sequence
  Description of Artificial Sequence: Synthetic oligonucleotide
  Target: FXN; (-) strand; PAM type: NRG; PAM sequence: AAG
gatctgtgatctgacagatt

SEQ ID NO: 8490 - DNA, 20 bp, Artificial Sequence
  Description of Artificial Sequence: Synthetic oligonucleotide
  Target: FXN; (-) strand; PAM type: NRG; PAM sequence: CAG
gcttttgatctgtgatctga

SEQ ID NO: 8491 - DNA, 20 bp, Artificial Sequence
  Description of Artificial Sequence: Synthetic oligonucleotide
  Target: FXN; (-) strand; PAM type: NRG; PAM sequence: TAG
gtcccttgggcagtgtgtga

SEQ ID NO: 8492 - DNA, 20 bp, Artificial Sequence
  Description of Artificial Sequence: Synthetic oligonucleotide
  Target: FXN; (-) strand; PAM type: NRG; PAM sequence: CAG
tccctttagggtcccttggg

SEQ ID NO: 8493 - DNA, 20 bp, Artificial Sequence
  Description of Artificial Sequence: Synthetic oligonucleotide
  Target: FXN; (-) strand; PAM type: NRG; PAM sequence: GGG
ggctccctttagggtccctt

SEQ ID NO: 8494 - DNA, 20 bp, Artificial Sequence
  Description of Artificial Sequence: Synthetic oligonucleotide
  Target: FXN; (-) strand; PAM type: NRG; PAM sequence: TGG
tggctccctttagggtccct

SEQ ID NO: 8495 - DNA, 20 bp, Artificial Sequence
  Description of Artificial Sequence: Synthetic oligonucleotide
  Target: FXN; (-) strand; PAM type: NRG; PAM sequence: GGG
tctgagagtggctcccttta

SEQ ID NO: 8496 - DNA, 20 bp, Artificial Sequence
  Description of Artificial Sequence: Synthetic oligonucleotide
  Target: FXN; (-) strand; PAM type: NRG; PAM sequence: AGG
ttctgagagtggctcccttt

SEQ ID NO: 8497 - DNA, 20 bp, Artificial Sequence
  Description of Artificial Sequence: Synthetic oligonucleotide
  Target: FXN; (-) strand; PAM type: NRG; PAM sequence: TAG
tttctgagagtggctccctt

SEQ ID NO: 8498 - DNA, 20 bp, Artificial Sequence
  Description of Artificial Sequence: Synthetic oligonucleotide
  Target: FXN; (-) strand; PAM type: NRG; PAM sequence: TGG
ttggatttattttctgagag

SEQ ID NO: 8499 - DNA, 20 bp, Artificial Sequence
  Description of Artificial Sequence: Synthetic oligonucleotide
  Target: FXN; (-) strand; PAM type: NRG; PAM sequence: GAG
ggtttggatttattttctga

SEQ ID NO: 8500 - DNA, 20 bp, Artificial Sequence
  Description of Artificial Sequence: Synthetic oligonucleotide
  Target: FXN; (-) strand; PAM type: NRG; PAM sequence: GAG
gaggtttggatttattttct

SEQ ID NO: 8501 - DNA, 20 bp, Artificial Sequence
  Description of Artificial Sequence: Synthetic oligonucleotide
  Target: FXN; (-) strand; PAM type: NRG; PAM sequence: TGG
tggccagaaaaaaggaggtt

SEQ ID NO: 8502 - DNA, 20 bp, Artificial Sequence
  Description of Artificial Sequence: Synthetic oligonucleotide
  Target: FXN; (-) strand; PAM type: NRG; PAM sequence: AGG
ttcagtggccagaaaaaagg

SEQ ID NO: 8503 - DNA, 20 bp, Artificial Sequence
  Description of Artificial Sequence: Synthetic oligonucleotide
  Target: FXN; (-) strand; PAM type: NRG; PAM sequence: GAG
tttcagtggccagaaaaaag

SEQ ID NO: 8504 - DNA, 20 bp, Artificial Sequence
  Description of Artificial Sequence: Synthetic oligonucleotide
  Target: FXN; (-) strand; PAM type: NRG; PAM sequence: AGG
cgtttcagtggccagaaaaa

SEQ ID NO: 8505 - DNA, 20 bp, Artificial Sequence
  Description of Artificial Sequence: Synthetic oligonucleotide
  Target: FXN; (-) strand; PAM type: NRG; PAM sequence: AAG
acgtttcagtggccagaaaa

SEQ ID NO: 8506 - DNA, 20 bp, Artificial Sequence
  Description of Artificial Sequence: Synthetic oligonucleotide
  Target: FXN; (-) strand; PAM type: NRG; PAM sequence: CAG
ttattgaacgtttcagtggc

SEQ ID NO: 8507 - DNA, 20 bp, Artificial Sequence
  Description of Artificial Sequence: Synthetic oligonucleotide
  Target: FXN; (-) strand; PAM type: NRG; PAM sequence: TGG
ctaattattgaacgtttcag

SEQ ID NO: 8508 - DNA, 20 bp, Artificial Sequence
  Description of Artificial Sequence: Synthetic oligonucleotide
  Target: FXN; (-) strand; PAM type: NRG; PAM sequence: CAG
gaactaattattgaacgttt

SEQ ID NO: 8509 - DNA, 20 bp, Artificial Sequence
  Description of Artificial Sequence: Synthetic oligonucleotide
  Target: FXN; (-) strand; PAM type: NRG; PAM sequence: TAG
tattaaacatgtgaatgatg

SEQ ID NO: 8510 - DNA, 20 bp, Artificial Sequence
  Description of Artificial Sequence: Synthetic oligonucleotide
  Target: FXN; (-) strand; PAM type: NRG; PAM sequence: AAG
caaagtaatcaataattcca

SEQ ID NO: 8511 - DNA, 20 bp, Artificial Sequence
  Description of Artificial Sequence: Synthetic oligonucleotide
  Target: FXN; (-) strand; PAM type: NRG; PAM sequence: AAG
aattcataagatactcagca

SEQ ID NO: 8512 - DNA, 20 bp, Artificial Sequence
  Description of Artificial Sequence: Synthetic oligonucleotide
  Target: FXN; (-) strand; PAM type: NRG; PAM sequence: CAG
gattaaattcataagatact

SEQ ID NO: 8513 - DNA, 20 bp, Artificial Sequence
  Description of Artificial Sequence: Synthetic oligonucleotide
  Target: FXN; (-) strand; PAM type: NRG; PAM sequence: AAG
ttaatatagattaaattcat

SEQ ID NO: 8514 - DNA, 20 bp, Artificial Sequence
  Description of Artificial Sequence: Synthetic oligonucleotide
  Target: FXN; (-) strand; PAM type: NRG; PAM sequence: TAG
acatcaccttaatattaata

SEQ ID NO: 8515 - DNA, 20 bp, Artificial Sequence
  Description of Artificial Sequence: Synthetic oligonucleotide
  Target: FXN; (-) strand; PAM type: NRG; PAM sequence: TGG
ctagagtcaaatccacactc

SEQ ID NO: 8516 - DNA, 20 bp, Artificial Sequence
  Description of Artificial Sequence: Synthetic oligonucleotide
  Target: FXN; (-) strand; PAM type: NRG; PAM sequence: GAG
ggagactgattatggcacta

SEQ ID NO: 8517 - DNA, 20 bp, Artificial Sequence
  Description of Artificial Sequence: Synthetic oligonucleotide
  Target: FXN; (-) strand; PAM type: NRG; PAM sequence: TAG
caggagactgattatggcac

SEQ ID NO: 8518 - DNA, 20 bp, Artificial Sequence
  Description of Artificial Sequence: Synthetic oligonucleotide
  Target: FXN; (-) strand; PAM type: NRG; PAM sequence: TGG
ttgtcccaggagactgatta

SEQ ID NO: 8519 - DNA, 20 bp, Artificial Sequence
  Description of Artificial Sequence: Synthetic oligonucleotide
  Target: FXN; (-) strand; PAM type: NRG; PAM sequence: GAG
gaaacagctgtttgtcccag

SEQ ID NO: 8520 - DNA, 20 bp, Artificial Sequence
  Description of Artificial Sequence: Synthetic oligonucleotide
  Target: FXN; (-) strand; PAM type: NRG; PAM sequence: AGG
gagaaacagctgtttgtccc

SEQ ID NO: 8521 - DNA, 20 bp, Artificial Sequence
  Description of Artificial Sequence: Synthetic oligonucleotide
  Target: FXN; (-) strand; PAM type: NRG; PAM sequence: CAG
agagaaacagctgtttgtcc

SEQ ID NO: 8522 - DNA, 20 bp, Artificial Sequence
  Description of Artificial Sequence: Synthetic oligonucleotide
  Target: FXN; (-) strand; PAM type: NRG; PAM sequence: CAG
ctataatgagggaagagaaa

SEQ ID NO: 8523 - DNA, 20 bp, Artificial Sequence
  Description of Artificial Sequence: Synthetic oligonucleotide
  Target: FXN; (-) strand; PAM type: NRG; PAM sequence: GAG
ttttttctataatgagggaa

SEQ ID NO: 8524 - DNA, 20 bp, Artificial Sequence
  Description of Artificial Sequence: Synthetic oligonucleotide
  Target: FXN; (-) strand; PAM type: NRG; PAM sequence: AAG
atttttttctataatgaggg

SEQ ID NO: 8525 - DNA, 20 bp, Artificial Sequence
  Description of Artificial Sequence: Synthetic oligonucleotide
  Target: FXN; (-) strand; PAM type: NRG; PAM sequence: GGG
gcaatttttttctataatga

SEQ ID NO: 8526 - DNA, 20 bp, Artificial Sequence
  Description of Artificial Sequence: Synthetic oligonucleotide
  Target: FXN; (-) strand; PAM type: NRG; PAM sequence: AGG
ggcaatttttttctataatg

SEQ ID NO: 8527 - DNA, 20 bp, Artificial Sequence
  Description of Artificial Sequence: Synthetic oligonucleotide
  Target: FXN; (-) strand; PAM type: NRG; PAM sequence: GAG
gggcaatttttttctataat

SEQ ID NO: 8528 - DNA, 20 bp, Artificial Sequence
  Description of Artificial Sequence: Synthetic oligonucleotide
  Target: FXN; (-) strand; PAM type: NRG; PAM sequence: GGG
tgttctttgacatttgccaa

SEQ ID NO: 8529 - DNA, 20 bp, Artificial Sequence
  Description of Artificial Sequence: Synthetic oligonucleotide
  Target: FXN; (-) strand; PAM type: NRG; PAM sequence: AGG
atgttctttgacatttgcca

SEQ ID NO: 8530 - DNA, 20 bp, Artificial Sequence
  Description of Artificial Sequence: Synthetic oligonucleotide
  Target: FXN; (-) strand; PAM type: NRG; PAM sequence: AAG
gatgttctttgacatttgcc

SEQ ID NO: 8531 - DNA, 20 bp, Artificial Sequence
  Description of Artificial Sequence: Synthetic oligonucleotide
  Target: FXN; (-) strand; PAM type: NRG; PAM sequence: AGG
tggtaagagagattgataaa

SEQ ID NO: 8532 - DNA, 20 bp, Artificial Sequence
  Description of Artificial Sequence: Synthetic oligonucleotide
  Target: FXN; (-) strand; PAM type: NRG; PAM sequence: AAG
ttggtaagagagattgataa

SEQ ID NO: 8533 - DNA, 20 bp, Artificial Sequence
  Description of Artificial Sequence: Synthetic oligonucleotide
  Target: FXN; (-) strand; PAM type: NRG; PAM sequence: GAG
gcttggattgattggtaaga

SEQ ID NO: 8534 - DNA, 20 bp, Artificial Sequence
  Description of Artificial Sequence: Synthetic oligonucleotide
  Target: FXN; (-) strand; PAM type: NRG; PAM sequence: GAG
ttgcttggattgattggtaa

SEQ ID NO: 8535 - DNA, 20 bp, Artificial Sequence
  Description of Artificial Sequence: Synthetic oligonucleotide
  Target: FXN; (-) strand; PAM type: NRG; PAM sequence: AAG
atttgcttggattgattggt

SEQ ID NO: 8536 - DNA, 20 bp, Artificial Sequence
  Description of Artificial Sequence: Synthetic oligonucleotide
  Target: FXN; (-) strand; PAM type: NRG; PAM sequence: TGG
ctgcatttgcttggattgat

SEQ ID NO: 8537 - DNA, 20 bp, Artificial Sequence
  Description of Artificial Sequence: Synthetic oligonucleotide
  Target: FXN; (-) strand; PAM type: NRG; PAM sequence: TGG
gaaatcccactgcatttgct

SEQ ID NO: 8538 - DNA, 20 bp, Artificial Sequence
  Description of Artificial Sequence: Synthetic oligonucleotide
  Target: FXN; (-) strand; PAM type: NRG; PAM sequence: AAG
gtgacttcaactctggggaa

SEQ ID NO: 8539 - DNA, 20 bp, Artificial Sequence
  Description of Artificial Sequence: Synthetic oligonucleotide
  Target: FXN; (-) strand; PAM type: NRG; PAM sequence: GGG
aggaggtgacttcaactctg

SEQ ID NO: 8540 - DNA, 20 bp, Artificial Sequence
  Description of Artificial Sequence: Synthetic oligonucleotide
  Target: FXN; (-) strand; PAM type: NRG; PAM sequence: GGG
caggaggtgacttcaactct

SEQ ID NO: 8541 - DNA, 20 bp, Artificial Sequence
  Description of Artificial Sequence: Synthetic oligonucleotide
  Target: FXN; (-) strand; PAM type: NRG; PAM sequence: TGG
tcaggaggtgacttcaactc

SEQ ID NO: 8542 - DNA, 20 bp, Artificial Sequence
  Description of Artificial Sequence: Synthetic oligonucleotide
  Target: FXN; (-) strand; PAM type: NRG; PAM sequence: AGG
agacttaacttcctgtcagg

SEQ ID NO: 8543 - DNA, 20 bp, Artificial Sequence
  Description of Artificial Sequence: Synthetic oligonucleotide
  Target: FXN; (-) strand; PAM type: NRG; PAM sequence: GAG
aagacttaacttcctgtcag

SEQ ID NO: 8544 - DNA, 20 bp, Artificial Sequence
  Description of Artificial Sequence: Synthetic oligonucleotide
  Target: FXN; (-) strand; PAM type: NRG; PAM sequence: AGG
taaagacttaacttcctgtc

SEQ ID NO: 8545 - DNA, 20 bp, Artificial Sequence
  Description of Artificial Sequence: Synthetic oligonucleotide
  Target: FXN; (-) strand; PAM type: NRG; PAM sequence: CAG
ctaaagacttaacttcctgt

SEQ ID NO: 8546 - DNA, 20 bp, Artificial Sequence
  Description of Artificial Sequence: Synthetic oligonucleotide
  Target: FXN; (-) strand; PAM type: NRG; PAM sequence: AAG
gtgctatgattcagtgccta

SEQ ID NO: 8547 - DNA, 20 bp, Artificial Sequence
  Description of Artificial Sequence: Synthetic oligonucleotide
  Target: FXN; (-) strand; PAM type: NRG; PAM sequence: CAG
ttcagctcagtgctatgatt

SEQ ID NO: 8548 - DNA, 20 bp, Artificial Sequence
  Description of Artificial Sequence: Synthetic oligonucleotide
  Target: FXN; (-) strand; PAM type: NRG; PAM sequence: CAG
cttagtcctgggcttcagct

SEQ ID NO: 8549 - DNA, 20 bp, Artificial Sequence
  Description of Artificial Sequence: Synthetic oligonucleotide
  Target: FXN; (-) strand; PAM type: NRG; PAM sequence: CAG
tcttgcttagtcctgggctt

SEQ ID NO: 8550 - DNA, 20 bp, Artificial Sequence
  Description of Artificial Sequence: Synthetic oligonucleotide
  Target: FXN; (-) strand; PAM type: NRG; PAM sequence: GGG
actcattcttgcttagtcct

SEQ ID NO: 8551 - DNA, 20 bp, Artificial Sequence
  Description of Artificial Sequence: Synthetic oligonucleotide
  Target: FXN; (-) strand; PAM type: NRG; PAM sequence: TGG
cactcattcttgcttagtcc

SEQ ID NO: 8552 - DNA, 20 bp, Artificial Sequence
  Description of Artificial Sequence: Synthetic oligonucleotide
  Target: FXN; (-) strand; PAM type: NRG; PAM sequence: TAG
aattctcactcattcttgct

SEQ ID NO: 8553 - DNA, 20 bp, Artificial Sequence
  Description of Artificial Sequence: Synthetic oligonucleotide
  Target: FXN; (-) strand; PAM type: NRG; PAM sequence: AAG
tctacagatgaccaaacctt

SEQ ID NO: 8554 - DNA, 20 bp, Artificial Sequence
  Description of Artificial Sequence: Synthetic oligonucleotide
  Target: FXN; (-) strand; PAM type: NRG; PAM sequence: CAG
agacaaaacccaatcctcta

SEQ ID NO: 8555 - DNA, 20 bp, Artificial Sequence
  Description of Artificial Sequence: Synthetic oligonucleotide
  Target: FXN; (-) strand; PAM type: NRG; PAM sequence: AAG
caccaaaacaaaaacaaaac

SEQ ID NO: 8556 - DNA, 20 bp, Artificial Sequence
  Description of Artificial Sequence: Synthetic oligonucleotide
  Target: FXN; (-) strand; PAM type: NRG; PAM sequence: AGG
agggcagtgagaaaccttgc

SEQ ID NO: 8557 - DNA, 20 bp, Artificial Sequence
  Description of Artificial Sequence: Synthetic oligonucleotide
  Target: FXN; (-) strand; PAM type: NRG; PAM sequence: CAG
aagggcagtgagaaaccttg

SEQ ID NO: 8558 - DNA, 20 bp, Artificial Sequence
  Description of Artificial Sequence: Synthetic oligonucleotide
  Target: FXN; (-) strand; PAM type: NRG; PAM sequence: GAG
attacctgatgaagggcagt

SEQ ID NO: 8559 - DNA, 20 bp, Artificial Sequence
  Description of Artificial Sequence: Synthetic oligonucleotide
  Target: FXN; (-) strand; PAM type: NRG; PAM sequence: CAG
gcatattacctgatgaaggg

SEQ ID NO: 8560 - DNA, 20 bp, Artificial Sequence
  Description of Artificial Sequence: Synthetic oligonucleotide
  Target: FXN; (-) strand; PAM type: NRG; PAM sequence: GGG
agggcatattacctgatgaa

SEQ ID NO: 8561 - DNA, 20 bp, Artificial Sequence
  Description of Artificial Sequence: Synthetic oligonucleotide
  Target: FXN; (-) strand; PAM type: NRG; PAM sequence: AGG
cagggcatattacctgatga

SEQ ID NO: 8562 - DNA, 20 bp, Artificial Sequence
  Description of Artificial Sequence: Synthetic oligonucleotide
  Target: FXN; (-) strand; PAM type: NRG; PAM sequence: AAG
acagggcatattacctgatg

SEQ ID NO: 8563 - DNA, 20 bp, Artificial Sequence
  Description of Artificial Sequence: Synthetic oligonucleotide
  Target: FXN; (-) strand; PAM type: NRG; PAM sequence: GGG
aattggccagttcagggaca

SEQ ID NO: 8564 - DNA, 20 bp, Artificial Sequence
  Description of Artificial Sequence: Synthetic oligonucleotide
  Target: FXN; (-) strand; PAM type: NRG; PAM sequence: AGG
caattggccagttcagggac

SEQ ID NO: 8565 - DNA, 20 bp, Artificial Sequence
  Description of Artificial Sequence: Synthetic oligonucleotide
  Target: FXN; (-) strand; PAM type: NRG; PAM sequence: CAG
acaattggccagttcaggga

SEQ ID NO: 8566 - DNA, 20 bp, Artificial Sequence
  Description of Artificial Sequence: Synthetic oligonucleotide
  Target: FXN; (-) strand; PAM type: NRG; PAM sequence: GGG
taacacaattggccagttca

SEQ ID NO: 8567 - DNA, 20 bp, Artificial Sequence
  Description of Artificial Sequence: Synthetic oligonucleotide
  Target: FXN; (-) strand; PAM type: NRG; PAM sequence: AGG
gtaacacaattggccagttc

SEQ ID NO: 8568 - DNA, 20 bp, Artificial Sequence
  Description of Artificial Sequence: Synthetic oligonucleotide
  Target: FXN; (-) strand; PAM type: NRG; PAM sequence: CAG
ggtaacacaattggccagtt

SEQ ID NO: 8569 - DNA, 20 bp, Artificial Sequence
  Description of Artificial Sequence: Synthetic oligonucleotide
  Target: FXN; (-) strand; PAM type: NRG; PAM sequence: CAG
aatggggtaacacaattggc

SEQ ID NO: 8570 - DNA, 20 bp, Artificial Sequence
  Description of Artificial Sequence: Synthetic oligonucleotide
  Target: FXN; (-) strand; PAM type: NRG; PAM sequence: TGG
agggaatggggtaacacaat

SEQ ID NO: 8571 - DNA, 20 bp, Artificial Sequence
  Description of Artificial Sequence: Synthetic oligonucleotide
  Target: FXN; (-) strand; PAM type: NRG; PAM sequence: GGG
tcactgttgctaagggaatg

SEQ ID NO: 8572 - DNA, 20 bp, Artificial Sequence
  Description of Artificial Sequence: Synthetic oligonucleotide
  Target: FXN; (-) strand; PAM type: NRG; PAM sequence: GGG
atcactgttgctaagggaat

SEQ ID NO: 8573 - DNA, 20 bp, Artificial Sequence
  Description of Artificial Sequence: Synthetic oligonucleotide
  Target: FXN; (-) strand; PAM type: NRG; PAM sequence: TGG
aatcactgttgctaagggaa

SEQ ID NO: 8574 - DNA, 20 bp, Artificial Sequence
  Description of Artificial Sequence: Synthetic oligonucleotide
  Target: FXN; (-) strand; PAM type: NRG; PAM sequence: GGG
gtagcaatcactgttgctaa

SEQ ID NO: 8575 - DNA, 20 bp, Artificial Sequence
  Description of Artificial Sequence: Synthetic oligonucleotide
  Target: FXN; (-) strand; PAM type: NRG; PAM sequence: AGG
agtagcaatcactgttgcta

SEQ ID NO: 8576 - DNA, 20 bp, Artificial Sequence
  Description of Artificial Sequence: Synthetic oligonucleotide
  Target: FXN; (-) strand; PAM type: NRG; PAM sequence: AAG
cagtagcaatcactgttgct

SEQ ID NO: 8577 - DNA, 20 bp, Artificial Sequence
  Description of Artificial Sequence: Synthetic oligonucleotide
  Target: FXN; (-) strand; PAM type: NRG; PAM sequence: TAG
ttggcctcctgtttcttcag

SEQ ID NO: 8578 - DNA, 20 bp, Artificial Sequence
  Description of Artificial Sequence: Synthetic oligonucleotide
  Target: FXN; (-) strand; PAM type: NRG; PAM sequence: CAG
ttgttggcctcctgtttctt

SEQ ID NO: 8579 - DNA, 20 bp, Artificial Sequence
  Description of Artificial Sequence: Synthetic oligonucleotide
  Target: FXN; (-) strand; PAM type: NRG; PAM sequence: TGG
gaatgagtgatattctttgt

SEQ ID NO: 8580 - DNA, 20 bp, Artificial Sequence
  Description of Artificial Sequence: Synthetic oligonucleotide
  Target: FXN; (-) strand; PAM type: NRG; PAM sequence: GAG
tagacactctactggtgaat

SEQ ID NO: 8581 - DNA, 20 bp, Artificial Sequence
  Description of Artificial Sequence: Synthetic oligonucleotide
  Target: FXN; (-) strand; PAM type: NRG; PAM sequence: TGG
ctctgacatagacactctac

SEQ ID NO: 8582 - DNA, 20 bp, Artificial Sequence
  Description of Artificial Sequence: Synthetic oligonucleotide
  Target: FXN; (-) strand; PAM type: NRG; PAM sequence: TAG
tttatctaatatctctgaca

SEQ ID NO: 8583 - DNA, 20 bp, Artificial Sequence
  Description of Artificial Sequence: Synthetic oligonucleotide
  Target: FXN; (-) strand; PAM type: NRG; PAM sequence: TAG
acagcctgcaatgtaattgt

SEQ ID NO: 8584 - DNA, 20 bp, Artificial Sequence
  Description of Artificial Sequence: Synthetic oligonucleotide
  Target: FXN; (-) strand; PAM type: NRG; PAM sequence: CAG
ggtacctctctctgtttcca

SEQ ID NO: 8585 - DNA, 20 bp, Artificial Sequence
  Description of Artificial Sequence: Synthetic oligonucleotide
  Target: FXN; (-) strand; PAM type: NRG; PAM sequence: AGG
tattcccacaggtgtgcctt

SEQ ID NO: 8586 - DNA, 20 bp, Artificial Sequence
  Description of Artificial Sequence: Synthetic oligonucleotide
  Target: FXN; (-) strand; PAM type: NRG; PAM sequence: TAG
atattcccacaggtgtgcct

SEQ ID NO: 8587 - DNA, 20 bp, Artificial Sequence
  Description of Artificial Sequence: Synthetic oligonucleotide
  Target: FXN; (-) strand; PAM type: NRG; PAM sequence: AGG
ccaaactttcatattcccac

SEQ ID NO: 8588 - DNA, 20 bp, Artificial Sequence
  Description of Artificial Sequence: Synthetic oligonucleotide
  Target: FXN; (-) strand; PAM type: NRG; PAM sequence: CAG
accaaactttcatattccca

SEQ ID NO: 8589 - DNA, 20 bp, Artificial Sequence
  Description of Artificial Sequence: Synthetic oligonucleotide
  Target: FXN; (-) strand; PAM type: NRG; PAM sequence: CAG
atgtcagaggtgacttcctc

SEQ ID NO: 8590 - DNA, 20 bp, Artificial Sequence
  Description of Artificial Sequence: Synthetic oligonucleotide
  Target: FXN; (-) strand; PAM type: NRG; PAM sequence: AGG
ggactcaactcaaatgtcag

SEQ ID NO: 8591 - DNA, 20 bp, Artificial Sequence
  Description of Artificial Sequence: Synthetic oligonucleotide
  Target: FXN; (-) strand; PAM type: NRG; PAM sequence: GAG
aggactcaactcaaatgtca

SEQ ID NO: 8592 - DNA, 20 bp, Artificial Sequence
  Description of Artificial Sequence: Synthetic oligonucleotide
  Target: FXN; (-) strand; PAM type: NRG; PAM sequence: CAG
gtaggactcaactcaaatgt

SEQ ID NO: 8593 - DNA, 20 bp, Artificial Sequence
  Description of Artificial Sequence: Synthetic oligonucleotide
  Target: FXN; (-) strand; PAM type: NRG; PAM sequence: AGG
ctactttcttcatatcctgt

SEQ ID NO: 8594 - DNA, 20 bp, Artificial Sequence
  Description of Artificial Sequence: Synthetic oligonucleotide
  Target: FXN; (-) strand; PAM type: NRG; PAM sequence: TAG
gctactttcttcatatcctg

SEQ ID NO: 8595 - DNA, 20 bp, Artificial Sequence
  Description of Artificial Sequence: Synthetic oligonucleotide
  Target: FXN; (-) strand; PAM type: NRG; PAM sequence: GGG
gccatagtaaccggaacatg

SEQ ID NO: 8596 - DNA, 20 bp, Artificial Sequence
  Description of Artificial Sequence: Synthetic oligonucleotide
  Target: FXN; (-) strand; PAM type: NRG; PAM sequence: GGG
agccatagtaaccggaacat

SEQ ID NO: 8597 - DNA, 20 bp, Artificial Sequence
  Description of Artificial Sequence: Synthetic oligonucleotide
  Target: FXN; (-) strand; PAM type: NRG; PAM sequence: TGG
cagccatagtaaccggaaca

SEQ ID NO: 8598 - DNA, 20 bp, Artificial Sequence
  Description of Artificial Sequence: Synthetic oligonucleotide
  Target: FXN; (-) strand; PAM type: NRG; PAM sequence: CGG
tattacacagccatagtaac

SEQ ID NO: 8599 - DNA, 20 bp, Artificial Sequence
  Description of Artificial Sequence: Synthetic oligonucleotide
  Target: FXN; (-) strand; PAM type: NRG; PAM sequence: TAG
ggtaatttattacacagcca

SEQ ID NO: 8600 - DNA, 20 bp, Artificial Sequence
  Description of Artificial Sequence: Synthetic oligonucleotide
  Target: FXN; (-) strand; PAM type: NRG; PAM sequence: CAG
gttttaggtaatttattaca

SEQ ID NO: 8601 - DNA, 20 bp, Artificial Sequence
  Description of Artificial Sequence: Synthetic oligonucleotide
  Target: FXN; (-) strand; PAM type: NRG; PAM sequence: AGG
gctttaatccagtatgtttt

SEQ ID NO: 8602 - DNA, 20 bp, Artificial Sequence
  Description of Artificial Sequence: Synthetic oligonucleotide
  Target: FXN; (-) strand; PAM type: NRG; PAM sequence: TAG
agctttaatccagtatgttt

SEQ ID NO: 8603 - DNA, 20 bp, Artificial Sequence
  Description of Artificial Sequence: Synthetic oligonucleotide
  Target: FXN; (-) strand; PAM type: NRG; PAM sequence: CAG
atgttttcatagctttaatc

SEQ ID NO: 8604 - DNA, 20 bp, Artificial Sequence
  Description of Artificial Sequence: Synthetic oligonucleotide
  Target: FXN; (-) strand; PAM type: NRG; PAM sequence: TAG
gggcagaaaagatgttttca

SEQ ID NO: 8605 - DNA, 20 bp, Artificial Sequence
  Description of Artificial Sequence: Synthetic oligonucleotide
  Target: FXN; (-) strand; PAM type: NRG; PAM sequence: AAG
cacagaatctctgggcagaa

SEQ ID NO: 8606 - DNA, 20 bp, Artificial Sequence
  Description of Artificial Sequence: Synthetic oligonucleotide
  Target: FXN; (-) strand; PAM type: NRG; PAM sequence: CAG
aggcccacagaatctctggg

SEQ ID NO: 8607 - DNA, 20 bp, Artificial Sequence
  Description of Artificial Sequence: Synthetic oligonucleotide
  Target: FXN; (-) strand; PAM type: NRG; PAM sequence: GGG
ttcaggcccacagaatctct

SEQ ID NO: 8608 - DNA, 20 bp, Artificial Sequence
  Description of Artificial Sequence: Synthetic oligonucleotide
  Target: FXN; (-) strand; PAM type: NRG; PAM sequence: TGG
tttcaggcccacagaatctc

SEQ ID NO: 8609 - DNA, 20 bp, Artificial Sequence
  Description of Artificial Sequence: Synthetic oligonucleotide
  Target: FXN; (-) strand; PAM type: NRG; PAM sequence: CAG
ccatgtgaatttcaggccca

SEQ ID NO: 8610 - DNA, 20 bp, Artificial Sequence
  Description of Artificial Sequence: Synthetic oligonucleotide
  Target: FXN; (-) strand; PAM type: NRG; PAM sequence: AGG
atgtgttccatgtgaatttc

SEQ ID NO: 8611 - DNA, 20 bp, Artificial Sequence
  Description of Artificial Sequence: Synthetic oligonucleotide
  Target: FXN; (-) strand; PAM type: NRG; PAM sequence: CAG
tatgtgttccatgtgaattt

SEQ ID NO: 8612 - DNA, 20 bp, Artificial Sequence
  Description of Artificial Sequence: Synthetic oligonucleotide
  Target: FXN; (-) strand; PAM type: NRG; PAM sequence: AGG
gacatcatggagcagaaaca

SEQ ID NO: 8613 - DNA, 20 bp, Artificial Sequence
  Description of Artificial Sequence: Synthetic oligonucleotide
  Target: FXN; (-) strand; PAM type: NRG; PAM sequence: AAG
agacatcatggagcagaaac

SEQ ID NO: 8614 - DNA, 20 bp, Artificial Sequence
  Description of Artificial Sequence: Synthetic oligonucleotide
  Target: FXN; (-) strand; PAM type: NRG; PAM sequence: CAG
aatccttagacatcatggag

SEQ ID NO: 8615 - DNA, 20 bp, Artificial Sequence
  Description of Artificial Sequence: Synthetic oligonucleotide
  Target: FXN; (-) strand; PAM type: NRG; PAM sequence: GAG
ctgaatccttagacatcatg

SEQ ID NO: 8616 - DNA, 20 bp, Artificial Sequence
  Description of Artificial Sequence: Synthetic oligonucleotide
  Target: FXN; (-) strand; PAM type: NRG; PAM sequence: TGG
agctgaatccttagacatca

SEQ ID NO: 8617 - DNA, 20 bp, Artificial Sequence
  Description of Artificial Sequence: Synthetic oligonucleotide
  Target: FXN; (-) strand; PAM type: NRG; PAM sequence: TAG
cagtcttccagctgaatcct

SEQ ID NO: 8618 - DNA, 20 bp, Artificial Sequence
  Description of Artificial Sequence: Synthetic oligonucleotide
  Target: FXN; (-) strand; PAM type: NRG; PAM sequence: CAG
cccccagcctcccagtcttc

SEQ ID NO: 8619 - DNA, 20 bp, Artificial Sequence
  Description of Artificial Sequence: Synthetic oligonucleotide
  Target: FXN; (-) strand; PAM type: NRG; PAM sequence: CAG
aattccagcccccagcctcc

SEQ ID NO: 8620 - DNA, 20 bp, Artificial Sequence
  Description of Artificial Sequence: Synthetic oligonucleotide
  Target: FXN; (-) strand; PAM type: NRG; PAM sequence: CAG
ttcagataaattccagcccc

SEQ ID NO: 8621 - DNA, 20 bp, Artificial Sequence
  Description of Artificial Sequence: Synthetic oligonucleotide
  Target: FXN; (-) strand; PAM type: NRG; PAM sequence: CAG
gtcattcttcagataaattc

SEQ ID NO: 8622 - DNA, 20 bp, Artificial Sequence
  Description of Artificial Sequence: Synthetic oligonucleotide
  Target: FXN; (-) strand; PAM type: NRG; PAM sequence: CAG
catgtaaatgagtcattctt

SEQ ID NO: 8623 - DNA, 20 bp, Artificial Sequence
  Description of Artificial Sequence: Synthetic oligonucleotide
  Target: FXN; (-) strand; PAM type: NRG; PAM sequence: GAG
caaccagtagacatgtaaat

SEQ ID NO: 8624 - DNA, 20 bp, Artificial Sequence
  Description of Artificial Sequence: Synthetic oligonucleotide
  Target: FXN; (-) strand; PAM type: NRG; PAM sequence: TAG
caacagccagggtcaaccag

SEQ ID NO: 8625 - DNA, 20 bp, Artificial Sequence
  Description of Artificial Sequence: Synthetic oligonucleotide
  Target: FXN; (-) strand; PAM type: NRG; PAM sequence: CAG
agccaacagccagggtcaac

SEQ ID NO: 8626 - DNA, 20 bp, Artificial Sequence
  Description of Artificial Sequence: Synthetic oligonucleotide
  Target: FXN; (-) strand; PAM type: NRG; PAM sequence: GGG
gccccctcagccaacagcca

SEQ ID NO: 8627 - DNA, 20 bp, Artificial Sequence
  Description of Artificial Sequence: Synthetic oligonucleotide
  Target: FXN; (-) strand; PAM type: NRG; PAM sequence: AGG
ggccccctcagccaacagcc

SEQ ID NO: 8628 - DNA, 20 bp, Artificial Sequence
  Description of Artificial Sequence: Synthetic oligonucleotide
  Target: FXN; (-) strand; PAM type: NRG; PAM sequence: CAG
aggccccctcagccaacagc

SEQ ID NO: 8629 - DNA, 20 bp, Artificial Sequence
  Description of Artificial Sequence: Synthetic oligonucleotide
  Target: FXN; (-) strand; PAM type: NRG; PAM sequence: CAG
gctgaggccccctcagccaa

SEQ ID NO: 8630 - DNA, 20 bp, Artificial Sequence
  Description of Artificial Sequence: Synthetic oligonucleotide
  Target: FXN; (-) strand; PAM type: NRG; PAM sequence: CAG
agagagagctgaggccccct

SEQ ID NO: 8631 - DNA, 20 bp, Artificial Sequence
  Description of Artificial Sequence: Synthetic oligonucleotide
  Target: FXN; (-) strand; PAM type: NRG; PAM sequence: AGG
aaacaatgtagagagagctg

SEQ ID NO: 8632 - DNA, 20 bp, Artificial Sequence
  Description of Artificial Sequence: Synthetic oligonucleotide
  Target: FXN; (-) strand; PAM type: NRG; PAM sequence: GAG
gaaacaatgtagagagagct

SEQ ID NO: 8633 - DNA, 20 bp, Artificial Sequence
  Description of Artificial Sequence: Synthetic oligonucleotide
  Target: FXN; (-) strand; PAM type: NRG; PAM sequence: GAG
gtagagaaacaatgtagaga

SEQ ID NO: 8634 - DNA, 20 bp, Artificial Sequence
  Description of Artificial Sequence: Synthetic oligonucleotide
  Target: FXN; (-) strand; PAM type: NRG; PAM sequence: GAG
aagtagagaaacaatgtaga

SEQ ID NO: 8635 - DNA, 20 bp, Artificial Sequence
  Description of Artificial Sequence: Synthetic oligonucleotide
  Target: FXN; (-) strand; PAM type: NRG; PAM sequence: GAG
caaagtagagaaacaatgta

SEQ ID NO: 8636 - DNA, 20 bp, Artificial Sequence
  Description of Artificial Sequence: Synthetic oligonucleotide
  Target: FXN; (-) strand; PAM type: NRG; PAM sequence: TAG
gccaaagtagagaaacaatg

SEQ ID NO: 8637 - DNA, 20 bp, Artificial Sequence
  Description of Artificial Sequence: Synthetic oligonucleotide
  Target: FXN; (-) strand; PAM type: NRG; PAM sequence: GAG
aatccaaactagccaaagta

SEQ ID NO: 8638 - DNA, 20 bp, Artificial Sequence
  Description of Artificial Sequence: Synthetic oligonucleotide
  Target: FXN; (-) strand; PAM type: NRG; PAM sequence: TAG
gaaatccaaactagccaaag

SEQ ID NO: 8639 - DNA, 20 bp, Artificial Sequence
  Description of Artificial Sequence: Synthetic oligonucleotide
  Target: FXN; (-) strand; PAM type: NRG; PAM sequence: AAG
gaggaaatccaaactagcca

SEQ ID NO: 8640 - DNA, 20 bp, Artificial Sequence
  Description of Artificial Sequence: Synthetic oligonucleotide
  Target: FXN; (-) strand; PAM type: NRG; PAM sequence: TAG
tgttttgaggaaatccaaac

SEQ ID NO: 8641 - DNA, 20 bp, Artificial Sequence
  Description of Artificial Sequence: Synthetic oligonucleotide
  Target: FXN; (-) strand; PAM type: NRG; PAM sequence: AGG
ggaccagccatcatgttttg

SEQ ID NO: 8642 - DNA, 20 bp, Artificial Sequence
  Description of Artificial Sequence: Synthetic oligonucleotide
  Target: FXN; (-) strand; PAM type: NRG; PAM sequence: GAG
aggaccagccatcatgtttt

SEQ ID NO: 8643 - DNA, 20 bp, Artificial Sequence
  Description of Artificial Sequence: Synthetic oligonucleotide
  Target: FXN; (-) strand; PAM type: NRG; PAM sequence: CAG
gggatgctgacactgaggac

SEQ ID NO: 8644 - DNA, 20 bp, Artificial Sequence
  Description of Artificial Sequence: Synthetic oligonucleotide
  Target: FXN; (-) strand; PAM type: NRG; PAM sequence: AGG
tttttgggatgctgacactg

SEQ ID NO: 8645 - DNA, 20 bp, Artificial Sequence
  Description of Artificial Sequence: Synthetic oligonucleotide
  Target: FXN; (-) strand; PAM type: NRG; PAM sequence: GAG
ctttttgggatgctgacact

SEQ ID NO: 8646 - DNA, 20 bp, Artificial Sequence
  Description of Artificial Sequence: Synthetic oligonucleotide
  Target: FXN; (-) strand; PAM type: NRG; PAM sequence: GGG
gtgtccggcattctcttttt

SEQ ID NO: 8647 - DNA, 20 bp, Artificial Sequence
  Description of Artificial Sequence: Synthetic oligonucleotide
  Target: FXN; (-) strand; PAM type: NRG; PAM sequence: TGG
tgtgtccggcattctctttt

SEQ ID NO: 8648 - DNA, 20 bp, Artificial Sequence
  Description of Artificial Sequence: Synthetic oligonucleotide
  Target: FXN; (-) strand; PAM type: NRG; PAM sequence: CGG
caggtgtgagccactgtgtc

SEQ ID NO: 8649 - DNA, 20 bp, Artificial Sequence
  Description of Artificial Sequence: Synthetic oligonucleotide
  Target: FXN; (-) strand; PAM type: NRG; PAM sequence: GAG
attgctgaggttacaggtgt

SEQ ID NO: 8650 - DNA, 20 bp, Artificial Sequence
  Description of Artificial Sequence: Synthetic oligonucleotide
  Target: FXN; (-) strand; PAM type: NRG; PAM sequence: AGG
tcccaaattgctgaggttac

SEQ ID NO: 8651 - DNA, 20 bp, Artificial Sequence
  Description of Artificial Sequence: Synthetic oligonucleotide
  Target: FXN; (-) strand; PAM type: NRG; PAM sequence: CAG
ctcccaaattgctgaggtta

SEQ ID NO: 8652 - DNA, 20 bp, Artificial Sequence
  Description of Artificial Sequence: Synthetic oligonucleotide
  Target: FXN; (-) strand; PAM type: NRG; PAM sequence: AGG
ctcagcctcccaaattgctg

SEQ ID NO: 8653 - DNA, 20 bp, Artificial Sequence
  Description of Artificial Sequence: Synthetic oligonucleotide
  Target: FXN; (-) strand; PAM type: NRG; PAM sequence: GAG
cctcagcctcccaaattgct

SEQ ID NO: 8654 - DNA, 20 bp, Artificial Sequence
  Description of Artificial Sequence: Synthetic oligonucleotide
  Target: FXN; (-) strand; PAM type: NRG; PAM sequence: CAG
actcaagcaacctcccacct

SEQ ID NO: 8655 - DNA, 20 bp, Artificial Sequence
  Description of Artificial Sequence: Synthetic oligonucleotide
  Target: FXN; (-) strand; PAM type: NRG; PAM sequence: AAG
ggtcttgaactcctgaactc

SEQ ID NO: 8656 - DNA, 20 bp, Artificial Sequence
  Description of Artificial Sequence: Synthetic oligonucleotide
  Target: FXN; (-) strand; PAM type: NRG; PAM sequence: TGG
tctcactatgttgcccaggc

SEQ ID NO: 8657 - DNA, 20 bp, Artificial Sequence
  Description of Artificial Sequence: Synthetic oligonucleotide
  Target: FXN; (-) strand; PAM type: NRG; PAM sequence: AGG
agagtctcactatgttgccc

SEQ ID NO: 8658 - DNA, 20 bp, Artificial Sequence
  Description of Artificial Sequence: Synthetic oligonucleotide
  Target: FXN; (-) strand; PAM type: NRG; PAM sequence: CAG
cagagtctcactatgttgcc

SEQ ID NO: 8659 - DNA, 20 bp, Artificial Sequence
  Description of Artificial Sequence: Synthetic oligonucleotide
  Target: FXN; (-) strand; PAM type: NRG; PAM sequence: GAG
aaaaatttttggtagagaca

SEQ ID NO: 8660 - DNA, 20 bp, Artificial Sequence
  Description of Artificial Sequence: Synthetic oligonucleotide
  Target: FXN; (-) strand; PAM type: NRG; PAM sequence: CAG
ttaaaaatttttggtagaga

SEQ ID NO: 8661 - DNA, 20 bp, Artificial Sequence
  Description of Artificial Sequence: Synthetic oligonucleotide
  Target: FXN; (-) strand; PAM type: NRG; PAM sequence: GAG
aattttaaaaatttttggta

SEQ ID NO: 8662 - DNA, 20 bp, Artificial Sequence
  Description of Artificial Sequence: Synthetic oligonucleotide
  Target: FXN; (-) strand; PAM type: NRG; PAM sequence: TAG
aaaattttaaaaatttttgg

SEQ ID NO: 8663 - DNA, 20 bp, Artificial Sequence
  Description of Artificial Sequence: Synthetic oligonucleotide
  Target: FXN; (-) strand; PAM type: NRG; PAM sequence: TGG
tttaaaattttaaaaatttt

SEQ ID NO: 8664 - DNA, 20 bp, Artificial Sequence
  Description of Artificial Sequence: Synthetic oligonucleotide
  Target: FXN; (-) strand; PAM type: NRG; PAM sequence: TGG
taggtgtgcataaccacacc

SEQ ID NO: 8665 - DNA, 20 bp, Artificial Sequence
  Description of Artificial Sequence: Synthetic oligonucleotide
  Target: FXN; (-) strand; PAM type: NRG; PAM sequence: AGG
tcctaagtaactgggactat

SEQ ID NO: 8666 - DNA, 20 bp, Artificial Sequence
  Description of Artificial Sequence: Synthetic oligonucleotide
  Target: FXN; (-) strand; PAM type: NRG; PAM sequence: TAG
ctcctaagtaactgggacta

SEQ ID NO: 8667 - DNA, 20 bp, Artificial Sequence
  Description of Artificial Sequence: Synthetic oligonucleotide
  Target: FXN; (-) strand; PAM type: NRG; PAM sequence: GGG
cctcagcctcctaagtaact

SEQ ID NO: 8668 - DNA, 20 bp, Artificial Sequence
  Description of Artificial Sequence: Synthetic oligonucleotide
  Target: FXN; (-) strand; PAM type: NRG; PAM sequence: TGG
gcctcagcctcctaagtaac

SEQ ID NO: 8669 - DNA, 20 bp, Artificial Sequence
  Description of Artificial Sequence: Synthetic oligonucleotide
  Target: FXN; (-) strand; PAM type: NRG; PAM sequence: AAG
tcctcctgcctcagcctcct

SEQ ID NO: 8670 - DNA, 20 bp, Artificial Sequence
  Description of Artificial Sequence: Synthetic oligonucleotide
  Target: FXN; (-) strand; PAM type: NRG; PAM sequence: CAG
atcaagtgatcctcctgcct

SEQ ID NO: 8671 - DNA, 20 bp, Artificial Sequence
  Description of Artificial Sequence: Synthetic oligonucleotide
  Target: FXN; (-) strand; PAM type: NRG; PAM sequence: AAG
agccttgacctcctggaatc

SEQ ID NO: 8672 - DNA, 20 bp, Artificial Sequence
  Description of Artificial Sequence: Synthetic oligonucleotide
  Target: FXN; (-) strand; PAM type: NRG; PAM sequence: TGG
tcacagcagccttgacctcc

SEQ ID NO: 8673 - DNA, 20 bp, Artificial Sequence
  Description of Artificial Sequence: Synthetic oligonucleotide
  Target: FXN; (-) strand; PAM type: NRG; PAM sequence: CAG
ggtgtggtcatagctcacag

SEQ ID NO: 8674 - DNA, 20 bp, Artificial Sequence
  Description of Artificial Sequence: Synthetic oligonucleotide
  Target: FXN; (-) strand; PAM type: NRG; PAM sequence: CAG
agtggtgtggtcatagctca

SEQ ID NO: 8675 - DNA, 20 bp, Artificial Sequence
  Description of Artificial Sequence: Synthetic oligonucleotide
  Target: FXN; (-) strand; PAM type: NRG; PAM sequence: TAG
gaaatgcagtggtgtggtca

SEQ ID NO: 8676 - DNA, 20 bp, Artificial Sequence
  Description of Artificial Sequence: Synthetic oligonucleotide
  Target: FXN; (-) strand; PAM type: NRG; PAM sequence: TGG
caggctgaaatgcagtggtg

SEQ ID NO: 8677 - DNA, 20 bp, Artificial Sequence
  Description of Artificial Sequence: Synthetic oligonucleotide
  Target: FXN; (-) strand; PAM type: NRG; PAM sequence: TGG
ttacccaggctgaaatgcag

SEQ ID NO: 8678 - DNA, 20 bp, Artificial Sequence
  Description of Artificial Sequence: Synthetic oligonucleotide
  Target: FXN; (-) strand; PAM type: NRG; PAM sequence: CAG
ctgttacccaggctgaaatg

SEQ ID NO: 8679 - DNA, 20 bp, Artificial Sequence
  Description of Artificial Sequence: Synthetic oligonucleotide
  Target: FXN; (-) strand; PAM type: NRG; PAM sequence: AGG
agagtctcattctgttaccc

SEQ ID NO: 8680 - DNA, 20 bp, Artificial Sequence
  Description of Artificial Sequence: Synthetic oligonucleotide
  Target: FXN; (-) strand; PAM type: NRG; PAM sequence: CAG
cagagtctcattctgttacc

SEQ ID NO: 8681 - DNA, 20 bp, Artificial Sequence
  Description of Artificial Sequence: Synthetic oligonucleotide
  Target: FXN; (-) strand; PAM type: NRG; PAM sequence: GAG
gtttttgtttgtttgaaaca

SEQ ID NO: 8682 - DNA, 20 bp, Artificial Sequence
  Description of Artificial Sequence: Synthetic oligonucleotide
  Target: FXN; (-) strand; PAM type: NRG; PAM sequence: CAG
gggtttttgtttgtttgaaa

SEQ ID NO: 8683 - DNA, 20 bp, Artificial Sequence
  Description of Artificial Sequence: Synthetic oligonucleotide
  Target: FXN; (-) strand; PAM type: NRG; PAM sequence: GGG
tctctctttttttttttttt

SEQ ID NO: 8684 - DNA, 20 bp, Artificial Sequence
  Description of Artificial Sequence: Synthetic oligonucleotide
  Target: FXN; (-) strand; PAM type: NRG; PAM sequence: TGG
ctctctcttttttttttttt

SEQ ID NO: 8685 - DNA, 20 bp, Artificial Sequence
  Description of Artificial Sequence: Synthetic oligonucleotide
  Target: FXN; (-) strand; PAM type: NRG; PAM sequence: AGG
gcttggtgacttccaagtcc

SEQ ID NO: 8686 - DNA, 20 bp, Artificial Sequence
  Description of Artificial Sequence: Synthetic oligonucleotide
  Target: FXN; (-) strand; PAM type: NRG; PAM sequence: CAG
tgcttggtgacttccaagtc

SEQ ID NO: 8687 - DNA, 20 bp, Artificial Sequence
  Description of Artificial Sequence: Synthetic oligonucleotide
  Target: FXN; (-) strand; PAM type: NRG; PAM sequence: AAG
agtgctgcttggtgacttcc

SEQ ID NO: 8688 - DNA, 20 bp, Artificial Sequence
  Description of Artificial Sequence: Synthetic oligonucleotide
  Target: FXN; (-) strand; PAM type: NRG; PAM sequence: TGG
ggtactgcagaagtgctgct

SEQ ID NO: 8689 - DNA, 20 bp, Artificial Sequence
  Description of Artificial Sequence: Synthetic oligonucleotide
  Target: FXN; (-) strand; PAM type: NRG; PAM sequence: AAG
caaccaacagggtactgcag

SEQ ID NO: 8690 - DNA, 20 bp, Artificial Sequence
  Description of Artificial Sequence: Synthetic oligonucleotide
  Target: FXN; (-) strand; PAM type: NRG; PAM sequence: CAG
ttccaaccaacagggtactg

SEQ ID NO: 8691 - DNA, 20 bp, Artificial Sequence
  Description of Artificial Sequence: Synthetic oligonucleotide
  Target: FXN; (-) strand; PAM type: NRG; PAM sequence: GGG
tacaactattccaaccaaca

SEQ ID NO: 8692 - DNA, 20 bp, Artificial Sequence
  Description of Artificial Sequence: Synthetic oligonucleotide
  Target: FXN; (-) strand; PAM type: NRG; PAM sequence: AGG
ctacaactattccaaccaac

SEQ ID NO: 8693 - DNA, 20 bp, Artificial Sequence
  Description of Artificial Sequence: Synthetic oligonucleotide
  Target: FXN; (-) strand; PAM type: NRG; PAM sequence: CAG
gctacaactattccaaccaa

SEQ ID NO: 8694 - DNA, 20 bp, Artificial Sequence
  Description of Artificial Sequence: Synthetic oligonucleotide
  Target: FXN; (-) strand; PAM type: NRG; PAM sequence: GGG
ctcccttcgaattcgggttt

SEQ ID NO: 8695 - DNA, 20 bp, Artificial Sequence
  Description of Artificial Sequence: Synthetic oligonucleotide
  Target: FXN; (-) strand; PAM type: NRG; PAM sequence: TGG
cctcccttcgaattcgggtt

SEQ ID NO: 8696 - DNA, 20 bp, Artificial Sequence
  Description of Artificial Sequence: Synthetic oligonucleotide
  Target: FXN; (-) strand; PAM type: NRG; PAM sequence: GGG
attctcctcccttcgaattc

SEQ ID NO: 8697 - DNA, 20 bp, Artificial Sequence
  Description of Artificial Sequence: Synthetic oligonucleotide
  Target: FXN; (-) strand; PAM type: NRG; PAM sequence: CGG
tattctcctcccttcgaatt

SEQ ID NO: 8698 - DNA, 20 bp, Artificial Sequence
  Description of Artificial Sequence: Synthetic oligonucleotide
  Target: FXN; (-) strand; PAM type: NRG; PAM sequence: GGG
tttgacattcctgtcaccca

SEQ ID NO: 8699 - DNA, 20 bp, Artificial Sequence
  Description of Artificial Sequence: Synthetic oligonucleotide
  Target: FXN; (-) strand; PAM type: NRG; PAM sequence: AGG
ctttgacattcctgtcaccc

SEQ ID NO: 8700 - DNA, 20 bp, Artificial Sequence
  Description of Artificial Sequence: Synthetic oligonucleotide
  Target: FXN; (-) strand; PAM type: NRG; PAM sequence: CAG
actttgacattcctgtcacc

SEQ ID NO: 8701 - DNA, 20 bp, Artificial Sequence
  Description of Artificial Sequence: Synthetic oligonucleotide
  Target: FXN; (-) strand; PAM type: NRG; PAM sequence: GGG
tcacatgtcatatgctgttt

SEQ ID NO: 8702 - DNA, 20 bp, Artificial Sequence
  Description of Artificial Sequence: Synthetic oligonucleotide
  Target: FXN; (-) strand; PAM type: NRG; PAM sequence: TGG
gtcacatgtcatatgctgtt

SEQ ID NO: 8703 - DNA, 20 bp, Artificial Sequence
  Description of Artificial Sequence: Synthetic oligonucleotide
  Target: FXN; (-) strand; PAM type: NRG; PAM sequence: AGG
aagattggatcttccaaaga

SEQ ID NO: 8704 - DNA, 20 bp, Artificial Sequence
  Description of Artificial Sequence: Synthetic oligonucleotide
  Target: FXN; (-) strand; PAM type: NRG; PAM sequence: AAG
gaagattggatcttccaaag

SEQ ID NO: 8705 - DNA, 20 bp, Artificial Sequence
  Description of Artificial Sequence: Synthetic oligonucleotide
  Target: FXN; (-) strand; PAM type: NRG; PAM sequence: AAG
atggaagattggatcttcca

SEQ ID NO: 8706 - DNA, 20 bp, Artificial Sequence
  Description of Artificial Sequence: Synthetic oligonucleotide
  Target: FXN; (-) strand; PAM type: NRG; PAM sequence: TGG
ctttgcctggtatggaagat

SEQ ID NO: 8707 - DNA, 20 bp, Artificial Sequence
  Description of Artificial Sequence: Synthetic oligonucleotide
  Target: FXN; (-) strand; PAM type: NRG; PAM sequence: AAG
catccctttgcctggtatgg

SEQ ID NO: 8708 - DNA, 20 bp, Artificial Sequence
  Description of Artificial Sequence: Synthetic oligonucleotide
  Target: FXN; (-) strand; PAM type: NRG; PAM sequence: TGG
ttccatccctttgcctggta

SEQ ID NO: 8709 - DNA, 20 bp, Artificial Sequence
  Description of Artificial Sequence: Synthetic oligonucleotide
  Target: FXN; (-) strand; PAM type: NRG; PAM sequence: TGG
tagtcttccatccctttgcc

SEQ ID NO: 8710 - DNA, 20 bp, Artificial Sequence
  Description of Artificial Sequence: Synthetic oligonucleotide
  Target: FXN; (-) strand; PAM type: NRG; PAM sequence: TAG
ctatccctcatgttgttcct

SEQ ID NO: 8711 - DNA, 20 bp, Artificial Sequence
  Description of Artificial Sequence: Synthetic oligonucleotide
  Target: FXN; (-) strand; PAM type: NRG; PAM sequence: TGG
agtgatgctttttccctctc

SEQ ID NO: 8712 - DNA, 20 bp, Artificial Sequence
  Description of Artificial Sequence: Synthetic oligonucleotide
  Target: FXN; (-) strand; PAM type: NRG; PAM sequence: AAG
ctatttgtagttcctagaac

SEQ ID NO: 8713 - DNA, 20 bp, Artificial Sequence
  Description of Artificial Sequence: Synthetic oligonucleotide
  Target: FXN; (-) strand; PAM type: NRG; PAM sequence: TAG
ttcaagctatttgtagttcc

SEQ ID NO: 8714 - DNA, 20 bp, Artificial Sequence
  Description of Artificial Sequence: Synthetic oligonucleotide
  Target: FXN; (-) strand; PAM type: NRG; PAM sequence: TAG
ttgcttcttcaagctatttg

SEQ ID NO: 8715 - DNA, 20 bp, Artificial Sequence
  Description of Artificial Sequence: Synthetic oligonucleotide
  Target: FXN; (-) strand; PAM type: NRG; PAM sequence: AAG
ctagacatctttgcttcttc

SEQ ID NO: 8716 - DNA, 20 bp, Artificial Sequence
  Description of Artificial Sequence: Synthetic oligonucleotide
  Target: FXN; (-) strand; PAM type: NRG; PAM sequence: TAG
tctgcatattgggaggcatc

SEQ ID NO: 8717 - DNA, 20 bp, Artificial Sequence
  Description of Artificial Sequence: Synthetic oligonucleotide
  Target: FXN; (-) strand; PAM type: NRG; PAM sequence: AGG
accccactctgcatattggg

SEQ ID NO: 8718 - DNA, 20 bp, Artificial Sequence
  Description of Artificial Sequence: Synthetic oligonucleotide
  Target: FXN; (-) strand; PAM type: NRG; PAM sequence: GAG
caccccactctgcatattgg

SEQ ID NO: 8719 - DNA, 20 bp, Artificial Sequence
  Description of Artificial Sequence: Synthetic oligonucleotide
  Target: FXN; (-) strand; PAM type: NRG; PAM sequence: GGG
tacaccccactctgcatatt

SEQ ID NO: 8720 - DNA, 20 bp, Artificial Sequence
  Description of Artificial Sequence: Synthetic oligonucleotide
  Target: FXN; (-) strand; PAM type: NRG; PAM sequence: TGG
gtacaccccactctgcatat

SEQ ID NO: 8721 - DNA, 20 bp, Artificial Sequence
  Description of Artificial Sequence: Synthetic oligonucleotide
  Target: FXN; (-) strand; PAM type: NRG; PAM sequence: CAG
cttgcccaccttagctctcc

SEQ ID NO: 8722 - DNA, 20 bp, Artificial Sequence
  Description of Artificial Sequence: Synthetic oligonucleotide
  Target: FXN; (-) strand; PAM type: NRG; PAM sequence: TAG
ggaagctctcttgcccacct

SEQ ID NO: 8723 - DNA, 20 bp, Artificial Sequence
  Description of Artificial Sequence: Synthetic oligonucleotide
  Target: FXN; (-) strand; PAM type: NRG; PAM sequence: AAG
ctttcttagcatgacagagg

SEQ ID NO: 8724 - DNA, 20 bp, Artificial Sequence
  Description of Artificial Sequence: Synthetic oligonucleotide
  Target: FXN; (-) strand; PAM type: NRG; PAM sequence: AGG
caactttcttagcatgacag

SEQ ID NO: 8725 - DNA, 20 bp, Artificial Sequence
  Description of Artificial Sequence: Synthetic oligonucleotide
  Target: FXN; (-) strand; PAM type: NRG; PAM sequence: GAG
ccaactttcttagcatgaca

SEQ ID NO: 8726 - DNA, 20 bp, Artificial Sequence
  Description of Artificial Sequence: Synthetic oligonucleotide
  Target: FXN; (-) strand; PAM type: NRG; PAM sequence: CAG
ttccaactttcttagcatga

SEQ ID NO: 8727 - DNA, 20 bp, Artificial Sequence
  Description of Artificial Sequence: Synthetic oligonucleotide
  Target: FXN; (-) strand; PAM type: NRG; PAM sequence: TAG
aagataaattccaactttct

SEQ ID NO: 8728 - DNA, 20 bp, Artificial Sequence
  Description of Artificial Sequence: Synthetic oligonucleotide
  Target: FXN; (-) strand; PAM type: NRG; PAM sequence: AAG
cctctgctttcaccaccatc

SEQ ID NO: 8729 - DNA, 20 bp, Artificial Sequence
  Description of Artificial Sequence: Synthetic oligonucleotide
  Target: FXN; (-) strand; PAM type: NRG; PAM sequence: TAG
ctcaaatgtgaatctaacca

SEQ ID NO: 8730 - DNA, 20 bp, Artificial Sequence
  Description of Artificial Sequence: Synthetic oligonucleotide
  Target: FXN; (-) strand; PAM type: NRG; PAM sequence: GGG
gagttaagccagtgtcacca

SEQ ID NO: 8731 - DNA, 20 bp, Artificial Sequence
  Description of Artificial Sequence: Synthetic oligonucleotide
  Target: FXN; (-) strand; PAM type: NRG; PAM sequence: AGG
tgagttaagccagtgtcacc

SEQ ID NO: 8732 - DNA, 20 bp, Artificial Sequence
  Description of Artificial Sequence: Synthetic oligonucleotide
  Target: FXN; (-) strand; PAM type: NRG; PAM sequence: CAG
gtgagttaagccagtgtcac

SEQ ID NO: 8733 - DNA, 20 bp, Artificial Sequence
  Description of Artificial Sequence: Synthetic oligonucleotide
  Target: FXN; (-) strand; PAM type: NRG; PAM sequence: CAG
ggcaaaattgtgagttaagc

SEQ ID NO: 8734 - DNA, 20 bp, Artificial Sequence
  Description of Artificial Sequence: Synthetic oligonucleotide
  Target: FXN; (-) strand; PAM type: NRG; PAM sequence: AAG
cttgggcaaaattgtgagtt

SEQ ID NO: 8735 - DNA, 20 bp, Artificial Sequence
  Description of Artificial Sequence: Synthetic oligonucleotide
  Target: FXN; (-) strand; PAM type: NRG; PAM sequence: GAG
taggccttgggcaaaattgt

SEQ ID NO: 8736 - DNA, 20 bp, Artificial Sequence
  Description of Artificial Sequence: Synthetic oligonucleotide
  Target: FXN; (-) strand; PAM type: NRG; PAM sequence: GGG
actgtggtagcataggcctt

SEQ ID NO: 8737 - DNA, 20 bp, Artificial Sequence
  Description of Artificial Sequence: Synthetic oligonucleotide
  Target: FXN; (-) strand; PAM type: NRG; PAM sequence: TGG
cactgtggtagcataggcct

SEQ ID NO: 8738 - DNA, 20 bp, Artificial Sequence
  Description of Artificial Sequence: Synthetic oligonucleotide
  Target: FXN; (-) strand; PAM type: NRG; PAM sequence: AGG
cagaagcactgtggtagcat

SEQ ID NO: 8739 - DNA, 20 bp, Artificial Sequence
  Description of Artificial Sequence: Synthetic oligonucleotide
  Target: FXN; (-) strand; PAM type: NRG; PAM sequence: TAG
tcagaagcactgtggtagca

SEQ ID NO: 8740 - DNA, 20 bp, Artificial Sequence
  Description of Artificial Sequence: Synthetic oligonucleotide
  Target: FXN; (-) strand; PAM type: NRG; PAM sequence: TAG
aagtttcagaagcactgtgg

SEQ ID NO: 8741 - DNA, 20 bp, Artificial Sequence
  Description of Artificial Sequence: Synthetic oligonucleotide
  Target: FXN; (-) strand; PAM type: NRG; PAM sequence: TGG
ttaaagtttcagaagcactg

SEQ ID NO: 8742 - DNA, 20 bp, Artificial Sequence
  Description of Artificial Sequence: Synthetic oligonucleotide
  Target: FXN; (-) strand; PAM type: NRG; PAM sequence: AAG
aatgtgctttaaagtttcag

SEQ ID NO: 8743 - DNA, 20 bp, Artificial Sequence
  Description of Artificial Sequence: Synthetic oligonucleotide
  Target: FXN; (-) strand; PAM type: NRG; PAM sequence: CAG
tctaatgtgctttaaagttt

SEQ ID NO: 8744 - DNA, 20 bp, Artificial Sequence
  Description of Artificial Sequence: Synthetic oligonucleotide
  Target: FXN; (-) strand; PAM type: NRG; PAM sequence: AAG
ggtgattctaatgtgcttta

SEQ ID NO: 8745 - DNA, 20 bp, Artificial Sequence
  Description of Artificial Sequence: Synthetic oligonucleotide
  Target: FXN; (-) strand; PAM type: NRG; PAM sequence: AGG
catggtttaacaagacctcc

SEQ ID NO: 8746 - DNA, 20 bp, Artificial Sequence
  Description of Artificial Sequence: Synthetic oligonucleotide
  Target: FXN; (-) strand; PAM type: NRG; PAM sequence: CAG
ccatggtttaacaagacctc

SEQ ID NO: 8747 - DNA, 20 bp, Artificial Sequence
  Description of Artificial Sequence: Synthetic oligonucleotide
  Target: FXN; (-) strand; PAM type: NRG; PAM sequence: AAG
ccagcaatccatggtttaac

SEQ ID NO: 8748 - DNA, 20 bp, Artificial Sequence
  Description of Artificial Sequence: Synthetic oligonucleotide
  Target: FXN; (-) strand; PAM type: NRG; PAM sequence: TGG
tttcaaggcccagcaatcca

SEQ ID NO: 8749 - DNA, 20 bp, Artificial Sequence
  Description of Artificial Sequence: Synthetic oligonucleotide
  Target: FXN; (-) strand; PAM type: NRG; PAM sequence: CAG
atctctggggtttcaaggcc

SEQ ID NO: 8750 - DNA, 20 bp, Artificial Sequence
  Description of Artificial Sequence: Synthetic oligonucleotide
  Target: FXN; (-) strand; PAM type: NRG; PAM sequence: AGG
tcagaatctctggggtttca

SEQ ID NO: 8751 - DNA, 20 bp, Artificial Sequence
  Description of Artificial Sequence: Synthetic oligonucleotide
  Target: FXN; (-) strand; PAM type: NRG; PAM sequence: AAG
atcagaatctctggggtttc

SEQ ID NO: 8752 - DNA, 20 bp, Artificial Sequence
  Description of Artificial Sequence: Synthetic oligonucleotide
  Target: FXN; (-) strand; PAM type: NRG; PAM sequence: GGG
ctactgaatcagaatctctg

SEQ ID NO: 8753 - DNA, 20 bp, Artificial Sequence
  Description of Artificial Sequence: Synthetic oligonucleotide
  Target: FXN; (-) strand; PAM type: NRG; PAM sequence: GGG
tctactgaatcagaatctct

SEQ ID NO: 8754 - DNA, 20 bp, Artificial Sequence
  Description of Artificial Sequence: Synthetic oligonucleotide
  Target: FXN; (-) strand; PAM type: NRG; PAM sequence: TGG
atctactgaatcagaatctc

SEQ ID NO: 8755 - DNA, 20 bp, Artificial Sequence
  Description of Artificial Sequence: Synthetic oligonucleotide
  Target: FXN; (-) strand; PAM type: NRG; PAM sequence: CAG
ctattctcgatctactgaat

SEQ ID NO: 8756 - DNA, 20 bp, Artificial Sequence
  Description of Artificial Sequence: Synthetic oligonucleotide
  Target: FXN; (-) strand; PAM type: NRG; PAM sequence: AGG
tgttagaaatacaaattctc

SEQ ID NO: 8757 - DNA, 20 bp, Artificial Sequence
  Description of Artificial Sequence: Synthetic oligonucleotide
  Target: FXN; (-) strand; PAM type: NRG; PAM sequence: CAG
ttgttagaaatacaaattct

SEQ ID NO: 8758 - DNA, 20 bp, Artificial Sequence
  Description of Artificial Sequence: Synthetic oligonucleotide
  Target: FXN; (-) strand; PAM type: NRG; PAM sequence: TAG
agcatcacctggaaacttgt

SEQ ID NO: 8759 - DNA, 20 bp, Artificial Sequence
  Description of Artificial Sequence: Synthetic oligonucleotide
  Target: FXN; (-) strand; PAM type: NRG; PAM sequence: TGG
ccagcagcctcagcatcacc

SEQ ID NO: 8760 - DNA, 20 bp, Artificial Sequence
  Description of Artificial Sequence: Synthetic oligonucleotide
  Target: FXN; (-) strand; PAM type: NRG; PAM sequence: CAG
ggtcgctgggccagcagcct

SEQ ID NO: 8761 - DNA, 20 bp, Artificial Sequence
  Description of Artificial Sequence: Synthetic oligonucleotide
  Target: FXN; (-) strand; PAM type: NRG; PAM sequence: CAG
aaatgtggtcgctgggccag

SEQ ID NO: 8762 - DNA, 20 bp, Artificial Sequence
  Description of Artificial Sequence: Synthetic oligonucleotide
  Target: FXN; (-) strand; PAM type: NRG; PAM sequence: CAG
atcaaatgtggtcgctgggc

SEQ ID NO: 8763 - DNA, 20 bp, Artificial Sequence
  Description of Artificial Sequence: Synthetic oligonucleotide
  Target: FXN; (-) strand; PAM type: NRG; PAM sequence: GGG
gattatcaaatgtggtcgct

SEQ ID NO: 8764 - DNA, 20 bp, Artificial Sequence
  Description of Artificial Sequence: Synthetic oligonucleotide
  Target: FXN; (-) strand; PAM type: NRG; PAM sequence: TGG
tgattatcaaatgtggtcgc

SEQ ID NO: 8765 - DNA, 20 bp, Artificial Sequence
  Description of Artificial Sequence: Synthetic oligonucleotide
  Target: FXN; (-) strand; PAM type: NRG; PAM sequence: TGG
agggctatgattatcaaatg

SEQ ID NO: 8766 - DNA, 20 bp, Artificial Sequence
  Description of Artificial Sequence: Synthetic oligonucleotide
  Target: FXN; (-) strand; PAM type: NRG; PAM sequence: GGG
ttttgataggatttatcaga

SEQ ID NO: 8767 - DNA, 20 bp, Artificial Sequence
  Description of Artificial Sequence: Synthetic oligonucleotide
  Target: FXN; (-) strand; PAM type: NRG; PAM sequence: AGG
attttgataggatttatcag

SEQ ID NO: 8768 - DNA, 20 bp, Artificial Sequence
  Description of Artificial Sequence: Synthetic oligonucleotide
  Target: FXN; (-) strand; PAM type: NRG; PAM sequence: GAG
tattttgataggatttatca

SEQ ID NO: 8769 - DNA, 20 bp, Artificial Sequence
  Description of Artificial Sequence: Synthetic oligonucleotide
  Target: FXN; (-) strand; PAM type: NRG; PAM sequence: CAG
gatattttgataggatttat

SEQ ID NO: 8770 - DNA, 20 bp, Artificial Sequence
  Description of Artificial Sequence: Synthetic oligonucleotide
  Target: FXN; (-) strand; PAM type: NRG; PAM sequence: AGG
tgccattaggatattttgat

SEQ ID NO: 8771 - DNA, 20 bp, Artificial Sequence
  Description of Artificial Sequence: Synthetic oligonucleotide
  Target: FXN; (-) strand; PAM type: NRG; PAM sequence: TAG
ctgccattaggatattttga

SEQ ID NO: 8772 - DNA, 20 bp, Artificial Sequence
  Description of Artificial Sequence: Synthetic oligonucleotide
  Target: FXN; (-) strand; PAM type: NRG; PAM sequence: AGG
aattcccttgctctgccatt

SEQ ID NO: 8773 - DNA, 20 bp, Artificial Sequence
  Description of Artificial Sequence: Synthetic oligonucleotide
  Target: FXN; (-) strand; PAM type: NRG; PAM sequence: TAG
gaattcccttgctctgccat

SEQ ID NO: 8774 - DNA, 20 bp, Artificial Sequence
  Description of Artificial Sequence: Synthetic oligonucleotide
  Target: FXN; (-) strand; PAM type: NRG; PAM sequence: CAG
tgggtaggggaggatatcac

SEQ ID NO: 8775 - DNA, 20 bp, Artificial Sequence
  Description of Artificial Sequence: Synthetic oligonucleotide
  Target: FXN; (-) strand; PAM type: NRG; PAM sequence: AGG
tgtcaggttatgggtagggg

SEQ ID NO: 8776 - DNA, 20 bp, Artificial Sequence
  Description of Artificial Sequence: Synthetic oligonucleotide
  Target: FXN; (-) strand; PAM type: NRG; PAM sequence: GAG
ctgtcaggttatgggtaggg

SEQ ID NO: 8777 - DNA, 20 bp, Artificial Sequence
  Description of Artificial Sequence: Synthetic oligonucleotide
  Target: FXN; (-) strand; PAM type: NRG; PAM sequence: GGG
agctgtcaggttatgggtag

SEQ ID NO: 8778 - DNA, 20 bp, Artificial Sequence
  Description of Artificial Sequence: Synthetic oligonucleotide
  Target: FXN; (-) strand; PAM type: NRG; PAM sequence: GGG
tagctgtcaggttatgggta

SEQ ID NO: 8779 - DNA, 20 bp, Artificial Sequence
  Description of Artificial Sequence: Synthetic oligonucleotide
  Target: FXN; (-) strand; PAM type: NRG; PAM sequence: AGG
atagctgtcaggttatgggt

SEQ ID NO: 8780 - DNA, 20 bp, Artificial Sequence
  Description of Artificial Sequence: Synthetic oligonucleotide
  Target: FXN; (-) strand; PAM type: NRG; PAM sequence: TAG
aatagctgtcaggttatggg

SEQ ID NO: 8781 - DNA, 20 bp, Artificial Sequence
  Description of Artificial Sequence: Synthetic oligonucleotide
  Target: FXN; (-) strand; PAM type: NRG; PAM sequence: GGG
cctaatagctgtcaggttat

SEQ ID NO: 8782 - DNA, 20 bp, Artificial Sequence
  Description of Artificial Sequence: Synthetic oligonucleotide
  Target: FXN; (-) strand; PAM type: NRG; PAM sequence: TGG
tcctaatagctgtcaggtta

SEQ ID NO: 8783 - DNA, 20 bp, Artificial Sequence
  Description of Artificial Sequence: Synthetic oligonucleotide
  Target: FXN; (-) strand; PAM type: NRG; PAM sequence: AGG
ggcagatcctaatagctgtc

SEQ ID NO: 8784 - DNA, 20 bp, Artificial Sequence
  Description of Artificial Sequence: Synthetic oligonucleotide
  Target: FXN; (-) strand; PAM type: NRG; PAM sequence: CAG
aggcagatcctaatagctgt

SEQ ID NO: 8785 - DNA, 20 bp, Artificial Sequence
  Description of Artificial Sequence: Synthetic oligonucleotide
  Target: FXN; (-) strand; PAM type: NRG; PAM sequence: TAG
ctcaagtaggcagatcctaa

SEQ ID NO: 8786 - DNA, 20 bp, Artificial Sequence
  Description of Artificial Sequence: Synthetic oligonucleotide
  Target: FXN; (-) strand; PAM type: NRG; PAM sequence: CAG
tgcttttagcctcaagtagg

SEQ ID NO: 8787 - DNA, 20 bp, Artificial Sequence
  Description of Artificial Sequence: Synthetic oligonucleotide
  Target: FXN; (-) strand; PAM type: NRG; PAM sequence: AGG
ggttgcttttagcctcaagt

SEQ ID NO: 8788 - DNA, 20 bp, Artificial Sequence
  Description of Artificial Sequence: Synthetic oligonucleotide
  Target: FXN; (-) strand; PAM type: NRG; PAM sequence: TAG
tggttgcttttagcctcaag

SEQ ID NO: 8789 - DNA, 20 bp, Artificial Sequence
  Description of Artificial Sequence: Synthetic oligonucleotide
  Target: FXN; (-) strand; PAM type: NRG; PAM sequence: AAG
tcttggttgcttttagcctc

SEQ ID NO: 8790 - DNA, 20 bp, Artificial Sequence
  Description of Artificial Sequence: Synthetic oligonucleotide
  Target: FXN; (-) strand; PAM type: NRG; PAM sequence: TAG
gttcctctcttggttgcttt

SEQ ID NO: 8791 - DNA, 20 bp, Artificial Sequence
  Description of Artificial Sequence: Synthetic oligonucleotide
  Target: FXN; (-) strand; PAM type: NRG; PAM sequence: TGG
cactgtagctgttcctctct

SEQ ID NO: 8792 - DNA, 20 bp, Artificial Sequence
  Description of Artificial Sequence: Synthetic oligonucleotide
  Target: FXN; (-) strand; PAM type: NRG; PAM sequence: TAG
agggactctgtggtacactg

SEQ ID NO: 8793 - DNA, 20 bp, Artificial Sequence
  Description of Artificial Sequence: Synthetic oligonucleotide
  Target: FXN; (-) strand; PAM type: NRG; PAM sequence: TGG
aaagatgttgagggactctg

SEQ ID NO: 8794 - DNA, 20 bp, Artificial Sequence
  Description of Artificial Sequence: Synthetic oligonucleotide
  Target: FXN; (-) strand; PAM type: NRG; PAM sequence: GGG
ggcgtgggcaaagatgttga

SEQ ID NO: 8795 - DNA, 20 bp, Artificial Sequence
  Description of Artificial Sequence: Synthetic oligonucleotide
  Target: FXN; (-) strand; PAM type: NRG; PAM sequence: AGG
tggcgtgggcaaagatgttg

SEQ ID NO: 8796 - DNA, 20 bp, Artificial Sequence
  Description of Artificial Sequence: Synthetic oligonucleotide
  Target: FXN; (-) strand; PAM type: NRG; PAM sequence: GAG
gtggcgtgggcaaagatgtt

SEQ ID NO: 8797 - DNA, 20 bp, Artificial Sequence
  Description of Artificial Sequence: Synthetic oligonucleotide
  Target: FXN; (-) strand; PAM type: NRG; PAM sequence: AAG
ggggcaccgtggcgtgggca

SEQ ID NO: 8798 - DNA, 20 bp, Artificial Sequence
  Description of Artificial Sequence: Synthetic oligonucleotide
  Target: FXN; (-) strand; PAM type: NRG; PAM sequence: GGG
aagctggggcaccgtggcgt

SEQ ID NO: 8799 - DNA, 20 bp, Artificial Sequence
  Description of Artificial Sequence: Synthetic oligonucleotide
  Target: FXN; (-) strand; PAM type: NRG; PAM sequence: TGG
gaagctggggcaccgtggcg

SEQ ID NO: 8800 - DNA, 20 bp, Artificial Sequence
  Description of Artificial Sequence: Synthetic oligonucleotide
  Target: FXN; (-) strand; PAM type: NRG; PAM sequence: TGG
ggtaagaagctggggcaccg

SEQ ID NO: 8801 - DNA, 20 bp, Artificial Sequence
  Description of Artificial Sequence: Synthetic oligonucleotide
  Target: FXN; (-) strand; PAM type: NRG; PAM sequence: GGG
gcacacttggtaagaagctg

SEQ ID NO: 8802 - DNA, 20 bp, Artificial Sequence
  Description of Artificial Sequence: Synthetic oligonucleotide
  Target: FXN; (-) strand; PAM type: NRG; PAM sequence: GGG
ggcacacttggtaagaagct

SEQ ID NO: 8803 - DNA, 20 bp, Artificial Sequence
  Description of Artificial Sequence: Synthetic oligonucleotide
  Target: FXN; (-) strand; PAM type: NRG; PAM sequence: TGG
aggcacacttggtaagaagc

SEQ ID NO: 8804 - DNA, 20 bp, Artificial Sequence
  Description of Artificial Sequence: Synthetic oligonucleotide
  Target: FXN; (-) strand; PAM type: NRG; PAM sequence: AAG
aatcaggcacacttggtaag

SEQ ID NO: 8805 - DNA, 20 bp, Artificial Sequence
  Description of Artificial Sequence: Synthetic oligonucleotide
  Target: FXN; (-) strand; PAM type: NRG; PAM sequence: AAG
aggaatcaggcacacttggt

SEQ ID NO: 8806 - DNA, 20 bp, Artificial Sequence
  Description of Artificial Sequence: Synthetic oligonucleotide
  Target: FXN; (-) strand; PAM type: NRG; PAM sequence: TGG
caagaggaatcaggcacact

SEQ ID NO: 8807 - DNA, 20 bp, Artificial Sequence
  Description of Artificial Sequence: Synthetic oligonucleotide
  Target: FXN; (-) strand; PAM type: NRG; PAM sequence: AGG
ggaggtagtcaagaggaatc

SEQ ID NO: 8808 - DNA, 20 bp, Artificial Sequence
  Description of Artificial Sequence: Synthetic oligonucleotide
  Target: FXN; (-) strand; PAM type: NRG; PAM sequence: CAG
tggaggtagtcaagaggaat

SEQ ID NO: 8809 - DNA, 20 bp, Artificial Sequence
  Description of Artificial Sequence: Synthetic oligonucleotide
  Target: FXN; (-) strand; PAM type: NRG; PAM sequence: AGG
cttccttggaggtagtcaag

SEQ ID NO: 8810 - DNA, 20 bp, Artificial Sequence
  Description of Artificial Sequence: Synthetic oligonucleotide
  Target: FXN; (-) strand; PAM type: NRG; PAM sequence: GAG
acttccttggaggtagtcaa

SEQ ID NO: 8811 - DNA, 20 bp, Artificial Sequence
  Description of Artificial Sequence: Synthetic oligonucleotide
  Target: FXN; (-) strand; PAM type: NRG; PAM sequence: AAG
ccacttccttggaggtagtc

SEQ ID NO: 8812 - DNA, 20 bp, Artificial Sequence
  Description of Artificial Sequence: Synthetic oligonucleotide
  Target: FXN; (-) strand; PAM type: NRG; PAM sequence: TAG
tttctccacttccttggagg

SEQ ID NO: 8813 - DNA, 20 bp, Artificial Sequence
  Description of Artificial Sequence: Synthetic oligonucleotide
  Target: FXN; (-) strand; PAM type: NRG; PAM sequence: AGG
gtctttctccacttccttgg

SEQ ID NO: 8814 - DNA, 20 bp, Artificial Sequence
  Description of Artificial Sequence: Synthetic oligonucleotide
  Target: FXN; (-) strand; PAM type: NRG; PAM sequence: GAG
tgtctttctccacttccttg

SEQ ID NO: 8815 - DNA, 20 bp, Artificial Sequence
  Description of Artificial Sequence: Synthetic oligonucleotide
  Target: FXN; (-) strand; PAM type: NRG; PAM sequence: TGG
cttgtctttctccacttcct

SEQ ID NO: 8816 - DNA, 20 bp, Artificial Sequence
  Description of Artificial Sequence: Synthetic oligonucleotide
  Target: FXN; (-) strand; PAM type: NRG; PAM sequence: AAG
agagaagacgaaggcttcgc

SEQ ID NO: 8817 - DNA, 20 bp, Artificial Sequence
  Description of Artificial Sequence: Synthetic oligonucleotide
  Target: FXN; (-) strand; PAM type: NRG; PAM sequence: AGG
tagcatatcagagaagacga

SEQ ID NO: 8818 - DNA, 20 bp, Artificial Sequence
  Description of Artificial Sequence: Synthetic oligonucleotide
  Target: FXN; (-) strand; PAM type: NRG; PAM sequence: AAG
atagcatatcagagaagacg

SEQ ID NO: 8819 - DNA, 20 bp, Artificial Sequence
  Description of Artificial Sequence: Synthetic oligonucleotide
  Target: FXN; (-) strand; PAM type: NRG; PAM sequence: AAG
catagaatagcatatcagag

SEQ ID NO: 8820 - DNA, 20 bp, Artificial Sequence
  Description of Artificial Sequence: Synthetic oligonucleotide
  Target: FXN; (-) strand; PAM type: NRG; PAM sequence: GAG
agacatagaatagcatatca

SEQ ID NO: 8821 - DNA, 20 bp, Artificial Sequence
  Description of Artificial Sequence: Synthetic oligonucleotide
  Target: FXN; (-) strand; PAM type: NRG; PAM sequence: CAG
atagacatagaatagcatat

SEQ ID NO: 8822 - DNA, 20 bp, Artificial Sequence
  Description of Artificial Sequence: Synthetic oligonucleotide
  Target: FXN; (-) strand; PAM type: NRG; PAM sequence: TAG
ccaaagaaatagacatagaa

SEQ ID NO: 8823 - DNA, 20 bp, Artificial Sequence
  Description of Artificial Sequence: Synthetic oligonucleotide
  Target: FXN; (-) strand; PAM type: NRG; PAM sequence: TAG
tttggccaaagaaatagaca

SEQ ID NO: 8824 - DNA, 20 bp, Artificial Sequence
  Description of Artificial Sequence: Synthetic oligonucleotide
  Target: FXN; (-) strand; PAM type: NRG; PAM sequence: TAG
catctttttggccaaagaaa

SEQ ID NO: 8825 - DNA, 20 bp, Artificial Sequence
  Description of Artificial Sequence: Synthetic oligonucleotide
  Target: FXN; (-) strand; PAM type: NRG; PAM sequence: AAG
ttgccccatctttttggcca

SEQ ID NO: 8826 - DNA, 20 bp, Artificial Sequence
  Description of Artificial Sequence: Synthetic oligonucleotide
  Target: FXN; (-) strand; PAM type: NRG; PAM sequence: TGG
atatcattgccccatctttt

SEQ ID NO: 8827 - DNA, 20 bp, Artificial Sequence
  Description of Artificial Sequence: Synthetic oligonucleotide
  Target: FXN; (-) strand; PAM type: NRG; PAM sequence: AAG
aaatgctccagctccctgca

SEQ ID NO: 8828 - DNA, 20 bp, Artificial Sequence
  Description of Artificial Sequence: Synthetic oligonucleotide
  Target: FXN; (-) strand; PAM type: NRG; PAM sequence: CAG
aaggtcactagcaaatgctc

SEQ ID NO: 8829 - DNA, 20 bp, Artificial Sequence
  Description of Artificial Sequence: Synthetic oligonucleotide
  Target: FXN; (-) strand; PAM type: NRG; PAM sequence: TAG
ttctggcatagaaaggtcac

SEQ ID NO: 8830 - DNA, 20 bp, Artificial Sequence
  Description of Artificial Sequence: Synthetic oligonucleotide
  Target: FXN; (-) strand; PAM type: NRG; PAM sequence: AGG
tagcaagttctggcatagaa

SEQ ID NO: 8831 - DNA, 20 bp, Artificial Sequence
  Description of Artificial Sequence: Synthetic oligonucleotide
  Target: FXN; (-) strand; PAM type: NRG; PAM sequence: AAG
ttagcaagttctggcataga

SEQ ID NO: 8832 - DNA, 20 bp, Artificial Sequence
  Description of Artificial Sequence: Synthetic oligonucleotide
  Target: FXN; (-) strand; PAM type: NRG; PAM sequence: TAG
atgcttagcaagttctggca

SEQ ID NO: 8833 - DNA, 20 bp, Artificial Sequence
  Description of Artificial Sequence: Synthetic oligonucleotide
  Target: FXN; (-) strand; PAM type: NRG; PAM sequence: TGG
ctagcatgcttagcaagttc

SEQ ID NO: 8834 - DNA, 20 bp, Artificial Sequence
  Description of Artificial Sequence: Synthetic oligonucleotide
  Target: FXN; (-) strand; PAM type: NRG; PAM sequence: AAG
tattagctagcatgcttagc

SEQ ID NO: 8835 - DNA, 20 bp, Artificial Sequence
  Description of Artificial Sequence: Synthetic oligonucleotide
  Target: FXN; (-) strand; PAM type: NRG; PAM sequence: TAG
tcattattagctagcatgct

SEQ ID NO: 8836 - DNA, 20 bp, Artificial Sequence
  Description of Artificial Sequence: Synthetic oligonucleotide
  Target: FXN; (-) strand; PAM type: NRG; PAM sequence: TAG
tgtgctacatcattattagc

SEQ ID NO: 8837 - DNA, 20 bp, Artificial Sequence
  Description of Artificial Sequence: Synthetic oligonucleotide
  Target: FXN; (-) strand; PAM type: NRG; PAM sequence: TAG
accctgtgctacatcattat

SEQ ID NO: 8838 - DNA, 20 bp, Artificial Sequence
  Description of Artificial Sequence: Synthetic oligonucleotide
  Target: FXN; (-) strand; PAM type: NRG; PAM sequence: GAG
agtgctgagattacaggcgt

SEQ ID NO: 8839 - DNA, 20 bp, Artificial Sequence
  Description of Artificial Sequence: Synthetic oligonucleotide
  Target: FXN; (-) strand; PAM type: NRG; PAM sequence: AGG
gcccaaagtgctgagattac

SEQ ID NO: 8840 - DNA, 20 bp, Artificial Sequence
  Description of Artificial Sequence: Synthetic oligonucleotide
  Target: FXN; (-) strand; PAM type: NRG; PAM sequence: CAG
cgcccaaagtgctgagatta

SEQ ID NO: 8841 - DNA, 20 bp, Artificial Sequence
  Description of Artificial Sequence: Synthetic oligonucleotide
  Target: FXN; (-) strand; PAM type: NRG; PAM sequence: GAG
cctcggccgcccaaagtgct

SEQ ID NO: 8842 - DNA, 20 bp, Artificial Sequence
  Description of Artificial Sequence: Synthetic oligonucleotide
  Target: FXN; (-) strand; PAM type: NRG; PAM sequence: AAG
ccgcccgcctcggccgccca

SEQ ID NO: 8843 - DNA, 20 bp, Artificial Sequence
  Description of Artificial Sequence: Synthetic oligonucleotide
  Target: FXN; (-) strand; PAM type: NRG; PAM sequence: CGG
ctcaggtgatccgcccgcct

SEQ ID NO: 8844 - DNA, 20 bp, Artificial Sequence
  Description of Artificial Sequence: Synthetic oligonucleotide
  Target: FXN; (-) strand; PAM type: NRG; PAM sequence: AGG
ggtctcgaactcctgacctc

SEQ ID NO: 8845 - DNA, 20 bp, Artificial Sequence
  Description of Artificial Sequence: Synthetic oligonucleotide
  Target: FXN; (-) strand; PAM type: NRG; PAM sequence: CAG
tggtctcgaactcctgacct

SEQ ID NO: 8846 - DNA, 20 bp, Artificial Sequence
  Description of Artificial Sequence: Synthetic oligonucleotide
  Target: FXN; (-) strand; PAM type: NRG; PAM sequence: TGG
tttcatcatgttggccaggc

SEQ ID NO: 8847 - DNA, 20 bp, Artificial Sequence
  Description of Artificial Sequence: Synthetic oligonucleotide
  Target: FXN; (-) strand; PAM type: NRG; PAM sequence: AGG
ggggtttcatcatgttggcc

SEQ ID NO: 8848 - DNA, 20 bp, Artificial Sequence
  Description of Artificial Sequence: Synthetic oligonucleotide
  Target: FXN; (-) strand; PAM type: NRG; PAM sequence: CAG
tggggtttcatcatgttggc

SEQ ID NO: 8849 - DNA, 20 bp, Artificial Sequence
  Description of Artificial Sequence: Synthetic oligonucleotide
  Target: FXN; (-) strand; PAM type: NRG; PAM sequence: TGG
gagatggggtttcatcatgt

SEQ ID NO: 8850 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagagatg

SEQ ID NO: 8851 - DNA, 20 bp, Artificial Sequence
  Description of Artificial Sequence: Synthetic oligonucleotide
  Target: FXN; (-) strand; PAM type: NRG; PAM sequence: GGG
tttgtatttttagtagagat

SEQ ID NO: 8852 - DNA, 20 bp, Artificial Sequence
  Description of Artificial Sequence: Synthetic oligonucleotide
  Target: FXN; (-) strand; PAM type: NRG; PAM sequence: TGG
ttttgtatttttagtagaga

SEQ ID NO: 8853 - DNA, 20 bp, Artificial Sequence
  Description of Artificial Sequence: Synthetic oligonucleotide
  Target: FXN; (-) strand; PAM type: NRG; PAM sequence: GAG
taatttttgtatttttagta

SEQ ID NO: 8854 - DNA, 20 bp, Artificial Sequence
  Description of Artificial Sequence: Synthetic oligonucleotide
  Target: FXN; (-) strand; PAM type: NRG; PAM sequence: TAG
gctaatttttgtatttttag

SEQ ID NO: 8855 - DNA, 20 bp, Artificial Sequence
  Description of Artificial Sequence: Synthetic oligonucleotide
  Target: FXN; (-) strand; PAM type: NRG; PAM sequence: TAG
ctggctaatttttgtatttt

SEQ ID NO: 8856 - DNA, 20 bp, Artificial Sequence
  Description of Artificial Sequence: Synthetic oligonucleotide
  Target: FXN; (-) strand; PAM type: NRG; PAM sequence: TGG
caggtgcccaccaccacgcc

SEQ ID NO: 8857 - DNA, 20 bp, Artificial Sequence
  Description of Artificial Sequence: Synthetic oligonucleotide
  Target: FXN; (-) strand; PAM type: NRG; PAM sequence: AGG
tccagagtagctgggattgc

SEQ ID NO: 8858 - DNA, 20 bp, Artificial Sequence
  Description of Artificial Sequence: Synthetic oligonucleotide
  Target: FXN; (-) strand; PAM type: NRG; PAM sequence: CAG
ctccagagtagctgggattg

SEQ ID NO: 8859 - DNA, 20 bp, Artificial Sequence
  Description of Artificial Sequence: Synthetic oligonucleotide
  Target: FXN; (-) strand; PAM type: NRG; PAM sequence: GGG
tctcagcctccagagtagct

SEQ ID NO: 8860 - DNA, 20 bp, Artificial Sequence
  Description of Artificial Sequence: Synthetic oligonucleotide
  Target: FXN; (-) strand; PAM type: NRG; PAM sequence: TGG
gtctcagcctccagagtagc

SEQ ID NO: 8861 - DNA, 20 bp, Artificial Sequence
  Description of Artificial Sequence: Synthetic oligonucleotide
  Target: FXN; (-) strand; PAM type: NRG; PAM sequence: TAG
ttctgtctcagcctccagag

SEQ ID NO: 8862 - DNA, 20 bp, Artificial Sequence
  Description of Artificial Sequence: Synthetic oligonucleotide
  Target: FXN; (-) strand; PAM type: NRG; PAM sequence: GAG
agattctgtctcagcctcca

SEQ ID NO: 8863 - DNA, 20 bp, Artificial Sequence
  Description of Artificial Sequence: Synthetic oligonucleotide
  Target: FXN; (-) strand; PAM type: NRG; PAM sequence: CAG
agagattctgtctcagcctc

SEQ ID NO: 8864 - DNA, 20 bp, Artificial Sequence
  Description of Artificial Sequence: Synthetic oligonucleotide
  Target: FXN; (-) strand; PAM type: NRG; PAM sequence: CAG
gggttcaagagattctgtct

SEQ ID NO: 8865 - DNA, 20 bp, Artificial Sequence
  Description of Artificial Sequence: Synthetic oligonucleotide
  Target: FXN; (-) strand; PAM type: NRG; PAM sequence: GAG
tctccacctcctgggttcaa

SEQ ID NO: 8866 - DNA, 20 bp, Artificial Sequence
  Description of Artificial Sequence: Synthetic oligonucleotide
  Target: FXN; (-) strand; PAM type: NRG; PAM sequence: AAG
aatctccacctcctgggttc

SEQ ID NO: 8867 - DNA, 20 bp, Artificial Sequence
  Description of Artificial Sequence: Synthetic oligonucleotide
  Target: FXN; (-) strand; PAM type: NRG; PAM sequence: GGG
cactgcaatctccacctcct

SEQ ID NO: 8868 - DNA, 20 bp, Artificial Sequence
  Description of Artificial Sequence: Synthetic oligonucleotide
  Target: FXN; (-) strand; PAM type: NRG; PAM sequence: TGG
tcactgcaatctccacctcc

SEQ ID NO: 8869 - DNA, 20 bp, Artificial Sequence
  Description of Artificial Sequence: Synthetic oligonucleotide
  Target: FXN; (-) strand; PAM type: NRG; PAM sequence: TGG
ttgcccaggctggaatgcag

SEQ ID NO: 8870 - DNA, 20 bp, Artificial Sequence
  Description of Artificial Sequence: Synthetic oligonucleotide
  Target: FXN; (-) strand; PAM type: NRG; PAM sequence: CAG
ttgttgcccaggctggaatg

SEQ ID NO: 8871 - DNA, 20 bp, Artificial Sequence
  Description of Artificial Sequence: Synthetic oligonucleotide
  Target: FXN; (-) strand; PAM type: NRG; PAM sequence: TGG
tcttgctttgttgcccaggc

SEQ ID NO: 8872 - DNA, 20 bp, Artificial Sequence
  Description of Artificial Sequence: Synthetic oligonucleotide
  Target: FXN; (-) strand; PAM type: NRG; PAM sequence: AGG
agagtcttgctttgttgccc

SEQ ID NO: 8873 - DNA, 20 bp, Artificial Sequence
  Description of Artificial Sequence: Synthetic oligonucleotide
  Target: FXN; (-) strand; PAM type: NRG; PAM sequence: CAG
cagagtcttgctttgttgcc

SEQ ID NO: 8874 - DNA, 20 bp, Artificial Sequence
  Description of Artificial Sequence: Synthetic oligonucleotide
  Target: FXN; (-) strand; PAM type: NRG; PAM sequence: GAG
tattattattatttgagaca

SEQ ID NO: 8875 - DNA, 20 bp, Artificial Sequence
  Description of Artificial Sequence: Synthetic oligonucleotide
  Target: FXN; (-) strand; PAM type: NRG; PAM sequence: CAG
attattattattatttgaga

SEQ ID NO: 8876 - DNA, 20 bp, Artificial Sequence
  Description of Artificial Sequence: Synthetic oligonucleotide
  Target: FXN; (-) strand; PAM type: NRG; PAM sequence: GAG
tattattattattattattt

SEQ ID NO: 8877 - DNA, 20 bp, Artificial Sequence
  Description of Artificial Sequence: Synthetic oligonucleotide
  Target: FXN; (-) strand; PAM type: NRG; PAM sequence: TAG
gagagagaaagctgcatcat

SEQ ID NO: 8878 - DNA, 20 bp, Artificial Sequence
  Description of Artificial Sequence: Synthetic oligonucleotide
  Target: FXN; (-) strand; PAM type: NRG; PAM sequence: AAG
attatatactcagagagaga

SEQ ID NO: 8879 - DNA, 20 bp, Artificial Sequence
  Description of Artificial Sequence: Synthetic oligonucleotide
  Target: FXN; (-) strand; PAM type: NRG; PAM sequence: GAG
ctgcattatatactcagaga

SEQ ID NO: 8880 - DNA, 20 bp, Artificial Sequence
  Description of Artificial Sequence: Synthetic oligonucleotide
  Target: FXN; (-) strand; PAM type: NRG; PAM sequence: GAG
aactgcattatatactcaga

SEQ ID NO: 8881 - DNA, 20 bp, Artificial Sequence
  Description of Artificial Sequence: Synthetic oligonucleotide
  Target: FXN; (-) strand; PAM type: NRG; PAM sequence: GAG
agaactgcattatatactca

SEQ ID NO: 8882 - DNA, 20 bp, Artificial Sequence
  Description of Artificial Sequence: Synthetic oligonucleotide
  Target: FXN; (-) strand; PAM type: NRG; PAM sequence: CAG
tcagaactgcattatatact

SEQ ID NO: 8883 - DNA, 20 bp, Artificial Sequence
  Description of Artificial Sequence: Synthetic oligonucleotide
  Target: FXN; (-) strand; PAM type: NRG; PAM sequence: CAG
gaggcccttcctcacatcat

SEQ ID NO: 8884 - DNA, 20 bp, Artificial Sequence
  Description of Artificial Sequence: Synthetic oligonucleotide
  Target: FXN; (-) strand; PAM type: NRG; PAM sequence: AGG
actctgccacaccaacagtg

SEQ ID NO: 8885 - DNA, 20 bp, Artificial Sequence
  Description of Artificial Sequence: Synthetic oligonucleotide
  Target: FXN; (-) strand; PAM type: NRG; PAM sequence: GAG
gactctgccacaccaacagt

SEQ ID NO: 8886 - DNA, 20 bp, Artificial Sequence
  Description of Artificial Sequence: Synthetic oligonucleotide
  Target: FXN; (-) strand; PAM type: NRG; PAM sequence: CAG
ctcagactctgccacaccaa

SEQ ID NO: 8887 - DNA, 20 bp, Artificial Sequence
  Description of Artificial Sequence: Synthetic oligonucleotide
  Target: FXN; (-) strand; PAM type: NRG; PAM sequence: CAG
ttcattgccagccatggtct

SEQ ID NO: 8888 - DNA, 20 bp, Artificial Sequence
  Description of Artificial Sequence: Synthetic oligonucleotide
  Target: FXN; (-) strand; PAM type: NRG; PAM sequence: TGG
agtgttttcattgccagcca

SEQ ID NO: 8889 - DNA, 20 bp, Artificial Sequence
  Description of Artificial Sequence: Synthetic oligonucleotide
  Target: FXN; (-) strand; PAM type: NRG; PAM sequence: CAG
aagggtagtgttttcattgc

SEQ ID NO: 8890 - DNA, 20 bp, Artificial Sequence
  Description of Artificial Sequence: Synthetic oligonucleotide
  Target: FXN; (-) strand; PAM type: NRG; PAM sequence: TAG
agcccataggcatcaaaggg

SEQ ID NO: 8891 - DNA, 20 bp, Artificial Sequence
  Description of Artificial Sequence: Synthetic oligonucleotide
  Target: FXN; (-) strand; PAM type: NRG; PAM sequence: GGG
gagagcccataggcatcaaa

SEQ ID NO: 8892 - DNA, 20 bp, Artificial Sequence
  Description of Artificial Sequence: Synthetic oligonucleotide
  Target: FXN; (-) strand; PAM type: NRG; PAM sequence: AGG
ggagagcccataggcatcaa

SEQ ID NO: 8893 - DNA, 20 bp, Artificial Sequence
  Description of Artificial Sequence: Synthetic oligonucleotide
  Target: FXN; (-) strand; PAM type: NRG; PAM sequence: AAG
gggagagcccataggcatca

SEQ ID NO: 8894 - DNA, 20 bp, Artificial Sequence
  Description of Artificial Sequence: Synthetic oligonucleotide
  Target: FXN; (-) strand; PAM type: NRG; PAM sequence: AGG
accataaagggagagcccat

SEQ ID NO: 8895 - DNA, 20 bp, Artificial Sequence
  Description of Artificial Sequence: Synthetic oligonucleotide
  Target: FXN; (-) strand; PAM type: NRG; PAM sequence: TAG
aaccataaagggagagccca

SEQ ID NO: 8896 - DNA, 20 bp, Artificial Sequence
  Description of Artificial Sequence: Synthetic oligonucleotide
  Target: FXN; (-) strand; PAM type: NRG; PAM sequence: GAG
tccttgaaaccataaaggga

SEQ ID NO: 8897 - DNA, 20 bp, Artificial Sequence
  Description of Artificial Sequence: Synthetic oligonucleotide
  Target: FXN; (-) strand; PAM type: NRG; PAM sequence: GAG
cctccttgaaaccataaagg

SEQ ID NO: 8898 - DNA, 20 bp, Artificial Sequence
  Description of Artificial Sequence: Synthetic oligonucleotide
  Target: FXN; (-) strand; PAM type: NRG; PAM sequence: GGG
gccctccttgaaaccataaa

SEQ ID NO: 8899 - DNA, 20 bp, Artificial Sequence
  Description of Artificial Sequence: Synthetic oligonucleotide
  Target: FXN; (-) strand; PAM type: NRG; PAM sequence: AGG
agccctccttgaaaccataa

SEQ ID NO: 8900 - DNA, 20 bp, Artificial Sequence
  Description of Artificial Sequence: Synthetic oligonucleotide
  Target: FXN; (-) strand; PAM type: NRG; PAM sequence: AAG
aagccctccttgaaaccata

SEQ ID NO: 8901 - DNA, 20 bp, Artificial Sequence
  Description of Artificial Sequence: Synthetic oligonucleotide
  Target: FXN; (-) strand; PAM type: NRG; PAM sequence: AAG
aaaattctgccaagattgag

SEQ ID NO: 8902 - DNA, 20 bp, Artificial Sequence
  Description of Artificial Sequence: Synthetic oligonucleotide
  Target: FXN; (-) strand; PAM type: NRG; PAM sequence: GAG
tccaaaattctgccaagatt

SEQ ID NO: 8903 - DNA, 20 bp, Artificial Sequence
  Description of Artificial Sequence: Synthetic oligonucleotide
  Target: FXN; (-) strand; PAM type: NRG; PAM sequence: AAG
atccagtccaaaattctgcc

SEQ ID NO: 8904 - DNA, 20 bp, Artificial Sequence
  Description of Artificial Sequence: Synthetic oligonucleotide
  Target: FXN; (-) strand; PAM type: NRG; PAM sequence: CAG
ctgtgcaacaaagaactatc

SEQ ID NO: 8905 - DNA, 20 bp, Artificial Sequence
  Description of Artificial Sequence: Synthetic oligonucleotide
  Target: FXN; (-) strand; PAM type: NRG; PAM sequence: AAG
agccccccacctgtgcaaca

SEQ ID NO: 8906 - DNA, 20 bp, Artificial Sequence
  Description of Artificial Sequence: Synthetic oligonucleotide
  Target: FXN; (-) strand; PAM type: NRG; PAM sequence: CAG
acatcctgtgatgtgcagga

SEQ ID NO: 8907 - DNA, 20 bp, Artificial Sequence
  Description of Artificial Sequence: Synthetic oligonucleotide
  Target: FXN; (-) strand; PAM type: NRG; PAM sequence: AGG
tgaaacatcctgtgatgtgc

SEQ ID NO: 8908 - DNA, 20 bp, Artificial Sequence
  Description of Artificial Sequence: Synthetic oligonucleotide
  Target: FXN; (-) strand; PAM type: NRG; PAM sequence: CAG
atgaaacatcctgtgatgtg

SEQ ID NO: 8909 - DNA, 20 bp, Artificial Sequence
  Description of Artificial Sequence: Synthetic oligonucleotide
  Target: FXN; (-) strand; PAM type: NRG; PAM sequence: GGG
catctagtaggtagaggcca

SEQ ID NO: 8910 - DNA, 20 bp, Artificial Sequence
  Description of Artificial Sequence: Synthetic oligonucleotide
  Target: FXN; (-) strand; PAM type: NRG; PAM sequence: AGG
gcatctagtaggtagaggcc

SEQ ID NO: 8911 - DNA, 20 bp, Artificial Sequence
  Description of Artificial Sequence: Synthetic oligonucleotide
  Target: FXN; (-) strand; PAM type: NRG; PAM sequence: CAG
ggcatctagtaggtagaggc

SEQ ID NO: 8912 - DNA, 20 bp, Artificial Sequence
  Description of Artificial Sequence: Synthetic oligonucleotide
  Target: FXN; (-) strand; PAM type: NRG; PAM sequence: AGG
tactggcatctagtaggtag

SEQ ID NO: 8913 - DNA, 20 bp, Artificial Sequence
  Description of Artificial Sequence: Synthetic oligonucleotide
  Target: FXN; (-) strand; PAM type: NRG; PAM sequence: GAG
ctactggcatctagtaggta

SEQ ID NO: 8914 - DNA, 20 bp, Artificial Sequence
  Description of Artificial Sequence: Synthetic oligonucleotide
  Target: FXN; (-) strand; PAM type: NRG; PAM sequence: TAG
ttctactggcatctagtagg

SEQ ID NO: 8915 - DNA, 20 bp, Artificial Sequence
  Description of Artificial Sequence: Synthetic oligonucleotide
  Target: FXN; (-) strand; PAM type: NRG; PAM sequence: AGG
atgttctactggcatctagt

SEQ ID NO: 8916 - DNA, 20 bp, Artificial Sequence
  Description of Artificial Sequence: Synthetic oligonucleotide
  Target: FXN; (-) strand; PAM type: NRG; PAM sequence: TAG
tatgttctactggcatctag

SEQ ID NO: 8917 - DNA, 20 bp, Artificial Sequence
  Description of Artificial Sequence: Synthetic oligonucleotide
  Target: FXN; (-) strand; PAM type: NRG; PAM sequence: TAG
gggtatgttctactggcatc

SEQ ID NO: 8918 - DNA, 20 bp, Artificial Sequence
  Description of Artificial Sequence: Synthetic oligonucleotide
  Target: FXN; (-) strand; PAM type: NRG; PAM sequence: TGG
gtggggtgggtatgttctac

SEQ ID NO: 8919 - DNA, 20 bp, Artificial Sequence
  Description of Artificial Sequence: Synthetic oligonucleotide
  Target: FXN; (-) strand; PAM type: NRG; PAM sequence: GGG
acaacaggcagctgtggggt

SEQ ID NO: 8920 - DNA, 20 bp, Artificial Sequence
  Description of Artificial Sequence: Synthetic oligonucleotide
  Target: FXN; (-) strand; PAM type: NRG; PAM sequence: TGG
cacaacaggcagctgtgggg

SEQ ID NO: 8921 - DNA, 20 bp, Artificial Sequence
  Description of Artificial Sequence: Synthetic oligonucleotide
  Target: FXN; (-) strand; PAM type: NRG; PAM sequence: GGG
tgtcacaacaggcagctgtg

SEQ ID NO: 8922 - DNA, 20 bp, Artificial Sequence
  Description of Artificial Sequence: Synthetic oligonucleotide
  Target: FXN; (-) strand; PAM type: NRG; PAM sequence: GGG
ttgtcacaacaggcagctgt

SEQ ID NO: 8923 - DNA, 20 bp, Artificial Sequence
  Description of Artificial Sequence: Synthetic oligonucleotide
  Target: FXN; (-) strand; PAM type: NRG; PAM sequence: TGG
attgtcacaacaggcagctg

SEQ ID NO: 8924 - DNA, 20 bp, Artificial Sequence
  Description of Artificial Sequence: Synthetic oligonucleotide
  Target: FXN; (-) strand; PAM type: NRG; PAM sequence: CAG
cttttgattgtcacaacagg

SEQ ID NO: 8925 - DNA, 20 bp, Artificial Sequence
  Description of Artificial Sequence: Synthetic oligonucleotide
  Target: FXN; (-) strand; PAM type: NRG; PAM sequence: AGG
atgcttttgattgtcacaac

SEQ ID NO: 8926 - DNA, 20 bp, Artificial Sequence
  Description of Artificial Sequence: Synthetic oligonucleotide
  Target: FXN; (-) strand; PAM type: NRG; PAM sequence: CAG
gatgcttttgattgtcacaa

SEQ ID NO: 8927 - DNA, 20 bp, Artificial Sequence
  Description of Artificial Sequence: Synthetic oligonucleotide
  Target: FXN; (-) strand; PAM type: NRG; PAM sequence: GAG
ttccccctgcaaagtatctg

SEQ ID NO: 8928 - DNA, 20 bp, Artificial Sequence
  Description of Artificial Sequence: Synthetic oligonucleotide
  Target: FXN; (-) strand; PAM type: NRG; PAM sequence: TGG
ttttccccctgcaaagtatc

SEQ ID NO: 8929 - DNA, 20 bp, Artificial Sequence
  Description of Artificial Sequence: Synthetic oligonucleotide
  Target: FXN; (-) strand; PAM type: NRG; PAM sequence: AAG
gaaatcattttccccctgca

SEQ ID NO: 8930 - DNA, 20 bp, Artificial Sequence
  Description of Artificial Sequence: Synthetic oligonucleotide
  Target: FXN; (-) strand; PAM type: NRG; PAM sequence: GAG
ttatgtatatgccaggcctg

SEQ ID NO: 8931 - DNA, 20 bp, Artificial Sequence
  Description of Artificial Sequence: Synthetic oligonucleotide
  Target: FXN; (-) strand; PAM type: NRG; PAM sequence: TGG
tgttatgtatatgccaggcc

SEQ ID NO: 8932 - DNA, 20 bp, Artificial Sequence
  Description of Artificial Sequence: Synthetic oligonucleotide
  Target: FXN; (-) strand; PAM type: NRG; PAM sequence: AGG
aatactgttatgtatatgcc

SEQ ID NO: 8933 - DNA, 20 bp, Artificial Sequence
  Description of Artificial Sequence: Synthetic oligonucleotide
  Target: FXN; (-) strand; PAM type: NRG; PAM sequence: CAG
aaatactgttatgtatatgc

SEQ ID NO: 8934 - DNA, 20 bp, Artificial Sequence
  Description of Artificial Sequence: Synthetic oligonucleotide
  Target: FXN; (-) strand; PAM type: NRG; PAM sequence: CAG
tgtgtttaattaattctagg

SEQ ID NO: 8935 - DNA, 20 bp, Artificial Sequence
  Description of Artificial Sequence: Synthetic oligonucleotide
  Target: FXN; (-) strand; PAM type: NRG; PAM sequence: AGG
ttctgtgtttaattaattct

SEQ ID NO: 8936 - DNA, 20 bp, Artificial Sequence
  Description of Artificial Sequence: Synthetic oligonucleotide
  Target: FXN; (-) strand; PAM type: NRG; PAM sequence: TAG
cttctgtgtttaattaattc

SEQ ID NO: 8937 - DNA, 20 bp, Artificial Sequence
  Description of Artificial Sequence: Synthetic oligonucleotide
  Target: FXN; (-) strand; PAM type: NRG; PAM sequence: GAG
gtccagggcattctggatga

SEQ ID NO: 8938 - DNA, 20 bp, Artificial Sequence
  Description of Artificial Sequence: Synthetic oligonucleotide
  Target: FXN; (-) strand; PAM type: NRG; PAM sequence: GAG
tggtccagggcattctggat

SEQ ID NO: 8939 - DNA, 20 bp, Artificial Sequence
  Description of Artificial Sequence: Synthetic oligonucleotide
  Target: FXN; (-) strand; PAM type: NRG; PAM sequence: TGG
agaggtggtccagggcattc

SEQ ID NO: 8940 - DNA, 20 bp, Artificial Sequence
  Description of Artificial Sequence: Synthetic oligonucleotide
  Target: FXN; (-) strand; PAM type: NRG; PAM sequence: GGG
cctatcaaagaggtggtcca

SEQ ID NO: 8941 - DNA, 20 bp, Artificial Sequence
  Description of Artificial Sequence: Synthetic oligonucleotide
  Target: FXN; (-) strand; PAM type: NRG; PAM sequence: AGG
gcctatcaaagaggtggtcc

SEQ ID NO: 8942 - DNA, 20 bp, Artificial Sequence
  Description of Artificial Sequence: Synthetic oligonucleotide
  Target: FXN; (-) strand; PAM type: NRG; PAM sequence: CAG
tgcctatcaaagaggtggtc

SEQ ID NO: 8943 - DNA, 20 bp, Artificial Sequence
  Description of Artificial Sequence: Synthetic oligonucleotide
  Target: FXN; (-) strand; PAM type: NRG; PAM sequence: TGG
ctgattgcctatcaaagagg

SEQ ID NO: 8944 - DNA, 20 bp, Artificial Sequence
  Description of Artificial Sequence: Synthetic oligonucleotide
  Target: FXN; (-) strand; PAM type: NRG; PAM sequence: AGG
gatctgattgcctatcaaag

SEQ ID NO: 8945 - DNA, 20 bp, Artificial Sequence
  Description of Artificial Sequence: Synthetic oligonucleotide
  Target: FXN; (-) strand; PAM type: NRG; PAM sequence: GAG
ggatctgattgcctatcaaa

SEQ ID NO: 8946 - DNA, 20 bp, Artificial Sequence
  Description of Artificial Sequence: Synthetic oligonucleotide
  Target: FXN; (-) strand; PAM type: NRG; PAM sequence: AAG
tgggatctgattgcctatca

SEQ ID NO: 8947 - DNA, 20 bp, Artificial Sequence
  Description of Artificial Sequence: Synthetic oligonucleotide
  Target: FXN; (-) strand; PAM type: NRG; PAM sequence: GGG
aaaaatagggtggaggaggt

SEQ ID NO: 8948 - DNA, 20 bp, Artificial Sequence
  Description of Artificial Sequence: Synthetic oligonucleotide
  Target: FXN; (-) strand; PAM type: NRG; PAM sequence: TGG
caaaaatagggtggaggagg

SEQ ID NO: 8949 - DNA, 20 bp, Artificial Sequence
  Description of Artificial Sequence: Synthetic oligonucleotide
  Target: FXN; (-) strand; PAM type: NRG; PAM sequence: AGG
cttcaaaaatagggtggagg

SEQ ID NO: 8950 - DNA, 20 bp, Artificial Sequence
  Description of Artificial Sequence: Synthetic oligonucleotide
  Target: FXN; (-) strand; PAM type: NRG; PAM sequence: GAG
ccttcaaaaatagggtggag

SEQ ID NO: 8951 - DNA, 20 bp, Artificial Sequence
  Description of Artificial Sequence: Synthetic oligonucleotide
  Target: FXN; (-) strand; PAM type: NRG; PAM sequence: AGG
ggccttcaaaaatagggtgg

SEQ ID NO: 8952 - DNA, 20 bp, Artificial Sequence
  Description of Artificial Sequence: Synthetic oligonucleotide
  Target: FXN; (-) strand; PAM type: NRG; PAM sequence: GAG
gggccttcaaaaatagggtg

SEQ ID NO: 8953 - DNA, 20 bp, Artificial Sequence
  Description of Artificial Sequence: Synthetic oligonucleotide
  Target: FXN; (-) strand; PAM type: NRG; PAM sequence: TGG
cagggccttcaaaaataggg

SEQ ID NO: 8954 - DNA, 20 bp, Artificial Sequence
  Description of Artificial Sequence: Synthetic oligonucleotide
  Target: FXN; (-) strand; PAM type: NRG; PAM sequence: GGG
gcacagggccttcaaaaata

SEQ ID NO: 8955 - DNA, 20 bp, Artificial Sequence
  Description of Artificial Sequence: Synthetic oligonucleotide
  Target: FXN; (-) strand; PAM type: NRG; PAM sequence: AGG
ggcacagggccttcaaaaat

SEQ ID NO: 8956 - DNA, 20 bp, Artificial Sequence
  Description of Artificial Sequence: Synthetic oligonucleotide
  Target: FXN; (-) strand; PAM type: NRG; PAM sequence: TAG
tggcacagggccttcaaaaa

SEQ ID NO: 8957 - DNA, 20 bp, Artificial Sequence
  Description of Artificial Sequence: Synthetic oligonucleotide
  Target: FXN; (-) strand; PAM type: NRG; PAM sequence: GGG
gaagaagtggtgttggcaca

SEQ ID NO: 8958 - DNA, 20 bp, Artificial Sequence
  Description of Artificial Sequence: Synthetic oligonucleotide
  Target: FXN; (-) strand; PAM type: NRG; PAM sequence: AGG
ggaagaagtggtgttggcac

SEQ ID NO: 8959 - DNA, 20 bp, Artificial Sequence
  Description of Artificial Sequence: Synthetic oligonucleotide
  Target: FXN; (-) strand; PAM type: NRG; PAM sequence: CAG
tggaagaagtggtgttggca

SEQ ID NO: 8960 - DNA, 20 bp, Artificial Sequence
  Description of Artificial Sequence: Synthetic oligonucleotide
  Target: FXN; (-) strand; PAM type: NRG; PAM sequence: TGG
attcatggaagaagtggtgt

SEQ ID NO: 8961 - DNA, 20 bp, Artificial Sequence
  Description of Artificial Sequence: Synthetic oligonucleotide
  Target: FXN; (-) strand; PAM type: NRG; PAM sequence: TGG
ggaagtattcatggaagaag

SEQ ID NO: 8962 - DNA, 20 bp, Artificial Sequence
  Description of Artificial Sequence: Synthetic oligonucleotide
  Target: FXN; (-) strand; PAM type: NRG; PAM sequence: AAG
caaggaagtattcatggaag

SEQ ID NO: 8963 - DNA, 20 bp, Artificial Sequence
  Description of Artificial Sequence: Synthetic oligonucleotide
  Target: FXN; (-) strand; PAM type: NRG; PAM sequence: AAG
aatcaaggaagtattcatgg

SEQ ID NO: 8964 - DNA, 20 bp, Artificial Sequence
  Description of Artificial Sequence: Synthetic oligonucleotide
  Target: FXN; (-) strand; PAM type: NRG; PAM sequence: TGG
gggaatcaaggaagtattca

SEQ ID NO: 8965 - DNA, 20 bp, Artificial Sequence
  Description of Artificial Sequence: Synthetic oligonucleotide
  Target: FXN; (-) strand; PAM type: NRG; PAM sequence: AAG
tagggatgggggaatcaagg

SEQ ID NO: 8966 - DNA, 20 bp, Artificial Sequence
  Description of Artificial Sequence: Synthetic oligonucleotide
  Target: FXN; (-) strand; PAM type: NRG; PAM sequence: AGG
agctagggatgggggaatca

SEQ ID NO: 8967 - DNA, 20 bp, Artificial Sequence
  Description of Artificial Sequence: Synthetic oligonucleotide
  Target: FXN; (-) strand; PAM type: NRG; PAM sequence: AAG
gagctagggatgggggaatc

SEQ ID NO: 8968 - DNA, 20 bp, Artificial Sequence
  Description of Artificial Sequence: Synthetic oligonucleotide
  Target: FXN; (-) strand; PAM type: NRG; PAM sequence: GGG
ttatatagagctagggatgg

SEQ ID NO: 8969 - DNA, 20 bp, Artificial Sequence
  Description of Artificial Sequence: Synthetic oligonucleotide
  Target: FXN; (-) strand; PAM type: NRG; PAM sequence: GGG
tttatatagagctagggatg

SEQ ID NO: 8970 - DNA, 20 bp, Artificial Sequence
  Description of Artificial Sequence: Synthetic oligonucleotide
  Target: FXN; (-) strand; PAM type: NRG; PAM sequence: GGG
atttatatagagctagggat

SEQ ID NO: 8971 - DNA, 20 bp, Artificial Sequence
  Description of Artificial Sequence: Synthetic oligonucleotide
  Target: FXN; (-) strand; PAM type: NRG; PAM sequence: TGG
gatttatatagagctaggga

SEQ ID NO: 8972 - DNA, 20 bp, Artificial Sequence
  Description of Artificial Sequence: Synthetic oligonucleotide
  Target: FXN; (-) strand; PAM type: NRG; PAM sequence: GGG
gggagatttatatagagcta

SEQ ID NO: 8973 - DNA, 20 bp, Artificial Sequence
  Description of Artificial Sequence: Synthetic oligonucleotide
  Target: FXN; (-) strand; PAM type: NRG; PAM sequence: AGG
tgggagatttatatagagct

SEQ ID NO: 8974 - DNA, 20 bp, Artificial Sequence
  Description of Artificial Sequence: Synthetic oligonucleotide
  Target: FXN; (-) strand; PAM type: NRG; PAM sequence: TAG
gtgggagatttatatagagc

SEQ ID NO: 8975 - DNA, 20 bp, Artificial Sequence
  Description of Artificial Sequence: Synthetic oligonucleotide
  Target: FXN; (-) strand; PAM type: NRG; PAM sequence: GAG
ttgagtgggagatttatata

SEQ ID NO: 8976 - DNA, 20 bp, Artificial Sequence
  Description of Artificial Sequence: Synthetic oligonucleotide
  Target: FXN; (-) strand; PAM type: NRG; PAM sequence: TAG
tgttgagtgggagatttata

SEQ ID NO: 8977 - DNA, 20 bp, Artificial Sequence
  Description of Artificial Sequence: Synthetic oligonucleotide
  Target: FXN; (-) strand; PAM type: NRG; PAM sequence: GAG
caggtgtgagtgttgagtgg

SEQ ID NO: 8978 - DNA, 20 bp, Artificial Sequence
  Description of Artificial Sequence: Synthetic oligonucleotide
  Target: FXN; (-) strand; PAM type: NRG; PAM sequence: GGG
aacaggtgtgagtgttgagt

SEQ ID NO: 8979 - DNA, 20 bp, Artificial Sequence
  Description of Artificial Sequence: Synthetic oligonucleotide
  Target: FXN; (-) strand; PAM type: NRG; PAM sequence: TGG
taacaggtgtgagtgttgag

SEQ ID NO: 8980 - DNA, 20 bp, Artificial Sequence
  Description of Artificial Sequence: Synthetic oligonucleotide
  Target: FXN; (-) strand; PAM type: NRG; PAM sequence: GAG
aactaacaggtgtgagtgtt

SEQ ID NO: 8981 - DNA, 20 bp, Artificial Sequence
  Description of Artificial Sequence: Synthetic oligonucleotide
  Target: FXN; (-) strand; PAM type: NRG; PAM sequence: GAG
gaatgtaaactaacaggtgt

SEQ ID NO: 8982 - DNA, 20 bp, Artificial Sequence
  Description of Artificial Sequence: Synthetic oligonucleotide
  Target: FXN; (-) strand; PAM type: NRG; PAM sequence: AGG
caagaggaatgtaaactaac

SEQ ID NO: 8983 - DNA, 20 bp, Artificial Sequence
  Description of Artificial Sequence: Synthetic oligonucleotide
  Target: FXN; (-) strand; PAM type: NRG; PAM sequence: CAG
tcaagaggaatgtaaactaa

SEQ ID NO: 8984 - DNA, 20 bp, Artificial Sequence
  Description of Artificial Sequence: Synthetic oligonucleotide
  Target: FXN; (-) strand; PAM type: NRG; PAM sequence: AGG
gctaaatgacaagtgtcaag

SEQ ID NO: 8985 - DNA, 20 bp, Artificial Sequence
  Description of Artificial Sequence: Synthetic oligonucleotide
  Target: FXN; (-) strand; PAM type: NRG; PAM sequence: GAG
tgctaaatgacaagtgtcaa

SEQ ID NO: 8986 - DNA, 20 bp, Artificial Sequence
  Description of Artificial Sequence: Synthetic oligonucleotide
  Target: FXN; (-) strand; PAM type: NRG; PAM sequence: AAG
gatgctaaatgacaagtgtc

SEQ ID NO: 8987 - DNA, 20 bp, Artificial Sequence
  Description of Artificial Sequence: Synthetic oligonucleotide
  Target: FXN; (-) strand; PAM type: NRG; PAM sequence: AAG
tacttaggatgctaaatgac

SEQ ID NO: 8988 - DNA, 20 bp, Artificial Sequence
  Description of Artificial Sequence: Synthetic oligonucleotide
  Target: FXN; (-) strand; PAM type: NRG; PAM sequence: AGG
agagacatgtttacatactt

SEQ ID NO: 8989 - DNA, 20 bp, Artificial Sequence
  Description of Artificial Sequence: Synthetic oligonucleotide
  Target: FXN; (-) strand; PAM type: NRG; PAM sequence: TAG
gagagacatgtttacatact

SEQ ID NO: 8990 - DNA, 20 bp, Artificial Sequence
  Description of Artificial Sequence: Synthetic oligonucleotide
  Target: FXN; (-) strand; PAM type: NRG; PAM sequence: GAG
cactttgtgaatcgtgaaga

SEQ ID NO: 8991 - DNA, 20 bp, Artificial Sequence
  Description of Artificial Sequence: Synthetic oligonucleotide
  Target: FXN; (-) strand; PAM type: NRG; PAM sequence: GAG
gccactttgtgaatcgtgaa

SEQ ID NO: 8992 - DNA, 20 bp, Artificial Sequence
  Description of Artificial Sequence: Synthetic oligonucleotide
  Target: FXN; (-) strand; PAM type: NRG; PAM sequence: AAG
aagccactttgtgaatcgtg

SEQ ID NO: 8993 - DNA, 20 bp, Artificial Sequence
  Description of Artificial Sequence: Synthetic oligonucleotide
  Target: FXN; (-) strand; PAM type: NRG; PAM sequence: AAG
aaggtactaaagttcttcca

SEQ ID NO: 8994 - DNA, 20 bp, Artificial Sequence
  Description of Artificial Sequence: Synthetic oligonucleotide
  Target: FXN; (-) strand; PAM type: NRG; PAM sequence: AAG
gagaagatgggaaggtacta

SEQ ID NO: 8995 - DNA, 20 bp, Artificial Sequence
  Description of Artificial Sequence: Synthetic oligonucleotide
  Target: FXN; (-) strand; PAM type: NRG; PAM sequence: AGG
ccatggcagagaagatggga

SEQ ID NO: 8996 - DNA, 20 bp, Artificial Sequence
  Description of Artificial Sequence: Synthetic oligonucleotide
  Target: FXN; (-) strand; PAM type: NRG; PAM sequence: AAG
tccatggcagagaagatggg

SEQ ID NO: 8997 - DNA, 20 bp, Artificial Sequence
  Description of Artificial Sequence: Synthetic oligonucleotide
  Target: FXN; (-) strand; PAM type: NRG; PAM sequence: GGG
ctttccatggcagagaagat

SEQ ID NO: 8998 - DNA, 20 bp, Artificial Sequence
  Description of Artificial Sequence: Synthetic oligonucleotide
  Target: FXN; (-) strand; PAM type: NRG; PAM sequence: TGG
actttccatggcagagaaga

SEQ ID NO: 8999 - DNA, 20 bp, Artificial Sequence
  Description of Artificial Sequence: Synthetic oligonucleotide
  Target: FXN; (-) strand; PAM type: NRG; PAM sequence: AAG
gtacactttccatggcagag

SEQ ID NO: 9000 - DNA, 20 bp, Artificial Sequence
  Description of Artificial Sequence: Synthetic oligonucleotide
  Target: FXN; (-) strand; PAM type: NRG; PAM sequence: GAG
tgtgtacactttccatggca

SEQ ID NO: 9001 - DNA, 20 bp, Artificial Sequence
  Description of Artificial Sequence: Synthetic oligonucleotide
  Target: FXN; (-) strand; PAM type: NRG; PAM sequence: CAG
gttgtgtacactttccatgg

SEQ ID NO: 9002 - DNA, 20 bp, Artificial Sequence
  Description of Artificial Sequence: Synthetic oligonucleotide
  Target: FXN; (-) strand; PAM type: NRG; PAM sequence: TGG
tcagttgtgtacactttcca

SEQ ID NO: 9003 - DNA, 20 bp, Artificial Sequence
  Description of Artificial Sequence: Synthetic oligonucleotide
  Target: FXN; (-) strand; PAM type: NRG; PAM sequence: CAG
cttaaaaaaaaagaaaatgt

SEQ ID NO: 9004 - DNA, 20 bp, Artificial Sequence
  Description of Artificial Sequence: Synthetic oligonucleotide
  Target: FXN; (-) strand; PAM type: NRG; PAM sequence: AAG
aagatactgtcttaaaaaaa

SEQ ID NO: 9005 - DNA, 20 bp, Artificial Sequence
  Description of Artificial Sequence: Synthetic oligonucleotide
  Target: FXN; (-) strand; PAM type: NRG; PAM sequence: AAG
tccagcccggccatcatagc

SEQ ID NO: 9006 - DNA, 20 bp, Artificial Sequence
  Description of Artificial Sequence: Synthetic oligonucleotide
  Target: FXN; (-) strand; PAM type: NRG; PAM sequence: TAG
gcattccagcccggccatca

SEQ ID NO: 9007 - DNA, 20 bp, Artificial Sequence
  Description of Artificial Sequence: Synthetic oligonucleotide
  Target: FXN; (-) strand; PAM type: NRG; PAM sequence: CGG
atagccacagcattccagcc

SEQ ID NO: 9008 - DNA, 20 bp, Artificial Sequence
  Description of Artificial Sequence: Synthetic oligonucleotide
  Target: FXN; (-) strand; PAM type: NRG; PAM sequence: CAG
tgtgaatagccacagcattc

SEQ ID NO: 9009 - DNA, 20 bp, Artificial Sequence
  Description of Artificial Sequence: Synthetic oligonucleotide
  Target: FXN; (-) strand; PAM type: NRG; PAM sequence: CAG
attgtgcctgtgaatagcca

SEQ ID NO: 9010 - DNA, 20 bp, Artificial Sequence
  Description of Artificial Sequence: Synthetic oligonucleotide
  Target: FXN; (-) strand; PAM type: NRG; PAM sequence: TAG
gctatgattgtgcctgtgaa

SEQ ID NO: 9011 - DNA, 20 bp, Artificial Sequence
  Description of Artificial Sequence: Synthetic oligonucleotide
  Target: FXN; (-) strand; PAM type: NRG; PAM sequence: GAG
tgggagctcaaggctgcagt

SEQ ID NO: 9012 - DNA, 20 bp, Artificial Sequence
  Description of Artificial Sequence: Synthetic oligonucleotide
  Target: FXN; (-) strand; PAM type: NRG; PAM sequence: CAG
agcctgggagctcaaggctg

SEQ ID NO: 9013 - DNA, 20 bp, Artificial Sequence
  Description of Artificial Sequence: Synthetic oligonucleotide
  Target: FXN; (-) strand; PAM type: NRG; PAM sequence: AGG
cacttgagcctgggagctca

SEQ ID NO: 9014 - DNA, 20 bp, Artificial Sequence
  Description of Artificial Sequence: Synthetic oligonucleotide
  Target: FXN; (-) strand; PAM type: NRG; PAM sequence: AAG
tcacttgagcctgggagctc

SEQ ID NO: 9015 - DNA, 20 bp, Artificial Sequence
  Description of Artificial Sequence: Synthetic oligonucleotide
  Target: FXN; (-) strand; PAM type: NRG; PAM sequence: GAG
ggaggatcacttgagcctgg

SEQ ID NO: 9016 - DNA, 20 bp, Artificial Sequence
  Description of Artificial Sequence: Synthetic oligonucleotide
  Target: FXN; (-) strand; PAM type: NRG; PAM sequence: GGG
cgggaggatcacttgagcct

SEQ ID NO: 9017 - DNA, 20 bp, Artificial Sequence
  Description of Artificial Sequence: Synthetic oligonucleotide
  Target: FXN; (-) strand; PAM type: NRG; PAM sequence: TGG
gcgggaggatcacttgagcc

SEQ ID NO: 9018 - DNA, 20 bp, Artificial Sequence
  Description of Artificial Sequence: Synthetic oligonucleotide
  Target: FXN; (-) strand; PAM type: NRG; PAM sequence: GAG
ctgaggcgggaggatcactt

SEQ ID NO: 9019 - DNA, 20 bp, Artificial Sequence
  Description of Artificial Sequence: Synthetic oligonucleotide
  Target: FXN; (-) strand; PAM type: NRG; PAM sequence: AGG
actcaggaggctgaggcggg

SEQ ID NO: 9020 - DNA, 20 bp, Artificial Sequence
  Description of Artificial Sequence: Synthetic oligonucleotide
  Target: FXN; (-) strand; PAM type: NRG; PAM sequence: GAG
tactcaggaggctgaggcgg

SEQ ID NO: 9021 - DNA, 20 bp, Artificial Sequence
  Description of Artificial Sequence: Synthetic oligonucleotide
  Target: FXN; (-) strand; PAM type: NRG; PAM sequence: GGG
gctactcaggaggctgaggc

SEQ ID NO: 9022 - DNA, 20 bp, Artificial Sequence
  Description of Artificial Sequence: Synthetic oligonucleotide
  Target: FXN; (-) strand; PAM type: NRG; PAM sequence: CGG
agctactcaggaggctgagg

SEQ ID NO: 9023 - DNA, 20 bp, Artificial Sequence
  Description of Artificial Sequence: Synthetic oligonucleotide
  Target: FXN; (-) strand; PAM type: NRG; PAM sequence: AGG
ctcagctactcaggaggctg

SEQ ID NO: 9024 - DNA, 20 bp, Artificial Sequence
  Description of Artificial Sequence: Synthetic oligonucleotide
  Target: FXN; (-) strand; PAM type: NRG; PAM sequence: GAG
tctcagctactcaggaggct

SEQ ID NO: 9025 - DNA, 20 bp, Artificial Sequence
  Description of Artificial Sequence: Synthetic oligonucleotide
  Target: FXN; (-) strand; PAM type: NRG; PAM sequence: AGG
tgtgatctcagctactcagg

SEQ ID NO: 9026 - DNA, 20 bp, Artificial Sequence
  Description of Artificial Sequence: Synthetic oligonucleotide
  Target: FXN; (-) strand; PAM type: NRG; PAM sequence: GAG
ctgtgatctcagctactcag

SEQ ID NO: 9027 - DNA, 20 bp, Artificial Sequence
  Description of Artificial Sequence: Synthetic oligonucleotide
  Target: FXN; (-) strand; PAM type: NRG; PAM sequence: AGG
gcctgtgatctcagctactc

SEQ ID NO: 9028 - DNA, 20 bp, Artificial Sequence
  Description of Artificial Sequence: Synthetic oligonucleotide
  Target: FXN; (-) strand; PAM type: NRG; PAM sequence: CAG
tgcctgtgatctcagctact

SEQ ID NO: 9029 - DNA, 20 bp, Artificial Sequence
  Description of Artificial Sequence: Synthetic oligonucleotide
  Target: FXN; (-) strand; PAM type: NRG; PAM sequence: CAG
gtagtgcatgcctgtgatct

SEQ ID NO: 9030 - DNA, 20 bp, Artificial Sequence
  Description of Artificial Sequence: Synthetic oligonucleotide
  Target: FXN; (-) strand; PAM type: NRG; PAM sequence: TAG
caaatgtgagccgagtgtgg

SEQ ID NO: 9031 - DNA, 20 bp, Artificial Sequence
  Description of Artificial Sequence: Synthetic oligonucleotide
  Target: FXN; (-) strand; PAM type: NRG; PAM sequence: TGG
tgtcaaatgtgagccgagtg

SEQ ID NO: 9032 - DNA, 20 bp, Artificial Sequence
  Description of Artificial Sequence: Synthetic oligonucleotide
  Target: FXN; (-) strand; PAM type: NRG; PAM sequence: GAG
gaggatgtcaaatgtgagcc

SEQ ID NO: 9033 - DNA, 20 bp, Artificial Sequence
  Description of Artificial Sequence: Synthetic oligonucleotide
  Target: FXN; (-) strand; PAM type: NRG; PAM sequence: GAG
ctttagaggatgtcaaatgt

SEQ ID NO: 9034 - DNA, 20 bp, Artificial Sequence
  Description of Artificial Sequence: Synthetic oligonucleotide
  Target: FXN; (-) strand; PAM type: NRG; PAM sequence: AGG
acattttatatatgctttag

SEQ ID NO: 9035 - DNA, 20 bp, Artificial Sequence
  Description of Artificial Sequence: Synthetic oligonucleotide
  Target: FXN; (-) strand; PAM type: NRG; PAM sequence: GAG
cacattttatatatgcttta

SEQ ID NO: 9036 - DNA, 20 bp, Artificial Sequence
  Description of Artificial Sequence: Synthetic oligonucleotide
  Target: FXN; (-) strand; PAM type: NRG; PAM sequence: TAG
ttcacattttatatatgctt

SEQ ID NO: 9037 - DNA, 20 bp, Artificial Sequence
  Description of Artificial Sequence: Synthetic oligonucleotide
  Target: FXN; (-) strand; PAM type: NRG; PAM sequence: AAG
caaagggatgcaaattgtga

SEQ ID NO: 9038 - DNA, 20 bp, Artificial Sequence
  Description of Artificial Sequence: Synthetic oligonucleotide
  Target: FXN; (-) strand; PAM type: NRG; PAM sequence: GGG
tttctgttacatattacaaa

SEQ ID NO: 9039 - DNA, 20 bp, Artificial Sequence
  Description of Artificial Sequence: Synthetic oligonucleotide
  Target: FXN; (-) strand; PAM type: NRG; PAM sequence: AGG
atttctgttacatattacaa

SEQ ID NO: 9040 - DNA, 20 bp, Artificial Sequence
  Description of Artificial Sequence: Synthetic oligonucleotide
  Target: FXN; (-) strand; PAM type: NRG; PAM sequence: AAG
tatttctgttacatattaca

SEQ ID NO: 9041 - DNA, 20 bp, Artificial Sequence
  Description of Artificial Sequence: Synthetic oligonucleotide
  Target: FXN; (-) strand; PAM type: NRG; PAM sequence: GAG
attgttgatagattttaaaa

SEQ ID NO: 9042 - DNA, 20 bp, Artificial Sequence
  Description of Artificial Sequence: Synthetic oligonucleotide
  Target: FXN; (-) strand; PAM type: NRG; PAM sequence: AAG
ctattgttgatagattttaa

SEQ ID NO: 9043 - DNA, 20 bp, Artificial Sequence
  Description of Artificial Sequence: Synthetic oligonucleotide
  Target: FXN; (-) strand; PAM type: NRG; PAM sequence: TAG
cgtgccttgcctattgttga

SEQ ID NO: 9044 - DNA, 20 bp, Artificial Sequence
  Description of Artificial Sequence: Synthetic oligonucleotide
  Target: FXN; (-) strand; PAM type: NRG; PAM sequence: GAG
agtgctgagacgacaggcgt

SEQ ID NO: 9045 - DNA, 20 bp, Artificial Sequence
  Description of Artificial Sequence: Synthetic oligonucleotide
  Target: FXN; (-) strand; PAM type: NRG; PAM sequence: AGG
tcacaaagtgctgagacgac

SEQ ID NO: 9046 - DNA, 20 bp, Artificial Sequence
  Description of Artificial Sequence: Synthetic oligonucleotide
  Target: FXN; (-) strand; PAM type: NRG; PAM sequence: CAG
ctcacaaagtgctgagacga

SEQ ID NO: 9047 - DNA, 20 bp, Artificial Sequence
  Description of Artificial Sequence: Synthetic oligonucleotide
  Target: FXN; (-) strand; PAM type: NRG; PAM sequence: GAG
cctgggcctcacaaagtgct

SEQ ID NO: 9048 - DNA, 20 bp, Artificial Sequence
  Description of Artificial Sequence: Synthetic oligonucleotide
  Target: FXN; (-) strand; PAM type: NRG; PAM sequence: AAG
ctgcccgcctgggcctcaca

SEQ ID NO: 9049 - DNA, 20 bp, Artificial Sequence
  Description of Artificial Sequence: Synthetic oligonucleotide
  Target: FXN; (-) strand; PAM type: NRG; PAM sequence: GGG
ctcaaacgatctgcccgcct

SEQ ID NO: 9050 - DNA, 20 bp, Artificial Sequence
  Description of Artificial Sequence: Synthetic oligonucleotide
  Target: FXN; (-) strand; PAM type: NRG; PAM sequence: TGG
gctcaaacgatctgcccgcc

SEQ ID NO: 9051 - DNA, 20 bp, Artificial Sequence
  Description of Artificial Sequence: Synthetic oligonucleotide
  Target: FXN; (-) strand; PAM type: NRG; PAM sequence: AGG
cagggtggtcttgaacttct

SEQ ID NO: 9052 - DNA, 20 bp, Artificial Sequence
  Description of Artificial Sequence: Synthetic oligonucleotide
  Target: FXN; (-) strand; PAM type: NRG; PAM sequence: TAG
ccagggtggtcttgaacttc

SEQ ID NO: 9053 - DNA, 20 bp, Artificial Sequence
  Description of Artificial Sequence: Synthetic oligonucleotide
  Target: FXN; (-) strand; PAM type: NRG; PAM sequence: TGG
tttcgctatgttgcccaggg

SEQ ID NO: 9054 - DNA, 20 bp, Artificial Sequence
  Description of Artificial Sequence: Synthetic oligonucleotide
  Target: FXN; (-) strand; PAM type: NRG; PAM sequence: GGG
gggtttcgctatgttgccca

SEQ ID NO: 9055 - DNA, 20 bp, Artificial Sequence
  Description of Artificial Sequence: Synthetic oligonucleotide
  Target: FXN; (-) strand; PAM type: NRG; PAM sequence: AGG
ggggtttcgctatgttgccc

SEQ ID NO: 9056 - DNA, 20 bp, Artificial Sequence
  Description of Artificial Sequence: Synthetic oligonucleotide
  Target: FXN; (-) strand; PAM type: NRG; PAM sequence: CAG
gggggtttcgctatgttgcc

SEQ ID NO: 9057 - DNA, 20 bp, Artificial Sequence
  Description of Artificial Sequence: Synthetic oligonucleotide
  Target: FXN; (-) strand; PAM type: NRG; PAM sequence: GGG
ttgtattttttgtagaaagg

SEQ ID NO: 9058 - DNA, 20 bp, Artificial Sequence
  Description of Artificial Sequence: Synthetic oligonucleotide
  Target: FXN; (-) strand; PAM type: NRG; PAM sequence: GGG
tttgtattttttgtagaaag

SEQ ID NO: 9059 - DNA, 20 bp, Artificial Sequence
  Description of Artificial Sequence: Synthetic oligonucleotide
  Target: FXN; (-) strand; PAM type: NRG; PAM sequence: GGG
ttttgtattttttgtagaaa

SEQ ID NO: 9060 - DNA, 20 bp, Artificial Sequence
  Description of Artificial Sequence: Synthetic oligonucleotide
  Target: FXN; (-) strand; PAM type: NRG; PAM sequence: AGG
tttttgtattttttgtagaa

SEQ ID NO: 9061 - DNA, 20 bp, Artificial Sequence
  Description of Artificial Sequence: Synthetic oligonucleotide
  Target: FXN; (-) strand; PAM type: NRG; PAM sequence: AAG
gtttttgtattttttgtaga

SEQ ID NO: 9062 - DNA, 20 bp, Artificial Sequence
  Description of Artificial Sequence: Synthetic oligonucleotide
  Target: FXN; (-) strand; PAM type: NRG; PAM sequence: TAG
gctagtttttgtattttttg

SEQ ID NO: 9063 - DNA, 20 bp, Artificial Sequence
  Description of Artificial Sequence: Synthetic oligonucleotide
  Target: FXN; (-) strand; PAM type: NRG; PAM sequence: TAG
tgtgcaccaccacacccagc

SEQ ID NO: 9064 - DNA, 20 bp, Artificial Sequence
  Description of Artificial Sequence: Synthetic oligonucleotide
  Target: FXN; (-) strand; PAM type: NRG; PAM sequence: CAG
caggtgtgcaccaccacacc

SEQ ID NO: 9065 - DNA, 20 bp, Artificial Sequence
  Description of Artificial Sequence: Synthetic oligonucleotide
  Target: FXN; (-) strand; PAM type: NRG; PAM sequence: AGG
ttccaagtagctgggactac

SEQ ID NO: 9066 - DNA, 20 bp, Artificial Sequence
  Description of Artificial Sequence: Synthetic oligonucleotide
  Target: FXN; (-) strand; PAM type: NRG; PAM sequence: CAG
cttccaagtagctgggacta

SEQ ID NO: 9067 - DNA, 20 bp, Artificial Sequence
  Description of Artificial Sequence: Synthetic oligonucleotide
  Target: FXN; (-) strand; PAM type: NRG; PAM sequence: GGG
tttcagccttccaagtagct

SEQ ID NO: 9068 - DNA, 20 bp, Artificial Sequence
  Description of Artificial Sequence: Synthetic oligonucleotide
  Target: FXN; (-) strand; PAM type: NRG; PAM sequence: TGG
atttcagccttccaagtagc

SEQ ID NO: 9069 - DNA, 20 bp, Artificial Sequence
  Description of Artificial Sequence: Synthetic oligonucleotide
  Target: FXN; (-) strand; PAM type: NRG; PAM sequence: TAG
tcccatttcagccttccaag

SEQ ID NO: 9070 - DNA, 20 bp, Artificial Sequence
  Description of Artificial Sequence: Synthetic oligonucleotide
  Target: FXN; (-) strand; PAM type: NRG; PAM sequence: AAG
tcttcccatttcagccttcc

SEQ ID NO: 9071 - DNA, 20 bp, Artificial Sequence
  Description of Artificial Sequence: Synthetic oligonucleotide
  Target: FXN; (-) strand; PAM type: NRG; PAM sequence: CAG
ctcaagcagtcttcccattt

SEQ ID NO: 9072 - DNA, 20 bp, Artificial Sequence
  Description of Artificial Sequence: Synthetic oligonucleotide
  Target: FXN; (-) strand; PAM type: NRG; PAM sequence: CAG
ttctccctcccgggctcaag

SEQ ID NO: 9073 - DNA, 20 bp, Artificial Sequence
  Description of Artificial Sequence: Synthetic oligonucleotide
  Target: FXN; (-) strand; PAM type: NRG; PAM sequence: AAG
aacttctccctcccgggctc

SEQ ID NO: 9074 - DNA, 20 bp, Artificial Sequence
  Description of Artificial Sequence: Synthetic oligonucleotide
  Target: FXN; (-) strand; PAM type: NRG; PAM sequence: GGG
tactgcaacttctccctccc

SEQ ID NO: 9075 - DNA, 20 bp, Artificial Sequence
  Description of Artificial Sequence: Synthetic oligonucleotide
  Target: FXN; (-) strand; PAM type: NRG; PAM sequence: CGG
ttactgcaacttctccctcc

SEQ ID NO: 9076 - DNA, 20 bp, Artificial Sequence
  Description of Artificial Sequence: Synthetic oligonucleotide
  Target: FXN; (-) strand; PAM type: NRG; PAM sequence: TGG
ggagtgcagtggtgtggtcc

SEQ ID NO: 9077 - DNA, 20 bp, Artificial Sequence
  Description of Artificial Sequence: Synthetic oligonucleotide
  Target: FXN; (-) strand; PAM type: NRG; PAM sequence: TGG
caggctggagtgcagtggtg

SEQ ID NO: 9078 - DNA, 20 bp, Artificial Sequence
  Description of Artificial Sequence: Synthetic oligonucleotide
  Target: FXN; (-) strand; PAM type: NRG; PAM sequence: TGG
ttgcccaggctggagtgcag

SEQ ID NO: 9079 - DNA, 20 bp, Artificial Sequence
  Description of Artificial Sequence: Synthetic oligonucleotide
  Target: FXN; (-) strand; PAM type: NRG; PAM sequence: CAG
ctgttgcccaggctggagtg

SEQ ID NO: 9080 - DNA, 20 bp, Artificial Sequence
  Description of Artificial Sequence: Synthetic oligonucleotide
  Target: FXN; (-) strand; PAM type: NRG; PAM sequence: GAG
tcactctgttgcccaggctg

SEQ ID NO: 9081 - DNA, 20 bp, Artificial Sequence
  Description of Artificial Sequence: Synthetic oligonucleotide
  Target: FXN; (-) strand; PAM type: NRG; PAM sequence: TGG
tctcactctgttgcccaggc

SEQ ID NO: 9082 - DNA, 20 bp, Artificial Sequence
  Description of Artificial Sequence: Synthetic oligonucleotide
  Target: FXN; (-) strand; PAM type: NRG; PAM sequence: AGG
agagtctcactctgttgccc

SEQ ID NO: 9083 - DNA, 20 bp, Artificial Sequence
  Description of Artificial Sequence: Synthetic oligonucleotide
  Target: FXN; (-) strand; PAM type: NRG; PAM sequence: CAG
cagagtctcactctgttgcc

SEQ ID NO: 9084 - DNA, 20 bp, Artificial Sequence
  Description of Artificial Sequence: Synthetic oligonucleotide
  Target: FXN; (-) strand; PAM type: NRG; PAM sequence: GAG
ttatttgtttgtttgagaca

SEQ ID NO: 9085 - DNA, 20 bp, Artificial Sequence
  Description of Artificial Sequence: Synthetic oligonucleotide
  Target: FXN; (-) strand; PAM type: NRG; PAM sequence: CAG
atttatttgtttgtttgaga

SEQ ID NO: 9086 - DNA, 20 bp, Artificial Sequence
  Description of Artificial Sequence: Synthetic oligonucleotide
  Target: FXN; (-) strand; PAM type: NRG; PAM sequence: GAG
cctcatttatttgtttgttt

SEQ ID NO: 9087 - DNA, 20 bp, Artificial Sequence
  Description of Artificial Sequence: Synthetic oligonucleotide
  Target: FXN; (-) strand; PAM type: NRG; PAM sequence: TGG
tttcaccgtgttagccagga

SEQ ID NO: 9088 - DNA, 20 bp, Artificial Sequence
  Description of Artificial Sequence: Synthetic oligonucleotide
  Target: FXN; (-) strand; PAM type: NRG; PAM sequence: AGG
cgggtttcaccgtgttagcc

SEQ ID NO: 9089 - DNA, 20 bp, Artificial Sequence
  Description of Artificial Sequence: Synthetic oligonucleotide
  Target: FXN; (-) strand; PAM type: NRG; PAM sequence: CAG
acgggtttcaccgtgttagc

SEQ ID NO: 9090 - DNA, 20 bp, Artificial Sequence
  Description of Artificial Sequence: Synthetic oligonucleotide
  Target: FXN; (-) strand; PAM type: NRG; PAM sequence: TAG
agagacgggtttcaccgtgt

SEQ ID NO: 9091 - DNA, 20 bp, Artificial Sequence
  Description of Artificial Sequence: Synthetic oligonucleotide
  Target: FXN; (-) strand; PAM type: NRG; PAM sequence: GGG
tttttttttttagtagagac

SEQ ID NO: 9092 - DNA, 20 bp, Artificial Sequence
  Description of Artificial Sequence: Synthetic oligonucleotide
  Target: FXN; (-) strand; PAM type: NRG; PAM sequence: CGG
ttttttttttttagtagaga

SEQ ID NO: 9093 - DNA, 20 bp, Artificial Sequence
  Description of Artificial Sequence: Synthetic oligonucleotide
  Target: FXN; (-) strand; PAM type: NRG; PAM sequence: GAG
atttttttttttttttagta

SEQ ID NO: 9094 - DNA, 20 bp, Artificial Sequence
  Description of Artificial Sequence: Synthetic oligonucleotide
  Target: FXN; (-) strand; PAM type: NRG; PAM sequence: TAG
gtatttttttttttttttag

SEQ ID NO: 9095 - DNA, 20 bp, Artificial Sequence
  Description of Artificial Sequence: Synthetic oligonucleotide
  Target: FXN; (-) strand; PAM type: NRG; PAM sequence: TAG
tttgtatttttttttttttt

SEQ ID NO: 9096 - DNA, 20 bp, Artificial Sequence
  Description of Artificial Sequence: Synthetic oligonucleotide
  Target: FXN; (-) strand; PAM type: NRG; PAM sequence: TGG
caggcgcccgccaccatgcc

SEQ ID NO: 9097 - DNA, 20 bp, Artificial Sequence
  Description of Artificial Sequence: Synthetic oligonucleotide
  Target: FXN; (-) strand; PAM type: NRG; PAM sequence: AGG
tcccgagtaactgggactac

SEQ ID NO: 9098 - DNA, 20 bp, Artificial Sequence
  Description of Artificial Sequence: Synthetic oligonucleotide
  Target: FXN; (-) strand; PAM type: NRG; PAM sequence: CAG
ctcccgagtaactgggacta

SEQ ID NO: 9099 - DNA, 20 bp, Artificial Sequence
  Description of Artificial Sequence: Synthetic oligonucleotide
  Target: FXN; (-) strand; PAM type: NRG; PAM sequence: GGG
cctcagcctcccgagtaact

SEQ ID NO: 9100 - DNA, 20 bp, Artificial Sequence
  Description of Artificial Sequence: Synthetic oligonucleotide
  Target: FXN; (-) strand; PAM type: NRG; PAM sequence: TGG
gcctcagcctcccgagtaac

SEQ ID NO: 9101 - DNA, 20 bp, Artificial Sequence
  Description of Artificial Sequence: Synthetic oligonucleotide
  Target: FXN; (-) strand; PAM type: NRG; PAM sequence: GAG
ttctcctgcctcagcctccc

SEQ ID NO: 9102 - DNA, 20 bp, Artificial Sequence
  Description of Artificial Sequence: Synthetic oligonucleotide
  Target: FXN; (-) strand; PAM type: NRG; PAM sequence: CAG
ttcacgccattctcctgcct

SEQ ID NO: 9103 - DNA, 20 bp, Artificial Sequence
  Description of Artificial Sequence: Synthetic oligonucleotide
  Target: FXN; (-) strand; PAM type: NRG; PAM sequence: CGG
tcactgcaagctctgcctcc

SEQ ID NO: 9104 - DNA, 20 bp, Artificial Sequence
  Description of Artificial Sequence: Synthetic oligonucleotide
  Target: FXN; (-) strand; PAM type: NRG; PAM sequence: AAG
gtgcgatctcggctcactgc

SEQ ID NO: 9105 - DNA, 20 bp, Artificial Sequence
  Description of Artificial Sequence: Synthetic oligonucleotide
  Target: FXN; (-) strand; PAM type: NRG; PAM sequence: CGG
ggagggcagtggtgcgatct

SEQ ID NO: 9106 - DNA, 20 bp, Artificial Sequence
  Description of Artificial Sequence: Synthetic oligonucleotide
  Target: FXN; (-) strand; PAM type: NRG; PAM sequence: TGG
tcgcccaggctggagggcag

SEQ ID NO: 9107 - DNA, 20 bp, Artificial Sequence
  Description of Artificial Sequence: Synthetic oligonucleotide
  Target: FXN; (-) strand; PAM type: NRG; PAM sequence: CAG
ctgtcgcccaggctggaggg

SEQ ID NO: 9108 - DNA, 20 bp, Artificial Sequence
  Description of Artificial Sequence: Synthetic oligonucleotide
  Target: FXN; (-) strand; PAM type: NRG; PAM sequence: GGG
gctctgtcgcccaggctgga

SEQ ID NO: 9109 - DNA, 20 bp, Artificial Sequence
  Description of Artificial Sequence: Synthetic oligonucleotide
  Target: FXN; (-) strand; PAM type: NRG; PAM sequence: AGG
cgctctgtcgcccaggctgg

SEQ ID NO: 9110 - DNA, 20 bp, Artificial Sequence
  Description of Artificial Sequence: Synthetic oligonucleotide
  Target: FXN; (-) strand; PAM type: NRG; PAM sequence: GAG
tcgctctgtcgcccaggctg

SEQ ID NO: 9111 - DNA, 20 bp, Artificial Sequence
  Description of Artificial Sequence: Synthetic oligonucleotide
  Target: FXN; (-) strand; PAM type: NRG; PAM sequence: TGG
tctcgctctgtcgcccaggc

SEQ ID NO: 9112 - DNA, 20 bp, Artificial Sequence
  Description of Artificial Sequence: Synthetic oligonucleotide
  Target: FXN; (-) strand; PAM type: NRG; PAM sequence: AGG
ggagtctcgctctgtcgccc

SEQ ID NO: 9113 - DNA, 20 bp, Artificial Sequence
  Description of Artificial Sequence: Synthetic oligonucleotide
  Target: FXN; (-) strand; PAM type: NRG; PAM sequence: CAG
cggagtctcgctctgtcgcc

SEQ ID NO: 9114 - DNA, 20 bp, Artificial Sequence
  Description of Artificial Sequence: Synthetic oligonucleotide
  Target: FXN; (-) strand; PAM type: NRG; PAM sequence: GAG
ttgattgattgattgagacg

SEQ ID NO: 9115 - DNA, 20 bp, Artificial Sequence
  Description of Artificial Sequence: Synthetic oligonucleotide
  Target: FXN; (-) strand; PAM type: NRG; PAM sequence: CGG
gattgattgattgattgaga

SEQ ID NO: 9116 - DNA, 20 bp, Artificial Sequence
  Description of Artificial Sequence: Synthetic oligonucleotide
  Target: FXN; (-) strand; PAM type: NRG; PAM sequence: GAG
tattgattgattgattgatt

SEQ ID NO: 9117 - DNA, 20 bp, Artificial Sequence
  Description of Artificial Sequence: Synthetic oligonucleotide
  Target: FXN; (-) strand; PAM type: NRG; PAM sequence: TAG
tgcacaataaatattgttaa

SEQ ID NO: 9118 - DNA, 20 bp, Artificial Sequence
  Description of Artificial Sequence: Synthetic oligonucleotide
  Target: FXN; (-) strand; PAM type: NRG; PAM sequence: AAG
ggacagggcatgttcctgtt

SEQ ID NO: 9119 - DNA, 20 bp, Artificial Sequence
  Description of Artificial Sequence: Synthetic oligonucleotide
  Target: FXN; (-) strand; PAM type: NRG; PAM sequence: GGG
tgtaaagttttttttggaca

SEQ ID NO: 9120 - DNA, 20 bp, Artificial Sequence
  Description of Artificial Sequence: Synthetic oligonucleotide
  Target: FXN; (-) strand; PAM type: NRG; PAM sequence: AGG
ctgtaaagttttttttggac

SEQ ID NO: 9121 - DNA, 20 bp, Artificial Sequence
  Description of Artificial Sequence: Synthetic oligonucleotide
  Target: FXN; (-) strand; PAM type: NRG; PAM sequence: CAG
cctgtaaagttttttttgga

SEQ ID NO: 9122 - DNA, 20 bp, Artificial Sequence
  Description of Artificial Sequence: Synthetic oligonucleotide
  Target: FXN; (-) strand; PAM type: NRG; PAM sequence: TGG
aagccctgtaaagttttttt

SEQ ID NO: 9123 - DNA, 20 bp, Artificial Sequence
  Description of Artificial Sequence: Synthetic oligonucleotide
  Target: FXN; (-) strand; PAM type: NRG; PAM sequence: AAG
aaaatgagttaagccctgta

SEQ ID NO: 9124 - DNA, 20 bp, Artificial Sequence
  Description of Artificial Sequence: Synthetic oligonucleotide
  Target: FXN; (-) strand; PAM type: NRG; PAM sequence: AAG
tggtaaggataaaatgagtt

SEQ ID NO: 9125 - DNA, 20 bp, Artificial Sequence
  Description of Artificial Sequence: Synthetic oligonucleotide
  Target: FXN; (-) strand; PAM type: NRG; PAM sequence: GAG
gattgtggtaaggataaaat

SEQ ID NO: 9126 - DNA, 20 bp, Artificial Sequence
  Description of Artificial Sequence: Synthetic oligonucleotide
  Target: FXN; (-) strand; PAM type: NRG; PAM sequence: AGG
tacttcataggattgtggta

SEQ ID NO: 9127 - DNA, 20 bp, Artificial Sequence
  Description of Artificial Sequence: Synthetic oligonucleotide
  Target: FXN; (-) strand; PAM type: NRG; PAM sequence: AAG
ctacttcataggattgtggt

SEQ ID NO: 9128 - DNA, 20 bp, Artificial Sequence
  Description of Artificial Sequence: Synthetic oligonucleotide
  Target: FXN; (-) strand; PAM type: NRG; PAM sequence: TGG
gttcctacttcataggattg

SEQ ID NO: 9129 - DNA, 20 bp, Artificial Sequence
  Description of Artificial Sequence: Synthetic oligonucleotide
  Target: FXN; (-) strand; PAM type: NRG; PAM sequence: AGG
tataaaagttcctacttcat

SEQ ID NO: 9130 - DNA, 20 bp, Artificial Sequence
  Description of Artificial Sequence: Synthetic oligonucleotide
  Target: FXN; (-) strand; PAM type: NRG; PAM sequence: TAG
ttataaaagttcctacttca

SEQ ID NO: 9131 - DNA, 20 bp, Artificial Sequence
  Description of Artificial Sequence: Synthetic oligonucleotide
  Target: FXN; (-) strand; PAM type: NRG; PAM sequence: AAG
ttataaaatgcgttttataa

SEQ ID NO: 9132 - DNA, 20 bp, Artificial Sequence
  Description of Artificial Sequence: Synthetic oligonucleotide
  Target: FXN; (-) strand; PAM type: NRG; PAM sequence: AAG
tagctgtgtgaccagagggc

SEQ ID NO: 9133 - DNA, 20 bp, Artificial Sequence
  Description of Artificial Sequence: Synthetic oligonucleotide
  Target: FXN; (-) strand; PAM type: NRG; PAM sequence: GGG
ttcctagctgtgtgaccaga

SEQ ID NO: 9134 - DNA, 20 bp, Artificial Sequence
  Description of Artificial Sequence: Synthetic oligonucleotide
  Target: FXN; (-) strand; PAM type: NRG; PAM sequence: AGG
cttcctagctgtgtgaccag

SEQ ID NO: 9135 - DNA, 20 bp, Artificial Sequence
  Description of Artificial Sequence: Synthetic oligonucleotide
  Target: FXN; (-) strand; PAM type: NRG; PAM sequence: GAG
acttcctagctgtgtgacca

SEQ ID NO: 9136 - DNA, 20 bp, Artificial Sequence
  Description of Artificial Sequence: Synthetic oligonucleotide
  Target: FXN; (-) strand; PAM type: NRG; PAM sequence: CAG
ccacttcctagctgtgtgac

SEQ ID NO: 9137 - DNA, 20 bp, Artificial Sequence
  Description of Artificial Sequence: Synthetic oligonucleotide
  Target: FXN; (-) strand; PAM type: NRG; PAM sequence: TAG
tctgtactctgcccacttcc

SEQ ID NO: 9138 - DNA, 20 bp, Artificial Sequence
  Description of Artificial Sequence: Synthetic oligonucleotide
  Target: FXN; (-) strand; PAM type: NRG; PAM sequence: CGG
gggtatgtggggccaggaga

SEQ ID NO: 9139 - DNA, 20 bp, Artificial Sequence
  Description of Artificial Sequence: Synthetic oligonucleotide
  Target: FXN; (-) strand; PAM type: NRG; PAM sequence: GAG
agttgggtatgtggggccag

SEQ ID NO: 9140 - DNA, 20 bp, Artificial Sequence
  Description of Artificial Sequence: Synthetic oligonucleotide
  Target: FXN; (-) strand; PAM type: NRG; PAM sequence: AGG
gcagttgggtatgtggggcc

SEQ ID NO: 9141 - DNA, 20 bp, Artificial Sequence
  Description of Artificial Sequence: Synthetic oligonucleotide
  Target: FXN; (-) strand; PAM type: NRG; PAM sequence: CAG
agcagttgggtatgtggggc

SEQ ID NO: 9142 - DNA, 20 bp, Artificial Sequence
  Description of Artificial Sequence: Synthetic oligonucleotide
  Target: FXN; (-) strand; PAM type: NRG; PAM sequence: GGG
ttacagcagttgggtatgtg

SEQ ID NO: 9143 - DNA, 20 bp, Artificial Sequence
  Description of Artificial Sequence: Synthetic oligonucleotide
  Target: FXN; (-) strand; PAM type: NRG; PAM sequence: GGG
tttacagcagttgggtatgt

SEQ ID NO: 9144 - DNA, 20 bp, Artificial Sequence
  Description of Artificial Sequence: Synthetic oligonucleotide
  Target: FXN; (-) strand; PAM type: NRG; PAM sequence: TGG
gtttacagcagttgggtatg

SEQ ID NO: 9145 - DNA, 20 bp, Artificial Sequence
  Description of Artificial Sequence: Synthetic oligonucleotide
  Target: FXN; (-) strand; PAM type: NRG; PAM sequence: GGG
ggtatgggtttacagcagtt

SEQ ID NO: 9146 - DNA, 20 bp, Artificial Sequence
  Description of Artificial Sequence: Synthetic oligonucleotide
  Target: FXN; (-) strand; PAM type: NRG; PAM sequence: TGG
cggtatgggtttacagcagt

SEQ ID NO: 9147 - DNA, 20 bp, Artificial Sequence
  Description of Artificial Sequence: Synthetic oligonucleotide
  Target: FXN; (-) strand; PAM type: NRG; PAM sequence: CAG
ccgccggtatgggtttacag

SEQ ID NO: 9148 - DNA, 20 bp, Artificial Sequence
  Description of Artificial Sequence: Synthetic oligonucleotide
  Target: FXN; (-) strand; PAM type: NRG; PAM sequence: CAG
tggccgccggtatgggttta

SEQ ID NO: 9149 - DNA, 20 bp, Artificial Sequence
  Description of Artificial Sequence: Synthetic oligonucleotide
  Target: FXN; (-) strand; PAM type: NRG; PAM sequence: GGG
ggctgcttggccgccggtat

SEQ ID NO: 9150 - DNA, 20 bp, Artificial Sequence
  Description of Artificial Sequence: Synthetic oligonucleotide
  Target: FXN; (-) strand; PAM type: NRG; PAM sequence: TGG
aggctgcttggccgccggta

SEQ ID NO: 9151 - DNA, 20 bp, Artificial Sequence
  Description of Artificial Sequence: Synthetic oligonucleotide
  Target: FXN; (-) strand; PAM type: NRG; PAM sequence: CGG
aattgaggctgcttggccgc

SEQ ID NO: 9152 - DNA, 20 bp, Artificial Sequence
  Description of Artificial Sequence: Synthetic oligonucleotide
  Target: FXN; (-) strand; PAM type: NRG; PAM sequence: TGG
atgcacaaattgaggctgct

SEQ ID NO: 9153 - DNA, 20 bp, Artificial Sequence
  Description of Artificial Sequence: Synthetic oligonucleotide
  Target: FXN; (-) strand; PAM type: NRG; PAM sequence: AGG
gtgggtgcatgcacaaattg

SEQ ID NO: 9154 - DNA, 20 bp, Artificial Sequence
  Description of Artificial Sequence: Synthetic oligonucleotide
  Target: FXN; (-) strand; PAM type: NRG; PAM sequence: GAG
agtgggtgcatgcacaaatt

SEQ ID NO: 9155 - DNA, 20 bp, Artificial Sequence
  Description of Artificial Sequence: Synthetic oligonucleotide
  Target: FXN; (-) strand; PAM type: NRG; PAM sequence: GGG
ctgctgtcttgctgggaagt

SEQ ID NO: 9156 - DNA, 20 bp, Artificial Sequence
  Description of Artificial Sequence: Synthetic oligonucleotide
  Target: FXN; (-) strand; PAM type: NRG; PAM sequence: TGG
gctgctgtcttgctgggaag

SEQ ID NO: 9157 - DNA, 20 bp, Artificial Sequence
  Description of Artificial Sequence: Synthetic oligonucleotide
  Target: FXN; (-) strand; PAM type: NRG; PAM sequence: AAG
ggagctgctgtcttgctggg

SEQ ID NO: 9158 - DNA, 20 bp, Artificial Sequence
  Description of Artificial Sequence: Synthetic oligonucleotide
  Target: FXN; (-) strand; PAM type: NRG; PAM sequence: GGG
ttgggagctgctgtcttgct

SEQ ID NO: 9159 - DNA, 20 bp, Artificial Sequence
  Description of Artificial Sequence: Synthetic oligonucleotide
  Target: FXN; (-) strand; PAM type: NRG; PAM sequence: TGG
cttgggagctgctgtcttgc

SEQ ID NO: 9160 - DNA, 20 bp, Artificial Sequence
  Description of Artificial Sequence: Synthetic oligonucleotide
  Target: FXN; (-) strand; PAM type: NRG; PAM sequence: GAG
tctaaacaggaggaacttgg

SEQ ID NO: 9161 - DNA, 20 bp, Artificial Sequence
  Description of Artificial Sequence: Synthetic oligonucleotide
  Target: FXN; (-) strand; PAM type: NRG; PAM sequence: GGG
attctaaacaggaggaactt

SEQ ID NO: 9162 - DNA, 20 bp, Artificial Sequence
  Description of Artificial Sequence: Synthetic oligonucleotide
  Target: FXN; (-) strand; PAM type: NRG; PAM sequence: TGG
aattctaaacaggaggaact

SEQ ID NO: 9163 - DNA, 20 bp, Artificial Sequence
  Description of Artificial Sequence: Synthetic oligonucleotide
  Target: FXN; (-) strand; PAM type: NRG; PAM sequence: AGG
cttctaaaattctaaacagg

SEQ ID NO: 9164 - DNA, 20 bp, Artificial Sequence
  Description of Artificial Sequence: Synthetic oligonucleotide
  Target: FXN; (-) strand; PAM type: NRG; PAM sequence: GAG
gcttctaaaattctaaacag

SEQ ID NO: 9165 - DNA, 20 bp, Artificial Sequence
  Description of Artificial Sequence: Synthetic oligonucleotide
  Target: FXN; (-) strand; PAM type: NRG; PAM sequence: AGG
ccgcttctaaaattctaaac

SEQ ID NO: 9166 - DNA, 20 bp, Artificial Sequence
  Description of Artificial Sequence: Synthetic oligonucleotide
  Target: FXN; (-) strand; PAM type: NRG; PAM sequence: CAG
gccgcttctaaaattctaaa

SEQ ID NO: 9167 - DNA, 20 bp, Artificial Sequence
  Description of Artificial Sequence: Synthetic oligonucleotide
  Target: FXN; (-) strand; PAM type: NRG; PAM sequence: TGG
caagggagactgcagcctgg

SEQ ID NO: 9168 - DNA, 20 bp, Artificial Sequence
  Description of Artificial Sequence: Synthetic oligonucleotide
  Target: FXN; (-) strand; PAM type: NRG; PAM sequence: TGG
acccaagggagactgcagcc

SEQ ID NO: 9169 - DNA, 20 bp, Artificial Sequence
  Description of Artificial Sequence: Synthetic oligonucleotide
  Target: FXN; (-) strand; PAM type: NRG; PAM sequence: CAG
ccctgacccaagggagactg

SEQ ID NO: 9170 - DNA, 20 bp, Artificial Sequence
  Description of Artificial Sequence: Synthetic oligonucleotide
  Target: FXN; (-) strand; PAM type: NRG; PAM sequence: GAG
ccaggacccctgacccaagg

SEQ ID NO: 9171 - DNA, 20 bp, Artificial Sequence
  Description of Artificial Sequence: Synthetic oligonucleotide
  Target: FXN; (-) strand; PAM type: NRG; PAM sequence: GGG
aaccaggacccctgacccaa

SEQ ID NO: 9172 - DNA, 20 bp, Artificial Sequence
  Description of Artificial Sequence: Synthetic oligonucleotide
  Target: FXN; (-) strand; PAM type: NRG; PAM sequence: AGG
caaccaggacccctgaccca

SEQ ID NO: 9173 - DNA, 20 bp, Artificial Sequence
  Description of Artificial Sequence: Synthetic oligonucleotide
  Target: FXN; (-) strand; PAM type: NRG; PAM sequence: AAG
gcaaccaggacccctgaccc

SEQ ID NO: 9174 - DNA, 20 bp, Artificial Sequence
  Description of Artificial Sequence: Synthetic oligonucleotide
  Target: FXN; (-) strand; PAM type: NRG; PAM sequence: AGG
gcaaagcacggagtgcaacc

SEQ ID NO: 9175 - DNA, 20 bp, Artificial Sequence
  Description of Artificial Sequence: Synthetic oligonucleotide
  Target: FXN; (-) strand; PAM type: NRG; PAM sequence: CAG
tgcaaagcacggagtgcaac

SEQ ID NO: 9176 - DNA, 20 bp, Artificial Sequence
  Description of Artificial Sequence: Synthetic oligonucleotide
  Target: FXN; (-) strand; PAM type: NRG; PAM sequence: GAG
cctgctttgtgcaaagcacg

SEQ ID NO: 9177 - DNA, 20 bp, Artificial Sequence
  Description of Artificial Sequence: Synthetic oligonucleotide
  Target: FXN; (-) strand; PAM type: NRG; PAM sequence: CGG
agcctgctttgtgcaaagca

SEQ ID NO: 9178 - DNA, 20 bp, Artificial Sequence
  Description of Artificial Sequence: Synthetic oligonucleotide
  Target: FXN; (-) strand; PAM type: NRG; PAM sequence: AAG
tggagagcctgctttgtgca

SEQ ID NO: 9179 - DNA, 20 bp, Artificial Sequence
  Description of Artificial Sequence: Synthetic oligonucleotide
  Target: FXN; (-) strand; PAM type: NRG; PAM sequence: GAG
gtgcatttaacaaaaatgga

SEQ ID NO: 9180 - DNA, 20 bp, Artificial Sequence
  Description of Artificial Sequence: Synthetic oligonucleotide
  Target: FXN; (-) strand; PAM type: NRG; PAM sequence: GAG
tcgtgcatttaacaaaaatg

SEQ ID NO: 9181 - DNA, 20 bp, Artificial Sequence
  Description of Artificial Sequence: Synthetic oligonucleotide
  Target: FXN; (-) strand; PAM type: NRG; PAM sequence: TGG
attcgtgcatttaacaaaaa

SEQ ID NO: 9182 - DNA, 20 bp, Artificial Sequence
  Description of Artificial Sequence: Synthetic oligonucleotide
  Target: FXN; (-) strand; PAM type: NRG; PAM sequence: TAG
tcaggaagaacttcccagct

SEQ ID NO: 9183 - DNA, 20 bp, Artificial Sequence
  Description of Artificial Sequence: Synthetic oligonucleotide
  Target: FXN; (-) strand; PAM type: NRG; PAM sequence: CAG
agacctcaggaagaacttcc

SEQ ID NO: 9184 - DNA, 20 bp, Artificial Sequence
  Description of Artificial Sequence: Synthetic oligonucleotide
  Target: FXN; (-) strand; PAM type: NRG; PAM sequence: AAG
gctagaggttagacctcagg

SEQ ID NO: 9185 - DNA, 20 bp, Artificial Sequence
  Description of Artificial Sequence: Synthetic oligonucleotide
  Target: FXN; (-) strand; PAM type: NRG; PAM sequence: AGG
gcagctagaggttagacctc

SEQ ID NO: 9186 - DNA, 20 bp, Artificial Sequence
  Description of Artificial Sequence: Synthetic oligonucleotide
  Target: FXN; (-) strand; PAM type: NRG; PAM sequence: CAG
agcagctagaggttagacct

SEQ ID NO: 9187 - DNA, 20 bp, Artificial Sequence
  Description of Artificial Sequence: Synthetic oligonucleotide
  Target: FXN; (-) strand; PAM type: NRG; PAM sequence: TAG
gtgggggagcagctagaggt

SEQ ID NO: 9188 - DNA, 20 bp, Artificial Sequence
  Description of Artificial Sequence: Synthetic oligonucleotide
  Target: FXN; (-) strand; PAM type: NRG; PAM sequence: AGG
ttctgtgggggagcagctag

SEQ ID NO: 9189 - DNA, 20 bp, Artificial Sequence
  Description of Artificial Sequence: Synthetic oligonucleotide
  Target: FXN; (-) strand; PAM type: NRG; PAM sequence: GAG
cttctgtgggggagcagcta

SEQ ID NO: 9190 - DNA, 20 bp, Artificial Sequence
  Description of Artificial Sequence: Synthetic oligonucleotide
  Target: FXN; (-) strand; PAM type: NRG; PAM sequence: TAG
ctcttctgtgggggagcagc

SEQ ID NO: 9191 - DNA, 20 bp, Artificial Sequence
  Description of Artificial Sequence: Synthetic oligonucleotide
  Target: FXN; (-) strand; PAM type: NRG; PAM sequence: CAG
ggcactcttctgtgggggag

SEQ ID NO: 9192 - DNA, 20 bp, Artificial Sequence
  Description of Artificial Sequence: Synthetic oligonucleotide
  Target: FXN; (-) strand; PAM type: NRG; PAM sequence: GAG
gcaggcactcttctgtgggg

SEQ ID NO: 9193 - DNA, 20 bp, Artificial Sequence
  Description of Artificial Sequence: Synthetic oligonucleotide
  Target: FXN; (-) strand; PAM type: NRG; PAM sequence: GGG
ccgcaggcactcttctgtgg

SEQ ID NO: 9194 - DNA, 20 bp, Artificial Sequence
  Description of Artificial Sequence: Synthetic oligonucleotide
  Target: FXN; (-) strand; PAM type: NRG; PAM sequence: GGG
gccgcaggcactcttctgtg

SEQ ID NO: 9195 - DNA, 20 bp, Artificial Sequence
  Description of Artificial Sequence: Synthetic oligonucleotide
  Target: FXN; (-) strand; PAM type: NRG; PAM sequence: GGG
ggccgcaggcactcttctgt

SEQ ID NO: 9196 - DNA, 20 bp, Artificial Sequence
  Description of Artificial Sequence: Synthetic oligonucleotide
  Target: FXN; (-) strand; PAM type: NRG; PAM sequence: TGG
tggccgcaggcactcttctg

SEQ ID NO: 9197 - DNA, 20 bp, Artificial Sequence
  Description of Artificial Sequence: Synthetic oligonucleotide
  Target: FXN; (-) strand; PAM type: NRG; PAM sequence: AGG
ccctggtggccactggccgc

SEQ ID NO: 9198 - DNA, 20 bp, Artificial Sequence
  Description of Artificial Sequence: Synthetic oligonucleotide
  Target: FXN; (-) strand; PAM type: NRG; PAM sequence: CAG
cccctggtggccactggccg

SEQ ID NO: 9199 - DNA, 20 bp, Artificial Sequence
  Description of Artificial Sequence: Synthetic oligonucleotide
  Target: FXN; (-) strand; PAM type: NRG; PAM sequence: TGG
cggcgacccctggtggccac

SEQ ID NO: 9200 - DNA, 20 bp, Artificial Sequence
  Description of Artificial Sequence: Synthetic oligonucleotide
  Target: FXN; (-) strand; PAM type: NRG; PAM sequence: TGG
ggtgctgcggcgacccctgg

SEQ ID NO: 9201 - DNA, 20 bp, Artificial Sequence
  Description of Artificial Sequence: Synthetic oligonucleotide
  Target: FXN; (-) strand; PAM type: NRG; PAM sequence: TGG
ctgggtgctgcggcgacccc

SEQ ID NO: 9202 - DNA, 20 bp, Artificial Sequence
  Description of Artificial Sequence: Synthetic oligonucleotide
  Target: FXN; (-) strand; PAM type: NRG; PAM sequence: CGG
ccctccagcgctgggtgctg

SEQ ID NO: 9203 - DNA, 20 bp, Artificial Sequence
  Description of Artificial Sequence: Synthetic oligonucleotide
  Target: FXN; (-) strand; PAM type: NRG; PAM sequence: GGG
ccgctccgccctccagcgct

SEQ ID NO: 9204 - DNA, 20 bp, Artificial Sequence
  Description of Artificial Sequence: Synthetic oligonucleotide
  Target: FXN; (-) strand; PAM type: NRG; PAM sequence: TGG
cccgctccgccctccagcgc

SEQ ID NO: 9205 - DNA, 20 bp, Artificial Sequence
  Description of Artificial Sequence: Synthetic oligonucleotide
  Target: FXN; (-) strand; PAM type: NRG; PAM sequence: CAG
ctgccgcccgctccgccctc

SEQ ID NO: 9206 - DNA, 20 bp, Artificial Sequence
  Description of Artificial Sequence: Synthetic oligonucleotide
  Target: FXN; (-) strand; PAM type: NRG; PAM sequence: GGG
gagagtccacatgctgctcc

SEQ ID NO: 9207 - DNA, 20 bp, Artificial Sequence
  Description of Artificial Sequence: Synthetic oligonucleotide
  Target: FXN; (-) strand; PAM type: NRG; PAM sequence: CGG
cgagagtccacatgctgctc

SEQ ID NO: 9208 - DNA, 20 bp, Artificial Sequence
  Description of Artificial Sequence: Synthetic oligonucleotide
  Target: FXN; (-) strand; PAM type: NRG; PAM sequence: GAG
ggctactgcgcggcgcccga

SEQ ID NO: 9209 - DNA, 20 bp, Artificial Sequence
  Description of Artificial Sequence: Synthetic oligonucleotide
  Target: FXN; (-) strand; PAM type: NRG; PAM sequence: GAG
ccggctactgcgcggcgccc

SEQ ID NO: 9210 - DNA, 20 bp, Artificial Sequence
  Description of Artificial Sequence: Synthetic oligonucleotide
  Target: FXN; (-) strand; PAM type: NRG; PAM sequence: CGG
ccaggaggccggctactgcg

SEQ ID NO: 9211 - DNA, 20 bp, Artificial Sequence
  Description of Artificial Sequence: Synthetic oligonucleotide
  Target: FXN; (-) strand; PAM type: NRG; PAM sequence: CGG
gctgggtgacgccaggaggc

SEQ ID NO: 9212 - DNA, 20 bp, Artificial Sequence
  Description of Artificial Sequence: Synthetic oligonucleotide
  Target: FXN; (-) strand; PAM type: NRG; PAM sequence: AGG
ctgggctgggtgacgccagg

SEQ ID NO: 9213 - DNA, 20 bp, Artificial Sequence
  Description of Artificial Sequence: Synthetic oligonucleotide
  Target: FXN; (-) strand; PAM type: NRG; PAM sequence: GAG
gctgggctgggtgacgccag

SEQ ID NO: 9214 - DNA, 20 bp, Artificial Sequence
  Description of Artificial Sequence: Synthetic oligonucleotide
  Target: FXN; (-) strand; PAM type: NRG; PAM sequence: AGG
gggctgggctgggtgacgcc

SEQ ID NO: 9215 - DNA, 20 bp, Artificial Sequence
  Description of Artificial Sequence: Synthetic oligonucleotide
  Target: FXN; (-) strand; PAM type: NRG; PAM sequence: CAG
tgggctgggctgggtgacgc

SEQ ID NO: 9216 - DNA, 20 bp, Artificial Sequence
  Description of Artificial Sequence: Synthetic oligonucleotide
  Target: FXN; (-) strand; PAM type: NRG; PAM sequence: GGG
gtctgggcctgggctgggct

SEQ ID NO: 9217 - DNA, 20 bp, Artificial Sequence
  Description of Artificial Sequence: Synthetic oligonucleotide
  Target: FXN; (-) strand; PAM type: NRG; PAM sequence: TGG
ggtctgggcctgggctgggc

SEQ ID NO: 9218 - DNA, 20 bp, Artificial Sequence
  Description of Artificial Sequence: Synthetic oligonucleotide
  Target: FXN; (-) strand; PAM type: NRG; PAM sequence: GGG
tgagggtctgggcctgggct

SEQ ID NO: 9219 - DNA, 20 bp, Artificial Sequence
  Description of Artificial Sequence: Synthetic oligonucleotide
  Target: FXN; (-) strand; PAM type: NRG; PAM sequence: TGG
gtgagggtctgggcctgggc

SEQ ID NO: 9220 - DNA, 20 bp, Artificial Sequence
  Description of Artificial Sequence: Synthetic oligonucleotide
  Target: FXN; (-) strand; PAM type: NRG; PAM sequence: GGG
ccgggtgagggtctgggcct

SEQ ID NO: 9221 - DNA, 20 bp, Artificial Sequence
  Description of Artificial Sequence: Synthetic oligonucleotide
  Target: FXN; (-) strand; PAM type: NRG; PAM sequence: TGG
cccgggtgagggtctgggcc

SEQ ID NO: 9222 - DNA, 20 bp, Artificial Sequence
  Description of Artificial Sequence: Synthetic oligonucleotide
  Target: FXN; (-) strand; PAM type: NRG; PAM sequence: GGG
cgggacccgggtgagggtct

SEQ ID NO: 9223 - DNA, 20 bp, Artificial Sequence
  Description of Artificial Sequence: Synthetic oligonucleotide
  Target: FXN; (-) strand; PAM type: NRG; PAM sequence: TGG
gcgggacccgggtgagggtc

SEQ ID NO: 9224 - DNA, 20 bp, Artificial Sequence
  Description of Artificial Sequence: Synthetic oligonucleotide
  Target: FXN; (-) strand; PAM type: NRG; PAM sequence: GGG
cggccgcgggacccgggtga

SEQ ID NO: 9225 - DNA, 20 bp, Artificial Sequence
  Description of Artificial Sequence: Synthetic oligonucleotide
  Target: FXN; (-) strand; PAM type: NRG; PAM sequence: AGG
ccggccgcgggacccgggtg

SEQ ID NO: 9226 - DNA, 20 bp, Artificial Sequence
  Description of Artificial Sequence: Synthetic oligonucleotide
  Target: FXN; (-) strand; PAM type: NRG; PAM sequence: GAG
gccggccgcgggacccgggt

SEQ ID NO: 9227 - DNA, 20 bp, Artificial Sequence
  Description of Artificial Sequence: Synthetic oligonucleotide
  Target: FXN; (-) strand; PAM type: NRG; PAM sequence: GGG
ctctgccggccgcgggaccc

SEQ ID NO: 9228 - DNA, 20 bp, Artificial Sequence
  Description of Artificial Sequence: Synthetic oligonucleotide
  Target: FXN; (-) strand; PAM type: NRG; PAM sequence: CGG
actctgccggccgcgggacc

SEQ ID NO: 9229 - DNA, 20 bp, Artificial Sequence
  Description of Artificial Sequence: Synthetic oligonucleotide
  Target: FXN; (-) strand; PAM type: NRG; PAM sequence: GGG
gggccaactctgccggccgc

SEQ ID NO: 9230 - DNA, 20 bp, Artificial Sequence
  Description of Artificial Sequence: Synthetic oligonucleotide
  Target: FXN; (-) strand; PAM type: NRG; PAM sequence: CGG
ggggccaactctgccggccg

SEQ ID NO: 9231 - DNA, 20 bp, Artificial Sequence
  Description of Artificial Sequence: Synthetic oligonucleotide
  Target: FXN; (-) strand; PAM type: NRG; PAM sequence: CGG
cagagtggggccaactctgc

SEQ ID NO: 9232 - DNA, 20 bp, Artificial Sequence
  Description of Artificial Sequence: Synthetic oligonucleotide
  Target: FXN; (-) strand; PAM type: NRG; PAM sequence: GGG
gccacggcggccgcagagtg

SEQ ID NO: 9233 - DNA, 20 bp, Artificial Sequence
  Description of Artificial Sequence: Synthetic oligonucleotide
  Target: FXN; (-) strand; PAM type: NRG; PAM sequence: GGG
ggccacggcggccgcagagt

SEQ ID NO: 9234 - DNA, 20 bp, Artificial Sequence
  Description of Artificial Sequence: Synthetic oligonucleotide
  Target: FXN; (-) strand; PAM type: NRG; PAM sequence: TGG
aggccacggcggccgcagag

SEQ ID NO: 9235 - DNA, 20 bp, Artificial Sequence
  Description of Artificial Sequence: Synthetic oligonucleotide
  Target: FXN; (-) strand; PAM type: NRG; PAM sequence: GAG
cgcaggccacggcggccgca

SEQ ID NO: 9236 - DNA, 20 bp, Artificial Sequence
  Description of Artificial Sequence: Synthetic oligonucleotide
  Target: FXN; (-) strand; PAM type: NRG; PAM sequence: CAG
tgcgcaggccacggcggccg

SEQ ID NO: 9237 - DNA, 20 bp, Artificial Sequence
  Description of Artificial Sequence: Synthetic oligonucleotide
  Target: FXN; (-) strand; PAM type: NRG; PAM sequence: CGG
tgtcggtgcgcaggccacgg

SEQ ID NO: 9238 - DNA, 20 bp, Artificial Sequence
  Description of Artificial Sequence: Synthetic oligonucleotide
  Target: FXN; (-) strand; PAM type: NRG; PAM sequence: CGG
cgatgtcggtgcgcaggcca

SEQ ID NO: 9239 - DNA, 20 bp, Artificial Sequence
  Description of Artificial Sequence: Synthetic oligonucleotide
  Target: FXN; (-) strand; PAM type: NRG; PAM sequence: AGG
tcgcatcgatgtcggtgcgc

SEQ ID NO: 9240 - DNA, 20 bp, Artificial Sequence
  Description of Artificial Sequence: Synthetic oligonucleotide
  Target: FXN; (-) strand; PAM type: NRG; PAM sequence: CAG
gtcgcatcgatgtcggtgcg

SEQ ID NO: 9241 - DNA, 20 bp, Artificial Sequence
  Description of Artificial Sequence: Synthetic oligonucleotide
  Target: FXN; (-) strand; PAM type: NRG; PAM sequence: CGG
cgtgcaggtcgcatcgatgt

SEQ ID NO: 9242 - DNA, 20 bp, Artificial Sequence
  Description of Artificial Sequence: Synthetic oligonucleotide
  Target: FXN; (-) strand; PAM type: NRG; PAM sequence: AGG
tactgcgcggcggggcgtgc

SEQ ID NO: 9243 - DNA, 20 bp, Artificial Sequence
  Description of Artificial Sequence: Synthetic oligonucleotide
  Target: FXN; (-) strand; PAM type: NRG; PAM sequence: CAG
ttactgcgcggcggggcgtg

SEQ ID NO: 9244 - DNA, 20 bp, Artificial Sequence
  Description of Artificial Sequence: Synthetic oligonucleotide
  Target: FXN; (-) strand; PAM type: NRG; PAM sequence: GGG
cggatacttactgcgcggcg

SEQ ID NO: 9245 - DNA, 20 bp, Artificial Sequence
  Description of Artificial Sequence: Synthetic oligonucleotide
  Target: FXN; (-) strand; PAM type: NRG; PAM sequence: GGG
gcggatacttactgcgcggc

SEQ ID NO: 9246 - DNA, 20 bp, Artificial Sequence
  Description of Artificial Sequence: Synthetic oligonucleotide
  Target: FXN; (-) strand; PAM type: NRG; PAM sequence: CGG
cgcggatacttactgcgcgg

SEQ ID NO: 9247 - DNA, 20 bp, Artificial Sequence
  Description of Artificial Sequence: Synthetic oligonucleotide
  Target: FXN; (-) strand; PAM type: NRG; PAM sequence: CGG
cggcgcggatacttactgcg

SEQ ID NO: 9248 - DNA, 20 bp, Artificial Sequence
  Description of Artificial Sequence: Synthetic oligonucleotide
  Target: FXN; (-) strand; PAM type: NRG; PAM sequence: CGG
gcccgcggctgttcccggcg

SEQ ID NO: 9249 - DNA, 20 bp, Artificial Sequence
  Description of Artificial Sequence: Synthetic oligonucleotide
  Target: FXN; (-) strand; PAM type: NRG; PAM sequence: CGG
gtgcggcccgcggctgttcc

SEQ ID NO: 9250 - DNA, 20 bp, Artificial Sequence
  Description of Artificial Sequence: Synthetic oligonucleotide
  Target: FXN; (-) strand; PAM type: NRG; PAM sequence: CGG
ggcccgcggcgtgcggcccg

SEQ ID NO: 9251 - DNA, 20 bp, Artificial Sequence
  Description of Artificial Sequence: Synthetic oligonucleotide
  Target: FXN; (-) strand; PAM type: NRG; PAM sequence: CGG
ggcgtgcggcccgcggcgtg

SEQ ID NO: 9252 - DNA, 20 bp, Artificial Sequence
  Description of Artificial Sequence: Synthetic oligonucleotide
  Target: FXN; (-) strand; PAM type: NRG; PAM sequence: CGG
ggcgtgcggcgtgcggcccg

SEQ ID NO: 9253 - DNA, 20 bp, Artificial Sequence
  Description of Artificial Sequence: Synthetic oligonucleotide
  Target: FXN; (-) strand; PAM type: NRG; PAM sequence: CGG
ctgcgcaggcgtgcggcgtg

SEQ ID NO: 9254 - DNA, 20 bp, Artificial Sequence
  Description of Artificial Sequence: Synthetic oligonucleotide
  Target: FXN; (-) strand; PAM type: NRG; PAM sequence: CGG
cgcctccctgcgcaggcgtg

SEQ ID NO: 9255 - DNA, 20 bp, Artificial Sequence
  Description of Artificial Sequence: Synthetic oligonucleotide
  Target: FXN; (-) strand; PAM type: NRG; PAM sequence: AGG
tgcgcggcgcctccctgcgc

SEQ ID NO: 9256 - DNA, 20 bp, Artificial Sequence
  Description of Artificial Sequence: Synthetic oligonucleotide
  Target: FXN; (-) strand; PAM type: NRG; PAM sequence: CAG
gtgcgcggcgcctccctgcg

SEQ ID NO: 9257 - DNA, 20 bp, Artificial Sequence
  Description of Artificial Sequence: Synthetic oligonucleotide
  Target: FXN; (-) strand; PAM type: NRG; PAM sequence: CGG
cggagcgaccccggcgtgcg

SEQ ID NO: 9258 - DNA, 20 bp, Artificial Sequence
  Description of Artificial Sequence: Synthetic oligonucleotide
  Target: FXN; (-) strand; PAM type: NRG; PAM sequence: CGG
gcgcgtacccggagcgaccc

SEQ ID NO: 9259 - DNA, 20 bp, Artificial Sequence
  Description of Artificial Sequence: Synthetic oligonucleotide
  Target: FXN; (-) strand; PAM type: NRG; PAM sequence: GAG
tagtccagcgcgcgtacccg

SEQ ID NO: 9260 - DNA, 20 bp, Artificial Sequence
  Description of Artificial Sequence: Synthetic oligonucleotide
  Target: FXN; (-) strand; PAM type: NRG; PAM sequence: CGG
gctagtccagcgcgcgtacc

SEQ ID NO: 9261 - DNA, 20 bp, Artificial Sequence
  Description of Artificial Sequence: Synthetic oligonucleotide
  Target: FXN; (-) strand; PAM type: NRG; PAM sequence: CAG
aggagcggggtgagctagtc

SEQ ID NO: 9262 - DNA, 20 bp, Artificial Sequence
  Description of Artificial Sequence: Synthetic oligonucleotide
  Target: FXN; (-) strand; PAM type: NRG; PAM sequence: TAG
tgagaaggagcggggtgagc

SEQ ID NO: 9263 - DNA, 20 bp, Artificial Sequence
  Description of Artificial Sequence: Synthetic oligonucleotide
  Target: FXN; (-) strand; PAM type: NRG; PAM sequence: GAG
gccctgagaaggagcggggt

SEQ ID NO: 9264 - DNA, 20 bp, Artificial Sequence
  Description of Artificial Sequence: Synthetic oligonucleotide
  Target: FXN; (-) strand; PAM type: NRG; PAM sequence: GGG
ggccgccctgagaaggagcg

SEQ ID NO: 9265 - DNA, 20 bp, Artificial Sequence
  Description of Artificial Sequence: Synthetic oligonucleotide
  Target: FXN; (-) strand; PAM type: NRG; PAM sequence: GGG
gggccgccctgagaaggagc

SEQ ID NO: 9266 - DNA, 20 bp, Artificial Sequence
  Description of Artificial Sequence: Synthetic oligonucleotide
  Target: FXN; (-) strand; PAM type: NRG; PAM sequence: CGG
cgggccgccctgagaaggag

SEQ ID NO: 9267 - DNA, 20 bp, Artificial Sequence
  Description of Artificial Sequence: Synthetic oligonucleotide
  Target: FXN; (-) strand; PAM type: NRG; PAM sequence: GAG
cgccgggccgccctgagaag

SEQ ID NO: 9268 - DNA, 20 bp, Artificial Sequence
  Description of Artificial Sequence: Synthetic oligonucleotide
  Target: FXN; (-) strand; PAM type: NRG; PAM sequence: AGG
tccgccgggccgccctgaga

SEQ ID NO: 9269 - DNA, 20 bp, Artificial Sequence
  Description of Artificial Sequence: Synthetic oligonucleotide
  Target: FXN; (-) strand; PAM type: NRG; PAM sequence: AAG
ttccgccgggccgccctgag

SEQ ID NO: 9270 - DNA, 20 bp, Artificial Sequence
  Description of Artificial Sequence: Synthetic oligonucleotide
  Target: FXN; (-) strand; PAM type: NRG; PAM sequence: GAG
cgcttccgccgggccgccct

SEQ ID NO: 9271 - DNA, 20 bp, Artificial Sequence
  Description of Artificial Sequence: Synthetic oligonucleotide
  Target: FXN; (-) strand; PAM type: NRG; PAM sequence: GGG
gttgcaaggccgcttccgcc

SEQ ID NO: 9272 - DNA, 20 bp, Artificial Sequence
  Description of Artificial Sequence: Synthetic oligonucleotide
  Target: FXN; (-) strand; PAM type: NRG; PAM sequence: CGG
agttgcaaggccgcttccgc

SEQ ID NO: 9273 - DNA, 20 bp, Artificial Sequence
  Description of Artificial Sequence: Synthetic oligonucleotide
  Target: FXN; (-) strand; PAM type: NRG; PAM sequence: AGG
aaccagagaagggagttgca

SEQ ID NO: 9274 - DNA, 20 bp, Artificial Sequence
  Description of Artificial Sequence: Synthetic oligonucleotide
  Target: FXN; (-) strand; PAM type: NRG; PAM sequence: AAG
gaaccagagaagggagttgc

SEQ ID NO: 9275 - DNA, 20 bp, Artificial Sequence
  Description of Artificial Sequence: Synthetic oligonucleotide
  Target: FXN; (-) strand; PAM type: NRG; PAM sequence: GAG
accgggagaaccagagaagg

SEQ ID NO: 9276 - DNA, 20 bp, Artificial Sequence
  Description of Artificial Sequence: Synthetic oligonucleotide
  Target: FXN; (-) strand; PAM type: NRG; PAM sequence: GGG
caaccgggagaaccagagaa

SEQ ID NO: 9277 - DNA, 20 bp, Artificial Sequence
  Description of Artificial Sequence: Synthetic oligonucleotide
  Target: FXN; (-) strand; PAM type: NRG; PAM sequence: AGG
gcaaccgggagaaccagaga

SEQ ID NO: 9278 - DNA, 20 bp, Artificial Sequence
  Description of Artificial Sequence: Synthetic oligonucleotide
  Target: FXN; (-) strand; PAM type: NRG; PAM sequence: AAG
tgcaaccgggagaaccagag

SEQ ID NO: 9279 - DNA, 20 bp, Artificial Sequence
  Description of Artificial Sequence: Synthetic oligonucleotide
  Target: FXN; (-) strand; PAM type: NRG; PAM sequence: GAG
aaatgcaaccgggagaacca

SEQ ID NO: 9280 - DNA, 20 bp, Artificial Sequence
  Description of Artificial Sequence: Synthetic oligonucleotide
  Target: FXN; (-) strand; PAM type: NRG; PAM sequence: CAG
gtaaatgcaaccgggagaac

SEQ ID NO: 9281 - DNA, 20 bp, Artificial Sequence
  Description of Artificial Sequence: Synthetic oligonucleotide
  Target: FXN; (-) strand; PAM type: NRG; PAM sequence: GAG
gccagtgtaaatgcaaccgg

SEQ ID NO: 9282 - DNA, 20 bp, Artificial Sequence
  Description of Artificial Sequence: Synthetic oligonucleotide
  Target: FXN; (-) strand; PAM type: NRG; PAM sequence: GGG
aagccagtgtaaatgcaacc

SEQ ID NO: 9283 - DNA, 20 bp, Artificial Sequence
  Description of Artificial Sequence: Synthetic oligonucleotide
  Target: FXN; (-) strand; PAM type: NRG; PAM sequence: CGG
gaagccagtgtaaatgcaac

SEQ ID NO: 9284 - DNA, 20 bp, Artificial Sequence
  Description of Artificial Sequence: Synthetic oligonucleotide
  Target: FXN; (-) strand; PAM type: NRG; PAM sequence: CAG
ttccttcggaaagcagaagc

SEQ ID NO: 9285 - DNA, 20 bp, Artificial Sequence
  Description of Artificial Sequence: Synthetic oligonucleotide
  Target: FXN; (-) strand; PAM type: NRG; PAM sequence: AAG
ccttttccttcggaaagcag

SEQ ID NO: 9286 - DNA, 20 bp, Artificial Sequence
  Description of Artificial Sequence: Synthetic oligonucleotide
  Target: FXN; (-) strand; PAM type: NRG; PAM sequence: CAG
tccccttttccttcggaaag

SEQ ID NO: 9287 - DNA, 20 bp, Artificial Sequence
  Description of Artificial Sequence: Synthetic oligonucleotide
  Target: FXN; (-) strand; PAM type: NRG; PAM sequence: AAG
atgtccccttttccttcgga

SEQ ID NO: 9288 - DNA, 20 bp, Artificial Sequence
  Description of Artificial Sequence: Synthetic oligonucleotide
  Target: FXN; (-) strand; PAM type: NRG; PAM sequence: CGG
caaaatgtccccttttcctt

SEQ ID NO: 9289 - DNA, 20 bp, Artificial Sequence
  Description of Artificial Sequence: Synthetic oligonucleotide
  Target: FXN; (-) strand; PAM type: NRG; PAM sequence: AGG
ttgacccgcagtcgcaccgc

SEQ ID NO: 9290 - DNA, 20 bp, Artificial Sequence
  Description of Artificial Sequence: Synthetic oligonucleotide
  Target: FXN; (-) strand; PAM type: NRG; PAM sequence: CAG
cttgacccgcagtcgcaccg

SEQ ID NO: 9291 - DNA, 20 bp, Artificial Sequence
  Description of Artificial Sequence: Synthetic oligonucleotide
  Target: FXN; (-) strand; PAM type: NRG; PAM sequence: CAG
ttcgcccgtgccttgacccg

SEQ ID NO: 9292 - DNA, 20 bp, Artificial Sequence
  Description of Artificial Sequence: Synthetic oligonucleotide
  Target: FXN; (-) strand; PAM type: NRG; PAM sequence: CAG
tcggaaccggtcccctccac

SEQ ID NO: 9293 - DNA, 20 bp, Artificial Sequence
  Description of Artificial Sequence: Synthetic oligonucleotide
  Target: FXN; (-) strand; PAM type: NRG; PAM sequence: CGG
agccgcacacccctcggaac

SEQ ID NO: 9294 - DNA, 20 bp, Artificial Sequence
  Description of Artificial Sequence: Synthetic oligonucleotide
  Target: FXN; (-) strand; PAM type: NRG; PAM sequence: CGG
ggagacagccgcacacccct

SEQ ID NO: 9295 - DNA, 20 bp, Artificial Sequence
  Description of Artificial Sequence: Synthetic oligonucleotide
  Target: FXN; (-) strand; PAM type: NRG; PAM sequence: CAG
agaagtgacaagcatggaga

SEQ ID NO: 9296 - DNA, 20 bp, Artificial Sequence
  Description of Artificial Sequence: Synthetic oligonucleotide
  Target: FXN; (-) strand; PAM type: NRG; PAM sequence: GAG
gcagagaagtgacaagcatg

SEQ ID NO: 9297 - DNA, 20 bp, Artificial Sequence
  Description of Artificial Sequence: Synthetic oligonucleotide
  Target: FXN; (-) strand; PAM type: NRG; PAM sequence: TGG
tcgcagagaagtgacaagca

SEQ ID NO: 9298 - DNA, 20 bp, Artificial Sequence
  Description of Artificial Sequence: Synthetic oligonucleotide
  Target: FXN; (-) strand; PAM type: NRG; PAM sequence: AAG
agttatcgcagagaagtgac

SEQ ID NO: 9299 - DNA, 20 bp, Artificial Sequence
  Description of Artificial Sequence: Synthetic oligonucleotide
  Target: FXN; (-) strand; PAM type: NRG; PAM sequence: AAG
tgaaacaagttatcgcagag

SEQ ID NO: 9300 - DNA, 20 bp, Artificial Sequence
  Description of Artificial Sequence: Synthetic oligonucleotide
  Target: FXN; (-) strand; PAM type: NRG; PAM sequence: GAG
tactgaaacaagttatcgca

SEQ ID NO: 9301 - DNA, 20 bp, Artificial Sequence
  Description of Artificial Sequence: Synthetic oligonucleotide
  Target: FXN; (-) strand; PAM type: NRG; PAM sequence: CAG
attactgaaacaagttatcg

SEQ ID NO: 9302 - DNA, 20 bp, Artificial Sequence
  Description of Artificial Sequence: Synthetic oligonucleotide
  Target: FXN; (-) strand; PAM type: NRG; PAM sequence: AAG
tctattaatattactgaaac

SEQ ID NO: 9303 - DNA, 20 bp, Artificial Sequence
  Description of Artificial Sequence: Synthetic oligonucleotide
  Target: FXN; (-) strand; PAM type: NRG; PAM sequence: CAG
tatgtgtatgtatatactag

SEQ ID NO: 9304 - DNA, 20 bp, Artificial Sequence
  Description of Artificial Sequence: Synthetic oligonucleotide
  Target: FXN; (-) strand; PAM type: NRG; PAM sequence: TAG
cattatgtgtatgtatatac

SEQ ID NO: 9305 - DNA, 20 bp, Artificial Sequence
  Description of Artificial Sequence: Synthetic oligonucleotide
  Target: FXN; (-) strand; PAM type: NRG; PAM sequence: CAG
acgctatatacagatacaca

SEQ ID NO: 9306 - DNA, 20 bp, Artificial Sequence
  Description of Artificial Sequence: Synthetic oligonucleotide
  Target: FXN; (-) strand; PAM type: NRG; PAM sequence: CAG
cacaacacacacgctatata

SEQ ID NO: 9307 - DNA, 20 bp, Artificial Sequence
  Description of Artificial Sequence: Synthetic oligonucleotide
  Target: FXN; (-) strand; PAM type: NRG; PAM sequence: AGG
aatccagccttgaaaatatt

SEQ ID NO: 9308 - DNA, 20 bp, Artificial Sequence
  Description of Artificial Sequence: Synthetic oligonucleotide
  Target: FXN; (-) strand; PAM type: NRG; PAM sequence: TAG
aaatccagccttgaaaatat

SEQ ID NO: 9309 - DNA, 20 bp, Artificial Sequence
  Description of Artificial Sequence: Synthetic oligonucleotide
  Target: FXN; (-) strand; PAM type: NRG; PAM sequence: CAG
gcatttcgttcaaaaaaatc

SEQ ID NO: 9310 - DNA, 20 bp, Artificial Sequence
  Description of Artificial Sequence: Synthetic oligonucleotide
  Target: FXN; (-) strand; PAM type: NRG; PAM sequence: AAG
agtttcacctcgttccagga

SEQ ID NO: 9311 - DNA, 20 bp, Artificial Sequence
  Description of Artificial Sequence: Synthetic oligonucleotide
  Target: FXN; (-) strand; PAM type: NRG; PAM sequence: AGG
tgaaagtttcacctcgttcc

SEQ ID NO: 9312 - DNA, 20 bp, Artificial Sequence
  Description of Artificial Sequence: Synthetic oligonucleotide
  Target: FXN; (-) strand; PAM type: NRG; PAM sequence: CAG
ctgaaagtttcacctcgttc

SEQ ID NO: 9313 - DNA, 20 bp, Artificial Sequence
  Description of Artificial Sequence: Synthetic oligonucleotide
  Target: FXN; (-) strand; PAM type: NRG; PAM sequence: AAG
tagctattctgcagctctga

SEQ ID NO: 9314 - DNA, 20 bp, Artificial Sequence
  Description of Artificial Sequence: Synthetic oligonucleotide
  Target: FXN; (-) strand; PAM type: NRG; PAM sequence: CAG
ctgctgctctagctattctg

SEQ ID NO: 9315 - DNA, 20 bp, Artificial Sequence
  Description of Artificial Sequence: Synthetic oligonucleotide
  Target: FXN; (-) strand; PAM type: NRG; PAM sequence: TAG
agccagggcccctgctgctc

SEQ ID NO: 9316 - DNA, 20 bp, Artificial Sequence
  Description of Artificial Sequence: Synthetic oligonucleotide
  Target: FXN; (-) strand; PAM type: NRG; PAM sequence: GGG
gggtcagtttccaaaagcca

SEQ ID NO: 9317 - DNA, 20 bp, Artificial Sequence
  Description of Artificial Sequence: Synthetic oligonucleotide
  Target: FXN; (-) strand; PAM type: NRG; PAM sequence: AGG
cgggtcagtttccaaaagcc

SEQ ID NO: 9318 - DNA, 20 bp, Artificial Sequence
  Description of Artificial Sequence: Synthetic oligonucleotide
  Target: FXN; (-) strand; PAM type: NRG; PAM sequence: CAG
tcgggtcagtttccaaaagc

SEQ ID NO: 9319 - DNA, 20 bp, Artificial Sequence
  Description of Artificial Sequence: Synthetic oligonucleotide
  Target: FXN; (-) strand; PAM type: NRG; PAM sequence: AAG
aaggtcgggtcagtttccaa

SEQ ID NO: 9320 - DNA, 20 bp, Artificial Sequence
  Description of Artificial Sequence: Synthetic oligonucleotide
  Target: FXN; (-) strand; PAM type: NRG; PAM sequence: CAG
atctggaataaaggtcgggt

SEQ ID NO: 9321 - DNA, 20 bp, Artificial Sequence
  Description of Artificial Sequence: Synthetic oligonucleotide
  Target: FXN; (-) strand; PAM type: NRG; PAM sequence: GGG
cagaatctggaataaaggtc

SEQ ID NO: 9322 - DNA, 20 bp, Artificial Sequence
  Description of Artificial Sequence: Synthetic oligonucleotide
  Target: FXN; (-) strand; PAM type: NRG; PAM sequence: CGG
gcagaatctggaataaaggt

SEQ ID NO: 9323 - DNA, 20 bp, Artificial Sequence
  Description of Artificial Sequence: Synthetic oligonucleotide
  Target: FXN; (-) strand; PAM type: NRG; PAM sequence: AGG
tggggcagaatctggaataa

SEQ ID NO: 9324 - DNA, 20 bp, Artificial Sequence
  Description of Artificial Sequence: Synthetic oligonucleotide
  Target: FXN; (-) strand; PAM type: NRG; PAM sequence: AAG
gtggggcagaatctggaata

SEQ ID NO: 9325 - DNA, 20 bp, Artificial Sequence
  Description of Artificial Sequence: Synthetic oligonucleotide
  Target: FXN; (-) strand; PAM type: NRG; PAM sequence: TGG
ctgcggagtggggcagaatc

SEQ ID NO: 9326 - DNA, 20 bp, Artificial Sequence
  Description of Artificial Sequence: Synthetic oligonucleotide
  Target: FXN; (-) strand; PAM type: NRG; PAM sequence: CAG
cacagctctgcggagtgggg

SEQ ID NO: 9327 - DNA, 20 bp, Artificial Sequence
  Description of Artificial Sequence: Synthetic oligonucleotide
  Target: FXN; (-) strand; PAM type: NRG; PAM sequence: GGG
tcacacagctctgcggagtg

SEQ ID NO: 9328 - DNA, 20 bp, Artificial Sequence
  Description of Artificial Sequence: Synthetic oligonucleotide
  Target: FXN; (-) strand; PAM type: NRG; PAM sequence: GGG
gtcacacagctctgcggagt

SEQ ID NO: 9329 - DNA, 20 bp, Artificial Sequence
  Description of Artificial Sequence: Synthetic oligonucleotide
  Target: FXN; (-) strand; PAM type: NRG; PAM sequence: TGG
ggtcacacagctctgcggag

SEQ ID NO: 9330 - DNA, 20 bp, Artificial Sequence
  Description of Artificial Sequence: Synthetic oligonucleotide
  Target: FXN; (-) strand; PAM type: NRG; PAM sequence: GAG
caaggtcacacagctctgcg

SEQ ID NO: 9331 - DNA, 20 bp, Artificial Sequence
  Description of Artificial Sequence: Synthetic oligonucleotide
  Target: FXN; (-) strand; PAM type: NRG; PAM sequence: CGG
cccaaggtcacacagctctg

SEQ ID NO: 9332 - DNA, 20 bp, Artificial Sequence
  Description of Artificial Sequence: Synthetic oligonucleotide
  Target: FXN; (-) strand; PAM type: NRG; PAM sequence: CAG
gggaatcccccaaggtcaca

SEQ ID NO: 9333 - DNA, 20 bp, Artificial Sequence
  Description of Artificial Sequence: Synthetic oligonucleotide
  Target: FXN; (-) strand; PAM type: NRG; PAM sequence: AGG
gaggttaggggaatccccca

SEQ ID NO: 9334 - DNA, 20 bp, Artificial Sequence
  Description of Artificial Sequence: Synthetic oligonucleotide
  Target: FXN; (-) strand; PAM type: NRG; PAM sequence: AAG
agaggttaggggaatccccc

SEQ ID NO: 9335 - DNA, 20 bp, Artificial Sequence
  Description of Artificial Sequence: Synthetic oligonucleotide
  Target: FXN; (-) strand; PAM type: NRG; PAM sequence: GGG
ccacgtctcagagaggttag

SEQ ID NO: 9336 - DNA, 20 bp, Artificial Sequence
  Description of Artificial Sequence: Synthetic oligonucleotide
  Target: FXN; (-) strand; PAM type: NRG; PAM sequence: GGG
gccacgtctcagagaggtta

SEQ ID NO: 9337 - DNA, 20 bp, Artificial Sequence
  Description of Artificial Sequence: Synthetic oligonucleotide
  Target: FXN; (-) strand; PAM type: NRG; PAM sequence: AGG
agccacgtctcagagaggtt

SEQ ID NO: 9338 - DNA, 20 bp, Artificial Sequence
  Description of Artificial Sequence: Synthetic oligonucleotide
  Target: FXN; (-) strand; PAM type: NRG; PAM sequence: TAG
aagccacgtctcagagaggt

SEQ ID NO: 9339 - DNA, 20 bp, Artificial Sequence
  Description of Artificial Sequence: Synthetic oligonucleotide
  Target: FXN; (-) strand; PAM type: NRG; PAM sequence: AGG
aacaaagccacgtctcagag

SEQ ID NO: 9340 - DNA, 20 bp, Artificial Sequence
  Description of Artificial Sequence: Synthetic oligonucleotide
  Target: FXN; (-) strand; PAM type: NRG; PAM sequence: GAG
aaacaaagccacgtctcaga

SEQ ID NO: 9341 - DNA, 20 bp, Artificial Sequence
  Description of Artificial Sequence: Synthetic oligonucleotide
  Target: FXN; (-) strand; PAM type: NRG; PAM sequence: GAG
gaaaacaaagccacgtctca

SEQ ID NO: 9342 - DNA, 20 bp, Artificial Sequence
  Description of Artificial Sequence: Synthetic oligonucleotide
  Target: FXN; (-) strand; PAM type: NRG; PAM sequence: CAG
cagaaaacaaagccacgtct

SEQ ID NO: 9343 - DNA, 20 bp, Artificial Sequence
  Description of Artificial Sequence: Synthetic oligonucleotide
  Target: FXN; (-) strand; PAM type: NRG; PAM sequence: AAG
tcttctccctacagaaaaca

SEQ ID NO: 9344 - DNA, 20 bp, Artificial Sequence
  Description of Artificial Sequence: Synthetic oligonucleotide
  Target: FXN; (-) strand; PAM type: NRG; PAM sequence: CAG
tcacctttatcttctcccta

SEQ ID NO: 9345 - DNA, 20 bp, Artificial Sequence
  Description of Artificial Sequence: Synthetic oligonucleotide
  Target: FXN; (-) strand; PAM type: NRG; PAM sequence: GGG
tcacaccaggtccgcaaaat

SEQ ID NO: 9346 - DNA, 20 bp, Artificial Sequence
  Description of Artificial Sequence: Synthetic oligonucleotide
  Target: FXN; (-) strand; PAM type: NRG; PAM sequence: TGG
ctcacaccaggtccgcaaaa

SEQ ID NO: 9347 - DNA, 20 bp, Artificial Sequence
  Description of Artificial Sequence: Synthetic oligonucleotide
  Target: FXN; (-) strand; PAM type: NRG; PAM sequence: AGG
tcccatttaatcctcacacc

SEQ ID NO: 9348 - DNA, 20 bp, Artificial Sequence
  Description of Artificial Sequence: Synthetic oligonucleotide
  Target: FXN; (-) strand; PAM type: NRG; PAM sequence: CAG
ttcccatttaatcctcacac

SEQ ID NO: 9349 - DNA, 20 bp, Artificial Sequence
  Description of Artificial Sequence: Synthetic oligonucleotide
  Target: FXN; (-) strand; PAM type: NRG; PAM sequence: AAG
ggaactaatttgaagttctg

SEQ ID NO: 9350 - DNA, 20 bp, Artificial Sequence
  Description of Artificial Sequence: Synthetic oligonucleotide
  Target: FXN; (-) strand; PAM type: NRG; PAM sequence: AAG
aagaaaggggaactaatttg

SEQ ID NO: 9351 - DNA, 20 bp, Artificial Sequence
  Description of Artificial Sequence: Synthetic oligonucleotide
  Target: FXN; (-) strand; PAM type: NRG; PAM sequence: GGG
taccccccaaaggaagaaag

SEQ ID NO: 9352 - DNA, 20 bp, Artificial Sequence
  Description of Artificial Sequence: Synthetic oligonucleotide
  Target: FXN; (-) strand; PAM type: NRG; PAM sequence: GGG
gtaccccccaaaggaagaaa

SEQ ID NO: 9353 - DNA, 20 bp, Artificial Sequence
  Description of Artificial Sequence: Synthetic oligonucleotide
  Target: FXN; (-) strand; PAM type: NRG; PAM sequence: AGG
tgtaccccccaaaggaagaa

SEQ ID NO: 9354 - DNA, 20 bp, Artificial Sequence
  Description of Artificial Sequence: Synthetic oligonucleotide
  Target: FXN; (-) strand; PAM type: NRG; PAM sequence: AAG
ttgtaccccccaaaggaaga

SEQ ID NO: 9355 - DNA, 20 bp, Artificial Sequence
  Description of Artificial Sequence: Synthetic oligonucleotide
  Target: FXN; (-) strand; PAM type: NRG; PAM sequence: AAG
ttctttgtaccccccaaagg

SEQ ID NO: 9356 - DNA, 20 bp, Artificial Sequence
  Description of Artificial Sequence: Synthetic oligonucleotide
  Target: FXN; (-) strand; PAM type: NRG; PAM sequence: AGG
tatttctttgtaccccccaa

SEQ ID NO: 9357 - DNA, 20 bp, Artificial Sequence
  Description of Artificial Sequence: Synthetic oligonucleotide
  Target: FXN; (-) strand; PAM type: NRG; PAM sequence: AAG
atatttctttgtacccccca

SEQ ID NO: 9358 - DNA, 20 bp, Artificial Sequence
  Description of Artificial Sequence: Synthetic oligonucleotide
  Target: FXN; (-) strand; PAM type: NRG; PAM sequence: CAG
aagccgtggcgtaactgggt

SEQ ID NO: 9359 - DNA, 20 bp, Artificial Sequence
  Description of Artificial Sequence: Synthetic oligonucleotide
  Target: FXN; (-) strand; PAM type: NRG; PAM sequence: GGG
tttcaagccgtggcgtaact

SEQ ID NO: 9360 - DNA, 20 bp, Artificial Sequence
  Description of Artificial Sequence: Synthetic oligonucleotide
  Target: FXN; (-) strand; PAM type: NRG; PAM sequence: TGG
ctttcaagccgtggcgtaac

SEQ ID NO: 9361 - DNA, 20 bp, Artificial Sequence
  Description of Artificial Sequence: Synthetic oligonucleotide
  Target: FXN; (-) strand; PAM type: NRG; PAM sequence: TGG
ggtttcctcctttcaagccg

SEQ ID NO: 9362 - DNA, 20 bp, Artificial Sequence
  Description of Artificial Sequence: Synthetic oligonucleotide
  Target: FXN; (-) strand; PAM type: NRG; PAM sequence: AAG
tctttgggtttcctcctttc

SEQ ID NO: 9363 - DNA, 20 bp, Artificial Sequence
  Description of Artificial Sequence: Synthetic oligonucleotide
  Target: FXN; (-) strand; PAM type: NRG; PAM sequence: GGG
catccccacagccattcttt

SEQ ID NO: 9364 - DNA, 20 bp, Artificial Sequence
  Description of Artificial Sequence: Synthetic oligonucleotide
  Target: FXN; (-) strand; PAM type: NRG; PAM sequence: TGG
tcatccccacagccattctt

SEQ ID NO: 9365 - DNA, 20 bp, Artificial Sequence
  Description of Artificial Sequence: Synthetic oligonucleotide
  Target: FXN; (-) strand; PAM type: NRG; PAM sequence: CAG
aggaatcttcctcatcccca

SEQ ID NO: 9366 - DNA, 20 bp, Artificial Sequence
  Description of Artificial Sequence: Synthetic oligonucleotide
  Target: FXN; (-) strand; PAM type: NRG; PAM sequence: AGG
aataccatgtcctccccttg

SEQ ID NO: 9367 - DNA, 20 bp, Artificial Sequence
  Description of Artificial Sequence: Synthetic oligonucleotide
  Target: FXN; (-) strand; PAM type: NRG; PAM sequence: GAG
aaataccatgtcctcccctt

SEQ ID NO: 9368 - DNA, 20 bp, Artificial Sequence
  Description of Artificial Sequence: Synthetic oligonucleotide
  Target: FXN; (-) strand; PAM type: NRG; PAM sequence: AAG
accacttccttggcatcttc

SEQ ID NO: 9369 - DNA, 20 bp, Artificial Sequence
  Description of Artificial Sequence: Synthetic oligonucleotide
  Target: FXN; (-) strand; PAM type: NRG; PAM sequence: TGG
aacaccctctaccacttcct

SEQ ID NO: 9370 - DNA, 20 bp, Artificial Sequence
  Description of Artificial Sequence: Synthetic oligonucleotide
  Target: FXN; (-) strand; PAM type: NRG; PAM sequence: CGG
cttcctggcctttgcccaga

SEQ ID NO: 9371 - DNA, 20 bp, Artificial Sequence
  Description of Artificial Sequence: Synthetic oligonucleotide
  Target: FXN; (-) strand; PAM type: NRG; PAM sequence: CAG
ccgccttcctggcctttgcc

SEQ ID NO: 9372 - DNA, 20 bp, Artificial Sequence
  Description of Artificial Sequence: Synthetic oligonucleotide
  Target: FXN; (-) strand; PAM type: NRG; PAM sequence: TGG
gggatccccttccgccttcc

SEQ ID NO: 9373 - DNA, 20 bp, Artificial Sequence
  Description of Artificial Sequence: Synthetic oligonucleotide
  Target: FXN; (-) strand; PAM type: NRG; PAM sequence: GGG
ggcgtaccagccactctgaa

SEQ ID NO: 9374 - DNA, 20 bp, Artificial Sequence
  Description of Artificial Sequence: Synthetic oligonucleotide
  Target: FXN; (-) strand; PAM type: NRG; PAM sequence: AGG
cggcgtaccagccactctga

SEQ ID NO: 9375 - DNA, 20 bp, Artificial Sequence
  Description of Artificial Sequence: Synthetic oligonucleotide
  Target: FXN; (-) strand; PAM type: NRG; PAM sequence: AAG
gcggcgtaccagccactctg

SEQ ID NO: 9376 - DNA, 20 bp, Artificial Sequence
  Description of Artificial Sequence: Synthetic oligonucleotide
  Target: FXN; (-) strand; PAM type: NRG; PAM sequence: CAG
ccctaatacatgcggcgtac

SEQ ID NO: 9377 - DNA, 20 bp, Artificial Sequence
  Description of Artificial Sequence: Synthetic oligonucleotide
  Target: FXN; (-) strand; PAM type: NRG; PAM sequence: CGG
ttcatctcccctaatacatg

SEQ ID NO: 9378 - DNA, 20 bp, Artificial Sequence
  Description of Artificial Sequence: Synthetic oligonucleotide
  Target: FXN; (-) strand; PAM type: NRG; PAM sequence: TGG
acacaaatatggcttggacg

SEQ ID NO: 9379 - DNA, 20 bp, Artificial Sequence
  Description of Artificial Sequence: Synthetic oligonucleotide
  Target: FXN; (-) strand; PAM type: NRG; PAM sequence: TGG
agagcaacacaaatatggct

SEQ ID NO: 9380 - DNA, 20 bp, Artificial Sequence
  Description of Artificial Sequence: Synthetic oligonucleotide
  Target: FXN; (-) strand; PAM type: NRG; PAM sequence: TGG
tccggagagcaacacaaata

SEQ ID NO: 9381 - DNA, 20 bp, Artificial Sequence
  Description of Artificial Sequence: Synthetic oligonucleotide
  Target: FXN; (-) strand; PAM type: NRG; PAM sequence: GAG
cctaaagtacaaactccgga

SEQ ID NO: 9382 - DNA, 20 bp, Artificial Sequence
  Description of Artificial Sequence: Synthetic oligonucleotide
  Target: FXN; (-) strand; PAM type: NRG; PAM sequence: GAG
agcctaaagtacaaactccg

SEQ ID NO: 9383 - DNA, 20 bp, Artificial Sequence
  Description of Artificial Sequence: Synthetic oligonucleotide
  Target: FXN; (-) strand; PAM type: NRG; PAM sequence: CGG
caagcctaaagtacaaactc

SEQ ID NO: 9384 - DNA, 20 bp, Artificial Sequence
  Description of Artificial Sequence: Synthetic oligonucleotide
  Target: FXN; (-) strand; PAM type: NRG; PAM sequence: AAG
gtgtgggaagttcaagccta

SEQ ID NO: 9385 - DNA, 20 bp, Artificial Sequence
  Description of Artificial Sequence: Synthetic oligonucleotide
  Target: FXN; (-) strand; PAM type: NRG; PAM sequence: AAG
ataacacgtgtgggaagttc

SEQ ID NO: 9386 - DNA, 20 bp, Artificial Sequence
  Description of Artificial Sequence: Synthetic oligonucleotide
  Target: FXN; (-) strand; PAM type: NRG; PAM sequence: AAG
ggccaaataacacgtgtggg

SEQ ID NO: 9387 - DNA, 20 bp, Artificial Sequence
  Description of Artificial Sequence: Synthetic oligonucleotide
  Target: FXN; (-) strand; PAM type: NRG; PAM sequence: GGG
gtgggccaaataacacgtgt

SEQ ID NO: 9388 - DNA, 20 bp, Artificial Sequence
  Description of Artificial Sequence: Synthetic oligonucleotide
  Target: FXN; (-) strand; PAM type: NRG; PAM sequence: TGG
tgtgggccaaataacacgtg

SEQ ID NO: 9389 - DNA, 20 bp, Artificial Sequence
  Description of Artificial Sequence: Synthetic oligonucleotide
  Target: FXN; (-) strand; PAM type: NRG; PAM sequence: GGG
agtttcttcaaacacaatgt

SEQ ID NO: 9390 - DNA, 20 bp, Artificial Sequence
  Description of Artificial Sequence: Synthetic oligonucleotide
  Target: FXN; (-) strand; PAM type: NRG; PAM sequence: TGG
aagtttcttcaaacacaatg

SEQ ID NO: 9391 - DNA, 20 bp, Artificial Sequence
  Description of Artificial Sequence: Synthetic oligonucleotide
  Target: FXN; (-) strand; PAM type: NRG; PAM sequence: AAG
agcactggcaaccaatccca

SEQ ID NO: 9392 - DNA, 20 bp, Artificial Sequence
  Description of Artificial Sequence: Synthetic oligonucleotide
  Target: FXN; (-) strand; PAM type: NRG; PAM sequence: TGG
aagtcctaacttttaagcac

SEQ ID NO: 9393 - DNA, 20 bp, Artificial Sequence
  Description of Artificial Sequence: Synthetic oligonucleotide
  Target: FXN; (-) strand; PAM type: NRG; PAM sequence: AAG
ttttctaagtcctaactttt

SEQ ID NO: 9394 - DNA, 20 bp, Artificial Sequence
  Description of Artificial Sequence: Synthetic oligonucleotide
  Target: FXN; (-) strand; PAM type: NRG; PAM sequence: AAG
tgccaggaaatccattttct

SEQ ID NO: 9395 - DNA, 20 bp, Artificial Sequence
  Description of Artificial Sequence: Synthetic oligonucleotide
  Target: FXN; (-) strand; PAM type: NRG; PAM sequence: AGG
atgagccaccgcgtcctgcc

SEQ ID NO: 9396 - DNA, 20 bp, Artificial Sequence
  Description of Artificial Sequence: Synthetic oligonucleotide
  Target: FXN; (-) strand; PAM type: NRG; PAM sequence: CAG
catgagccaccgcgtcctgc

SEQ ID NO: 9397 - DNA, 20 bp, Artificial Sequence
  Description of Artificial Sequence: Synthetic oligonucleotide
  Target: FXN; (-) strand; PAM type: NRG; PAM sequence: GAG
agtgctgagattatgggcat

SEQ ID NO: 9398 - DNA, 20 bp, Artificial Sequence
  Description of Artificial Sequence: Synthetic oligonucleotide
  Target: FXN; (-) strand; PAM type: NRG; PAM sequence: GGG
tcccaaagtgctgagattat

SEQ ID NO: 9399 - DNA, 20 bp, Artificial Sequence
  Description of Artificial Sequence: Synthetic oligonucleotide
  Target: FXN; (-) strand; PAM type: NRG; PAM sequence: TGG
ctcccaaagtgctgagatta

SEQ ID NO: 9400 - DNA, 20 bp, Artificial Sequence
  Description of Artificial Sequence: Synthetic oligonucleotide
  Target: FXN; (-) strand; PAM type: NRG; PAM sequence: GAG
cctaggcctcccaaagtgct

SEQ ID NO: 9401 - DNA, 20 bp, Artificial Sequence
  Description of Artificial Sequence: Synthetic oligonucleotide
  Target: FXN; (-) strand; PAM type: NRG; PAM sequence: AAG
ccaccttcctaggcctccca

SEQ ID NO: 9402 - DNA, 20 bp, Artificial Sequence
  Description of Artificial Sequence: Synthetic oligonucleotide
  Target: FXN; (-) strand; PAM type: NRG; PAM sequence: AGG
ctcaggtgatccaccttcct

SEQ ID NO: 9403 - DNA, 20 bp, Artificial Sequence
  Description of Artificial Sequence: Synthetic oligonucleotide
  Target: FXN; (-) strand; PAM type: NRG; PAM sequence: TAG
cctcaggtgatccaccttcc

SEQ ID NO: 9404 - DNA, 20 bp, Artificial Sequence
  Description of Artificial Sequence: Synthetic oligonucleotide
  Target: FXN; (-) strand; PAM type: NRG; PAM sequence: AGG
agtcttgaactccggacctc

SEQ ID NO: 9405 - DNA, 20 bp, Artificial Sequence
  Description of Artificial Sequence: Synthetic oligonucleotide
  Target: FXN; (-) strand; PAM type: NRG; PAM sequence: CAG
tagtcttgaactccggacct

SEQ ID NO: 9406 - DNA, 20 bp, Artificial Sequence
  Description of Artificial Sequence: Synthetic oligonucleotide
  Target: FXN; (-) strand; PAM type: NRG; PAM sequence: CGG
gccaggttagtcttgaactc

SEQ ID NO: 9407 - DNA, 20 bp, Artificial Sequence
  Description of Artificial Sequence: Synthetic oligonucleotide
  Target: FXN; (-) strand; PAM type: NRG; PAM sequence: TAG
tttcaccatgttggccaggt

SEQ ID NO: 9408 - DNA, 20 bp, Artificial Sequence
  Description of Artificial Sequence: Synthetic oligonucleotide
  Target: FXN; (-) strand; PAM type: NRG; PAM sequence: AGG
tgggtttcaccatgttggcc

SEQ ID NO: 9409 - DNA, 20 bp, Artificial Sequence
  Description of Artificial Sequence: Synthetic oligonucleotide
  Target: FXN; (-) strand; PAM type: NRG; PAM sequence: CAG
ctgggtttcaccatgttggc

SEQ ID NO: 9410 - DNA, 20 bp, Artificial Sequence
  Description of Artificial Sequence: Synthetic oligonucleotide
  Target: FXN; (-) strand; PAM type: NRG; PAM sequence: TGG
gatactgggtttcaccatgt

SEQ ID NO: 9411 - DNA, 20 bp, Artificial Sequence
  Description of Artificial Sequence: Synthetic oligonucleotide
  Target: FXN; (-) strand; PAM type: NRG; PAM sequence: GGG
tgtattttttagtagatact

SEQ ID NO: 9412 - DNA, 20 bp, Artificial Sequence
  Description of Artificial Sequence: Synthetic oligonucleotide
  Target: FXN; (-) strand; PAM type: NRG; PAM sequence: TGG
ttgtattttttagtagatac

SEQ ID NO: 9413 - DNA, 20 bp, Artificial Sequence
  Description of Artificial Sequence: Synthetic oligonucleotide
  Target: FXN; (-) strand; PAM type: NRG; PAM sequence: TAG
tttttttttgtattttttag

SEQ ID NO: 9414 - DNA, 20 bp, Artificial Sequence
  Description of Artificial Sequence: Synthetic oligonucleotide
  Target: FXN; (-) strand; PAM type: NRG; PAM sequence: TAG
ttttttttttttgtattttt

SEQ ID NO: 9415 - DNA, 20 bp, Artificial Sequence
  Description of Artificial Sequence: Synthetic oligonucleotide
  Target: FXN; (-) strand; PAM type: NRG; PAM sequence: CGG
caggcgcgcgacaccacgcc

SEQ ID NO: 9416 - DNA, 20 bp, Artificial Sequence
  Description of Artificial Sequence: Synthetic oligonucleotide
  Target: FXN; (-) strand; PAM type: NRG; PAM sequence: AGG
tctggagtagctgggattac

SEQ ID NO: 9417 - DNA, 20 bp, Artificial Sequence
  Description of Artificial Sequence: Synthetic oligonucleotide
  Target: FXN; (-) strand; PAM type: NRG; PAM sequence: CAG
ctctggagtagctgggatta

SEQ ID NO: 9418 - DNA, 20 bp, Artificial Sequence
  Description of Artificial Sequence: Synthetic oligonucleotide
  Target: FXN; (-) strand; PAM type: NRG; PAM sequence: GGG
ccgcagcctctggagtagct

SEQ ID NO: 9419 - DNA, 20 bp, Artificial Sequence
  Description of Artificial Sequence: Synthetic oligonucleotide
  Target: FXN; (-) strand; PAM type: NRG; PAM sequence: TGG
gccgcagcctctggagtagc

SEQ ID NO: 9420 - DNA, 20 bp, Artificial Sequence
  Description of Artificial Sequence: Synthetic oligonucleotide
  Target: FXN; (-) strand; PAM type: NRG; PAM sequence: TAG
tcctgccgcagcctctggag

SEQ ID NO: 9421 - DNA, 20 bp, Artificial Sequence
  Description of Artificial Sequence: Synthetic oligonucleotide
  Target: FXN; (-) strand; PAM type: NRG; PAM sequence: GAG
ttctcctgccgcagcctctg

SEQ ID NO: 9422 - DNA, 20 bp, Artificial Sequence
  Description of Artificial Sequence: Synthetic oligonucleotide
  Target: FXN; (-) strand; PAM type: NRG; PAM sequence: TGG
gattctcctgccgcagcctc

SEQ ID NO: 9423 - DNA, 20 bp, Artificial Sequence
  Description of Artificial Sequence: Synthetic oligonucleotide
  Target: FXN; (-) strand; PAM type: NRG; PAM sequence: CAG
ctcaagcgattctcctgccg

SEQ ID NO: 9424 - DNA, 20 bp, Artificial Sequence
  Description of Artificial Sequence: Synthetic oligonucleotide
  Target: FXN; (-) strand; PAM type: NRG; PAM sequence: AAG
aacctctgcctcccgggctc

SEQ ID NO: 9425 - DNA, 20 bp, Artificial Sequence
  Description of Artificial Sequence: Synthetic oligonucleotide
  Target: FXN; (-) strand; PAM type: NRG; PAM sequence: GGG
taatgcaacctctgcctccc

SEQ ID NO: 9426 - DNA, 20 bp, Artificial Sequence
  Description of Artificial Sequence: Synthetic oligonucleotide
  Target: FXN; (-) strand; PAM type: NRG; PAM sequence: CGG
ttaatgcaacctctgcctcc

SEQ ID NO: 9427 - DNA, 20 bp, Artificial Sequence
  Description of Artificial Sequence: Synthetic oligonucleotide
  Target: FXN; (-) strand; PAM type: NRG; PAM sequence: TGG
cggagtgcattgggcgatct

SEQ ID NO: 9428 - DNA, 20 bp, Artificial Sequence
  Description of Artificial Sequence: Synthetic oligonucleotide
  Target: FXN; (-) strand; PAM type: NRG; PAM sequence: GGG
cgcccaggccggagtgcatt

SEQ ID NO: 9429 - DNA, 20 bp, Artificial Sequence
  Description of Artificial Sequence: Synthetic oligonucleotide
  Target: FXN; (-) strand; PAM type: NRG; PAM sequence: TGG
tcgcccaggccggagtgcat

SEQ ID NO: 9430 - DNA, 20 bp, Artificial Sequence
  Description of Artificial Sequence: Synthetic oligonucleotide
  Target: FXN; (-) strand; PAM type: NRG; PAM sequence: GAG
ttgctctgtcgcccaggccg

SEQ ID NO: 9431 - DNA, 20 bp, Artificial Sequence
  Description of Artificial Sequence: Synthetic oligonucleotide
  Target: FXN; (-) strand; PAM type: NRG; PAM sequence: CGG
tcttgctctgtcgcccaggc

SEQ ID NO: 9432 - DNA, 20 bp, Artificial Sequence
  Description of Artificial Sequence: Synthetic oligonucleotide
  Target: FXN; (-) strand; PAM type: NRG; PAM sequence: AGG
ggagtcttgctctgtcgccc

SEQ ID NO: 9433 - DNA, 20 bp, Artificial Sequence
  Description of Artificial Sequence: Synthetic oligonucleotide
  Target: FXN; (-) strand; PAM type: NRG; PAM sequence: CAG
cggagtcttgctctgtcgcc

SEQ ID NO: 9434 - DNA, 20 bp, Artificial Sequence
  Description of Artificial Sequence: Synthetic oligonucleotide
  Target: FXN; (-) strand; PAM type: NRG; PAM sequence: GAG
tattattattttttgagacg

SEQ ID NO: 9435 - DNA, 20 bp, Artificial Sequence
  Description of Artificial Sequence: Synthetic oligonucleotide
  Target: FXN; (-) strand; PAM type: NRG; PAM sequence: CGG
attattattattttttgaga

SEQ ID NO: 9436 - DNA, 20 bp, Artificial Sequence
  Description of Artificial Sequence: Synthetic oligonucleotide
  Target: FXN; (-) strand; PAM type: NRG; PAM sequence: GAG
atttattattattatttttt

SEQ ID NO: 9437 - DNA, 20 bp, Artificial Sequence
  Description of Artificial Sequence: Synthetic oligonucleotide
  Target: FXN; (-) strand; PAM type: NRG; PAM sequence: GGG
cctatttttccagagatgct

SEQ ID NO: 9438 - DNA, 20 bp, Artificial Sequence
  Description of Artificial Sequence: Synthetic oligonucleotide
  Target: FXN; (-) strand; PAM type: NRG; PAM sequence: TGG
gcctatttttccagagatgc

SEQ ID NO: 9439 - DNA, 20 bp, Artificial Sequence
  Description of Artificial Sequence: Synthetic oligonucleotide
  Target: FXN; (-) strand; PAM type: NRG; PAM sequence: GAG
cacacttgcctatttttcca

SEQ ID NO: 9440 - DNA, 20 bp, Artificial Sequence
  Description of Artificial Sequence: Synthetic oligonucleotide
  Target: FXN; (-) strand; PAM type: NRG; PAM sequence: CAG
gccacacttgcctatttttc

SEQ ID NO: 9441 - DNA, 20 bp, Artificial Sequence
  Description of Artificial Sequence: Synthetic oligonucleotide
  Target: FXN; (-) strand; PAM type: NRG; PAM sequence: TGG
aggagatctaaggaccatca

SEQ ID NO: 9442 - DNA, 20 bp, Artificial Sequence
  Description of Artificial Sequence: Synthetic oligonucleotide
  Target: FXN; (-) strand; PAM type: NRG; PAM sequence: AGG
gctttcctagaggagatcta

SEQ ID NO: 9443 - DNA, 20 bp, Artificial Sequence
  Description of Artificial Sequence: Synthetic oligonucleotide
  Target: FXN; (-) strand; PAM type: NRG; PAM sequence: AAG
tgctttcctagaggagatct

SEQ ID NO: 9444 - DNA, 20 bp, Artificial Sequence
  Description of Artificial Sequence: Synthetic oligonucleotide
  Target: FXN; (-) strand; PAM type: NRG; PAM sequence: GAG
aaatgtctgctttcctagag

SEQ ID NO: 9445 - DNA, 20 bp, Artificial Sequence
  Description of Artificial Sequence: Synthetic oligonucleotide
  Target: FXN; (-) strand; PAM type: NRG; PAM sequence: AGG
ataaatgtctgctttcctag

SEQ ID NO: 9446 - DNA, 20 bp, Artificial Sequence
  Description of Artificial Sequence: Synthetic oligonucleotide
  Target: FXN; (-) strand; PAM type: NRG; PAM sequence: GAG
aataaatgtctgctttccta

SEQ ID NO: 9447 - DNA, 20 bp, Artificial Sequence
  Description of Artificial Sequence: Synthetic oligonucleotide
  Target: FXN; (-) strand; PAM type: NRG; PAM sequence: TAG
gtaataaatgtctgctttcc

SEQ ID NO: 9448 - DNA, 20 bp, Artificial Sequence
  Description of Artificial Sequence: Synthetic oligonucleotide
  Target: FXN; (-) strand; PAM type: NRG; PAM sequence: AAG
tcagatagtgcacagaagcc

SEQ ID NO: 9449 - DNA, 20 bp, Artificial Sequence
  Description of Artificial Sequence: Synthetic oligonucleotide
  Target: FXN; (-) strand; PAM type: NRG; PAM sequence: AAG
gcagctcagatagtgcacag

SEQ ID NO: 9450 - DNA, 20 bp, Artificial Sequence
  Description of Artificial Sequence: Synthetic oligonucleotide
  Target: FXN; (-) strand; PAM type: NRG; PAM sequence: CAG
gtggcagctcagatagtgca

SEQ ID NO: 9451 - DNA, 20 bp, Artificial Sequence
  Description of Artificial Sequence: Synthetic oligonucleotide
  Target: FXN; (-) strand; PAM type: NRG; PAM sequence: TAG
ccaatacgtggcagctcaga

SEQ ID NO: 9452 - DNA, 20 bp, Artificial Sequence
  Description of Artificial Sequence: Synthetic oligonucleotide
  Target: FXN; (-) strand; PAM type: NRG; PAM sequence: CAG
aagcccaatacgtggcagct

SEQ ID NO: 9453 - DNA, 20 bp, Artificial Sequence
  Description of Artificial Sequence: Synthetic oligonucleotide
  Target: FXN; (-) strand; PAM type: NRG; PAM sequence: CAG
ggtggaagcccaatacgtgg

SEQ ID NO: 9454 - DNA, 20 bp, Artificial Sequence
  Description of Artificial Sequence: Synthetic oligonucleotide
  Target: FXN; (-) strand; PAM type: NRG; PAM sequence: TGG
aggggtggaagcccaatacg

SEQ ID NO: 9455 - DNA, 20 bp, Artificial Sequence
  Description of Artificial Sequence: Synthetic oligonucleotide
  Target: FXN; (-) strand; PAM type: NRG; PAM sequence: AAG
gtccacacaggcaggggtgg

SEQ ID NO: 9456 - DNA, 20 bp, Artificial Sequence
  Description of Artificial Sequence: Synthetic oligonucleotide
  Target: FXN; (-) strand; PAM type: NRG; PAM sequence: TGG
gctgtccacacaggcagggg

SEQ ID NO: 9457 - DNA, 20 bp, Artificial Sequence
  Description of Artificial Sequence: Synthetic oligonucleotide
  Target: FXN; (-) strand; PAM type: NRG; PAM sequence: GGG
catgctgtccacacaggcag

SEQ ID NO: 9458 - DNA, 20 bp, Artificial Sequence
  Description of Artificial Sequence: Synthetic oligonucleotide
  Target: FXN; (-) strand; PAM type: NRG; PAM sequence: GGG
ccatgctgtccacacaggca

SEQ ID NO: 9459 - DNA, 20 bp, Artificial Sequence
  Description of Artificial Sequence: Synthetic oligonucleotide
  Target: FXN; (-) strand; PAM type: NRG; PAM sequence: AGG
cccatgctgtccacacaggc

SEQ ID NO: 9460 - DNA, 20 bp, Artificial Sequence
  Description of Artificial Sequence: Synthetic oligonucleotide
  Target: FXN; (-) strand; PAM type: NRG; PAM sequence: CAG
acccatgctgtccacacagg

SEQ ID NO: 9461 - DNA, 20 bp, Artificial Sequence
  Description of Artificial Sequence: Synthetic oligonucleotide
  Target: FXN; (-) strand; PAM type: NRG; PAM sequence: AGG
acaacccatgctgtccacac

SEQ ID NO: 9462 - DNA, 20 bp, Artificial Sequence
  Description of Artificial Sequence: Synthetic oligonucleotide
  Target: FXN; (-) strand; PAM type: NRG; PAM sequence: CAG
gacaacccatgctgtccaca

SEQ ID NO: 9463 - DNA, 20 bp, Artificial Sequence
  Description of Artificial Sequence: Synthetic oligonucleotide
  Target: FXN; (-) strand; PAM type: NRG; PAM sequence: GGG
ctccagcctgggcaacaaga

SEQ ID NO: 9464 - DNA, 20 bp, Artificial Sequence
  Description of Artificial Sequence: Synthetic oligonucleotide
  Target: FXN; (-) strand; PAM type: NRG; PAM sequence: AGG
actccagcctgggcaacaag

SEQ ID NO: 9465 - DNA, 20 bp, Artificial Sequence
  Description of Artificial Sequence: Synthetic oligonucleotide
  Target: FXN; (-) strand; PAM type: NRG; PAM sequence: GAG
cactccagcctgggcaacaa

SEQ ID NO: 9466 - DNA, 20 bp, Artificial Sequence
  Description of Artificial Sequence: Synthetic oligonucleotide
  Target: FXN; (-) strand; PAM type: NRG; PAM sequence: AAG
tgcactccagcctgggcaac

SEQ ID NO: 9467 - DNA, 20 bp, Artificial Sequence
  Description of Artificial Sequence: Synthetic oligonucleotide
  Target: FXN; (-) strand; PAM type: NRG; PAM sequence: GGG
gagccactgcactccagcct

SEQ ID NO: 9468 - DNA, 20 bp, Artificial Sequence
  Description of Artificial Sequence: Synthetic oligonucleotide
  Target: FXN; (-) strand; PAM type: NRG; PAM sequence: TGG
tgagccactgcactccagcc

SEQ ID NO: 9469 - DNA, 20 bp, Artificial Sequence
  Description of Artificial Sequence: Synthetic oligonucleotide
  Target: FXN; (-) strand; PAM type: NRG; PAM sequence: CAG
gagactgagccactgcactc

SEQ ID NO: 9470 - DNA, 20 bp, Artificial Sequence
  Description of Artificial Sequence: Synthetic oligonucleotide
  Target: FXN; (-) strand; PAM type: NRG; PAM sequence: GAG
ggttgcagtgagctgagact

SEQ ID NO: 9471 - DNA, 20 bp, Artificial Sequence
  Description of Artificial Sequence: Synthetic oligonucleotide
  Target: FXN; (-) strand; PAM type: NRG; PAM sequence: GAG
ggcagaggttgcagtgagct

SEQ ID NO: 9472 - DNA, 20 bp, Artificial Sequence
  Description of Artificial Sequence: Synthetic oligonucleotide
  Target: FXN; (-) strand; PAM type: NRG; PAM sequence: GAG
caggaggcagaggttgcagt

SEQ ID NO: 9473 - DNA, 20 bp, Artificial Sequence
  Description of Artificial Sequence: Synthetic oligonucleotide
  Target: FXN; (-) strand; PAM type: NRG; PAM sequence: CAG
aacccaggaggcagaggttg

SEQ ID NO: 9474 - DNA, 20 bp, Artificial Sequence
  Description of Artificial Sequence: Synthetic oligonucleotide
  Target: FXN; (-) strand; PAM type: NRG; PAM sequence: AGG
cacttgaacccaggaggcag

SEQ ID NO: 9475 - DNA, 20 bp, Artificial Sequence
  Description of Artificial Sequence: Synthetic oligonucleotide
  Target: FXN; (-) strand; PAM type: NRG; PAM sequence: GAG
tcacttgaacccaggaggca

SEQ ID NO: 9476 - DNA, 20 bp, Artificial Sequence
  Description of Artificial Sequence: Synthetic oligonucleotide
  Target: FXN; (-) strand; PAM type: NRG; PAM sequence: CAG
aatcacttgaacccaggagg

SEQ ID NO: 9477 - DNA, 20 bp, Artificial Sequence
  Description of Artificial Sequence: Synthetic oligonucleotide
  Target: FXN; (-) strand; PAM type: NRG; PAM sequence: AGG
gagaatcacttgaacccagg

SEQ ID NO: 9478 - DNA, 20 bp, Artificial Sequence
  Description of Artificial Sequence: Synthetic oligonucleotide
  Target: FXN; (-) strand; PAM type: NRG; PAM sequence: GAG
ggagaatcacttgaacccag

SEQ ID NO: 9479 - DNA, 20 bp, Artificial Sequence
  Description of Artificial Sequence: Synthetic oligonucleotide
  Target: FXN; (-) strand; PAM type: NRG; PAM sequence: AGG
caggagaatcacttgaaccc

SEQ ID NO: 9480 - DNA, 20 bp, Artificial Sequence
  Description of Artificial Sequence: Synthetic oligonucleotide
  Target: FXN; (-) strand; PAM type: NRG; PAM sequence: CAG
gcaggagaatcacttgaacc

SEQ ID NO: 9481 - DNA, 20 bp, Artificial Sequence
  Description of Artificial Sequence: Synthetic oligonucleotide
  Target: FXN; (-) strand; PAM type: NRG; PAM sequence: GAG
tactcgggaggctgaggcag

SEQ ID NO: 9482 - DNA, 20 bp, Artificial Sequence
  Description of Artificial Sequence: Synthetic oligonucleotide
  Target: FXN; (-) strand; PAM type: NRG; PAM sequence: AGG
gctactcgggaggctgaggc

SEQ ID NO: 9483 - DNA, 20 bp, Artificial Sequence
  Description of Artificial Sequence: Synthetic oligonucleotide
  Target: FXN; (-) strand; PAM type: NRG; PAM sequence: CAG
agctactcgggaggctgagg

SEQ ID NO: 9484 - DNA, 20 bp, Artificial Sequence
  Description of Artificial Sequence: Synthetic oligonucleotide
  Target: FXN; (-) strand; PAM type: NRG; PAM sequence: AGG
cccagctactcgggaggctg

SEQ ID NO: 9485 - DNA, 20 bp, Artificial Sequence
  Description of Artificial Sequence: Synthetic oligonucleotide
  Target: FXN; (-) strand; PAM type: NRG; PAM sequence: GAG
tcccagctactcgggaggct

SEQ ID NO: 9486 - DNA, 20 bp, Artificial Sequence
  Description of Artificial Sequence: Synthetic oligonucleotide
  Target: FXN; (-) strand; PAM type: NRG; PAM sequence: AGG
gataatcccagctactcggg

SEQ ID NO: 9487 - DNA, 20 bp, Artificial Sequence
  Description of Artificial Sequence: Synthetic oligonucleotide
  Target: FXN; (-) strand; PAM type: NRG; PAM sequence: GAG
cgataatcccagctactcgg

SEQ ID NO: 9488 - DNA, 20 bp, Artificial Sequence
  Description of Artificial Sequence: Synthetic oligonucleotide
  Target: FXN; (-) strand; PAM type: NRG; PAM sequence: GGG
gccgataatcccagctactc

SEQ ID NO: 9489 - DNA, 20 bp, Artificial Sequence
  Description of Artificial Sequence: Synthetic oligonucleotide
  Target: FXN; (-) strand; PAM type: NRG; PAM sequence: CGG
agccgataatcccagctact

SEQ ID NO: 9490 - DNA, 20 bp, Artificial Sequence
  Description of Artificial Sequence: Synthetic oligonucleotide
  Target: FXN; (-) strand; PAM type: NRG; PAM sequence: CAG
acaaaattagccgataatcc

SEQ ID NO: 9491 - DNA, 20 bp, Artificial Sequence
  Description of Artificial Sequence: Synthetic oligonucleotide
  Target: FXN; (-) strand; PAM type: NRG; PAM sequence: TAG
ctctactaaaaatacaaaat

SEQ ID NO: 9492 - DNA, 20 bp, Artificial Sequence
  Description of Artificial Sequence: Synthetic oligonucleotide
  Target: FXN; (-) strand; PAM type: NRG; PAM sequence: GAG
agaccagcctgaccaacatg

SEQ ID NO: 9493 - DNA, 20 bp, Artificial Sequence
  Description of Artificial Sequence: Synthetic oligonucleotide
  Target: FXN; (-) strand; PAM type: NRG; PAM sequence: TGG
cgagaccagcctgaccaaca

SEQ ID NO: 9494 - DNA, 20 bp, Artificial Sequence
  Description of Artificial Sequence: Synthetic oligonucleotide
  Target: FXN; (-) strand; PAM type: NRG; PAM sequence: CAG
tgaggttgggagttcgagac

SEQ ID NO: 9495 - DNA, 20 bp, Artificial Sequence
  Description of Artificial Sequence: Synthetic oligonucleotide
  Target: FXN; (-) strand; PAM type: NRG; PAM sequence: GAG
tcacctgaggttgggagttc

SEQ ID NO: 9496 - DNA, 20 bp, Artificial Sequence
  Description of Artificial Sequence: Synthetic oligonucleotide
  Target: FXN; (-) strand; PAM type: NRG; PAM sequence: GAG
ggcggatcacctgaggttgg

SEQ ID NO: 9497 - DNA, 20 bp, Artificial Sequence
  Description of Artificial Sequence: Synthetic oligonucleotide
  Target: FXN; (-) strand; PAM type: NRG; PAM sequence: GGG
tgggcggatcacctgaggtt

SEQ ID NO: 9498 - DNA, 20 bp, Artificial Sequence
  Description of Artificial Sequence: Synthetic oligonucleotide
  Target: FXN; (-) strand; PAM type: NRG; PAM sequence: TGG
gtgggcggatcacctgaggt

SEQ ID NO: 9499 - DNA, 20 bp, Artificial Sequence
  Description of Artificial Sequence: Synthetic oligonucleotide
  Target: FXN; (-) strand; PAM type: NRG; PAM sequence: AGG
cgaggtgggcggatcacctg

SEQ ID NO: 9500 - DNA, 20 bp, Artificial Sequence
  Description of Artificial Sequence: Synthetic oligonucleotide
  Target: FXN; (-) strand; PAM type: NRG; PAM sequence: GAG
gcgaggtgggcggatcacct

SEQ ID NO: 9501 - DNA, 20 bp, Artificial Sequence
  Description of Artificial Sequence: Synthetic oligonucleotide
  Target: FXN; (-) strand; PAM type: NRG; PAM sequence: CGG
ctttgggagggcgaggtggg

SEQ ID NO: 9502 - DNA, 20 bp, Artificial Sequence
  Description of Artificial Sequence: Synthetic oligonucleotide
  Target: FXN; (-) strand; PAM type: NRG; PAM sequence: GGG
gcactttgggagggcgaggt

SEQ ID NO: 9503 - DNA, 20 bp, Artificial Sequence
  Description of Artificial Sequence: Synthetic oligonucleotide
  Target: FXN; (-) strand; PAM type: NRG; PAM sequence: TGG
agcactttgggagggcgagg

SEQ ID NO: 9504 - DNA, 20 bp, Artificial Sequence
  Description of Artificial Sequence: Synthetic oligonucleotide
  Target: FXN; (-) strand; PAM type: NRG; PAM sequence: AGG
tccagcactttgggagggcg

SEQ ID NO: 9505 - DNA, 20 bp, Artificial Sequence
  Description of Artificial Sequence: Synthetic oligonucleotide
  Target: FXN; (-) strand; PAM type: NRG; PAM sequence: GAG
ttccagcactttgggagggc

SEQ ID NO: 9506 - DNA, 20 bp, Artificial Sequence
  Description of Artificial Sequence: Synthetic oligonucleotide
  Target: FXN; (-) strand; PAM type: NRG; PAM sequence: GGG
gtaattccagcactttggga

SEQ ID NO: 9507 - DNA, 20 bp, Artificial Sequence
  Description of Artificial Sequence: Synthetic oligonucleotide
  Target: FXN; (-) strand; PAM type: NRG; PAM sequence: AGG
tgtaattccagcactttggg

SEQ ID NO: 9508 - DNA, 20 bp, Artificial Sequence
  Description of Artificial Sequence: Synthetic oligonucleotide
  Target: FXN; (-) strand; PAM type: NRG; PAM sequence: GAG
ctgtaattccagcactttgg

SEQ ID NO: 9509 - DNA, 20 bp, Artificial Sequence
  Description of Artificial Sequence: Synthetic oligonucleotide
  Target: FXN; (-) strand; PAM type: NRG; PAM sequence: GGG
gcctgtaattccagcacttt

SEQ ID NO: 9510 - DNA, 20 bp, Artificial Sequence
  Description of Artificial Sequence: Synthetic oligonucleotide
  Target: FXN; (-) strand; PAM type: NRG; PAM sequence: TGG
cgcctgtaattccagcactt

SEQ ID NO: 9511 - DNA, 20 bp, Artificial Sequence
  Description of Artificial Sequence: Synthetic oligonucleotide
  Target: FXN; (-) strand; PAM type: NRG; PAM sequence: CAG
gtggctcacgcctgtaattc

SEQ ID NO: 9512 - DNA, 20 bp, Artificial Sequence
  Description of Artificial Sequence: Synthetic oligonucleotide
  Target: FXN; (-) strand; PAM type: NRG; PAM sequence: TGG
ctgctgatggccagacgcgg

SEQ ID NO: 9513 - DNA, 20 bp, Artificial Sequence
  Description of Artificial Sequence: Synthetic oligonucleotide
  Target: FXN; (-) strand; PAM type: NRG; PAM sequence: CGG
actctgctgatggccagacg

SEQ ID NO: 9514 - DNA, 20 bp, Artificial Sequence
  Description of Artificial Sequence: Synthetic oligonucleotide
  Target: FXN; (-) strand; PAM type: NRG; PAM sequence: CAG
ttaaaaactctgctgatggc

SEQ ID NO: 9515 - DNA, 20 bp, Artificial Sequence
  Description of Artificial Sequence: Synthetic oligonucleotide
  Target: FXN; (-) strand; PAM type: NRG; PAM sequence: TGG
taaattaaaaactctgctga

SEQ ID NO: 9516 - DNA, 20 bp, Artificial Sequence
  Description of Artificial Sequence: Synthetic oligonucleotide
  Target: FXN; (-) strand; PAM type: NRG; PAM sequence: AGG
aatagcccttaacagccacc

SEQ ID NO: 9517 - DNA, 20 bp, Artificial Sequence
  Description of Artificial Sequence: Synthetic oligonucleotide
  Target: FXN; (-) strand; PAM type: NRG; PAM sequence: CAG
caatagcccttaacagccac

SEQ ID NO: 9518 - DNA, 20 bp, Artificial Sequence
  Description of Artificial Sequence: Synthetic oligonucleotide
  Target: FXN; (-) strand; PAM type: NRG; PAM sequence: CAG
tgtcagtcaatagcccttaa

SEQ ID NO: 9519 - DNA, 20 bp, Artificial Sequence
  Description of Artificial Sequence: Synthetic oligonucleotide
  Target: FXN; (-) strand; PAM type: NRG; PAM sequence: TAG
tgggtgtgtttgtcagtcaa

SEQ ID NO: 9520 - DNA, 20 bp, Artificial Sequence
  Description of Artificial Sequence: Synthetic oligonucleotide
  Target: FXN; (-) strand; PAM type: NRG; PAM sequence: CAG
gccaagttgggtgtgtttgt

SEQ ID NO: 9521 - DNA, 20 bp, Artificial Sequence
  Description of Artificial Sequence: Synthetic oligonucleotide
  Target: FXN; (-) strand; PAM type: NRG; PAM sequence: GGG
ctgggcggcagcgccaagtt

SEQ ID NO: 9522 - DNA, 20 bp, Artificial Sequence
  Description of Artificial Sequence: Synthetic oligonucleotide
  Target: FXN; (-) strand; PAM type: NRG; PAM sequence: TGG
cctgggcggcagcgccaagt

SEQ ID NO: 9523 - DNA, 20 bp, Artificial Sequence
  Description of Artificial Sequence: Synthetic oligonucleotide
  Target: FXN; (-) strand; PAM type: NRG; PAM sequence: AAG
acctcctgggcggcagcgcc

SEQ ID NO: 9524 - DNA, 20 bp, Artificial Sequence
  Description of Artificial Sequence: Synthetic oligonucleotide
  Target: FXN; (-) strand; PAM type: NRG; PAM sequence: CAG
agtgtccacctcctgggcgg

SEQ ID NO: 9525 - DNA, 20 bp, Artificial Sequence
  Description of Artificial Sequence: Synthetic oligonucleotide
  Target: FXN; (-) strand; PAM type: NRG; PAM sequence: CGG
cccagtgtccacctcctggg

SEQ ID NO: 9526 - DNA, 20 bp, Artificial Sequence
  Description of Artificial Sequence: Synthetic oligonucleotide
  Target: FXN; (-) strand; PAM type: NRG; PAM sequence: GGG
aaacccagtgtccacctcct

SEQ ID NO: 9527 - DNA, 20 bp, Artificial Sequence
  Description of Artificial Sequence: Synthetic oligonucleotide
  Target: FXN; (-) strand; PAM type: NRG; PAM sequence: TGG
gaaacccagtgtccacctcc

SEQ ID NO: 9528 - DNA, 20 bp, Artificial Sequence
  Description of Artificial Sequence: Synthetic oligonucleotide
  Target: FXN; (-) strand; PAM type: NRG; PAM sequence: CAG
taaccatctatccagaaacc

SEQ ID NO: 9529 - DNA, 20 bp, Artificial Sequence
  Description of Artificial Sequence: Synthetic oligonucleotide
  Target: FXN; (-) strand; PAM type: NRG; PAM sequence: CAG
gaggttgctaaccatctatc

SEQ ID NO: 9530 - DNA, 20 bp, Artificial Sequence
  Description of Artificial Sequence: Synthetic oligonucleotide
  Target: FXN; (-) strand; PAM type: NRG; PAM sequence: AGG
agaggcccagctggtgacag

SEQ ID NO: 9531 - DNA, 20 bp, Artificial Sequence
  Description of Artificial Sequence: Synthetic oligonucleotide
  Target: FXN; (-) strand; PAM type: NRG; PAM sequence: GAG
aagaggcccagctggtgaca

SEQ ID NO: 9532 - DNA, 20 bp, Artificial Sequence
  Description of Artificial Sequence: Synthetic oligonucleotide
  Target: FXN; (-) strand; PAM type: NRG; PAM sequence: CAG
aaaagaggcccagctggtga

SEQ ID NO: 9533 - DNA, 20 bp, Artificial Sequence
  Description of Artificial Sequence: Synthetic oligonucleotide
  Target: FXN; (-) strand; PAM type: NRG; PAM sequence: TGG
tagaaaaaaagaggcccagc

SEQ ID NO: 9534 - DNA, 20 bp, Artificial Sequence
  Description of Artificial Sequence: Synthetic oligonucleotide
  Target: FXN; (-) strand; PAM type: NRG; PAM sequence: CAG
agtatagaaaaaaagaggcc

SEQ ID NO: 9535 - DNA, 20 bp, Artificial Sequence
  Description of Artificial Sequence: Synthetic oligonucleotide
  Target: FXN; (-) strand; PAM type: NRG; PAM sequence: AGG
aattcagtatagaaaaaaag

SEQ ID NO: 9536 - DNA, 20 bp, Artificial Sequence
  Description of Artificial Sequence: Synthetic oligonucleotide
  Target: FXN; (-) strand; PAM type: NRG; PAM sequence: GAG
taattcagtatagaaaaaaa

SEQ ID NO: 9537 - DNA, 20 bp, Artificial Sequence
  Description of Artificial Sequence: Synthetic oligonucleotide
  Target: FXN; (-) strand; PAM type: NRG; PAM sequence: AAG
attaattcagtatagaaaaa

SEQ ID NO: 9538 - DNA, 20 bp, Artificial Sequence
  Description of Artificial Sequence: Synthetic oligonucleotide
  Target: FXN; (-) strand; PAM type: NRG; PAM sequence: TAG
caaatgtgattaattcagta

SEQ ID NO: 9539 - DNA, 20 bp, Artificial Sequence
  Description of Artificial Sequence: Synthetic oligonucleotide
  Target: FXN; (-) strand; PAM type: NRG; PAM sequence: CAG
ttaaacaaatgtgattaatt

SEQ ID NO: 9540 - DNA, 20 bp, Artificial Sequence
  Description of Artificial Sequence: Synthetic oligonucleotide
  Target: FXN; (-) strand; PAM type: NRG; PAM sequence: AGG
aagggaactatggaacagac

SEQ ID NO: 9541 - DNA, 20 bp, Artificial Sequence
  Description of Artificial Sequence: Synthetic oligonucleotide
  Target: FXN; (-) strand; PAM type: NRG; PAM sequence: CAG
caagggaactatggaacaga

SEQ ID NO: 9542 - DNA, 20 bp, Artificial Sequence
  Description of Artificial Sequence: Synthetic oligonucleotide
  Target: FXN; (-) strand; PAM type: NRG; PAM sequence: CAG
tgtgcaagggaactatggaa

SEQ ID NO: 9543 - DNA, 20 bp, Artificial Sequence
  Description of Artificial Sequence: Synthetic oligonucleotide
  Target: FXN; (-) strand; PAM type: NRG; PAM sequence: TGG
caagatgtgcaagggaacta

SEQ ID NO: 9544 - DNA, 20 bp, Artificial Sequence
  Description of Artificial Sequence: Synthetic oligonucleotide
  Target: FXN; (-) strand; PAM type: NRG; PAM sequence: GGG
caaatacccaagatgtgcaa

SEQ ID NO: 9545 - DNA, 20 bp, Artificial Sequence
  Description of Artificial Sequence: Synthetic oligonucleotide
  Target: FXN; (-) strand; PAM type: NRG; PAM sequence: AGG
tcaaatacccaagatgtgca

SEQ ID NO: 9546 - DNA, 20 bp, Artificial Sequence
  Description of Artificial Sequence: Synthetic oligonucleotide
  Target: FXN; (-) strand; PAM type: NRG; PAM sequence: AAG
ctcaaatacccaagatgtgc

SEQ ID NO: 9547 - DNA, 20 bp, Artificial Sequence
  Description of Artificial Sequence: Synthetic oligonucleotide
  Target: FXN; (-) strand; PAM type: NRG; PAM sequence: AAG
acccaactcctcaaataccc

SEQ ID NO: 9548 - DNA, 20 bp, Artificial Sequence
  Description of Artificial Sequence: Synthetic oligonucleotide
  Target: FXN; (-) strand; PAM type: NRG; PAM sequence: CAG
attaaacaggatggtggccc

SEQ ID NO: 9549 - DNA, 20 bp, Artificial Sequence
  Description of Artificial Sequence: Synthetic oligonucleotide
  Target: FXN; (-) strand; PAM type: NRG; PAM sequence: TGG
aaaataattaaacaggatgg

SEQ ID NO: 9550 - DNA, 20 bp, Artificial Sequence
  Description of Artificial Sequence: Synthetic oligonucleotide
  Target: FXN; (-) strand; PAM type: NRG; PAM sequence: TGG
tttaaaataattaaacagga

SEQ ID NO: 9551 - DNA, 20 bp, Artificial Sequence
  Description of Artificial Sequence: Synthetic oligonucleotide
  Target: FXN; (-) strand; PAM type: NRG; PAM sequence: AGG
gggctttaaaataattaaac

SEQ ID NO: 9552 - DNA, 20 bp, Artificial Sequence
  Description of Artificial Sequence: Synthetic oligonucleotide
  Target: FXN; (-) strand; PAM type: NRG; PAM sequence: CAG
agggctttaaaataattaaa

SEQ ID NO: 9553 - DNA, 20 bp, Artificial Sequence
  Description of Artificial Sequence: Synthetic oligonucleotide
  Target: FXN; (-) strand; PAM type: NRG; PAM sequence: GGG
gggtcaatccaggacagtca

SEQ ID NO: 9554 - DNA, 20 bp, Artificial Sequence
  Description of Artificial Sequence: Synthetic oligonucleotide
  Target: FXN; (-) strand; PAM type: NRG; PAM sequence: AGG
agggtcaatccaggacagtc

SEQ ID NO: 9555 - DNA, 20 bp, Artificial Sequence
  Description of Artificial Sequence: Synthetic oligonucleotide
  Target: FXN; (-) strand; PAM type: NRG; PAM sequence: CAG
tagggtcaatccaggacagt

SEQ ID NO: 9556 - DNA, 20 bp, Artificial Sequence
  Description of Artificial Sequence: Synthetic oligonucleotide
  Target: FXN; (-) strand; PAM type: NRG; PAM sequence: CAG
agcttagggtcaatccagga

SEQ ID NO: 9557 - DNA, 20 bp, Artificial Sequence
  Description of Artificial Sequence: Synthetic oligonucleotide
  Target: FXN; (-) strand; PAM type: NRG; PAM sequence: AGG
ggggagcttagggtcaatcc

SEQ ID NO: 9558 - DNA, 20 bp, Artificial Sequence
  Description of Artificial Sequence: Synthetic oligonucleotide
  Target: FXN; (-) strand; PAM type: NRG; PAM sequence: CAG
gggggagcttagggtcaatc

SEQ ID NO: 9559 - DNA, 20 bp, Artificial Sequence
  Description of Artificial Sequence: Synthetic oligonucleotide
  Target: FXN; (-) strand; PAM type: NRG; PAM sequence: GGG
tggagaccagggggagctta

SEQ ID NO: 9560 - DNA, 20 bp, Artificial Sequence
  Description of Artificial Sequence: Synthetic oligonucleotide
  Target: FXN; (-) strand; PAM type: NRG; PAM sequence: AGG
ttggagaccagggggagctt

SEQ ID NO: 9561 - DNA, 20 bp, Artificial Sequence
  Description of Artificial Sequence: Synthetic oligonucleotide
  Target: FXN; (-) strand; PAM type: NRG; PAM sequence: TAG
tttggagaccagggggagct

SEQ ID NO: 9562 - DNA, 20 bp, Artificial Sequence
  Description of Artificial Sequence: Synthetic oligonucleotide
  Target: FXN; (-) strand; PAM type: NRG; PAM sequence: GAG
tgaattttggagaccagggg

SEQ ID NO: 9563 - DNA, 20 bp, Artificial Sequence
  Description of Artificial Sequence: Synthetic oligonucleotide
  Target: FXN; (-) strand; PAM type: NRG; PAM sequence: GGG
gatgaattttggagaccagg

SEQ ID NO: 9564 - DNA, 20 bp, Artificial Sequence
  Description of Artificial Sequence: Synthetic oligonucleotide
  Target: FXN; (-) strand; PAM type: NRG; PAM sequence: GGG
tgatgaattttggagaccag

SEQ ID NO: 9565 - DNA, 20 bp, Artificial Sequence
  Description of Artificial Sequence: Synthetic oligonucleotide
  Target: FXN; (-) strand; PAM type: NRG; PAM sequence: GGG
ctgatgaattttggagacca

SEQ ID NO: 9566 - DNA, 20 bp, Artificial Sequence
  Description of Artificial Sequence: Synthetic oligonucleotide
  Target: FXN; (-) strand; PAM type: NRG; PAM sequence: AGG
tctgatgaattttggagacc

SEQ ID NO: 9567 - DNA, 20 bp, Artificial Sequence
  Description of Artificial Sequence: Synthetic oligonucleotide
  Target: FXN; (-) strand; PAM type: NRG; PAM sequence: CAG
ttctgatgaattttggagac

SEQ ID NO: 9568 - DNA, 20 bp, Artificial Sequence
  Description of Artificial Sequence: Synthetic oligonucleotide
  Target: FXN; (-) strand; PAM type: NRG; PAM sequence: GAG
tcagtttctgatgaattttg

SEQ ID NO: 9569 - DNA, 20 bp, Artificial Sequence
  Description of Artificial Sequence: Synthetic oligonucleotide
  Target: FXN; (-) strand; PAM type: NRG; PAM sequence: TGG
actcagtttctgatgaattt

SEQ ID NO: 9570 - DNA, 20 bp, Artificial Sequence
  Description of Artificial Sequence: Synthetic oligonucleotide
  Target: FXN; (-) strand; PAM type: NRG; PAM sequence: CAG
aagaggccttcaagtgaact

SEQ ID NO: 9571 - DNA, 20 bp, Artificial Sequence
  Description of Artificial Sequence: Synthetic oligonucleotide
  Target: FXN; (-) strand; PAM type: NRG; PAM sequence: AAG
agggtggggaagaggccttc

SEQ ID NO: 9572 - DNA, 20 bp, Artificial Sequence
  Description of Artificial Sequence: Synthetic oligonucleotide
  Target: FXN; (-) strand; PAM type: NRG; PAM sequence: AGG
tggagaaaagggtggggaag

SEQ ID NO: 9573 - DNA, 20 bp, Artificial Sequence
  Description of Artificial Sequence: Synthetic oligonucleotide
  Target: FXN; (-) strand; PAM type: NRG; PAM sequence: GAG
gtggagaaaagggtggggaa

SEQ ID NO: 9574 - DNA, 20 bp, Artificial Sequence
  Description of Artificial Sequence: Synthetic oligonucleotide
  Target: FXN; (-) strand; PAM type: NRG; PAM sequence: AAG
gggtggagaaaagggtgggg

SEQ ID NO: 9575 - DNA, 20 bp, Artificial Sequence
  Description of Artificial Sequence: Synthetic oligonucleotide
  Target: FXN; (-) strand; PAM type: NRG; PAM sequence: GGG
aaggggtggagaaaagggtg

SEQ ID NO: 9576 - DNA, 20 bp, Artificial Sequence
  Description of Artificial Sequence: Synthetic oligonucleotide
  Target: FXN; (-) strand; PAM type: NRG; PAM sequence: GGG
caaggggtggagaaaagggt

SEQ ID NO: 9577 - DNA, 20 bp, Artificial Sequence
  Description of Artificial Sequence: Synthetic oligonucleotide
  Target: FXN; (-) strand; PAM type: NRG; PAM sequence: TGG
gcaaggggtggagaaaaggg

SEQ ID NO: 9578 - DNA, 20 bp, Artificial Sequence
  Description of Artificial Sequence: Synthetic oligonucleotide
  Target: FXN; (-) strand; PAM type: NRG; PAM sequence: GGG
gatgcaaggggtggagaaaa

SEQ ID NO: 9579 - DNA, 20 bp, Artificial Sequence
  Description of Artificial Sequence: Synthetic oligonucleotide
  Target: FXN; (-) strand; PAM type: NRG; PAM sequence: AGG
agatgcaaggggtggagaaa

SEQ ID NO: 9580 - DNA, 20 bp, Artificial Sequence
  Description of Artificial Sequence: Synthetic oligonucleotide
  Target: FXN; (-) strand; PAM type: NRG; PAM sequence: AAG
tagatgcaaggggtggagaa

SEQ ID NO: 9581 - DNA, 20 bp, Artificial Sequence
  Description of Artificial Sequence: Synthetic oligonucleotide
  Target: FXN; (-) strand; PAM type: NRG; PAM sequence: GAG
agaagtagatgcaaggggtg

SEQ ID NO: 9582 - DNA, 20 bp, Artificial Sequence
  Description of Artificial Sequence: Synthetic oligonucleotide
  Target: FXN; (-) strand; PAM type: NRG; PAM sequence: TGG
ttagaagtagatgcaagggg

SEQ ID NO: 9583 - DNA, 20 bp, Artificial Sequence
  Description of Artificial Sequence: Synthetic oligonucleotide
  Target: FXN; (-) strand; PAM type: NRG; PAM sequence: GGG
gctttagaagtagatgcaag

SEQ ID NO: 9584 - DNA, 20 bp, Artificial Sequence
  Description of Artificial Sequence: Synthetic oligonucleotide
  Target: FXN; (-) strand; PAM type: NRG; PAM sequence: GGG
tgctttagaagtagatgcaa

SEQ ID NO: 9585 - DNA, 20 bp, Artificial Sequence
  Description of Artificial Sequence: Synthetic oligonucleotide
  Target: FXN; (-) strand; PAM type: NRG; PAM sequence: AGG
ctgctttagaagtagatgca

SEQ ID NO: 9586 - DNA, 20 bp, Artificial Sequence
  Description of Artificial Sequence: Synthetic oligonucleotide
  Target: FXN; (-) strand; PAM type: NRG; PAM sequence: AAG
gctgctttagaagtagatgc

SEQ ID NO: 9587 - DNA, 20 bp, Artificial Sequence
  Description of Artificial Sequence: Synthetic oligonucleotide
  Target: FXN; (-) strand; PAM type: NRG; PAM sequence: TAG
ttgaacagctgctttagaag

SEQ ID NO: 9588 - DNA, 20 bp, Artificial Sequence
  Description of Artificial Sequence: Synthetic oligonucleotide
  Target: FXN; (-) strand; PAM type: NRG; PAM sequence: AAG
ctgttgaacagctgctttag

SEQ ID NO: 9589 - DNA, 20 bp, Artificial Sequence
  Description of Artificial Sequence: Synthetic oligonucleotide
  Target: FXN; (-) strand; PAM type: NRG; PAM sequence: TAG
tttctgttgaacagctgctt

SEQ ID NO: 9590 - DNA, 20 bp, Artificial Sequence
  Description of Artificial Sequence: Synthetic oligonucleotide
  Target: FXN; (-) strand; PAM type: NRG; PAM sequence: CAG
cccattctgtttctgttgaa

SEQ ID NO: 9591 - DNA, 20 bp, Artificial Sequence
  Description of Artificial Sequence: Synthetic oligonucleotide
  Target: FXN; (-) strand; PAM type: NRG; PAM sequence: TGG
aaaatgtagaattatgtgtg

SEQ ID NO: 9592 - DNA, 20 bp, Artificial Sequence
  Description of Artificial Sequence: Synthetic oligonucleotide
  Target: FXN; (-) strand; PAM type: NRG; PAM sequence: TAG
ttctttttaactagaaaatg

SEQ ID NO: 9593 - DNA, 20 bp, Artificial Sequence
  Description of Artificial Sequence: Synthetic oligonucleotide
  Target: FXN; (-) strand; PAM type: NRG; PAM sequence: TAG
gatttttttttctttttaac

SEQ ID NO: 9594 - DNA, 20 bp, Artificial Sequence
  Description of Artificial Sequence: Synthetic oligonucleotide
  Target: FXN; (-) strand; PAM type: NRG; PAM sequence: AGG
gataatattttgtatgtact

SEQ ID NO: 9595 - DNA, 20 bp, Artificial Sequence
  Description of Artificial Sequence: Synthetic oligonucleotide
  Target: FXN; (-) strand; PAM type: NRG; PAM sequence: TAG
tgataatattttgtatgtac

SEQ ID NO: 9596 - DNA, 20 bp, Artificial Sequence
  Description of Artificial Sequence: Synthetic oligonucleotide
  Target: FXN; (-) strand; PAM type: NRG; PAM sequence: TGG
ttaaaatactgattacatgt

SEQ ID NO: 9597 - DNA, 20 bp, Artificial Sequence
  Description of Artificial Sequence: Synthetic oligonucleotide
  Target: FXN; (-) strand; PAM type: NRG; PAM sequence: TGG
cagtcgtgagccaccgtgcc

SEQ ID NO: 9598 - DNA, 20 bp, Artificial Sequence
  Description of Artificial Sequence: Synthetic oligonucleotide
  Target: FXN; (-) strand; PAM type: NRG; PAM sequence: GAG
agtcctgggattacagtcgt

SEQ ID NO: 9599 - DNA, 20 bp, Artificial Sequence
  Description of Artificial Sequence: Synthetic oligonucleotide
  Target: FXN; (-) strand; PAM type: NRG; PAM sequence: CAG
ctcccaaagtcctgggatta

SEQ ID NO: 9600 - DNA, 20 bp, Artificial Sequence
  Description of Artificial Sequence: Synthetic oligonucleotide
  Target: FXN; (-) strand; PAM type: NRG; PAM sequence: GGG
cctcggcctcccaaagtcct

SEQ ID NO: 9601 - DNA, 20 bp, Artificial Sequence
  Description of Artificial Sequence: Synthetic oligonucleotide
  Target: FXN; (-) strand; PAM type: NRG; PAM sequence: TGG
gcctcggcctcccaaagtcc

SEQ ID NO: 9602 - DNA, 20 bp, Artificial Sequence
  Description of Artificial Sequence: Synthetic oligonucleotide
  Target: FXN; (-) strand; PAM type: NRG; PAM sequence: AAG
ccactcgcctcggcctccca

SEQ ID NO: 9603 - DNA, 20 bp, Artificial Sequence
  Description of Artificial Sequence: Synthetic oligonucleotide
  Target: FXN; (-) strand; PAM type: NRG; PAM sequence: CGG
ctcagatgatccactcgcct

SEQ ID NO: 9604 - DNA, 20 bp, Artificial Sequence
  Description of Artificial Sequence: Synthetic oligonucleotide
  Target: FXN; (-) strand; PAM type: NRG; PAM sequence: CAG
tggtcttgaactcctgatct

SEQ ID NO: 9605 - DNA, 20 bp, Artificial Sequence
  Description of Artificial Sequence: Synthetic oligonucleotide
  Target: FXN; (-) strand; PAM type: NRG; PAM sequence: TGG
tttcaccatgttggccaggc

SEQ ID NO: 9606 - DNA, 20 bp, Artificial Sequence
  Description of Artificial Sequence: Synthetic oligonucleotide
  Target: FXN; (-) strand; PAM type: NRG; PAM sequence: AGG
ggggtttcaccatgttggcc

SEQ ID NO: 9607 - DNA, 20 bp, Artificial Sequence
  Description of Artificial Sequence: Synthetic oligonucleotide
  Target: FXN; (-) strand; PAM type: NRG; PAM sequence: CAG
tggggtttcaccatgttggc

SEQ ID NO: 9608 - DNA, 20 bp, Artificial Sequence
  Description of Artificial Sequence: Synthetic oligonucleotide
  Target: FXN; (-) strand; PAM type: NRG; PAM sequence: TGG
gagatggggtttcaccatgt

SEQ ID NO: 9609 - DNA, 20 bp, Artificial Sequence
  Description of Artificial Sequence: Synthetic oligonucleotide
  Target: FXN; (-) strand; PAM type: NRG; PAM sequence: GGG
gctagtttttagtagagatg

SEQ ID NO: 9610 - DNA, 20 bp, Artificial Sequence
  Description of Artificial Sequence: Synthetic oligonucleotide
  Target: FXN; (-) strand; PAM type: NRG; PAM sequence: GGG
agctagtttttagtagagat

SEQ ID NO: 9611 - DNA, 20 bp, Artificial Sequence
  Description of Artificial Sequence: Synthetic oligonucleotide
  Target: FXN; (-) strand; PAM type: NRG; PAM sequence: TGG
gagctagtttttagtagaga

SEQ ID NO: 9612 - DNA, 20 bp, Artificial Sequence
  Description of Artificial Sequence: Synthetic oligonucleotide
  Target: FXN; (-) strand; PAM type: NRG; PAM sequence: GAG
tgctgagctagtttttagta

SEQ ID NO: 9613 - DNA, 20 bp, Artificial Sequence
  Description of Artificial Sequence: Synthetic oligonucleotide
  Target: FXN; (-) strand; PAM type: NRG; PAM sequence: TAG
catgctgagctagtttttag

SEQ ID NO: 9614 - DNA, 20 bp, Artificial Sequence
  Description of Artificial Sequence: Synthetic oligonucleotide
  Target: FXN; (-) strand; PAM type: NRG; PAM sequence: TAG
caccatgctgagctagtttt

SEQ ID NO: 9615 - DNA, 20 bp, Artificial Sequence
  Description of Artificial Sequence: Synthetic oligonucleotide
  Target: FXN; (-) strand; PAM type: NRG; PAM sequence: TAG
cacccaccaccatgctgagc

SEQ ID NO: 9616 - DNA, 20 bp, Artificial Sequence
  Description of Artificial Sequence: Synthetic oligonucleotide
  Target: FXN; (-) strand; PAM type: NRG; PAM sequence: GAG
caggcacccaccaccatgct

SEQ ID NO: 9617 - DNA, 20 bp, Artificial Sequence
  Description of Artificial Sequence: Synthetic oligonucleotide
  Target: FXN; (-) strand; PAM type: NRG; PAM sequence: AGG
tcccgagtagctgggactac

SEQ ID NO: 9618 - DNA, 20 bp, Artificial Sequence
  Description of Artificial Sequence: Synthetic oligonucleotide
  Target: FXN; (-) strand; PAM type: NRG; PAM sequence: CAG
ctcccgagtagctgggacta

SEQ ID NO: 9619 - DNA, 20 bp, Artificial Sequence
  Description of Artificial Sequence: Synthetic oligonucleotide
  Target: FXN; (-) strand; PAM type: NRG; PAM sequence: GGG
cctcagcctcccgagtagct

SEQ ID NO: 9620 - DNA, 20 bp, Artificial Sequence
  Description of Artificial Sequence: Synthetic oligonucleotide
  Target: FXN; (-) strand; PAM type: NRG; PAM sequence: TGG
gcctcagcctcccgagtagc

SEQ ID NO: 9621 - DNA, 20 bp, Artificial Sequence
  Description of Artificial Sequence: Synthetic oligonucleotide
  Target: FXN; (-) strand; PAM type: NRG; PAM sequence: TAG
tcatgcctcagcctcccgag

SEQ ID NO: 9622 - DNA, 20 bp, Artificial Sequence
  Description of Artificial Sequence: Synthetic oligonucleotide
  Target: FXN; (-) strand; PAM type: NRG; PAM sequence: GAG
ttctcatgcctcagcctccc

SEQ ID NO: 9623 - DNA, 20 bp, Artificial Sequence
  Description of Artificial Sequence: Synthetic oligonucleotide
  Target: FXN; (-) strand; PAM type: NRG; PAM sequence: CAG
ctcaagtgattctcatgcct

SEQ ID NO: 9624 - DNA, 20 bp, Artificial Sequence
  Description of Artificial Sequence: Synthetic oligonucleotide
  Target: FXN; (-) strand; PAM type: NRG; PAM sequence: AAG
aacctctgcctcctgggctc

SEQ ID NO: 9625 - DNA, 20 bp, Artificial Sequence
  Description of Artificial Sequence: Synthetic oligonucleotide
  Target: FXN; (-) strand; PAM type: NRG; PAM sequence: GGG
cactgcaacctctgcctcct

SEQ ID NO: 9626 - DNA, 20 bp, Artificial Sequence
  Description of Artificial Sequence: Synthetic oligonucleotide
  Target: FXN; (-) strand; PAM type: NRG; PAM sequence: TGG
tcactgcaacctctgcctcc

SEQ ID NO: 9627 - DNA, 20 bp, Artificial Sequence
  Description of Artificial Sequence: Synthetic oligonucleotide
  Target: FXN; (-) strand; PAM type: NRG; PAM sequence: TGG
cacagaatcccccaaaatct

SEQ ID NO: 9628 - DNA, 20 bp, Artificial Sequence
  Description of Artificial Sequence: Synthetic oligonucleotide
  Target: FXN; (-) strand; PAM type: NRG; PAM sequence: CAG
ctgattttttttgtatgtca

SEQ ID NO: 9629 - DNA, 20 bp, Artificial Sequence
  Description of Artificial Sequence: Synthetic oligonucleotide
  Target: FXN; (-) strand; PAM type: NRG; PAM sequence: AAG
tgagtacgaaaagagtatgc

SEQ ID NO: 9630 - DNA, 20 bp, Artificial Sequence
  Description of Artificial Sequence: Synthetic oligonucleotide
  Target: FXN; (-) strand; PAM type: NRG; PAM sequence: GAG
gaagtatatgagtacgaaaa

SEQ ID NO: 9631 - DNA, 20 bp, Artificial Sequence
  Description of Artificial Sequence: Synthetic oligonucleotide
  Target: FXN; (-) strand; PAM type: NRG; PAM sequence: AAG
tggaagtatatgagtacgaa

SEQ ID NO: 9632 - DNA, 20 bp, Artificial Sequence
  Description of Artificial Sequence: Synthetic oligonucleotide
  Target: FXN; (-) strand; PAM type: NRG; PAM sequence: GAG
gagatatgctggaagtatat

SEQ ID NO: 9633 - DNA, 20 bp, Artificial Sequence
  Description of Artificial Sequence: Synthetic oligonucleotide
  Target: FXN; (-) strand; PAM type: NRG; PAM sequence: AAG
tgtgaattgagatatgctgg

SEQ ID NO: 9634 - DNA, 20 bp, Artificial Sequence
  Description of Artificial Sequence: Synthetic oligonucleotide
  Target: FXN; (-) strand; PAM type: NRG; PAM sequence: TGG
aattgtgaattgagatatgc

SEQ ID NO: 9635 - DNA, 20 bp, Artificial Sequence
  Description of Artificial Sequence: Synthetic oligonucleotide
  Target: FXN; (-) strand; PAM type: NRG; PAM sequence: GAG
ttacttagaaattgtgaatt

SEQ ID NO: 9636 - DNA, 20 bp, Artificial Sequence
  Description of Artificial Sequence: Synthetic oligonucleotide
  Target: FXN; (-) strand; PAM type: NRG; PAM sequence: TAG
atacagatagagcatttact

SEQ ID NO: 9637 - DNA, 20 bp, Artificial Sequence
  Description of Artificial Sequence: Synthetic oligonucleotide
  Target: FXN; (-) strand; PAM type: NRG; PAM sequence: GAG
tataaaagtaaatacagata

SEQ ID NO: 9638 - DNA, 20 bp, Artificial Sequence
  Description of Artificial Sequence: Synthetic oligonucleotide
  Target: FXN; (-) strand; PAM type: NRG; PAM sequence: TAG
tttataaaagtaaatacaga

SEQ ID NO: 9639 - DNA, 20 bp, Artificial Sequence
  Description of Artificial Sequence: Synthetic oligonucleotide
  Target: FXN; (-) strand; PAM type: NRG; PAM sequence: CAG
gaattttataaaagtaaata

SEQ ID NO: 9640 - DNA, 20 bp, Artificial Sequence
  Description of Artificial Sequence: Synthetic oligonucleotide
  Target: FXN; (-) strand; PAM type: NRG; PAM sequence: AAG
tttaattgtgaattttataa

SEQ ID NO: 9641 - DNA, 20 bp, Artificial Sequence
  Description of Artificial Sequence: Synthetic oligonucleotide
  Target: FXN; (-) strand; PAM type: NRG; PAM sequence: TGG
aggagacatttaagtgtgtt

SEQ ID NO: 9642 - DNA, 20 bp, Artificial Sequence
  Description of Artificial Sequence: Synthetic oligonucleotide
  Target: FXN; (-) strand; PAM type: NRG; PAM sequence: AAG
acccagcctaggagacattt

SEQ ID NO: 9643 - DNA, 20 bp, Artificial Sequence
  Description of Artificial Sequence: Synthetic oligonucleotide
  Target: FXN; (-) strand; PAM type: NRG; PAM sequence: GAG
agcaaccacacccagcctag

SEQ ID NO: 9644 - DNA, 20 bp, Artificial Sequence
  Description of Artificial Sequence: Synthetic oligonucleotide
  Target: FXN; (-) strand; PAM type: NRG; PAM sequence: AGG
tgagcaaccacacccagcct

SEQ ID NO: 9645 - DNA, 20 bp, Artificial Sequence
  Description of Artificial Sequence: Synthetic oligonucleotide
  Target: FXN; (-) strand; PAM type: NRG; PAM sequence: TAG
gtgagcaaccacacccagcc

SEQ ID NO: 9646 - DNA, 20 bp, Artificial Sequence
  Description of Artificial Sequence: Synthetic oligonucleotide
  Target: FXN; (-) strand; PAM type: NRG; PAM sequence: CAG
caggtgtgagcaaccacacc

SEQ ID NO: 9647 - DNA, 20 bp, Artificial Sequence
  Description of Artificial Sequence: Synthetic oligonucleotide
  Target: FXN; (-) strand; PAM type: NRG; PAM sequence: GAG
agtgctgggattacaggtgt

SEQ ID NO: 9648 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctgggattac

SEQ ID NO: 9649 - DNA, 20 bp, Artificial Sequence
  Description of Artificial Sequence: Synthetic oligonucleotide
  Target: FXN; (-) strand; PAM type: NRG; PAM sequence: CAG
ctcccaaagtgctgggatta

SEQ ID NO: 9650 - DNA, 20 bp, Artificial Sequence
  Description of Artificial Sequence: Synthetic oligonucleotide
  Target: FXN; (-) strand; PAM type: NRG; PAM sequence: GGG
tctcagcctcccaaagtgct

SEQ ID NO: 9651 - DNA, 20 bp, Artificial Sequence
  Description of Artificial Sequence: Synthetic oligonucleotide
  Target: FXN; (-) strand; PAM type: NRG; PAM sequence: TGG
atctcagcctcccaaagtgc

SEQ ID NO: 9652 - DNA, 20 bp, Artificial Sequence
  Description of Artificial Sequence: Synthetic oligonucleotide
  Target: FXN; (-) strand; PAM type: NRG; PAM sequence: AAG
ccgcccatctcagcctccca

SEQ ID NO: 9653 - DNA, 20 bp, Artificial Sequence
  Description of Artificial Sequence: Synthetic oligonucleotide
  Target: FXN; (-) strand; PAM type: NRG; PAM sequence: CAG
ctcaggtgatccgcccatct

SEQ ID NO: 9654 - DNA, 20 bp, Artificial Sequence
  Description of Artificial Sequence: Synthetic oligonucleotide
  Target: FXN; (-) strand; PAM type: NRG; PAM sequence: AGG
ggtctcaaactcctgacctc

SEQ ID NO: 9655 - DNA, 20 bp, Artificial Sequence
  Description of Artificial Sequence: Synthetic oligonucleotide
  Target: FXN; (-) strand; PAM type: NRG; PAM sequence: CAG
tggtctcaaactcctgacct

SEQ ID NO: 9656 - DNA, 20 bp, Artificial Sequence
  Description of Artificial Sequence: Synthetic oligonucleotide
  Target: FXN; (-) strand; PAM type: NRG; PAM sequence: TGG
tttcaccatgttggccaggc

SEQ ID NO: 9657 - DNA, 20 bp, Artificial Sequence
  Description of Artificial Sequence: Synthetic oligonucleotide
  Target: FXN; (-) strand; PAM type: NRG; PAM sequence: AGG
ggggtttcaccatgttggcc

SEQ ID NO: 9658 - DNA, 20 bp, Artificial Sequence
  Description of Artificial Sequence: Synthetic oligonucleotide
  Target: FXN; (-) strand; PAM type: NRG; PAM sequence: CAG
cggggtttcaccatgttggc

SEQ ID NO: 9659 - DNA, 20 bp, Artificial Sequence
  Description of Artificial Sequence: Synthetic oligonucleotide
  Target: FXN; (-) strand; PAM type: NRG; PAM sequence: TGG
gagacggggtttcaccatgt

SEQ ID NO: 9660 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagagacg

SEQ ID NO: 9661 - DNA, 20 bp, Artificial Sequence
  Description of Artificial Sequence: Synthetic oligonucleotide
  Target: FXN; (-) strand; PAM type: NRG; PAM sequence: GGG
tttgtatttttagtagagac

SEQ ID NO: 9662 - DNA, 20 bp, Artificial Sequence
  Description of Artificial Sequence: Synthetic oligonucleotide
  Target: FXN; (-) strand; PAM type: NRG; PAM sequence: CGG
ttttgtatttttagtagaga

SEQ ID NO: 9663 - DNA, 20 bp, Artificial Sequence
  Description of Artificial Sequence: Synthetic oligonucleotide
  Target: FXN; (-) strand; PAM type: NRG; PAM sequence: GAG
taatttttgtatttttagta

SEQ ID NO: 9664 - DNA, 20 bp, Artificial Sequence
  Description of Artificial Sequence: Synthetic oligonucleotide
  Target: FXN; (-) strand; PAM type: NRG; PAM sequence: TAG
gctaatttttgtatttttag

SEQ ID NO: 9665 - DNA, 20 bp, Artificial Sequence
  Description of Artificial Sequence: Synthetic oligonucleotide
  Target: FXN; (-) strand; PAM type: NRG; PAM sequence: TAG
ccagctaatttttgtatttt

SEQ ID NO: 9666 - DNA, 20 bp, Artificial Sequence
  Description of Artificial Sequence: Synthetic oligonucleotide
  Target: FXN; (-) strand; PAM type: NRG; PAM sequence: CAG
caggtgagtgccaccacatc

SEQ ID NO: 9667 - DNA, 20 bp, Artificial Sequence
  Description of Artificial Sequence: Synthetic oligonucleotide
  Target: FXN; (-) strand; PAM type: NRG; PAM sequence: GAG
gagtagctgggattacaggt

SEQ ID NO: 9668 - DNA, 20 bp, Artificial Sequence
  Description of Artificial Sequence: Synthetic oligonucleotide
  Target: FXN; (-) strand; PAM type: NRG; PAM sequence: AGG
tcctgagtagctgggattac

SEQ ID NO: 9669 - DNA, 20 bp, Artificial Sequence
  Description of Artificial Sequence: Synthetic oligonucleotide
  Target: FXN; (-) strand; PAM type: NRG; PAM sequence: CAG
ctcctgagtagctgggatta

SEQ ID NO: 9670 - DNA, 20 bp, Artificial Sequence
  Description of Artificial Sequence: Synthetic oligonucleotide
  Target: FXN; (-) strand; PAM type: NRG; PAM sequence: GGG
cctcagcctcctgagtagct

SEQ ID NO: 9671 - DNA, 20 bp, Artificial Sequence
  Description of Artificial Sequence: Synthetic oligonucleotide
  Target: FXN; (-) strand; PAM type: NRG; PAM sequence: TGG
gcctcagcctcctgagtagc

SEQ ID NO: 9672 - DNA, 20 bp, Artificial Sequence
  Description of Artificial Sequence: Synthetic oligonucleotide
  Target: FXN; (-) strand; PAM type: NRG; PAM sequence: TAG
tcctgcctcagcctcctgag

SEQ ID NO: 9673 - DNA, 20 bp, Artificial Sequence
  Description of Artificial Sequence: Synthetic oligonucleotide
  Target: FXN; (-) strand; PAM type: NRG; PAM sequence: GAG
ttatcctgcctcagcctcct

SEQ ID NO: 9674 - DNA, 20 bp, Artificial Sequence
  Description of Artificial Sequence: Synthetic oligonucleotide
  Target: FXN; (-) strand; PAM type: NRG; PAM sequence: CAG
ttcaagcaattatcctgcct

SEQ ID NO: 9675 - DNA, 20 bp, Artificial Sequence
  Description of Artificial Sequence: Synthetic oligonucleotide
  Target: FXN; (-) strand; PAM type: NRG; PAM sequence: AAG
ctccaccacctcccgggttc

SEQ ID NO: 9676 - DNA, 20 bp, Artificial Sequence
  Description of Artificial Sequence: Synthetic oligonucleotide
  Target: FXN; (-) strand; PAM type: NRG; PAM sequence: GGG
tgcaacctccaccacctccc

SEQ ID NO: 9677 - DNA, 20 bp, Artificial Sequence
  Description of Artificial Sequence: Synthetic oligonucleotide
  Target: FXN; (-) strand; PAM type: NRG; PAM sequence: CGG
ctgcaacctccaccacctcc

SEQ ID NO: 9678 - DNA, 20 bp, Artificial Sequence
  Description of Artificial Sequence: Synthetic oligonucleotide
  Target: FXN; (-) strand; PAM type: NRG; PAM sequence: CGG
ggaaggcagtggtgcgatct

SEQ ID NO: 9679 - DNA, 20 bp, Artificial Sequence
  Description of Artificial Sequence: Synthetic oligonucleotide
  Target: FXN; (-) strand; PAM type: NRG; PAM sequence: TGG
tcgcccaggttggaaggcag

SEQ ID NO: 9680 - DNA, 20 bp, Artificial Sequence
  Description of Artificial Sequence: Synthetic oligonucleotide
  Target: FXN; (-) strand; PAM type: NRG; PAM sequence: CAG
ctgtcgcccaggttggaagg

SEQ ID NO: 9681 - DNA, 20 bp, Artificial Sequence
  Description of Artificial Sequence: Synthetic oligonucleotide
  Target: FXN; (-) strand; PAM type: NRG; PAM sequence: AGG
gctctgtcgcccaggttgga

SEQ ID NO: 9682 - DNA, 20 bp, Artificial Sequence
  Description of Artificial Sequence: Synthetic oligonucleotide
  Target: FXN; (-) strand; PAM type: NRG; PAM sequence: AAG
cgctctgtcgcccaggttgg

SEQ ID NO: 9683 - DNA, 20 bp, Artificial Sequence
  Description of Artificial Sequence: Synthetic oligonucleotide
  Target: FXN; (-) strand; PAM type: NRG; PAM sequence: TGG
tctcgctctgtcgcccaggt

SEQ ID NO: 9684 - DNA, 20 bp, Artificial Sequence
  Description of Artificial Sequence: Synthetic oligonucleotide
  Target: FXN; (-) strand; PAM type: NRG; PAM sequence: AGG
ggagtctcgctctgtcgccc

SEQ ID NO: 9685 - DNA, 20 bp, Artificial Sequence
  Description of Artificial Sequence: Synthetic oligonucleotide
  Target: FXN; (-) strand; PAM type: NRG; PAM sequence: CAG
cggagtctcgctctgtcgcc

SEQ ID NO: 9686 - DNA, 20 bp, Artificial Sequence
  Description of Artificial Sequence: Synthetic oligonucleotide
  Target: FXN; (-) strand; PAM type: NRG; PAM sequence: GAG
ttttttttttttttgagacg

SEQ ID NO: 9687 - DNA, 20 bp, Artificial Sequence
  Description of Artificial Sequence: Synthetic oligonucleotide
  Target: FXN; (-) strand; PAM type: NRG; PAM sequence: CGG
ccttttttttttttttgaga

SEQ ID NO: 9688 - DNA, 20 bp, Artificial Sequence
  Description of Artificial Sequence: Synthetic oligonucleotide
  Target: FXN; (-) strand; PAM type: NRG; PAM sequence: GAG
ggagcctttttttttttttt

SEQ ID NO: 9689 - DNA, 20 bp, Artificial Sequence
  Description of Artificial Sequence: Synthetic oligonucleotide
  Target: FXN; (-) strand; PAM type: NRG; PAM sequence: GAG
taaagtaataaagttattag

SEQ ID NO: 9690 - DNA, 20 bp, Artificial Sequence
  Description of Artificial Sequence: Synthetic oligonucleotide
  Target: FXN; (-) strand; PAM type: NRG; PAM sequence: AGG
aataaagtaataaagttatt

SEQ ID NO: 9691 - DNA, 20 bp, Artificial Sequence
  Description of Artificial Sequence: Synthetic oligonucleotide
  Target: FXN; (-) strand; PAM type: NRG; PAM sequence: TAG
taataaagtaataaagttat

SEQ ID NO: 9692 - DNA, 20 bp, Artificial Sequence
  Description of Artificial Sequence: Synthetic oligonucleotide
  Target: FXN; (-) strand; PAM type: NRG; PAM sequence: AAG
gaggtgataataaagtaata

SEQ ID NO: 9693 - DNA, 20 bp, Artificial Sequence
  Description of Artificial Sequence: Synthetic oligonucleotide
  Target: FXN; (-) strand; PAM type: NRG; PAM sequence: AAG
aattatttgaggtgataata

SEQ ID NO: 9694 - DNA, 20 bp, Artificial Sequence
  Description of Artificial Sequence: Synthetic oligonucleotide
  Target: FXN; (-) strand; PAM type: NRG; PAM sequence: AGG
catttaattttaattatttg

SEQ ID NO: 9695 - DNA, 20 bp, Artificial Sequence
  Description of Artificial Sequence: Synthetic oligonucleotide
  Target: FXN; (-) strand; PAM type: NRG; PAM sequence: GAG
tcatttaattttaattattt

SEQ ID NO: 9696 - DNA, 20 bp, Artificial Sequence
  Description of Artificial Sequence: Synthetic oligonucleotide
  Target: FXN; (-) strand; PAM type: NRG; PAM sequence: TGG
ggctaatgggactgaggacc

SEQ ID NO: 9697 - DNA, 20 bp, Artificial Sequence
  Description of Artificial Sequence: Synthetic oligonucleotide
  Target: FXN; (-) strand; PAM type: NRG; PAM sequence: AGG
aaatgtggctaatgggactg

SEQ ID NO: 9698 - DNA, 20 bp, Artificial Sequence
  Description of Artificial Sequence: Synthetic oligonucleotide
  Target: FXN; (-) strand; PAM type: NRG; PAM sequence: GAG
gaaatgtggctaatgggact

SEQ ID NO: 9699 - DNA, 20 bp, Artificial Sequence
  Description of Artificial Sequence: Synthetic oligonucleotide
  Target: FXN; (-) strand; PAM type: NRG; PAM sequence: GGG
gcactagaaatgtggctaat

SEQ ID NO: 9700 - DNA, 20 bp, Artificial Sequence
  Description of Artificial Sequence: Synthetic oligonucleotide
  Target: FXN; (-) strand; PAM type: NRG; PAM sequence: TGG
agcactagaaatgtggctaa

SEQ ID NO: 9701 - DNA, 20 bp, Artificial Sequence
  Description of Artificial Sequence: Synthetic oligonucleotide
  Target: FXN; (-) strand; PAM type: NRG; PAM sequence: TGG
gctactgagcactagaaatg

SEQ ID NO: 9702 - DNA, 20 bp, Artificial Sequence
  Description of Artificial Sequence: Synthetic oligonucleotide
  Target: FXN; (-) strand; PAM type: NRG; PAM sequence: TAG
cccccgtggctactgagcac

SEQ ID NO: 9703 - DNA, 20 bp, Artificial Sequence
  Description of Artificial Sequence: Synthetic oligonucleotide
  Target: FXN; (-) strand; PAM type: NRG; PAM sequence: GAG
caccagcccccgtggctact

SEQ ID NO: 9704 - DNA, 20 bp, Artificial Sequence
  Description of Artificial Sequence: Synthetic oligonucleotide
  Target: FXN; (-) strand; PAM type: NRG; PAM sequence: TGG
gtggtggtcaccagcccccg

SEQ ID NO: 9705 - DNA, 20 bp, Artificial Sequence
  Description of Artificial Sequence: Synthetic oligonucleotide
  Target: FXN; (-) strand; PAM type: NRG; PAM sequence: CAG
ctgtcccatgtggtggtcac

SEQ ID NO: 9706 - DNA, 20 bp, Artificial Sequence
  Description of Artificial Sequence: Synthetic oligonucleotide
  Target: FXN; (-) strand; PAM type: NRG; PAM sequence: TGG
aaatatgctgtcccatgtgg

SEQ ID NO: 9707 - DNA, 20 bp, Artificial Sequence
  Description of Artificial Sequence: Synthetic oligonucleotide
  Target: FXN; (-) strand; PAM type: NRG; PAM sequence: TGG
actaaatatgctgtcccatg

SEQ ID NO: 9708 - DNA, 20 bp, Artificial Sequence
  Description of Artificial Sequence: Synthetic oligonucleotide
  Target: FXN; (-) strand; PAM type: NRG; PAM sequence: AGG
agatctgagaaccaatgatc

SEQ ID NO: 9709 - DNA, 20 bp, Artificial Sequence
  Description of Artificial Sequence: Synthetic oligonucleotide
  Target: FXN; (-) strand; PAM type: NRG; PAM sequence: CAG
cagatctgagaaccaatgat

SEQ ID NO: 9710 - DNA, 20 bp, Artificial Sequence
  Description of Artificial Sequence: Synthetic oligonucleotide
  Target: FXN; (-) strand; PAM type: NRG; PAM sequence: GAG
tctgctgagtagccagatct

SEQ ID NO: 9711 - DNA, 20 bp, Artificial Sequence
  Description of Artificial Sequence: Synthetic oligonucleotide
  Target: FXN; (-) strand; PAM type: NRG; PAM sequence: CAG
tcttggttctgctgagtagc

SEQ ID NO: 9712 - DNA, 20 bp, Artificial Sequence
  Description of Artificial Sequence: Synthetic oligonucleotide
  Target: FXN; (-) strand; PAM type: NRG; PAM sequence: TAG
ggattcttggttctgctgag

SEQ ID NO: 9713 - DNA, 20 bp, Artificial Sequence
  Description of Artificial Sequence: Synthetic oligonucleotide
  Target: FXN; (-) strand; PAM type: NRG; PAM sequence: GAG
tgtggattcttggttctgct

SEQ ID NO: 9714 - DNA, 20 bp, Artificial Sequence
  Description of Artificial Sequence: Synthetic oligonucleotide
  Target: FXN; (-) strand; PAM type: NRG; PAM sequence: TGG
aagccgtttctgtggattct

SEQ ID NO: 9715 - DNA, 20 bp, Artificial Sequence
  Description of Artificial Sequence: Synthetic oligonucleotide
  Target: FXN; (-) strand; PAM type: NRG; PAM sequence: TGG
gcttttaaaagccgtttctg

SEQ ID NO: 9716 - DNA, 20 bp, Artificial Sequence
  Description of Artificial Sequence: Synthetic oligonucleotide
  Target: FXN; (-) strand; PAM type: NRG; PAM sequence: AAG
ctgtggggctgtgcttttaa

SEQ ID NO: 9717 - DNA, 20 bp, Artificial Sequence
  Description of Artificial Sequence: Synthetic oligonucleotide
  Target: FXN; (-) strand; PAM type: NRG; PAM sequence: GGG
ggctggggctgggggctgtg

SEQ ID NO: 9718 - DNA, 20 bp, Artificial Sequence
  Description of Artificial Sequence: Synthetic oligonucleotide
  Target: FXN; (-) strand; PAM type: NRG; PAM sequence: GGG
aggctggggctgggggctgt

SEQ ID NO: 9719 - DNA, 20 bp, Artificial Sequence
  Description of Artificial Sequence: Synthetic oligonucleotide
  Target: FXN; (-) strand; PAM type: NRG; PAM sequence: TGG
aaggctggggctgggggctg

SEQ ID NO: 9720 - DNA, 20 bp, Artificial Sequence
  Description of Artificial Sequence: Synthetic oligonucleotide
  Target: FXN; (-) strand; PAM type: NRG; PAM sequence: GGG
gtaggtaaggctggggctgg

SEQ ID NO: 9721 - DNA, 20 bp, Artificial Sequence
  Description of Artificial Sequence: Synthetic oligonucleotide
  Target: FXN; (-) strand; PAM type: NRG; PAM sequence: GGG
ggtaggtaaggctggggctg

SEQ ID NO: 9722 - DNA, 20 bp, Artificial Sequence
  Description of Artificial Sequence: Synthetic oligonucleotide
  Target: FXN; (-) strand; PAM type: NRG; PAM sequence: GGG
aggtaggtaaggctggggct

SEQ ID NO: 9723 - DNA, 20 bp, Artificial Sequence
  Description of Artificial Sequence: Synthetic oligonucleotide
  Target: FXN; (-) strand; PAM type: NRG; PAM sequence: TGG
caggtaggtaaggctggggc

SEQ ID NO: 9724 - DNA, 20 bp, Artificial Sequence
  Description of Artificial Sequence: Synthetic oligonucleotide
  Target: FXN; (-) strand; PAM type: NRG; PAM sequence: GGG
cctccaggtaggtaaggctg

SEQ ID NO: 9725 - DNA, 20 bp, Artificial Sequence
  Description of Artificial Sequence: Synthetic oligonucleotide
  Target: FXN; (-) strand; PAM type: NRG; PAM sequence: GGG
gcctccaggtaggtaaggct

SEQ ID NO: 9726 - DNA, 20 bp, Artificial Sequence
  Description of Artificial Sequence: Synthetic oligonucleotide
  Target: FXN; (-) strand; PAM type: NRG; PAM sequence: TGG
agcctccaggtaggtaaggc

SEQ ID NO: 9727 - DNA, 20 bp, Artificial Sequence
  Description of Artificial Sequence: Synthetic oligonucleotide
  Target: FXN; (-) strand; PAM type: NRG; PAM sequence: AGG
tcccagcctccaggtaggta

SEQ ID NO: 9728 - DNA, 20 bp, Artificial Sequence
  Description of Artificial Sequence: Synthetic oligonucleotide
  Target: FXN; (-) strand; PAM type: NRG; PAM sequence: AAG
ttcccagcctccaggtaggt

SEQ ID NO: 9729 - DNA, 20 bp, Artificial Sequence
  Description of Artificial Sequence: Synthetic oligonucleotide
  Target: FXN; (-) strand; PAM type: NRG; PAM sequence: AGG
gtccttcccagcctccaggt

SEQ ID NO: 9730 - DNA, 20 bp, Artificial Sequence
  Description of Artificial Sequence: Synthetic oligonucleotide
  Target: FXN; (-) strand; PAM type: NRG; PAM sequence: TAG
agtccttcccagcctccagg

SEQ ID NO: 9731 - DNA, 20 bp, Artificial Sequence
  Description of Artificial Sequence: Synthetic oligonucleotide
  Target: FXN; (-) strand; PAM type: NRG; PAM sequence: AGG
cagagtccttcccagcctcc

SEQ ID NO: 9732 - DNA, 20 bp, Artificial Sequence
  Description of Artificial Sequence: Synthetic oligonucleotide
  Target: FXN; (-) strand; PAM type: NRG; PAM sequence: CAG
tcagagtccttcccagcctc

SEQ ID NO: 9733 - DNA, 20 bp, Artificial Sequence
  Description of Artificial Sequence: Synthetic oligonucleotide
  Target: FXN; (-) strand; PAM type: NRG; PAM sequence: CAG
cgtggaatcagagtccttcc

SEQ ID NO: 9734 - DNA, 20 bp, Artificial Sequence
  Description of Artificial Sequence: Synthetic oligonucleotide
  Target: FXN; (-) strand; PAM type: NRG; PAM sequence: GAG
taggctgcctcgtggaatca

SEQ ID NO: 9735 - DNA, 20 bp, Artificial Sequence
  Description of Artificial Sequence: Synthetic oligonucleotide
  Target: FXN; (-) strand; PAM type: NRG; PAM sequence: CAG
cataggctgcctcgtggaat

SEQ ID NO: 9736 - DNA, 20 bp, Artificial Sequence
  Description of Artificial Sequence: Synthetic oligonucleotide
  Target: FXN; (-) strand; PAM type: NRG; PAM sequence: TGG
aaaaaacataggctgcctcg

SEQ ID NO: 9737 - DNA, 20 bp, Artificial Sequence
  Description of Artificial Sequence: Synthetic oligonucleotide
  Target: FXN; (-) strand; PAM type: NRG; PAM sequence: AGG
atccctccatcaaaaaacat

SEQ ID NO: 9738 - DNA, 20 bp, Artificial Sequence
  Description of Artificial Sequence: Synthetic oligonucleotide
  Target: FXN; (-) strand; PAM type: NRG; PAM sequence: TAG
catccctccatcaaaaaaca

SEQ ID NO: 9739 - DNA, 20 bp, Artificial Sequence
  Description of Artificial Sequence: Synthetic oligonucleotide
  Target: FXN; (-) strand; PAM type: NRG; PAM sequence: CAG
aagaggaaacgttaaagatg

SEQ ID NO: 9740 - DNA, 20 bp, Artificial Sequence
  Description of Artificial Sequence: Synthetic oligonucleotide
  Target: FXN; (-) strand; PAM type: NRG; PAM sequence: AAG
gtatttaagaggaaacgtta

SEQ ID NO: 9741 - DNA, 20 bp, Artificial Sequence
  Description of Artificial Sequence: Synthetic oligonucleotide
  Target: FXN; (-) strand; PAM type: NRG; PAM sequence: AGG
agctgtctccagtatttaag

SEQ ID NO: 9742 - DNA, 20 bp, Artificial Sequence
  Description of Artificial Sequence: Synthetic oligonucleotide
  Target: FXN; (-) strand; PAM type: NRG; PAM sequence: GAG
aagctgtctccagtatttaa

SEQ ID NO: 9743 - DNA, 20 bp, Artificial Sequence
  Description of Artificial Sequence: Synthetic oligonucleotide
  Target: FXN; (-) strand; PAM type: NRG; PAM sequence: AAG
cgaagctgtctccagtattt

SEQ ID NO: 9744 - DNA, 20 bp, Artificial Sequence
  Description of Artificial Sequence: Synthetic oligonucleotide
  Target: FXN; (-) strand; PAM type: NRG; PAM sequence: CAG
ctcctcctcgaagctgtctc

SEQ ID NO: 9745 - DNA, 20 bp, Artificial Sequence
  Description of Artificial Sequence: Synthetic oligonucleotide
  Target: FXN; (-) strand; PAM type: NRG; PAM sequence: AAG
atccagttatctcctcctcg

SEQ ID NO: 9746 - DNA, 20 bp, Artificial Sequence
  Description of Artificial Sequence: Synthetic oligonucleotide
  Target: FXN; (-) strand; PAM type: NRG; PAM sequence: CAG
caaatggactaagacacatc

SEQ ID NO: 9747 - DNA, 20 bp, Artificial Sequence
  Description of Artificial Sequence: Synthetic oligonucleotide
  Target: FXN; (-) strand; PAM type: NRG; PAM sequence: AAG
atccctccatcaaatggact

SEQ ID NO: 9748 - DNA, 20 bp, Artificial Sequence
  Description of Artificial Sequence: Synthetic oligonucleotide
  Target: FXN; (-) strand; PAM type: NRG; PAM sequence: TGG
cgtcacatccctccatcaaa

SEQ ID NO: 9749 - DNA, 20 bp, Artificial Sequence
  Description of Artificial Sequence: Synthetic oligonucleotide
  Target: FXN; (-) strand; PAM type: NRG; PAM sequence: CAG
aagaggaaacgttaaagacg

SEQ ID NO: 9750 - DNA, 20 bp, Artificial Sequence
  Description of Artificial Sequence: Synthetic oligonucleotide
  Target: FXN; (-) strand; PAM type: NRG; PAM sequence: AAG
gtatttaagaggaaacgtta

SEQ ID NO: 9751 - DNA, 20 bp, Artificial Sequence
  Description of Artificial Sequence: Synthetic oligonucleotide
  Target: FXN; (-) strand; PAM type: NRG; PAM sequence: AGG
agctgtctccggtatttaag

SEQ ID NO: 9752 - DNA, 20 bp, Artificial Sequence
  Description of Artificial Sequence: Synthetic oligonucleotide
  Target: FXN; (-) strand; PAM type: NRG; PAM sequence: GAG
aagctgtctccggtatttaa

SEQ ID NO: 9753 - DNA, 20 bp, Artificial Sequence
  Description of Artificial Sequence: Synthetic oligonucleotide
  Target: FXN; (-) strand; PAM type: NRG; PAM sequence: AAG
cgaagctgtctccggtattt

SEQ ID NO: 9754 - DNA, 20 bp, Artificial Sequence
  Description of Artificial Sequence: Synthetic oligonucleotide
  Target: FXN; (-) strand; PAM type: NRG; PAM sequence: CGG
ctccttctcgaagctgtctc

SEQ ID NO: 9755 - DNA, 20 bp, Artificial Sequence
  Description of Artificial Sequence: Synthetic oligonucleotide
  Target: FXN; (-) strand; PAM type: NRG; PAM sequence: AAG
atccagttatctccttctcg

SEQ ID NO: 9756 - DNA, 20 bp, Artificial Sequence
  Description of Artificial Sequence: Synthetic oligonucleotide
  Target: FXN; (-) strand; PAM type: NRG; PAM sequence: CAG
aaaatggactaagaaacatc

SEQ ID NO: 9757 - DNA, 20 bp, Artificial Sequence
  Description of Artificial Sequence: Synthetic oligonucleotide
  Target: FXN; (-) strand; PAM type: NRG; PAM sequence: AAG
caagcaacagaaaatggact

SEQ ID NO: 9758 - DNA, 20 bp, Artificial Sequence
  Description of Artificial Sequence: Synthetic oligonucleotide
  Target: FXN; (-) strand; PAM type: NRG; PAM sequence: TGG
ctgtcacaagcaacagaaaa

SEQ ID NO: 9759 - DNA, 20 bp, Artificial Sequence
  Description of Artificial Sequence: Synthetic oligonucleotide
  Target: FXN; (-) strand; PAM type: NRG; PAM sequence: CAG
aggtattctgtcacaagcaa

SEQ ID NO: 9760 - DNA, 20 bp, Artificial Sequence
  Description of Artificial Sequence: Synthetic oligonucleotide
  Target: FXN; (-) strand; PAM type: NRG; PAM sequence: AAG
agtttcaggtattctgtcac

SEQ ID NO: 9761 - DNA, 20 bp, Artificial Sequence
  Description of Artificial Sequence: Synthetic oligonucleotide
  Target: FXN; (-) strand; PAM type: NRG; PAM sequence: AGG
catataaattgcccagtttc

SEQ ID NO: 9762 - DNA, 20 bp, Artificial Sequence
  Description of Artificial Sequence: Synthetic oligonucleotide
  Target: FXN; (-) strand; PAM type: NRG; PAM sequence: CAG
ccatataaattgcccagttt

SEQ ID NO: 9763 - DNA, 20 bp, Artificial Sequence
  Description of Artificial Sequence: Synthetic oligonucleotide
  Target: FXN; (-) strand; PAM type: NRG; PAM sequence: CAG
tttttaccatataaattgcc

SEQ ID NO: 9764 - DNA, 20 bp, Artificial Sequence
  Description of Artificial Sequence: Synthetic oligonucleotide
  Target: FXN; (-) strand; PAM type: NRG; PAM sequence: AAG
tcagcctccagagcagtaag

SEQ ID NO: 9765 - DNA, 20 bp, Artificial Sequence
  Description of Artificial Sequence: Synthetic oligonucleotide
  Target: FXN; (-) strand; PAM type: NRG; PAM sequence: AAG
ttctcagcctccagagcagt

SEQ ID NO: 9766 - DNA, 20 bp, Artificial Sequence
  Description of Artificial Sequence: Synthetic oligonucleotide
  Target: FXN; (-) strand; PAM type: NRG; PAM sequence: CAG
ggacttctcagcctccagag

SEQ ID NO: 9767 - DNA, 20 bp, Artificial Sequence
  Description of Artificial Sequence: Synthetic oligonucleotide
  Target: FXN; (-) strand; PAM type: NRG; PAM sequence: GAG
tttggacttctcagcctcca

SEQ ID NO: 9768 - DNA, 20 bp, Artificial Sequence
  Description of Artificial Sequence: Synthetic oligonucleotide
  Target: FXN; (-) strand; PAM type: NRG; PAM sequence: CAG
actttggacttctcagcctc

SEQ ID NO: 9769 - DNA, 20 bp, Artificial Sequence
  Description of Artificial Sequence: Synthetic oligonucleotide
  Target: FXN; (-) strand; PAM type: NRG; PAM sequence: CAG
ggacttgactttggacttct

SEQ ID NO: 9770 - DNA, 20 bp, Artificial Sequence
  Description of Artificial Sequence: Synthetic oligonucleotide
  Target: FXN; (-) strand; PAM type: NRG; PAM sequence: TGG
agcaagaagggacttgactt

SEQ ID NO: 9771 - DNA, 20 bp, Artificial Sequence
  Description of Artificial Sequence: Synthetic oligonucleotide
  Target: FXN; (-) strand; PAM type: NRG; PAM sequence: GGG
aaagtccccaccagcaagaa

SEQ ID NO: 9772 - DNA, 20 bp, Artificial Sequence
  Description of Artificial Sequence: Synthetic oligonucleotide
  Target: FXN; (-) strand; PAM type: NRG; PAM sequence: AGG
caaagtccccaccagcaaga

SEQ ID NO: 9773 - DNA, 20 bp, Artificial Sequence
  Description of Artificial Sequence: Synthetic oligonucleotide
  Target: FXN; (-) strand; PAM type: NRG; PAM sequence: AAG
gcaaagtccccaccagcaag

SEQ ID NO: 9774 - DNA, 20 bp, Artificial Sequence
  Description of Artificial Sequence: Synthetic oligonucleotide
  Target: FXN; (-) strand; PAM type: NRG; PAM sequence: AAG
tctgcaaagtccccaccagc

SEQ ID NO: 9775 - DNA, 20 bp, Artificial Sequence
  Description of Artificial Sequence: Synthetic oligonucleotide
  Target: FXN; (-) strand; PAM type: NRG; PAM sequence: CAG
atactctgcaaagtccccac

SEQ ID NO: 9776 - DNA, 20 bp, Artificial Sequence
  Description of Artificial Sequence: Synthetic oligonucleotide
  Target: FXN; (-) strand; PAM type: NRG; PAM sequence: AAG
tgccgcctcaatactctgca

SEQ ID NO: 9777 - DNA, 20 bp, Artificial Sequence
  Description of Artificial Sequence: Synthetic oligonucleotide
  Target: FXN; (-) strand; PAM type: NRG; PAM sequence: CGG
gccccttaccatatgacgcc

SEQ ID NO: 9778 - DNA, 20 bp, Artificial Sequence
  Description of Artificial Sequence: Synthetic oligonucleotide
  Target: FXN; (-) strand; PAM type: NRG; PAM sequence: CAG
gacacctgaggtagcacact

SEQ ID NO: 9779 - DNA, 20 bp, Artificial Sequence
  Description of Artificial Sequence: Synthetic oligonucleotide
  Target: FXN; (-) strand; PAM type: NRG; PAM sequence: TAG
aaagaaaaagacacctgagg

SEQ ID NO: 9780 - DNA, 20 bp, Artificial Sequence
  Description of Artificial Sequence: Synthetic oligonucleotide
  Target: FXN; (-) strand; PAM type: NRG; PAM sequence: AGG
agaaaagaaaaagacacctg

SEQ ID NO: 9781 - DNA, 20 bp, Artificial Sequence
  Description of Artificial Sequence: Synthetic oligonucleotide
  Target: FXN; (-) strand; PAM type: NRG; PAM sequence: GAG
aagaaaagaaaaagacacct

SEQ ID NO: 9782 - DNA, 20 bp, Artificial Sequence
  Description of Artificial Sequence: Synthetic oligonucleotide
  Target: FXN; (-) strand; PAM type: NRG; PAM sequence: AAG
aggctttataagaaaagaaa

SEQ ID NO: 9783 - DNA, 20 bp, Artificial Sequence
  Description of Artificial Sequence: Synthetic oligonucleotide
  Target: FXN; (-) strand; PAM type: NRG; PAM sequence: AAG
ctagttaggctttataagaa

SEQ ID NO: 9784 - DNA, 20 bp, Artificial Sequence
  Description of Artificial Sequence: Synthetic oligonucleotide
  Target: FXN; (-) strand; PAM type: NRG; PAM sequence: AAG
tgaaactagttaggctttat

SEQ ID NO: 9785 - DNA, 20 bp, Artificial Sequence
  Description of Artificial Sequence: Synthetic oligonucleotide
  Target: FXN; (-) strand; PAM type: NRG; PAM sequence: AGG
tcatgggagtgaaactagtt

SEQ ID NO: 9786 - DNA, 20 bp, Artificial Sequence
  Description of Artificial Sequence: Synthetic oligonucleotide
  Target: FXN; (-) strand; PAM type: NRG; PAM sequence: TAG
atcatgggagtgaaactagt

SEQ ID NO: 9787 - DNA, 20 bp, Artificial Sequence
  Description of Artificial Sequence: Synthetic oligonucleotide
  Target: FXN; (-) strand; PAM type: NRG; PAM sequence: TAG
ggttatcatgggagtgaaac

SEQ ID NO: 9788 - DNA, 20 bp, Artificial Sequence
  Description of Artificial Sequence: Synthetic oligonucleotide
  Target: FXN; (-) strand; PAM type: NRG; PAM sequence: GAG
agattaatgggttatcatgg

SEQ ID NO: 9789 - DNA, 20 bp, Artificial Sequence
  Description of Artificial Sequence: Synthetic oligonucleotide
  Target: FXN; (-) strand; PAM type: NRG; PAM sequence: GGG
atagattaatgggttatcat

SEQ ID NO: 9790 - DNA, 20 bp, Artificial Sequence
  Description of Artificial Sequence: Synthetic oligonucleotide
  Target: FXN; (-) strand; PAM type: NRG; PAM sequence: TGG
catagattaatgggttatca

SEQ ID NO: 9791 - DNA, 20 bp, Artificial Sequence
  Description of Artificial Sequence: Synthetic oligonucleotide
  Target: FXN; (-) strand; PAM type: NRG; PAM sequence: GGG
taatccattcatagattaat

SEQ ID NO: 9792 - DNA, 20 bp, Artificial Sequence
  Description of Artificial Sequence: Synthetic oligonucleotide
  Target: FXN; (-) strand; PAM type: NRG; PAM sequence: TGG
ttaatccattcatagattaa

SEQ ID NO: 9793 - DNA, 20 bp, Artificial Sequence
  Description of Artificial Sequence: Synthetic oligonucleotide
  Target: FXN; (-) strand; PAM type: NRG; PAM sequence: TAG
ataatggattaatccattca

SEQ ID NO: 9794 - DNA, 20 bp, Artificial Sequence
  Description of Artificial Sequence: Synthetic oligonucleotide
  Target: FXN; (-) strand; PAM type: NRG; PAM sequence: TGG
gaaggttcttccctcaataa

SEQ ID NO: 9795 - DNA, 20 bp, Artificial Sequence
  Description of Artificial Sequence: Synthetic oligonucleotide
  Target: FXN; (-) strand; PAM type: NRG; PAM sequence: AGG
aagcggtgactgggtcatga

SEQ ID NO: 9796 - DNA, 20 bp, Artificial Sequence
  Description of Artificial Sequence: Synthetic oligonucleotide
  Target: FXN; (-) strand; PAM type: NRG; PAM sequence: AAG
taagcggtgactgggtcatg

SEQ ID NO: 9797 - DNA, 20 bp, Artificial Sequence
  Description of Artificial Sequence: Synthetic oligonucleotide
  Target: FXN; (-) strand; PAM type: NRG; PAM sequence: GGG
ggggcctttaagcggtgact

SEQ ID NO: 9798 - DNA, 20 bp, Artificial Sequence
  Description of Artificial Sequence: Synthetic oligonucleotide
  Target: FXN; (-) strand; PAM type: NRG; PAM sequence: TGG
tggggcctttaagcggtgac

SEQ ID NO: 9799 - DNA, 20 bp, Artificial Sequence
  Description of Artificial Sequence: Synthetic oligonucleotide
  Target: FXN; (-) strand; PAM type: NRG; PAM sequence: CGG
tgagaggtggggcctttaag

SEQ ID NO: 9800 - DNA, 20 bp, Artificial Sequence
  Description of Artificial Sequence: Synthetic oligonucleotide
  Target: FXN; (-) strand; PAM type: NRG; PAM sequence: AAG
tattgagaggtggggccttt

SEQ ID NO: 9801 - DNA, 20 bp, Artificial Sequence
  Description of Artificial Sequence: Synthetic oligonucleotide
  Target: FXN; (-) strand; PAM type: NRG; PAM sequence: GGG
tgtggcagtattgagaggtg

SEQ ID NO: 9802 - DNA, 20 bp, Artificial Sequence
  Description of Artificial Sequence: Synthetic oligonucleotide
  Target: FXN; (-) strand; PAM type: NRG; PAM sequence: GGG
atgtggcagtattgagaggt

SEQ ID NO: 9803 - DNA, 20 bp, Artificial Sequence
  Description of Artificial Sequence: Synthetic oligonucleotide
  Target: FXN; (-) strand; PAM type: NRG; PAM sequence: TGG
gatgtggcagtattgagagg

SEQ ID NO: 9804 - DNA, 20 bp, Artificial Sequence
  Description of Artificial Sequence: Synthetic oligonucleotide
  Target: FXN; (-) strand; PAM type: NRG; PAM sequence: AGG
cccgatgtggcagtattgag

SEQ ID NO: 9805 - DNA, 20 bp, Artificial Sequence
  Description of Artificial Sequence: Synthetic oligonucleotide
  Target: FXN; (-) strand; PAM type: NRG; PAM sequence: GAG
tcccgatgtggcagtattga

SEQ ID NO: 9806 - DNA, 20 bp, Artificial Sequence
  Description of Artificial Sequence: Synthetic oligonucleotide
  Target: FXN; (-) strand; PAM type: NRG; PAM sequence: GAG
attcccgatgtggcagtatt

SEQ ID NO: 9807 - DNA, 20 bp, Artificial Sequence
  Description of Artificial Sequence: Synthetic oligonucleotide
  Target: FXN; (-) strand; PAM type: NRG; PAM sequence: CAG
aaacttaattcccgatgtgg

SEQ ID NO: 9808 - DNA, 20 bp, Artificial Sequence
  Description of Artificial Sequence: Synthetic oligonucleotide
  Target: FXN; (-) strand; PAM type: NRG; PAM sequence: TGG
ttgaaacttaattcccgatg

SEQ ID NO: 9809 - DNA, 20 bp, Artificial Sequence
  Description of Artificial Sequence: Synthetic oligonucleotide
  Target: FXN; (-) strand; PAM type: NRG; PAM sequence: TGG
atttaagagacagcatgcta

SEQ ID NO: 9810 - DNA, 20 bp, Artificial Sequence
  Description of Artificial Sequence: Synthetic oligonucleotide
  Target: FXN; (-) strand; PAM type: NRG; PAM sequence: CAG
ttattgagtcatttaagaga

SEQ ID NO: 9811 - DNA, 20 bp, Artificial Sequence
  Description of Artificial Sequence: Synthetic oligonucleotide
  Target: FXN; (-) strand; PAM type: NRG; PAM sequence: GAG
gagcttattgagtcatttaa

SEQ ID NO: 9812 - DNA, 20 bp, Artificial Sequence
  Description of Artificial Sequence: Synthetic oligonucleotide
  Target: FXN; (-) strand; PAM type: NRG; PAM sequence: AAG
aggagcttattgagtcattt

SEQ ID NO: 9813 - DNA, 20 bp, Artificial Sequence
  Description of Artificial Sequence: Synthetic oligonucleotide
  Target: FXN; (-) strand; PAM type: NRG; PAM sequence: GAG
ggatgccacaggagcttatt

SEQ ID NO: 9814 - DNA, 20 bp, Artificial Sequence
  Description of Artificial Sequence: Synthetic oligonucleotide
  Target: FXN; (-) strand; PAM type: NRG; PAM sequence: GAG
tgcagaagtggatgccacag

SEQ ID NO: 9815 - DNA, 20 bp, Artificial Sequence
  Description of Artificial Sequence: Synthetic oligonucleotide
  Target: FXN; (-) strand; PAM type: NRG; PAM sequence: AGG
catgcagaagtggatgccac

SEQ ID NO: 9816 - DNA, 20 bp, Artificial Sequence
  Description of Artificial Sequence: Synthetic oligonucleotide
  Target: FXN; (-) strand; PAM type: NRG; PAM sequence: CAG
gcatgcagaagtggatgcca

SEQ ID NO: 9817 - DNA, 20 bp, Artificial Sequence
  Description of Artificial Sequence: Synthetic oligonucleotide
  Target: FXN; (-) strand; PAM type: NRG; PAM sequence: TGG
ctgcccaaggcatgcagaag

SEQ ID NO: 9818 - DNA, 20 bp, Artificial Sequence
  Description of Artificial Sequence: Synthetic oligonucleotide
  Target: FXN; (-) strand; PAM type: NRG; PAM sequence: AAG
aagctgcccaaggcatgcag

SEQ ID NO: 9819 - DNA, 20 bp, Artificial Sequence
  Description of Artificial Sequence: Synthetic oligonucleotide
  Target: FXN; (-) strand; PAM type: NRG; PAM sequence: CAG
taaaagctgcccaaggcatg

SEQ ID NO: 9820 - DNA, 20 bp, Artificial Sequence
  Description of Artificial Sequence: Synthetic oligonucleotide
  Target: FXN; (-) strand; PAM type: NRG; PAM sequence: AGG
agatgtctaaaagctgccca

SEQ ID NO: 9821 - DNA, 20 bp, Artificial Sequence
  Description of Artificial Sequence: Synthetic oligonucleotide
  Target: FXN; (-) strand; PAM type: NRG; PAM sequence: AAG
cagatgtctaaaagctgccc

SEQ ID NO: 9822 - DNA, 20 bp, Artificial Sequence
  Description of Artificial Sequence: Synthetic oligonucleotide
  Target: FXN; (-) strand; PAM type: NRG; PAM sequence: AAG
gaaaatggacagatgtctaa

SEQ ID NO: 9823 - DNA, 20 bp, Artificial Sequence
  Description of Artificial Sequence: Synthetic oligonucleotide
  Target: FXN; (-) strand; PAM type: NRG; PAM sequence: CAG
tgtccctctaggaaaatgga

SEQ ID NO: 9824 - DNA, 20 bp, Artificial Sequence
  Description of Artificial Sequence: Synthetic oligonucleotide
  Target: FXN; (-) strand; PAM type: NRG; PAM sequence: TGG
gtcttgtccctctaggaaaa

SEQ ID NO: 9825 - DNA, 20 bp, Artificial Sequence
  Description of Artificial Sequence: Synthetic oligonucleotide
  Target: FXN; (-) strand; PAM type: NRG; PAM sequence: AGG
ggtggtggtcttgtccctct

SEQ ID NO: 9826 - DNA, 20 bp, Artificial Sequence
  Description of Artificial Sequence: Synthetic oligonucleotide
  Target: FXN; (-) strand; PAM type: NRG; PAM sequence: TAG
aggtggtggtcttgtccctc

SEQ ID NO: 9827 - DNA, 20 bp, Artificial Sequence
  Description of Artificial Sequence: Synthetic oligonucleotide
  Target: FXN; (-) strand; PAM type: NRG; PAM sequence: TGG
ggtcataggatcacaggtgg

SEQ ID NO: 9828 - DNA, 20 bp, Artificial Sequence
  Description of Artificial Sequence: Synthetic oligonucleotide
  Target: FXN; (-) strand; PAM type: NRG; PAM sequence: TGG
aaaggtcataggatcacagg

SEQ ID NO: 9829 - DNA, 20 bp, Artificial Sequence
  Description of Artificial Sequence: Synthetic oligonucleotide
  Target: FXN; (-) strand; PAM type: NRG; PAM sequence: AGG
ccaaaaggtcataggatcac

SEQ ID NO: 9830 - DNA, 20 bp, Artificial Sequence
  Description of Artificial Sequence: Synthetic oligonucleotide
  Target: FXN; (-) strand; PAM type: NRG; PAM sequence: CAG
gccaaaaggtcataggatca

SEQ ID NO: 9831 - DNA, 20 bp, Artificial Sequence
  Description of Artificial Sequence: Synthetic oligonucleotide
  Target: FXN; (-) strand; PAM type: NRG; PAM sequence: AGG
gcctaaagccaaaaggtcat

SEQ ID NO: 9832 - DNA, 20 bp, Artificial Sequence
  Description of Artificial Sequence: Synthetic oligonucleotide
  Target: FXN; (-) strand; PAM type: NRG; PAM sequence: TAG
ggcctaaagccaaaaggtca

SEQ ID NO: 9833 - DNA, 20 bp, Artificial Sequence
  Description of Artificial Sequence: Synthetic oligonucleotide
  Target: FXN; (-) strand; PAM type: NRG; PAM sequence: AGG
ttgttaggcctaaagccaaa

SEQ ID NO: 9834 - DNA, 20 bp, Artificial Sequence
  Description of Artificial Sequence: Synthetic oligonucleotide
  Target: FXN; (-) strand; PAM type: NRG; PAM sequence: AAG
cttgttaggcctaaagccaa

SEQ ID NO: 9835 - DNA, 20 bp, Artificial Sequence
  Description of Artificial Sequence: Synthetic oligonucleotide
  Target: FXN; (-) strand; PAM type: NRG; PAM sequence: AAG
taacctgcttgttaggccta

SEQ ID NO: 9836 - DNA, 20 bp, Artificial Sequence
  Description of Artificial Sequence: Synthetic oligonucleotide
  Target: FXN; (-) strand; PAM type: NRG; PAM sequence: AGG
gagggtataacctgcttgtt

SEQ ID NO: 9837 - DNA, 20 bp, Artificial Sequence
  Description of Artificial Sequence: Synthetic oligonucleotide
  Target: FXN; (-) strand; PAM type: NRG; PAM sequence: TAG
tgagggtataacctgcttgt

SEQ ID NO: 9838 - DNA, 20 bp, Artificial Sequence
  Description of Artificial Sequence: Synthetic oligonucleotide
  Target: FXN; (-) strand; PAM type: NRG; PAM sequence: GGG
aatgatttgaaagtgagtga

SEQ ID NO: 9839 - DNA, 20 bp, Artificial Sequence
  Description of Artificial Sequence: Synthetic oligonucleotide
  Target: FXN; (-) strand; PAM type: NRG; PAM sequence: AGG
aaatgatttgaaagtgagtg

SEQ ID NO: 9840 - DNA, 20 bp, Artificial Sequence
  Description of Artificial Sequence: Synthetic oligonucleotide
  Target: FXN; (-) strand; PAM type: NRG; PAM sequence: GAG
aaaatgatttgaaagtgagt

SEQ ID NO: 9841 - DNA, 20 bp, Artificial Sequence
  Description of Artificial Sequence: Synthetic oligonucleotide
  Target: FXN; (-) strand; PAM type: NRG; PAM sequence: GAG
aataaaaatgatttgaaagt

SEQ ID NO: 9842 - DNA, 20 bp, Artificial Sequence
  Description of Artificial Sequence: Synthetic oligonucleotide
  Target: FXN; (-) strand; PAM type: NRG; PAM sequence: AAG
agacaataaaaatgatttga

SEQ ID NO: 9843 - DNA, 20 bp, Artificial Sequence
  Description of Artificial Sequence: Synthetic oligonucleotide
  Target: FXN; (-) strand; PAM type: NRG; PAM sequence: AAG
aacttgtgtaaattgtctgc

SEQ ID NO: 9844 - DNA, 20 bp, Artificial Sequence
  Description of Artificial Sequence: Synthetic oligonucleotide
  Target: FXN; (-) strand; PAM type: NRG; PAM sequence: CAG
gcgtgagccaccgcgcccgg

SEQ ID NO: 9845 - DNA, 20 bp, Artificial Sequence
  Description of Artificial Sequence: Synthetic oligonucleotide
  Target: FXN; (-) strand; PAM type: NRG; PAM sequence: CGG
caggcgtgagccaccgcgcc

SEQ ID NO: 9846 - DNA, 20 bp, Artificial Sequence
  Description of Artificial Sequence: Synthetic oligonucleotide
  Target: FXN; (-) strand; PAM type: NRG; PAM sequence: GAG
agtgctgggattacaggcgt

SEQ ID NO: 9847 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctgggattac

SEQ ID NO: 9848 - DNA, 20 bp, Artificial Sequence
  Description of Artificial Sequence: Synthetic oligonucleotide
  Target: FXN; (-) strand; PAM type: NRG; PAM sequence: CAG
ctcccaaagtgctgggatta

SEQ ID NO: 9849 - DNA, 20 bp, Artificial Sequence
  Description of Artificial Sequence: Synthetic oligonucleotide
  Target: FXN; (-) strand; PAM type: NRG; PAM sequence: GGG
cctcggcctcccaaagtgct

SEQ ID NO: 9850 - DNA, 20 bp, Artificial Sequence
  Description of Artificial Sequence: Synthetic oligonucleotide
  Target: FXN; (-) strand; PAM type: NRG; PAM sequence: TGG
gcctcggcctcccaaagtgc

SEQ ID NO: 9851 - DNA, 20 bp, Artificial Sequence
  Description of Artificial Sequence: Synthetic oligonucleotide
  Target: FXN; (-) strand; PAM type: NRG; PAM sequence: AAG
ccacctgcctcggcctccca

SEQ ID NO: 9852 - DNA, 20 bp, Artificial Sequence
  Description of Artificial Sequence: Synthetic oligonucleotide
  Target: FXN; (-) strand; PAM type: NRG; PAM sequence: CGG
aactcgtgatccacctgcct

SEQ ID NO: 9853 - DNA, 20 bp, Artificial Sequence
  Description of Artificial Sequence: Synthetic oligonucleotide
  Target: FXN; (-) strand; PAM type: NRG; PAM sequence: TGG
tttcatcgtattagccagga

SEQ ID NO: 9854 - DNA, 20 bp, Artificial Sequence
  Description of Artificial Sequence: Synthetic oligonucleotide
  Target: FXN; (-) strand; PAM type: NRG; PAM sequence: AGG
ggggtttcatcgtattagcc

SEQ ID NO: 9855 - DNA, 20 bp, Artificial Sequence
  Description of Artificial Sequence: Synthetic oligonucleotide
  Target: FXN; (-) strand; PAM type: NRG; PAM sequence: CAG
tggggtttcatcgtattagc

SEQ ID NO: 9856 - DNA, 20 bp, Artificial Sequence
  Description of Artificial Sequence: Synthetic oligonucleotide
  Target: FXN; (-) strand; PAM type: NRG; PAM sequence: TAG
gagatggggtttcatcgtat

SEQ ID NO: 9857 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagagatg

SEQ ID NO: 9858 - DNA, 20 bp, Artificial Sequence
  Description of Artificial Sequence: Synthetic oligonucleotide
  Target: FXN; (-) strand; PAM type: NRG; PAM sequence: GGG
tttgtatttttagtagagat

SEQ ID NO: 9859 - DNA, 20 bp, Artificial Sequence
  Description of Artificial Sequence: Synthetic oligonucleotide
  Target: FXN; (-) strand; PAM type: NRG; PAM sequence: TGG
ttttgtatttttagtagaga

SEQ ID NO: 9860 - DNA, 20 bp, Artificial Sequence
  Description of Artificial Sequence: Synthetic oligonucleotide
  Target: FXN; (-) strand; PAM type: NRG; PAM sequence: GAG
aattttttgtatttttagta

SEQ ID NO: 9861 - DNA, 20 bp, Artificial Sequence
  Description of Artificial Sequence: Synthetic oligonucleotide
  Target: FXN; (-) strand; PAM type: NRG; PAM sequence: TAG
ctaattttttgtatttttag

SEQ ID NO: 9862 - DNA, 20 bp, Artificial Sequence
  Description of Artificial Sequence: Synthetic oligonucleotide
  Target: FXN; (-) strand; PAM type: NRG; PAM sequence: TAG
cggctaattttttgtatttt

SEQ ID NO: 9863 - DNA, 20 bp, Artificial Sequence
  Description of Artificial Sequence: Synthetic oligonucleotide
  Target: FXN; (-) strand; PAM type: NRG; PAM sequence: CGG
caggcacccgtcaccacgcc

SEQ ID NO: 9864 - DNA, 20 bp, Artificial Sequence
  Description of Artificial Sequence: Synthetic oligonucleotide
  Target: FXN; (-) strand; PAM type: NRG; PAM sequence: AGG
tcccgagtagtggggactac

SEQ ID NO: 9865 - DNA, 20 bp, Artificial Sequence
  Description of Artificial Sequence: Synthetic oligonucleotide
  Target: FXN; (-) strand; PAM type: NRG; PAM sequence: CAG
gtcccgagtagtggggacta

SEQ ID NO: 9866 - DNA, 20 bp, Artificial Sequence
  Description of Artificial Sequence: Synthetic oligonucleotide
  Target: FXN; (-) strand; PAM type: NRG; PAM sequence: GGG
cctcagcgtcccgagtagtg

SEQ ID NO: 9867 - DNA, 20 bp, Artificial Sequence
  Description of Artificial Sequence: Synthetic oligonucleotide
  Target: FXN; (-) strand; PAM type: NRG; PAM sequence: GGG
gcctcagcgtcccgagtagt

SEQ ID NO: 9868 - DNA, 20 bp, Artificial Sequence
  Description of Artificial Sequence: Synthetic oligonucleotide
  Target: FXN; (-) strand; PAM type: NRG; PAM sequence: TGG
tgcctcagcgtcccgagtag

SEQ ID NO: 9869 - DNA, 20 bp, Artificial Sequence
  Description of Artificial Sequence: Synthetic oligonucleotide
  Target: FXN; (-) strand; PAM type: NRG; PAM sequence: TAG
tcctgcctcagcgtcccgag

SEQ ID NO: 9870 - DNA, 20 bp, Artificial Sequence
  Description of Artificial Sequence: Synthetic oligonucleotide
  Target: FXN; (-) strand; PAM type: NRG; PAM sequence: GAG
ttctcctgcctcagcgtccc

SEQ ID NO: 9871 - DNA, 20 bp, Artificial Sequence
  Description of Artificial Sequence: Synthetic oligonucleotide
  Target: FXN; (-) strand; PAM type: NRG; PAM sequence: CAG
ttcacgccattctcctgcct

SEQ ID NO: 9872 - DNA, 20 bp, Artificial Sequence
  Description of Artificial Sequence: Synthetic oligonucleotide
  Target: FXN; (-) strand; PAM type: NRG; PAM sequence: GGG
cactgcaagctctgcctccc

SEQ ID NO: 9873 - DNA, 20 bp, Artificial Sequence
  Description of Artificial Sequence: Synthetic oligonucleotide
  Target: FXN; (-) strand; PAM type: NRG; PAM sequence: CGG
tcactgcaagctctgcctcc

SEQ ID NO: 9874 - DNA, 20 bp, Artificial Sequence
  Description of Artificial Sequence: Synthetic oligonucleotide
  Target: FXN; (-) strand; PAM type: NRG; PAM sequence: AAG
gcacgatctcggatcactgc

SEQ ID NO: 9875 - DNA, 20 bp, Artificial Sequence
  Description of Artificial Sequence: Synthetic oligonucleotide
  Target: FXN; (-) strand; PAM type: NRG; PAM sequence: CGG
ggagtgcagtggcacgatct

SEQ ID NO: 9876 - DNA, 20 bp, Artificial Sequence
  Description of Artificial Sequence: Synthetic oligonucleotide
  Target: FXN; (-) strand; PAM type: NRG; PAM sequence: TGG
tcacccaggctggagtgcag

SEQ ID NO: 9877 - DNA, 20 bp, Artificial Sequence
  Description of Artificial Sequence: Synthetic oligonucleotide
  Target: FXN; (-) strand; PAM type: NRG; PAM sequence: CAG
ctgtcacccaggctggagtg

SEQ ID NO: 9878 - DNA, 20 bp, Artificial Sequence
  Description of Artificial Sequence: Synthetic oligonucleotide
  Target: FXN; (-) strand; PAM type: NRG; PAM sequence: GAG
tcgctctgtcacccaggctg

SEQ ID NO: 9879 - DNA, 20 bp, Artificial Sequence
  Description of Artificial Sequence: Synthetic oligonucleotide
  Target: FXN; (-) strand; PAM type: NRG; PAM sequence: TGG
tctcgctctgtcacccaggc

SEQ ID NO: 9880 - DNA, 20 bp, Artificial Sequence
  Description of Artificial Sequence: Synthetic oligonucleotide
  Target: FXN; (-) strand; PAM type: NRG; PAM sequence: AGG
gcagtctcgctctgtcaccc

SEQ ID NO: 9881 - DNA, 20 bp, Artificial Sequence
  Description of Artificial Sequence: Synthetic oligonucleotide
  Target: FXN; (-) strand; PAM type: NRG; PAM sequence: CAG
tgcagtctcgctctgtcacc

SEQ ID NO: 9882 - DNA, 20 bp, Artificial Sequence
  Description of Artificial Sequence: Synthetic oligonucleotide
  Target: FXN; (-) strand; PAM type: NRG; PAM sequence: CAG
ttatttttttctttgagatg

SEQ ID NO: 9883 - DNA, 20 bp, Artificial Sequence
  Description of Artificial Sequence: Synthetic oligonucleotide
  Target: FXN; (-) strand; PAM type: NRG; PAM sequence: GAG
atttatttatttttttcttt

SEQ ID NO: 9884 - DNA, 20 bp, Artificial Sequence
  Description of Artificial Sequence: Synthetic oligonucleotide
  Target: FXN; (-) strand; PAM type: NRG; PAM sequence: CAG
atttattattagtttataag

SEQ ID NO: 9885 - DNA, 20 bp, Artificial Sequence
  Description of Artificial Sequence: Synthetic oligonucleotide
  Target: FXN; (-) strand; PAM type: NRG; PAM sequence: AAG
agcatttattattagtttat

SEQ ID NO: 9886 - DNA, 20 bp, Artificial Sequence
  Description of Artificial Sequence: Synthetic oligonucleotide
  Target: FXN; (-) strand; PAM type: NRG; PAM sequence: TAG
cagaccatagcatttattat

SEQ ID NO: 9887 - DNA, 20 bp, Artificial Sequence
  Description of Artificial Sequence: Synthetic oligonucleotide
  Target: FXN; (-) strand; PAM type: NRG; PAM sequence: TAG
tgacacaaacatgcagacca

SEQ ID NO: 9888 - DNA, 20 bp, Artificial Sequence
  Description of Artificial Sequence: Synthetic oligonucleotide
  Target: FXN; (-) strand; PAM type: NRG; PAM sequence: CAG
ggtggggtgacacaaacatg

SEQ ID NO: 9889 - DNA, 20 bp, Artificial Sequence
  Description of Artificial Sequence: Synthetic oligonucleotide
  Target: FXN; (-) strand; PAM type: NRG; PAM sequence: GGG
gttttaacatatgaatggtg

SEQ ID NO: 9890 - DNA, 20 bp, Artificial Sequence
  Description of Artificial Sequence: Synthetic oligonucleotide
  Target: FXN; (-) strand; PAM type: NRG; PAM sequence: GGG
ggttttaacatatgaatggt

SEQ ID NO: 9891 - DNA, 20 bp, Artificial Sequence
  Description of Artificial Sequence: Synthetic oligonucleotide
  Target: FXN; (-) strand; PAM type: NRG; PAM sequence: TGG
aggttttaacatatgaatgg

SEQ ID NO: 9892 - DNA, 20 bp, Artificial Sequence
  Description of Artificial Sequence: Synthetic oligonucleotide
  Target: FXN; (-) strand; PAM type: NRG; PAM sequence: TGG
attaggttttaacatatgaa

SEQ ID NO: 9893 - DNA, 20 bp, Artificial Sequence
  Description of Artificial Sequence: Synthetic oligonucleotide
  Target: FXN; (-) strand; PAM type: NRG; PAM sequence: AGG
ctaatatcactttggtgatt

SEQ ID NO: 9894 - DNA, 20 bp, Artificial Sequence
  Description of Artificial Sequence: Synthetic oligonucleotide
  Target: FXN; (-) strand; PAM type: NRG; PAM sequence: TAG
cctaatatcactttggtgat

SEQ ID NO: 9895 - DNA, 20 bp, Artificial Sequence
  Description of Artificial Sequence: Synthetic oligonucleotide
  Target: FXN; (-) strand; PAM type: NRG; PAM sequence: TGG
cccacctcctaatatcactt

SEQ ID NO: 9896 - DNA, 20 bp, Artificial Sequence
  Description of Artificial Sequence: Synthetic oligonucleotide
  Target: FXN; (-) strand; PAM type: NRG; PAM sequence: GGG
catacctcatcacctcccaa

SEQ ID NO: 9897 - DNA, 20 bp, Artificial Sequence
  Description of Artificial Sequence: Synthetic oligonucleotide
  Target: FXN; (-) strand; PAM type: NRG; PAM sequence: AGG
tcatacctcatcacctccca

SEQ ID NO: 9898 - DNA, 20 bp, Artificial Sequence
  Description of Artificial Sequence: Synthetic oligonucleotide
  Target: FXN; (-) strand; PAM type: NRG; PAM sequence: AAG
ctcatacctcatcacctccc

SEQ ID NO: 9899 - DNA, 20 bp, Artificial Sequence
  Description of Artificial Sequence: Synthetic oligonucleotide
  Target: FXN; (-) strand; PAM type: NRG; PAM sequence: GGG
ggcactaatcccaatcatat

SEQ ID NO: 9900 - DNA, 20 bp, Artificial Sequence
  Description of Artificial Sequence: Synthetic oligonucleotide
  Target: FXN; (-) strand; PAM type: NRG; PAM sequence: TGG
gggcactaatcccaatcata

SEQ ID NO: 9901 - DNA, 20 bp, Artificial Sequence
  Description of Artificial Sequence: Synthetic oligonucleotide
  Target: FXN; (-) strand; PAM type: NRG; PAM sequence: GGG
tccgttgggctattttagaa

SEQ ID NO: 9902 - DNA, 20 bp, Artificial Sequence
  Description of Artificial Sequence: Synthetic oligonucleotide
  Target: FXN; (-) strand; PAM type: NRG; PAM sequence: AGG
ctccgttgggctattttaga

SEQ ID NO: 9903 - DNA, 20 bp, Artificial Sequence
  Description of Artificial Sequence: Synthetic oligonucleotide
  Target: FXN; (-) strand; PAM type: NRG; PAM sequence: AAG
gctccgttgggctattttag

SEQ ID NO: 9904 - DNA, 20 bp, Artificial Sequence
  Description of Artificial Sequence: Synthetic oligonucleotide
  Target: FXN; (-) strand; PAM type: NRG; PAM sequence: TAG
tgggctccgttgggctattt

SEQ ID NO: 9905 - DNA, 20 bp, Artificial Sequence
  Description of Artificial Sequence: Synthetic oligonucleotide
  Target: FXN; (-) strand; PAM type: NRG; PAM sequence: GGG
ccttgtcactgggctccgtt

SEQ ID NO: 9906 - DNA, 20 bp, Artificial Sequence
  Description of Artificial Sequence: Synthetic oligonucleotide
  Target: FXN; (-) strand; PAM type: NRG; PAM sequence: TGG
gccttgtcactgggctccgt

SEQ ID NO: 9907 - DNA, 20 bp, Artificial Sequence
  Description of Artificial Sequence: Synthetic oligonucleotide
  Target: FXN; (-) strand; PAM type: NRG; PAM sequence: GGG
atagatgatgccttgtcact

SEQ ID NO: 9908 - DNA, 20 bp, Artificial Sequence
  Description of Artificial Sequence: Synthetic oligonucleotide
  Target: FXN; (-) strand; PAM type: NRG; PAM sequence: TGG
catagatgatgccttgtcac

SEQ ID NO: 9909 - DNA, 20 bp, Artificial Sequence
  Description of Artificial Sequence: Synthetic oligonucleotide
  Target: FXN; (-) strand; PAM type: NRG; PAM sequence: TAG
agggccagtttcctggttca

SEQ ID NO: 9910 - DNA, 20 bp, Artificial Sequence
  Description of Artificial Sequence: Synthetic oligonucleotide
  Target: FXN; (-) strand; PAM type: NRG; PAM sequence: TGG
tctggtgagggccagtttcc

SEQ ID NO: 9911 - DNA, 20 bp, Artificial Sequence
  Description of Artificial Sequence: Synthetic oligonucleotide
  Target: FXN; (-) strand; PAM type: NRG; PAM sequence: CAG
ctttggtgtctggtgagggc

SEQ ID NO: 9912 - DNA, 20 bp, Artificial Sequence
  Description of Artificial Sequence: Synthetic oligonucleotide
  Target: FXN; (-) strand; PAM type: NRG; PAM sequence: GGG
acagctttggtgtctggtga

SEQ ID NO: 9913 - DNA, 20 bp, Artificial Sequence
  Description of Artificial Sequence: Synthetic oligonucleotide
  Target: FXN; (-) strand; PAM type: NRG; PAM sequence: AGG
aacagctttggtgtctggtg

SEQ ID NO: 9914 - DNA, 20 bp, Artificial Sequence
  Description of Artificial Sequence: Synthetic oligonucleotide
  Target: FXN; (-) strand; PAM type: NRG; PAM sequence: GAG
caacagctttggtgtctggt

SEQ ID NO: 9915 - DNA, 20 bp, Artificial Sequence
  Description of Artificial Sequence: Synthetic oligonucleotide
  Target: FXN; (-) strand; PAM type: NRG; PAM sequence: TGG
gcaccaacagctttggtgtc

SEQ ID NO: 9916 - DNA, 20 bp, Artificial Sequence
  Description of Artificial Sequence: Synthetic oligonucleotide
  Target: FXN; (-) strand; PAM type: NRG; PAM sequence: TGG
gatcaatgcaccaacagctt

SEQ ID NO: 9917 - DNA, 20 bp, Artificial Sequence
  Description of Artificial Sequence: Synthetic oligonucleotide
  Target: FXN; (-) strand; PAM type: NRG; PAM sequence: CAG
atccaagatcaatgcaccaa

SEQ ID NO: 9918 - DNA, 20 bp, Artificial Sequence
  Description of Artificial Sequence: Synthetic oligonucleotide
  Target: FXN; (-) strand; PAM type: NRG; PAM sequence: AAG
tcctggagggtgggaaatcc

SEQ ID NO: 9919 - DNA, 20 bp, Artificial Sequence
  Description of Artificial Sequence: Synthetic oligonucleotide
  Target: FXN; (-) strand; PAM type: NRG; PAM sequence: GGG
ttcttagagtcctggagggt

SEQ ID NO: 9920 - DNA, 20 bp, Artificial Sequence
  Description of Artificial Sequence: Synthetic oligonucleotide
  Target: FXN; (-) strand; PAM type: NRG; PAM sequence: TGG
tttcttagagtcctggaggg

SEQ ID NO: 9921 - DNA, 20 bp, Artificial Sequence
  Description of Artificial Sequence: Synthetic oligonucleotide
  Target: FXN; (-) strand; PAM type: NRG; PAM sequence: GGG
gtgtttcttagagtcctgga

SEQ ID NO: 9922 - DNA, 20 bp, Artificial Sequence
  Description of Artificial Sequence: Synthetic oligonucleotide
  Target: FXN; (-) strand; PAM type: NRG; PAM sequence: AGG
tgtgtttcttagagtcctgg

SEQ ID NO: 9923 - DNA, 20 bp, Artificial Sequence
  Description of Artificial Sequence: Synthetic oligonucleotide
  Target: FXN; (-) strand; PAM type: NRG; PAM sequence: GAG
atgtgtttcttagagtcctg

SEQ ID NO: 9924 - DNA, 20 bp, Artificial Sequence
  Description of Artificial Sequence: Synthetic oligonucleotide
  Target: FXN; (-) strand; PAM type: NRG; PAM sequence: TGG
aaatgtgtttcttagagtcc

SEQ ID NO: 9925 - DNA, 20 bp, Artificial Sequence
  Description of Artificial Sequence: Synthetic oligonucleotide
  Target: FXN; (-) strand; PAM type: NRG; PAM sequence: GAG
caatagaaatgtgtttctta

SEQ ID NO: 9926 - DNA, 20 bp, Artificial Sequence
  Description of Artificial Sequence: Synthetic oligonucleotide
  Target: FXN; (-) strand; PAM type: NRG; PAM sequence: TAG
aacaatagaaatgtgtttct

SEQ ID NO: 9927 - DNA, 20 bp, Artificial Sequence
  Description of Artificial Sequence: Synthetic oligonucleotide
  Target: FXN; (-) strand; PAM type: NRG; PAM sequence: TAG
actgggtggcttataaacaa

SEQ ID NO: 9928 - DNA, 20 bp, Artificial Sequence
  Description of Artificial Sequence: Synthetic oligonucleotide
  Target: FXN; (-) strand; PAM type: NRG; PAM sequence: TGG
acaaaataccagccactggg

SEQ ID NO: 9929 - DNA, 20 bp, Artificial Sequence
  Description of Artificial Sequence: Synthetic oligonucleotide
  Target: FXN; (-) strand; PAM type: NRG; PAM sequence: GGG
ataacaaaataccagccact

SEQ ID NO: 9930 - DNA, 20 bp, Artificial Sequence
  Description of Artificial Sequence: Synthetic oligonucleotide
  Target: FXN; (-) strand; PAM type: NRG; PAM sequence: TGG
tataacaaaataccagccac

SEQ ID NO: 9931 - DNA, 20 bp, Artificial Sequence
  Description of Artificial Sequence: Synthetic oligonucleotide
  Target: FXN; (-) strand; PAM type: NRG; PAM sequence: CAG
gggatgttataacaaaatac

SEQ ID NO: 9932 - DNA, 20 bp, Artificial Sequence
  Description of Artificial Sequence: Synthetic oligonucleotide
  Target: FXN; (-) strand; PAM type: NRG; PAM sequence: GGG
tttgttatttgtcttagtct

SEQ ID NO: 9933 - DNA, 20 bp, Artificial Sequence
  Description of Artificial Sequence: Synthetic oligonucleotide
  Target: FXN; (-) strand; PAM type: NRG; PAM sequence: TGG
atttgttatttgtcttagtc

SEQ ID NO: 9934 - DNA, 20 bp, Artificial Sequence
  Description of Artificial Sequence: Synthetic oligonucleotide
  Target: FXN; (-) strand; PAM type: NRG; PAM sequence: TAG
caagtatttgttatttgtct

SEQ ID NO: 9935 - DNA, 20 bp, Artificial Sequence
  Description of Artificial Sequence: Synthetic oligonucleotide
  Target: FXN; (-) strand; PAM type: NRG; PAM sequence: AAG
taacctggtgtcagggatac

SEQ ID NO: 9936 - DNA, 20 bp, Artificial Sequence
  Description of Artificial Sequence: Synthetic oligonucleotide
  Target: FXN; (-) strand; PAM type: NRG; PAM sequence: GGG
tatctcttaacctggtgtca

SEQ ID NO: 9937 - DNA, 20 bp, Artificial Sequence
  Description of Artificial Sequence: Synthetic oligonucleotide
  Target: FXN; (-) strand; PAM type: NRG; PAM sequence: AGG
ctatctcttaacctggtgtc

SEQ ID NO: 9938 - DNA, 20 bp, Artificial Sequence
  Description of Artificial Sequence: Synthetic oligonucleotide
  Target: FXN; (-) strand; PAM type: NRG; PAM sequence: CAG
tctatctcttaacctggtgt

SEQ ID NO: 9939 - DNA, 20 bp, Artificial Sequence
  Description of Artificial Sequence: Synthetic oligonucleotide
  Target: FXN; (-) strand; PAM type: NRG; PAM sequence: TGG
acaaattctatctcttaacc

SEQ ID NO: 9940 - DNA, 20 bp, Artificial Sequence
  Description of Artificial Sequence: Synthetic oligonucleotide
  Target: FXN; (-) strand; PAM type: NRG; PAM sequence: AGG
gtgaagacaagggcctccag

SEQ ID NO: 9941 - DNA, 20 bp, Artificial Sequence
  Description of Artificial Sequence: Synthetic oligonucleotide
  Target: FXN; (-) strand; PAM type: NRG; PAM sequence: GAG
ggtgaagacaagggcctcca

SEQ ID NO: 9942 - DNA, 20 bp, Artificial Sequence
  Description of Artificial Sequence: Synthetic oligonucleotide
  Target: FXN; (-) strand; PAM type: NRG; PAM sequence: CAG
ggggtgaagacaagggcctc

SEQ ID NO: 9943 - DNA, 20 bp, Artificial Sequence
  Description of Artificial Sequence: Synthetic oligonucleotide
  Target: FXN; (-) strand; PAM type: NRG; PAM sequence: GGG
cagtgatggggtgaagacaa

SEQ ID NO: 9944 - DNA, 20 bp, Artificial Sequence
  Description of Artificial Sequence: Synthetic oligonucleotide
  Target: FXN; (-) strand; PAM type: NRG; PAM sequence: AGG
gcagtgatggggtgaagaca

SEQ ID NO: 9945 - DNA, 20 bp, Artificial Sequence
  Description of Artificial Sequence: Synthetic oligonucleotide
  Target: FXN; (-) strand; PAM type: NRG; PAM sequence: AAG
ggcagtgatggggtgaagac

SEQ ID NO: 9946 - DNA, 20 bp, Artificial Sequence
  Description of Artificial Sequence: Synthetic oligonucleotide
  Target: FXN; (-) strand; PAM type: NRG; PAM sequence: AAG
gacagggcagtgatggggtg

SEQ ID NO: 9947 - DNA, 20 bp, Artificial Sequence
  Description of Artificial Sequence: Synthetic oligonucleotide
  Target: FXN; (-) strand; PAM type: NRG; PAM sequence: GGG
gggaggacagggcagtgatg

SEQ ID NO: 9948 - DNA, 20 bp, Artificial Sequence
  Description of Artificial Sequence: Synthetic oligonucleotide
  Target: FXN; (-) strand; PAM type: NRG; PAM sequence: GGG
agggaggacagggcagtgat

SEQ ID NO: 9949 - DNA, 20 bp, Artificial Sequence
  Description of Artificial Sequence: Synthetic oligonucleotide
  Target: FXN; (-) strand; PAM type: NRG; PAM sequence: TGG
cagggaggacagggcagtga

SEQ ID NO: 9950 - DNA, 20 bp, Artificial Sequence
  Description of Artificial Sequence: Synthetic oligonucleotide
  Target: FXN; (-) strand; PAM type: NRG; PAM sequence: CAG
ttcctccagggaggacaggg

SEQ ID NO: 9951 - DNA, 20 bp, Artificial Sequence
  Description of Artificial Sequence: Synthetic oligonucleotide
  Target: FXN; (-) strand; PAM type: NRG; PAM sequence: GGG
agattcctccagggaggaca

SEQ ID NO: 9952 - DNA, 20 bp, Artificial Sequence
  Description of Artificial Sequence: Synthetic oligonucleotide
  Target: FXN; (-) strand; PAM type: NRG; PAM sequence: AGG
cagattcctccagggaggac

SEQ ID NO: 9953 - DNA, 20 bp, Artificial Sequence
  Description of Artificial Sequence: Synthetic oligonucleotide
  Target: FXN; (-) strand; PAM type: NRG; PAM sequence: CAG
gcagattcctccagggagga

SEQ ID NO: 9954 - DNA, 20 bp, Artificial Sequence
  Description of Artificial Sequence: Synthetic oligonucleotide
  Target: FXN; (-) strand; PAM type: NRG; PAM sequence: AGG
gctggcagattcctccaggg

SEQ ID NO: 9955 - DNA, 20 bp, Artificial Sequence
  Description of Artificial Sequence: Synthetic oligonucleotide
  Target: FXN; (-) strand; PAM type: NRG; PAM sequence: GAG
ggctggcagattcctccagg

SEQ ID NO: 9956 - DNA, 20 bp, Artificial Sequence
  Description of Artificial Sequence: Synthetic oligonucleotide
  Target: FXN; (-) strand; PAM type: NRG; PAM sequence: GGG
cgggctggcagattcctcca

SEQ ID NO: 9957 - DNA, 20 bp, Artificial Sequence
  Description of Artificial Sequence: Synthetic oligonucleotide
  Target: FXN; (-) strand; PAM type: NRG; PAM sequence: AGG
tcgggctggcagattcctcc

SEQ ID NO: 9958 - DNA, 20 bp, Artificial Sequence
  Description of Artificial Sequence: Synthetic oligonucleotide
  Target: FXN; (-) strand; PAM type: NRG; PAM sequence: CAG
ttcgggctggcagattcctc

SEQ ID NO: 9959 - DNA, 20 bp, Artificial Sequence
  Description of Artificial Sequence: Synthetic oligonucleotide
  Target: FXN; (-) strand; PAM type: NRG; PAM sequence: CAG
atgaacagaattcgggctgg

SEQ ID NO: 9960 - DNA, 20 bp, Artificial Sequence
  Description of Artificial Sequence: Synthetic oligonucleotide
  Target: FXN; (-) strand; PAM type: NRG; PAM sequence: TGG
acgatgaacagaattcgggc

SEQ ID NO: 9961 - DNA, 20 bp, Artificial Sequence
  Description of Artificial Sequence: Synthetic oligonucleotide
  Target: FXN; (-) strand; PAM type: NRG; PAM sequence: GGG
gggtacgatgaacagaattc

SEQ ID NO: 9962 - DNA, 20 bp, Artificial Sequence
  Description of Artificial Sequence: Synthetic oligonucleotide
  Target: FXN; (-) strand; PAM type: NRG; PAM sequence: CGG
agggtacgatgaacagaatt

SEQ ID NO: 9963 - DNA, 20 bp, Artificial Sequence
  Description of Artificial Sequence: Synthetic oligonucleotide
  Target: FXN; (-) strand; PAM type: NRG; PAM sequence: CAG
gaaaaggagggtacgatgaa

SEQ ID NO: 9964 - DNA, 20 bp, Artificial Sequence
  Description of Artificial Sequence: Synthetic oligonucleotide
  Target: FXN; (-) strand; PAM type: NRG; PAM sequence: GGG
gtcaaactctaagaaaagga

SEQ ID NO: 9965 - DNA, 20 bp, Artificial Sequence
  Description of Artificial Sequence: Synthetic oligonucleotide
  Target: FXN; (-) strand; PAM type: NRG; PAM sequence: AGG
ggtcaaactctaagaaaagg

SEQ ID NO: 9966 - DNA, 20 bp, Artificial Sequence
  Description of Artificial Sequence: Synthetic oligonucleotide
  Target: FXN; (-) strand; PAM type: NRG; PAM sequence: GAG
aggtcaaactctaagaaaag

SEQ ID NO: 9967 - DNA, 20 bp, Artificial Sequence
  Description of Artificial Sequence: Synthetic oligonucleotide
  Target: FXN; (-) strand; PAM type: NRG; PAM sequence: AGG
ggaggtcaaactctaagaaa

SEQ ID NO: 9968 - DNA, 20 bp, Artificial Sequence
  Description of Artificial Sequence: Synthetic oligonucleotide
  Target: FXN; (-) strand; PAM type: NRG; PAM sequence: AAG
aggaggtcaaactctaagaa

SEQ ID NO: 9969 - DNA, 20 bp, Artificial Sequence
  Description of Artificial Sequence: Synthetic oligonucleotide
  Target: FXN; (-) strand; PAM type: NRG; PAM sequence: AAG
tacagaggaggtcaaactct

SEQ ID NO: 9970 - DNA, 20 bp, Artificial Sequence
  Description of Artificial Sequence: Synthetic oligonucleotide
  Target: FXN; (-) strand; PAM type: NRG; PAM sequence: AGG
gattgggggagatacagagg

SEQ ID NO: 9971 - DNA, 20 bp, Artificial Sequence
  Description of Artificial Sequence: Synthetic oligonucleotide
  Target: FXN; (-) strand; PAM type: NRG; PAM sequence: GAG
ggattgggggagatacagag

SEQ ID NO: 9972 - DNA, 20 bp, Artificial Sequence
  Description of Artificial Sequence: Synthetic oligonucleotide
  Target: FXN; (-) strand; PAM type: NRG; PAM sequence: AGG
atggattgggggagatacag

SEQ ID NO: 9973 - DNA, 20 bp, Artificial Sequence
  Description of Artificial Sequence: Synthetic oligonucleotide
  Target: FXN; (-) strand; PAM type: NRG; PAM sequence: GAG
catggattgggggagataca

SEQ ID NO: 9974 - DNA, 20 bp, Artificial Sequence
  Description of Artificial Sequence: Synthetic oligonucleotide
  Target: FXN; (-) strand; PAM type: NRG; PAM sequence: CAG
tacatggattgggggagata

SEQ ID NO: 9975 - DNA, 20 bp, Artificial Sequence
  Description of Artificial Sequence: Synthetic oligonucleotide
  Target: FXN; (-) strand; PAM type: NRG; PAM sequence: GAG
aagcaatacatggattgggg

SEQ ID NO: 9976 - DNA, 20 bp, Artificial Sequence
  Description of Artificial Sequence: Synthetic oligonucleotide
  Target: FXN; (-) strand; PAM type: NRG; PAM sequence: GGG
ataagcaatacatggattgg

SEQ ID NO: 9977 - DNA, 20 bp, Artificial Sequence
  Description of Artificial Sequence: Synthetic oligonucleotide
  Target: FXN; (-) strand; PAM type: NRG; PAM sequence: GGG
tataagcaatacatggattg

SEQ ID NO: 9978 - DNA, 20 bp, Artificial Sequence
  Description of Artificial Sequence: Synthetic oligonucleotide
  Target: FXN; (-) strand; PAM type: NRG; PAM sequence: GGG
atataagcaatacatggatt

SEQ ID NO: 9979 - DNA, 20 bp, Artificial Sequence
  Description of Artificial Sequence: Synthetic oligonucleotide
  Target: FXN; (-) strand; PAM type: NRG; PAM sequence: TGG
tatataagcaatacatggat

SEQ ID NO: 9980 - DNA, 20 bp, Artificial Sequence
  Description of Artificial Sequence: Synthetic oligonucleotide
  Target: FXN; (-) strand; PAM type: NRG; PAM sequence: TGG
ccttgtatataagcaataca

SEQ ID NO: 9981 - DNA, 20 bp, Artificial Sequence
  Description of Artificial Sequence: Synthetic oligonucleotide
  Target: FXN; (-) strand; PAM type: NRG; PAM sequence: AAG
cagcagaataccttgtatat

SEQ ID NO: 9982 - DNA, 20 bp, Artificial Sequence
  Description of Artificial Sequence: Synthetic oligonucleotide
  Target: FXN; (-) strand; PAM type: NRG; PAM sequence: CAG
ccatagcagaacagatacag

SEQ ID NO: 9983 - DNA, 20 bp, Artificial Sequence
  Description of Artificial Sequence: Synthetic oligonucleotide
  Target: FXN; (-) strand; PAM type: NRG; PAM sequence: CAG
aagccatagcagaacagata

SEQ ID NO: 9984 - DNA, 20 bp, Artificial Sequence
  Description of Artificial Sequence: Synthetic oligonucleotide
  Target: FXN; (-) strand; PAM type: NRG; PAM sequence: CAG
aggggcaagccatagcagaa

SEQ ID NO: 9985 - DNA, 20 bp, Artificial Sequence
  Description of Artificial Sequence: Synthetic oligonucleotide
  Target: FXN; (-) strand; PAM type: NRG; PAM sequence: CAG
acaaaaggggcaagccatag

SEQ ID NO: 9986 - DNA, 20 bp, Artificial Sequence
  Description of Artificial Sequence: Synthetic oligonucleotide
  Target: FXN; (-) strand; PAM type: NRG; PAM sequence: TAG
tgaacaaaaggggcaagcca

SEQ ID NO: 9987 - DNA, 20 bp, Artificial Sequence
  Description of Artificial Sequence: Synthetic oligonucleotide
  Target: FXN; (-) strand; PAM type: NRG; PAM sequence: AAG
cagtgttgaacaaaaggggc

SEQ ID NO: 9988 - DNA, 20 bp, Artificial Sequence
  Description of Artificial Sequence: Synthetic oligonucleotide
  Target: FXN; (-) strand; PAM type: NRG; PAM sequence: GGG
aaaacagtgttgaacaaaag

SEQ ID NO: 9989 - DNA, 20 bp, Artificial Sequence
  Description of Artificial Sequence: Synthetic oligonucleotide
  Target: FXN; (-) strand; PAM type: NRG; PAM sequence: GGG
aaaaacagtgttgaacaaaa

SEQ ID NO: 9990 - DNA, 20 bp, Artificial Sequence
  Description of Artificial Sequence: Synthetic oligonucleotide
  Target: FXN; (-) strand; PAM type: NRG; PAM sequence: AGG
caaaaacagtgttgaacaaa

SEQ ID NO: 9991 - DNA, 20 bp, Artificial Sequence
  Description of Artificial Sequence: Synthetic oligonucleotide
  Target: FXN; (-) strand; PAM type: NRG; PAM sequence: AAG
acaaaaacagtgttgaacaa

SEQ ID NO: 9992 - DNA, 20 bp, Artificial Sequence
  Description of Artificial Sequence: Synthetic oligonucleotide
  Target: FXN; (-) strand; PAM type: NRG; PAM sequence: CAG
atgcagatgacgcacaaaaa

SEQ ID NO: 9993 - DNA, 20 bp, Artificial Sequence
  Description of Artificial Sequence: Synthetic oligonucleotide
  Target: FXN; (-) strand; PAM type: NRG; PAM sequence: CAG
gacaactgcatgcatcaatg

SEQ ID NO: 9994 - DNA, 20 bp, Artificial Sequence
  Description of Artificial Sequence: Synthetic oligonucleotide
  Target: FXN; (-) strand; PAM type: NRG; PAM sequence: AGG
ccagcagtgagaacaaataa

SEQ ID NO: 9995 - DNA, 20 bp, Artificial Sequence
  Description of Artificial Sequence: Synthetic oligonucleotide
  Target: FXN; (-) strand; PAM type: NRG; PAM sequence: AAG
tccagcagtgagaacaaata

SEQ ID NO: 9996 - DNA, 20 bp, Artificial Sequence
  Description of Artificial Sequence: Synthetic oligonucleotide
  Target: FXN; (-) strand; PAM type: NRG; PAM sequence: GAG
accagatactatccagcagt

SEQ ID NO: 9997 - DNA, 20 bp, Artificial Sequence
  Description of Artificial Sequence: Synthetic oligonucleotide
  Target: FXN; (-) strand; PAM type: NRG; PAM sequence: CAG
cccaaccagatactatccag

SEQ ID NO: 9998 - DNA, 20 bp, Artificial Sequence
  Description of Artificial Sequence: Synthetic oligonucleotide
  Target: FXN; (-) strand; PAM type: NRG; PAM sequence: CAG
ttacccaaccagatactatc

SEQ ID NO: 9999 - DNA, 20 bp, Artificial Sequence
  Description of Artificial Sequence: Synthetic oligonucleotide
  Target: FXN; (-) strand; PAM type: NRG; PAM sequence: CAG
gtgtgatatatttacccaac

SEQ ID NO: 10000 - DNA, 20 bp, Artificial Sequence
  Description of Artificial Sequence: Synthetic oligonucleotide
  Target: FXN; (-) strand; PAM type: NRG; PAM sequence: CAG
aacctggatagtgtgattta

SEQ ID NO: 10001 - DNA, 20 bp, Artificial Sequence
  Description of Artificial Sequence: Synthetic oligonucleotide
  Target: FXN; (-) strand; PAM type: NRG; PAM sequence: TAG
gtcacctaaaggaacctgga

SEQ ID NO: 10002 - DNA, 20 bp, Artificial Sequence
  Description of Artificial Sequence: Synthetic oligonucleotide
  Target: FXN; (-) strand; PAM type: NRG; PAM sequence: TGG
aaatgtcacctaaaggaacc

SEQ ID NO: 10003 - DNA, 20 bp, Artificial Sequence
  Description of Artificial Sequence: Synthetic oligonucleotide
  Target: FXN; (-) strand; PAM type: NRG; PAM sequence: AGG
atcaaccaaatgtcacctaa

SEQ ID NO: 10004 - DNA, 20 bp, Artificial Sequence
  Description of Artificial Sequence: Synthetic oligonucleotide
  Target: FXN; (-) strand; PAM type: NRG; PAM sequence: AAG
aatcaaccaaatgtcaccta

SEQ ID NO: 10005 - DNA, 20 bp, Artificial Sequence
  Description of Artificial Sequence: Synthetic oligonucleotide
  Target: FXN; (-) strand; PAM type: NRG; PAM sequence: CAG
cagcagcaccatcgtaacaa

SEQ ID NO: 10006 - DNA, 20 bp, Artificial Sequence
  Description of Artificial Sequence: Synthetic oligonucleotide
  Target: FXN; (-) strand; PAM type: NRG; PAM sequence: CAG
atgcacaagaacagtcacag

SEQ ID NO: 10007 - DNA, 20 bp, Artificial Sequence
  Description of Artificial Sequence: Synthetic oligonucleotide
  Target: FXN; (-) strand; PAM type: NRG; PAM sequence: CAG
tccatgcacaagaacagtca

SEQ ID NO: 10008 - DNA, 20 bp, Artificial Sequence
  Description of Artificial Sequence: Synthetic oligonucleotide
  Target: FXN; (-) strand; PAM type: NRG; PAM sequence: CAG
cttctgtccatgcacaagaa

SEQ ID NO: 10009 - DNA, 20 bp, Artificial Sequence
  Description of Artificial Sequence: Synthetic oligonucleotide
  Target: FXN; (-) strand; PAM type: NRG; PAM sequence: AAG
aggaacttctgtccatgcac

SEQ ID NO: 10010 - DNA, 20 bp, Artificial Sequence
  Description of Artificial Sequence: Synthetic oligonucleotide
  Target: FXN; (-) strand; PAM type: NRG; PAM sequence: AGG
ttctgagaaattcacctgaa

SEQ ID NO: 10011 - DNA, 20 bp, Artificial Sequence
  Description of Artificial Sequence: Synthetic oligonucleotide
  Target: FXN; (-) strand; PAM type: NRG; PAM sequence: AAG
attctgagaaattcacctga

SEQ ID NO: 10012 - DNA, 20 bp, Artificial Sequence
  Description of Artificial Sequence: Synthetic oligonucleotide
  Target: FXN; (-) strand; PAM type: NRG; PAM sequence: GAG
ttgcccagcaattccattct

SEQ ID NO: 10013 - DNA, 20 bp, Artificial Sequence
  Description of Artificial Sequence: Synthetic oligonucleotide
  Target: FXN; (-) strand; PAM type: NRG; PAM sequence: CAG
ttattggctgcccctttgcc

SEQ ID NO: 10014 - DNA, 20 bp, Artificial Sequence
  Description of Artificial Sequence: Synthetic oligonucleotide
  Target: FXN; (-) strand; PAM type: NRG; PAM sequence: TGG
gcatcaaatgagttgattat

SEQ ID NO: 10015 - DNA, 20 bp, Artificial Sequence
  Description of Artificial Sequence: Synthetic oligonucleotide
  Target: FXN; (-) strand; PAM type: NRG; PAM sequence: GAG
caccacttttggcatcaaat

SEQ ID NO: 10016 - DNA, 20 bp, Artificial Sequence
  Description of Artificial Sequence: Synthetic oligonucleotide
  Target: FXN; (-) strand; PAM type: NRG; PAM sequence: TGG
tgaactggcaccaccacttt

SEQ ID NO: 10017 - DNA, 20 bp, Artificial Sequence
  Description of Artificial Sequence: Synthetic oligonucleotide
  Target: FXN; (-) strand; PAM type: NRG; PAM sequence: TGG
cctcgcaggggaggatgaac

SEQ ID NO: 10018 - DNA, 20 bp, Artificial Sequence
  Description of Artificial Sequence: Synthetic oligonucleotide
  Target: FXN; (-) strand; PAM type: NRG; PAM sequence: AGG
ggacccatacctcgcagggg

SEQ ID NO: 10019 - DNA, 20 bp, Artificial Sequence
  Description of Artificial Sequence: Synthetic oligonucleotide
  Target: FXN; (-) strand; PAM type: NRG; PAM sequence: GAG
aggacccatacctcgcaggg

SEQ ID NO: 10020 - DNA, 20 bp, Artificial Sequence
  Description of Artificial Sequence: Synthetic oligonucleotide
  Target: FXN; (-) strand; PAM type: NRG; PAM sequence: GGG
tcaggacccatacctcgcag

SEQ ID NO: 10021 - DNA, 20 bp, Artificial Sequence
  Description of Artificial Sequence: Synthetic oligonucleotide
  Target: FXN; (-) strand; PAM type: NRG; PAM sequence: GGG
atcaggacccatacctcgca

SEQ ID NO: 10022 - DNA, 20 bp, Artificial Sequence
  Description of Artificial Sequence: Synthetic oligonucleotide
  Target: FXN; (-) strand; PAM type: NRG; PAM sequence: AGG
aatcaggacccatacctcgc

SEQ ID NO: 10023 - DNA, 20 bp, Artificial Sequence
  Description of Artificial Sequence: Synthetic oligonucleotide
  Target: FXN; (-) strand; PAM type: NRG; PAM sequence: CAG
gaatcaggacccatacctcg

SEQ ID NO: 10024 - DNA, 20 bp, Artificial Sequence
  Description of Artificial Sequence: Synthetic oligonucleotide
  Target: FXN; (-) strand; PAM type: NRG; PAM sequence: AGG
cagcacttgaagagtgaatc

SEQ ID NO: 10025 - DNA, 20 bp, Artificial Sequence
  Description of Artificial Sequence: Synthetic oligonucleotide
  Target: FXN; (-) strand; PAM type: NRG; PAM sequence: CAG
acagcacttgaagagtgaat

SEQ ID NO: 10026 - DNA, 20 bp, Artificial Sequence
  Description of Artificial Sequence: Synthetic oligonucleotide
  Target: FXN; (-) strand; PAM type: NRG; PAM sequence: GAG
gtcaaaccacagcacttgaa

SEQ ID NO: 10027 - DNA, 20 bp, Artificial Sequence
  Description of Artificial Sequence: Synthetic oligonucleotide
  Target: FXN; (-) strand; PAM type: NRG; PAM sequence: AAG
ctgtcaaaccacagcacttg

SEQ ID NO: 10028 - DNA, 20 bp, Artificial Sequence
  Description of Artificial Sequence: Synthetic oligonucleotide
  Target: FXN; (-) strand; PAM type: NRG; PAM sequence: CAG
cccccggccctgtcaaacca

SEQ ID NO: 10029 - DNA, 20 bp, Artificial Sequence
  Description of Artificial Sequence: Synthetic oligonucleotide
  Target: FXN; (-) strand; PAM type: NRG; PAM sequence: CGG
aggtgtccccttgtcacccc

SEQ ID NO: 10030 - DNA, 20 bp, Artificial Sequence
  Description of Artificial Sequence: Synthetic oligonucleotide
  Target: FXN; (-) strand; PAM type: NRG; PAM sequence: AGG
ggagcccagctttccttccc

SEQ ID NO: 10031 - DNA, 20 bp, Artificial Sequence
  Description of Artificial Sequence: Synthetic oligonucleotide
  Target: FXN; (-) strand; PAM type: NRG; PAM sequence: CAG
gggagcccagctttccttcc

SEQ ID NO: 10032 - DNA, 20 bp, Artificial Sequence
  Description of Artificial Sequence: Synthetic oligonucleotide
  Target: FXN; (-) strand; PAM type: NRG; PAM sequence: CAG
tggatggccagcagggagcc

SEQ ID NO: 10033 - DNA, 20 bp, Artificial Sequence
  Description of Artificial Sequence: Synthetic oligonucleotide
  Target: FXN; (-) strand; PAM type: NRG; PAM sequence: GAG
tggcctggatggccagcagg

SEQ ID NO: 10034 - DNA, 20 bp, Artificial Sequence
  Description of Artificial Sequence: Synthetic oligonucleotide
  Target: FXN; (-) strand; PAM type: NRG; PAM sequence: GGG
actggcctggatggccagca

SEQ ID NO: 10035 - DNA, 20 bp, Artificial Sequence
  Description of Artificial Sequence: Synthetic oligonucleotide
  Target: FXN; (-) strand; PAM type: NRG; PAM sequence: AGG
gactggcctggatggccagc

SEQ ID NO: 10036 - DNA, 20 bp, Artificial Sequence
  Description of Artificial Sequence: Synthetic oligonucleotide
  Target: FXN; (-) strand; PAM type: NRG; PAM sequence: CAG
ggactggcctggatggccag

SEQ ID NO: 10037 - DNA, 20 bp, Artificial Sequence
  Description of Artificial Sequence: Synthetic oligonucleotide
  Target: FXN; (-) strand; PAM type: NRG; PAM sequence: CAG
taaggactggcctggatggc

SEQ ID NO: 10038 - DNA, 20 bp, Artificial Sequence
  Description of Artificial Sequence: Synthetic oligonucleotide
  Target: FXN; (-) strand; PAM type: NRG; PAM sequence: TGG
ctggtaaggactggcctgga

SEQ ID NO: 10039 - DNA, 20 bp, Artificial Sequence
  Description of Artificial Sequence: Synthetic oligonucleotide
  Target: FXN; (-) strand; PAM type: NRG; PAM sequence: TGG
ccccctggtaaggactggcc

SEQ ID NO: 10040 - DNA, 20 bp, Artificial Sequence
  Description of Artificial Sequence: Synthetic oligonucleotide
  Target: FXN; (-) strand; PAM type: NRG; PAM sequence: TGG
gcctaccccctggtaaggac

SEQ ID NO: 10041 - DNA, 20 bp, Artificial Sequence
  Description of Artificial Sequence: Synthetic oligonucleotide
  Target: FXN; (-) strand; PAM type: NRG; PAM sequence: AGG
tcattgcctaccccctggta

SEQ ID NO: 10042 - DNA, 20 bp, Artificial Sequence
  Description of Artificial Sequence: Synthetic oligonucleotide
  Target: FXN; (-) strand; PAM type: NRG; PAM sequence: AAG
atcattgcctaccccctggt

SEQ ID NO: 10043 - DNA, 20 bp, Artificial Sequence
  Description of Artificial Sequence: Synthetic oligonucleotide
  Target: FXN; (-) strand; PAM type: NRG; PAM sequence: TGG
cccaatcattgcctaccccc

SEQ ID NO: 10044 - DNA, 20 bp, Artificial Sequence
  Description of Artificial Sequence: Synthetic oligonucleotide
  Target: FXN; (-) strand; PAM type: NRG; PAM sequence: AGG
aagtctcaggcccagtggtc

SEQ ID NO: 10045 - DNA, 20 bp, Artificial Sequence
  Description of Artificial Sequence: Synthetic oligonucleotide
  Target: FXN; (-) strand; PAM type: NRG; PAM sequence: CAG
gaagtctcaggcccagtggt

SEQ ID NO: 10046 - DNA, 20 bp, Artificial Sequence
  Description of Artificial Sequence: Synthetic oligonucleotide
  Target: FXN; (-) strand; PAM type: NRG; PAM sequence: TGG
gcctgaagtctcaggcccag

SEQ ID NO: 10047 - DNA, 20 bp, Artificial Sequence
  Description of Artificial Sequence: Synthetic oligonucleotide
  Target: FXN; (-) strand; PAM type: NRG; PAM sequence: CAG
tgggcctgaagtctcaggcc

SEQ ID NO: 10048 - DNA, 20 bp, Artificial Sequence
  Description of Artificial Sequence: Synthetic oligonucleotide
  Target: FXN; (-) strand; PAM type: NRG; PAM sequence: AGG
gtttctgggcctgaagtctc

SEQ ID NO: 10049 - DNA, 20 bp, Artificial Sequence
  Description of Artificial Sequence: Synthetic oligonucleotide
  Target: FXN; (-) strand; PAM type: NRG; PAM sequence: CAG
agtttctgggcctgaagtct

SEQ ID NO: 10050 - DNA, 20 bp, Artificial Sequence
  Description of Artificial Sequence: Synthetic oligonucleotide
  Target: FXN; (-) strand; PAM type: NRG; PAM sequence: AAG
ttagatagtttctgggcctg

SEQ ID NO: 10051 - DNA, 20 bp, Artificial Sequence
  Description of Artificial Sequence: Synthetic oligonucleotide
  Target: FXN; (-) strand; PAM type: NRG; PAM sequence: GGG
ggaaatattagatagtttct

SEQ ID NO: 10052 - DNA, 20 bp, Artificial Sequence
  Description of Artificial Sequence: Synthetic oligonucleotide
  Target: FXN; (-) strand; PAM type: NRG; PAM sequence: TGG
aggaaatattagatagtttc

SEQ ID NO: 10053 - DNA, 20 bp, Artificial Sequence
  Description of Artificial Sequence: Synthetic oligonucleotide
  Target: FXN; (-) strand; PAM type: NRG; PAM sequence: TAG
gcatttgaggaaatattaga

SEQ ID NO: 10054 - DNA, 20 bp, Artificial Sequence
  Description of Artificial Sequence: Synthetic oligonucleotide
  Target: FXN; (-) strand; PAM type: NRG; PAM sequence: TAG
ggatgcatttgaggaaatat

SEQ ID NO: 10055 - DNA, 20 bp, Artificial Sequence
  Description of Artificial Sequence: Synthetic oligonucleotide
  Target: FXN; (-) strand; PAM type: NRG; PAM sequence: AGG
ctgctcatgggatgcatttg

SEQ ID NO: 10056 - DNA, 20 bp, Artificial Sequence
  Description of Artificial Sequence: Synthetic oligonucleotide
  Target: FXN; (-) strand; PAM type: NRG; PAM sequence: GAG
cctgctcatgggatgcattt

SEQ ID NO: 10057 - DNA, 20 bp, Artificial Sequence
  Description of Artificial Sequence: Synthetic oligonucleotide
  Target: FXN; (-) strand; PAM type: NRG; PAM sequence: GGG
ctcacacagtgcctgctcat

SEQ ID NO: 10058 - DNA, 20 bp, Artificial Sequence
  Description of Artificial Sequence: Synthetic oligonucleotide
  Target: FXN; (-) strand; PAM type: NRG; PAM sequence: TGG
actcacacagtgcctgctca

SEQ ID NO: 10059 - DNA, 20 bp, Artificial Sequence
  Description of Artificial Sequence: Synthetic oligonucleotide
  Target: FXN; (-) strand; PAM type: NRG; PAM sequence: CAG
gatgtgtgtgctcactcaca

SEQ ID NO: 10060 - DNA, 20 bp, Artificial Sequence
  Description of Artificial Sequence: Synthetic oligonucleotide
  Target: FXN; (-) strand; PAM type: NRG; PAM sequence: CAG
gcttgcctagcttgaggctt

SEQ ID NO: 10061 - DNA, 20 bp, Artificial Sequence
  Description of Artificial Sequence: Synthetic oligonucleotide
  Target: FXN; (-) strand; PAM type: NRG; PAM sequence: AGG
tggtaggcttgcctagcttg

SEQ ID NO: 10062 - DNA, 20 bp, Artificial Sequence
  Description of Artificial Sequence: Synthetic oligonucleotide
  Target: FXN; (-) strand; PAM type: NRG; PAM sequence: GAG
atggtaggcttgcctagctt

SEQ ID NO: 10063 - DNA, 20 bp, Artificial Sequence
  Description of Artificial Sequence: Synthetic oligonucleotide
  Target: FXN; (-) strand; PAM type: NRG; PAM sequence: TAG
caagtcatggtaggcttgcc

SEQ ID NO: 10064 - DNA, 20 bp, Artificial Sequence
  Description of Artificial Sequence: Synthetic oligonucleotide
  Target: FXN; (-) strand; PAM type: NRG; PAM sequence: AGG
cttggaccacaagtcatggt

SEQ ID NO: 10065 - DNA, 20 bp, Artificial Sequence
  Description of Artificial Sequence: Synthetic oligonucleotide
  Target: FXN; (-) strand; PAM type: NRG; PAM sequence: TAG
ccttggaccacaagtcatgg

SEQ ID NO: 10066 - DNA, 20 bp, Artificial Sequence
  Description of Artificial Sequence: Synthetic oligonucleotide
  Target: FXN; (-) strand; PAM type: NRG; PAM sequence: TGG
agcccttggaccacaagtca

SEQ ID NO: 10067 - DNA, 20 bp, Artificial Sequence
  Description of Artificial Sequence: Synthetic oligonucleotide
  Target: FXN; (-) strand; PAM type: NRG; PAM sequence: AAG
cccgtgagcccttggaccac

SEQ ID NO: 10068 - DNA, 20 bp, Artificial Sequence
  Description of Artificial Sequence: Synthetic oligonucleotide
  Target: FXN; (-) strand; PAM type: NRG; PAM sequence: TGG
ccaggtcacccgtgagccct

SEQ ID NO: 10069 - DNA, 20 bp, Artificial Sequence
  Description of Artificial Sequence: Synthetic oligonucleotide
  Target: FXN; (-) strand; PAM type: NRG; PAM sequence: GAG
tctaactccaggtcacccgt

SEQ ID NO: 10070 - DNA, 20 bp, Artificial Sequence
  Description of Artificial Sequence: Synthetic oligonucleotide
  Target: FXN; (-) strand; PAM type: NRG; PAM sequence: AGG
ccatgtctccctctaactcc

SEQ ID NO: 10071 - DNA, 20 bp, Artificial Sequence
  Description of Artificial Sequence: Synthetic oligonucleotide
  Target: FXN; (-) strand; PAM type: NRG; PAM sequence: CAG
gccatgtctccctctaactc

SEQ ID NO: 10072 - DNA, 20 bp, Artificial Sequence
  Description of Artificial Sequence: Synthetic oligonucleotide
  Target: FXN; (-) strand; PAM type: NRG; PAM sequence: CAG
ttctttctaaagccacctgg

SEQ ID NO: 10073 - DNA, 20 bp, Artificial Sequence
  Description of Artificial Sequence: Synthetic oligonucleotide
  Target: FXN; (-) strand; PAM type: NRG; PAM sequence: TGG
gtgttctttctaaagccacc

SEQ ID NO: 10074 - DNA, 20 bp, Artificial Sequence
  Description of Artificial Sequence: Synthetic oligonucleotide
  Target: FXN; (-) strand; PAM type: NRG; PAM sequence: AAG
catgatgagtgttctttcta

SEQ ID NO: 10075 - DNA, 20 bp, Artificial Sequence
  Description of Artificial Sequence: Synthetic oligonucleotide
  Target: FXN; (-) strand; PAM type: NRG; PAM sequence: GAG
ccaccgcacctggccatgat

SEQ ID NO: 10076 - DNA, 20 bp, Artificial Sequence
  Description of Artificial Sequence: Synthetic oligonucleotide
  Target: FXN; (-) strand; PAM type: NRG; PAM sequence: TGG
caggcgtaagccaccgcacc

SEQ ID NO: 10077 - DNA, 20 bp, Artificial Sequence
  Description of Artificial Sequence: Synthetic oligonucleotide
  Target: FXN; (-) strand; PAM type: NRG; PAM sequence: AAG
agtgctgggattacaggcgt

SEQ ID NO: 10078 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctgggattac

SEQ ID NO: 10079 - DNA, 20 bp, Artificial Sequence
  Description of Artificial Sequence: Synthetic oligonucleotide
  Target: FXN; (-) strand; PAM type: NRG; PAM sequence: CAG
ctcccaaagtgctgggatta

SEQ ID NO: 10080 - DNA, 20 bp, Artificial Sequence
  Description of Artificial Sequence: Synthetic oligonucleotide
  Target: FXN; (-) strand; PAM type: NRG; PAM sequence: GGG
ccttggcctcccaaagtgct

SEQ ID NO: 10081 - DNA, 20 bp, Artificial Sequence
  Description of Artificial Sequence: Synthetic oligonucleotide
  Target: FXN; (-) strand; PAM type: NRG; PAM sequence: TGG
accttggcctcccaaagtgc

SEQ ID NO: 10082 - DNA, 20 bp, Artificial Sequence
  Description of Artificial Sequence: Synthetic oligonucleotide
  Target: FXN; (-) strand; PAM type: NRG; PAM sequence: AAG
ccacccaccttggcctccca

SEQ ID NO: 10083 - DNA, 20 bp, Artificial Sequence
  Description of Artificial Sequence: Synthetic oligonucleotide
  Target: FXN; (-) strand; PAM type: NRG; PAM sequence: TGG
acctcatgatccacccacct

SEQ ID NO: 10084 - DNA, 20 bp, Artificial Sequence
  Description of Artificial Sequence: Synthetic oligonucleotide
  Target: FXN; (-) strand; PAM type: NRG; PAM sequence: TGG
tttcagcatgttggtcaggc

SEQ ID NO: 10085 - DNA, 20 bp, Artificial Sequence
  Description of Artificial Sequence: Synthetic oligonucleotide
  Target: FXN; (-) strand; PAM type: NRG; PAM sequence: AGG
caggtttcagcatgttggtc

SEQ ID NO: 10086 - DNA, 20 bp, Artificial Sequence
  Description of Artificial Sequence: Synthetic oligonucleotide
  Target: FXN; (-) strand; PAM type: NRG; PAM sequence: CAG
acaggtttcagcatgttggt

SEQ ID NO: 10087 - DNA, 20 bp, Artificial Sequence
  Description of Artificial Sequence: Synthetic oligonucleotide
  Target: FXN; (-) strand; PAM type: NRG; PAM sequence: TGG
agagacaggtttcagcatgt

SEQ ID NO: 10088 - DNA, 20 bp, Artificial Sequence
  Description of Artificial Sequence: Synthetic oligonucleotide
  Target: FXN; (-) strand; PAM type: NRG; PAM sequence: CAG
tttttaggagagacaggttt

SEQ ID NO: 10089 - DNA, 20 bp, Artificial Sequence
  Description of Artificial Sequence: Synthetic oligonucleotide
  Target: FXN; (-) strand; PAM type: NRG; PAM sequence: AGG
tttgtgtttttaggagagac

SEQ ID NO: 10090 - DNA, 20 bp, Artificial Sequence
  Description of Artificial Sequence: Synthetic oligonucleotide
  Target: FXN; (-) strand; PAM type: NRG; PAM sequence: CAG
ttttgtgtttttaggagaga

SEQ ID NO: 10091 - DNA, 20 bp, Artificial Sequence
  Description of Artificial Sequence: Synthetic oligonucleotide
  Target: FXN; (-) strand; PAM type: NRG; PAM sequence: GAG
taatttttgtgtttttagga

SEQ ID NO: 10092 - DNA, 20 bp, Artificial Sequence
  Description of Artificial Sequence: Synthetic oligonucleotide
  Target: FXN; (-) strand; PAM type: NRG; PAM sequence: GAG
gctaatttttgtgtttttag

SEQ ID NO: 10093 - DNA, 20 bp, Artificial Sequence
  Description of Artificial Sequence: Synthetic oligonucleotide
  Target: FXN; (-) strand; PAM type: NRG; PAM sequence: AGG
cagctaatttttgtgttttt

SEQ ID NO: 10094 - DNA, 20 bp, Artificial Sequence
  Description of Artificial Sequence: Synthetic oligonucleotide
  Target: FXN; (-) strand; PAM type: NRG; PAM sequence: TAG
ccagctaatttttgtgtttt

SEQ ID NO: 10095 - DNA, 20 bp, Artificial Sequence
  Description of Artificial Sequence: Synthetic oligonucleotide
  Target: FXN; (-) strand; PAM type: NRG; PAM sequence: CAG
caggcgtgcacctccatgcc

SEQ ID NO: 10096 - DNA, 20 bp, Artificial Sequence
  Description of Artificial Sequence: Synthetic oligonucleotide
  Target: FXN; (-) strand; PAM type: NRG; PAM sequence: AGG
tcctgagtagctgggattac

SEQ ID NO: 10097 - DNA, 20 bp, Artificial Sequence
  Description of Artificial Sequence: Synthetic oligonucleotide
  Target: FXN; (-) strand; PAM type: NRG; PAM sequence: CAG
ctcctgagtagctgggatta

SEQ ID NO: 10098 - DNA, 20 bp, Artificial Sequence
  Description of Artificial Sequence: Synthetic oligonucleotide
  Target: FXN; (-) strand; PAM type: NRG; PAM sequence: GGG
cctcagcctcctgagtagct

SEQ ID NO: 10099 - DNA, 20 bp, Artificial Sequence
  Description of Artificial Sequence: Synthetic oligonucleotide
  Target: FXN; (-) strand; PAM type: NRG; PAM sequence: TGG
gcctcagcctcctgagtagc

SEQ ID NO: 10100 - DNA, 20 bp, Artificial Sequence
  Description of Artificial Sequence: Synthetic oligonucleotide
  Target: FXN; (-) strand; PAM type: NRG; PAM sequence: TAG
tcctgcctcagcctcctgag

SEQ ID NO: 10101 - DNA, 20 bp, Artificial Sequence
  Description of Artificial Sequence: Synthetic oligonucleotide
  Target: FXN; (-) strand; PAM type: NRG; PAM sequence: GAG
ttctcctgcctcagcctcct

SEQ ID NO: 10102 - DNA, 20 bp, Artificial Sequence
  Description of Artificial Sequence: Synthetic oligonucleotide
  Target: FXN; (-) strand; PAM type: NRG; PAM sequence: CAG
ttcaagtgattctcctgcct

SEQ ID NO: 10103 - DNA, 20 bp, Artificial Sequence
  Description of Artificial Sequence: Synthetic oligonucleotide
  Target: FXN; (-) strand; PAM type: NRG; PAM sequence: AAG
aacctccgcctcccgggttc

SEQ ID NO: 10104 - DNA, 20 bp, Artificial Sequence
  Description of Artificial Sequence: Synthetic oligonucleotide
  Target: FXN; (-) strand; PAM type: NRG; PAM sequence: GGG
tattgcaacctccgcctccc

SEQ ID NO: 10105 - DNA, 20 bp, Artificial Sequence
  Description of Artificial Sequence: Synthetic oligonucleotide
  Target: FXN; (-) strand; PAM type: NRG; PAM sequence: CGG
ttattgcaacctccgcctcc

SEQ ID NO: 10106 - DNA, 20 bp, Artificial Sequence
  Description of Artificial Sequence: Synthetic oligonucleotide
  Target: FXN; (-) strand; PAM type: NRG; PAM sequence: AGG
ggaatgcagtggcacaatct

SEQ ID NO: 10107 - DNA, 20 bp, Artificial Sequence
  Description of Artificial Sequence: Synthetic oligonucleotide
  Target: FXN; (-) strand; PAM type: NRG; PAM sequence: TAG
tggaatgcagtggcacaatc

SEQ ID NO: 10108 - DNA, 20 bp, Artificial Sequence
  Description of Artificial Sequence: Synthetic oligonucleotide
  Target: FXN; (-) strand; PAM type: NRG; PAM sequence: TGG
ttgcccaggctggaatgcag

SEQ ID NO: 10109 - DNA, 20 bp, Artificial Sequence
  Description of Artificial Sequence: Synthetic oligonucleotide
  Target: FXN; (-) strand; PAM type: NRG; PAM sequence: CAG
ctgttgcccaggctggaatg

SEQ ID NO: 10110 - DNA, 20 bp, Artificial Sequence
  Description of Artificial Sequence: Synthetic oligonucleotide
  Target: FXN; (-) strand; PAM type: NRG; PAM sequence: TGG
tcttgctctgttgcccaggc

SEQ ID NO: 10111 - DNA, 20 bp, Artificial Sequence
  Description of Artificial Sequence: Synthetic oligonucleotide
  Target: FXN; (-) strand; PAM type: NRG; PAM sequence: AGG
ggagtcttgctctgttgccc

SEQ ID NO: 10112 - DNA, 20 bp, Artificial Sequence
  Description of Artificial Sequence: Synthetic oligonucleotide
  Target: FXN; (-) strand; PAM type: NRG; PAM sequence: CAG
cggagtcttgctctgttgcc

SEQ ID NO: 10113 - DNA, 20 bp, Artificial Sequence
  Description of Artificial Sequence: Synthetic oligonucleotide
  Target: FXN; (-) strand; PAM type: NRG; PAM sequence: GAG
ttttttttttttctgagacg

SEQ ID NO: 10114 - DNA, 20 bp, Artificial Sequence
  Description of Artificial Sequence: Synthetic oligonucleotide
  Target: FXN; (-) strand; PAM type: NRG; PAM sequence: CGG
ttttttttttttttctgaga

SEQ ID NO: 10115 - DNA, 20 bp, Artificial Sequence
  Description of Artificial Sequence: Synthetic oligonucleotide
  Target: FXN; (-) strand; PAM type: NRG; PAM sequence: GAG
tcctttttttttttttttct

SEQ ID NO: 10116 - DNA, 20 bp, Artificial Sequence
  Description of Artificial Sequence: Synthetic oligonucleotide
  Target: FXN; (-) strand; PAM type: NRG; PAM sequence: GAG
ggaggtcaaggtcataggat

SEQ ID NO: 10117 - DNA, 20 bp, Artificial Sequence
  Description of Artificial Sequence: Synthetic oligonucleotide
  Target: FXN; (-) strand; PAM type: NRG; PAM sequence: AGG
agcttggaggtcaaggtcat

SEQ ID NO: 10118 - DNA, 20 bp, Artificial Sequence
  Description of Artificial Sequence: Synthetic oligonucleotide
  Target: FXN; (-) strand; PAM type: NRG; PAM sequence: TAG
aagcttggaggtcaaggtca

SEQ ID NO: 10119 - DNA, 20 bp, Artificial Sequence
  Description of Artificial Sequence: Synthetic oligonucleotide
  Target: FXN; (-) strand; PAM type: NRG; PAM sequence: AGG
gaggcaaagcttggaggtca

SEQ ID NO: 10120 - DNA, 20 bp, Artificial Sequence
  Description of Artificial Sequence: Synthetic oligonucleotide
  Target: FXN; (-) strand; PAM type: NRG; PAM sequence: AAG
ggaggcaaagcttggaggtc

SEQ ID NO: 10121 - DNA, 20 bp, Artificial Sequence
  Description of Artificial Sequence: Synthetic oligonucleotide
  Target: FXN; (-) strand; PAM type: NRG; PAM sequence: AGG
ttgagggaggcaaagcttgg

SEQ ID NO: 10122 - DNA, 20 bp, Artificial Sequence
  Description of Artificial Sequence: Synthetic oligonucleotide
  Target: FXN; (-) strand; PAM type: NRG; PAM sequence: GAG
cttgagggaggcaaagcttg

SEQ ID NO: 10123 - DNA, 20 bp, Artificial Sequence
  Description of Artificial Sequence: Synthetic oligonucleotide
  Target: FXN; (-) strand; PAM type: NRG; PAM sequence: TGG
tgcttgagggaggcaaagct

SEQ ID NO: 10124 - DNA, 20 bp, Artificial Sequence
  Description of Artificial Sequence: Synthetic oligonucleotide
  Target: FXN; (-) strand; PAM type: NRG; PAM sequence: AAG
tgttctgcttgagggaggca

SEQ ID NO: 10125 - DNA, 20 bp, Artificial Sequence
  Description of Artificial Sequence: Synthetic oligonucleotide
  Target: FXN; (-) strand; PAM type: NRG; PAM sequence: AGG
cattctgttctgcttgaggg

SEQ ID NO: 10126 - DNA, 20 bp, Artificial Sequence
  Description of Artificial Sequence: Synthetic oligonucleotide
  Target: FXN; (-) strand; PAM type: NRG; PAM sequence: GAG
ccattctgttctgcttgagg

SEQ ID NO: 10127 - DNA, 20 bp, Artificial Sequence
  Description of Artificial Sequence: Synthetic oligonucleotide
  Target: FXN; (-) strand; PAM type: NRG; PAM sequence: GGG
ctccattctgttctgcttga

SEQ ID NO: 10128 - DNA, 20 bp, Artificial Sequence
  Description of Artificial Sequence: Synthetic oligonucleotide
  Target: FXN; (-) strand; PAM type: NRG; PAM sequence: AGG
gctccattctgttctgcttg

SEQ ID NO: 10129 - DNA, 20 bp, Artificial Sequence
  Description of Artificial Sequence: Synthetic oligonucleotide
  Target: FXN; (-) strand; PAM type: NRG; PAM sequence: GAG
ggctccattctgttctgctt

SEQ ID NO: 10130 - DNA, 20 bp, Artificial Sequence
  Description of Artificial Sequence: Synthetic oligonucleotide
  Target: FXN; (-) strand; PAM type: NRG; PAM sequence: AGG
cttccgcctctgcctaaggg

SEQ ID NO: 10131 - DNA, 20 bp, Artificial Sequence
  Description of Artificial Sequence: Synthetic oligonucleotide
  Target: FXN; (-) strand; PAM type: NRG; PAM sequence: GAG
acttccgcctctgcctaagg

SEQ ID NO: 10132 - DNA, 20 bp, Artificial Sequence
  Description of Artificial Sequence: Synthetic oligonucleotide
  Target: FXN; (-) strand; PAM type: NRG; PAM sequence: GGG
aaacttccgcctctgcctaa

SEQ ID NO: 10133 - DNA, 20 bp, Artificial Sequence
  Description of Artificial Sequence: Synthetic oligonucleotide
  Target: FXN; (-) strand; PAM type: NRG; PAM sequence: AGG
caaacttccgcctctgccta

SEQ ID NO: 10134 - DNA, 20 bp, Artificial Sequence
  Description of Artificial Sequence: Synthetic oligonucleotide
  Target: FXN; (-) strand; PAM type: NRG; PAM sequence: AAG
gcaaacttccgcctctgcct

SEQ ID NO: 10135 - DNA, 20 bp, Artificial Sequence
  Description of Artificial Sequence: Synthetic oligonucleotide
  Target: FXN; (-) strand; PAM type: NRG; PAM sequence: AGG
agaatggagaactaggtgag

SEQ ID NO: 10136 - DNA, 20 bp, Artificial Sequence
  Description of Artificial Sequence: Synthetic oligonucleotide
  Target: FXN; (-) strand; PAM type: NRG; PAM sequence: GAG
aagaatggagaactaggtga

SEQ ID NO: 10137 - DNA, 20 bp, Artificial Sequence
  Description of Artificial Sequence: Synthetic oligonucleotide
  Target: FXN; (-) strand; PAM type: NRG; PAM sequence: GAG
aaaagaatggagaactaggt

SEQ ID NO: 10138 - DNA, 20 bp, Artificial Sequence
  Description of Artificial Sequence: Synthetic oligonucleotide
  Target: FXN; (-) strand; PAM type: NRG; PAM sequence: AGG
gaacaaaagaatggagaact

SEQ ID NO: 10139 - DNA, 20 bp, Artificial Sequence
  Description of Artificial Sequence: Synthetic oligonucleotide
  Target: FXN; (-) strand; PAM type: NRG; PAM sequence: TAG
tgaacaaaagaatggagaac

SEQ ID NO: 10140 - DNA, 20 bp, Artificial Sequence
  Description of Artificial Sequence: Synthetic oligonucleotide
  Target: FXN; (-) strand; PAM type: NRG; PAM sequence: GAG
aggctctgaacaaaagaatg

SEQ ID NO: 10141 - DNA, 20 bp, Artificial Sequence
  Description of Artificial Sequence: Synthetic oligonucleotide
  Target: FXN; (-) strand; PAM type: NRG; PAM sequence: TGG
tcaggctctgaacaaaagaa

SEQ ID NO: 10142 - DNA, 20 bp, Artificial Sequence
  Description of Artificial Sequence: Synthetic oligonucleotide
  Target: FXN; (-) strand; PAM type: NRG; PAM sequence: AAG
ggtattcaggctctgaacaa

SEQ ID NO: 10143 - DNA, 20 bp, Artificial Sequence
  Description of Artificial Sequence: Synthetic oligonucleotide
  Target: FXN; (-) strand; PAM type: NRG; PAM sequence: AGG
tacagagcctgagggtattc

SEQ ID NO: 10144 - DNA, 20 bp, Artificial Sequence
  Description of Artificial Sequence: Synthetic oligonucleotide
  Target: FXN; (-) strand; PAM type: NRG; PAM sequence: CAG
gtacagagcctgagggtatt

SEQ ID NO: 10145 - DNA, 20 bp, Artificial Sequence
  Description of Artificial Sequence: Synthetic oligonucleotide
  Target: FXN; (-) strand; PAM type: NRG; PAM sequence: GGG
accccaagtacagagcctga

SEQ ID NO: 10146 - DNA, 20 bp, Artificial Sequence
  Description of Artificial Sequence: Synthetic oligonucleotide
  Target: FXN; (-) strand; PAM type: NRG; PAM sequence: AGG
taccccaagtacagagcctg

SEQ ID NO: 10147 - DNA, 20 bp, Artificial Sequence
  Description of Artificial Sequence: Synthetic oligonucleotide
  Target: FXN; (-) strand; PAM type: NRG; PAM sequence: GAG
ataccccaagtacagagcct

SEQ ID NO: 10148 - DNA, 20 bp, Artificial Sequence
  Description of Artificial Sequence: Synthetic oligonucleotide
  Target: FXN; (-) strand; PAM type: NRG; PAM sequence: GAG
acagaaataccccaagtaca

SEQ ID NO: 10149 - DNA, 20 bp, Artificial Sequence
  Description of Artificial Sequence: Synthetic oligonucleotide
  Target: FXN; (-) strand; PAM type: NRG; PAM sequence: CAG
gaacagaaataccccaagta

SEQ ID NO: 10150 - DNA, 20 bp, Artificial Sequence
  Description of Artificial Sequence: Synthetic oligonucleotide
  Target: FXN; (-) strand; PAM type: NRG; PAM sequence: AAG
caagagaacagaaatacccc

SEQ ID NO: 10151 - DNA, 20 bp, Artificial Sequence
  Description of Artificial Sequence: Synthetic oligonucleotide
  Target: FXN; (-) strand; PAM type: NRG; PAM sequence: CAG
gtgagcataaaacaagagaa

SEQ ID NO: 10152 - DNA, 20 bp, Artificial Sequence
  Description of Artificial Sequence: Synthetic oligonucleotide
  Target: FXN; (-) strand; PAM type: NRG; PAM sequence: GAG
caaccgtgagcataaaacaa

SEQ ID NO: 10153 - DNA, 20 bp, Artificial Sequence
  Description of Artificial Sequence: Synthetic oligonucleotide
  Target: FXN; (-) strand; PAM type: NRG; PAM sequence: AAG
cacaaccgtgagcataaaac

SEQ ID NO: 10154 - DNA, 20 bp, Artificial Sequence
  Description of Artificial Sequence: Synthetic oligonucleotide
  Target: FXN; (-) strand; PAM type: NRG; PAM sequence: GAG
acaacaaacctcacaaccgt

SEQ ID NO: 10155 - DNA, 20 bp, Artificial Sequence
  Description of Artificial Sequence: Synthetic oligonucleotide
  Target: FXN; (-) strand; PAM type: NRG; PAM sequence: TGG
tcctctgaaggaagggatcg

SEQ ID NO: 10156 - DNA, 20 bp, Artificial Sequence
  Description of Artificial Sequence: Synthetic oligonucleotide
  Target: FXN; (-) strand; PAM type: NRG; PAM sequence: GGG
agtttactcctctgaaggaa

SEQ ID NO: 10157 - DNA, 20 bp, Artificial Sequence
  Description of Artificial Sequence: Synthetic oligonucleotide
  Target: FXN; (-) strand; PAM type: NRG; PAM sequence: AGG
cagtttactcctctgaagga

SEQ ID NO: 10158 - DNA, 20 bp, Artificial Sequence
  Description of Artificial Sequence: Synthetic oligonucleotide
  Target: FXN; (-) strand; PAM type: NRG; PAM sequence: AAG
tcagtttactcctctgaagg

SEQ ID NO: 10159 - DNA, 20 bp, Artificial Sequence
  Description of Artificial Sequence: Synthetic oligonucleotide
  Target: FXN; (-) strand; PAM type: NRG; PAM sequence: AGG
acctcagtttactcctctga

SEQ ID NO: 10160 - DNA, 20 bp, Artificial Sequence
  Description of Artificial Sequence: Synthetic oligonucleotide
  Target: FXN; (-) strand; PAM type: NRG; PAM sequence: AAG
aacctcagtttactcctctg

SEQ ID NO: 10161 - DNA, 20 bp, Artificial Sequence
  Description of Artificial Sequence: Synthetic oligonucleotide
  Target: FXN; (-) strand; PAM type: NRG; PAM sequence: CAG
tgctaaaccttttggaacct

SEQ ID NO: 10162 - DNA, 20 bp, Artificial Sequence
  Description of Artificial Sequence: Synthetic oligonucleotide
  Target: FXN; (-) strand; PAM type: NRG; PAM sequence: TGG
cgggcaactgctaaaccttt

SEQ ID NO: 10163 - DNA, 20 bp, Artificial Sequence
  Description of Artificial Sequence: Synthetic oligonucleotide
  Target: FXN; (-) strand; PAM type: NRG; PAM sequence: GGG
ttgccaatttaatattcctc

SEQ ID NO: 10164 - DNA, 20 bp, Artificial Sequence
  Description of Artificial Sequence: Synthetic oligonucleotide
  Target: FXN; (-) strand; PAM type: NRG; PAM sequence: CGG
tttgccaatttaatattcct

SEQ ID NO: 10165 - DNA, 20 bp, Artificial Sequence
  Description of Artificial Sequence: Synthetic oligonucleotide
  Target: FXN; (-) strand; PAM type: NRG; PAM sequence: AAG
ggctgtttttaatcataaaa

SEQ ID NO: 10166 - DNA, 20 bp, Artificial Sequence
  Description of Artificial Sequence: Synthetic oligonucleotide
  Target: FXN; (-) strand; PAM type: NRG; PAM sequence: CGG
cacaagtagaagtctttctt

SEQ ID NO: 10167 - DNA, 20 bp, Artificial Sequence
  Description of Artificial Sequence: Synthetic oligonucleotide
  Target: FXN; (-) strand; PAM type: NRG; PAM sequence: AAG
tccttcaaaggcacaagtag

SEQ ID NO: 10168 - DNA, 20 bp, Artificial Sequence
  Description of Artificial Sequence: Synthetic oligonucleotide
  Target: FXN; (-) strand; PAM type: NRG; PAM sequence: TAG
tactccttcaaaggcacaag

SEQ ID NO: 10169 - DNA, 20 bp, Artificial Sequence
  Description of Artificial Sequence: Synthetic oligonucleotide
  Target: FXN; (-) strand; PAM type: NRG; PAM sequence: AAG
agttactccttcaaaggcac

SEQ ID NO: 10170 - DNA, 20 bp, Artificial Sequence
  Description of Artificial Sequence: Synthetic oligonucleotide
  Target: FXN; (-) strand; PAM type: NRG; PAM sequence: AGG
aaatgcagttactccttcaa

SEQ ID NO: 10171 - DNA, 20 bp, Artificial Sequence
  Description of Artificial Sequence: Synthetic oligonucleotide
  Target: FXN; (-) strand; PAM type: NRG; PAM sequence: AAG
caaatgcagttactccttca

SEQ ID NO: 10172 - DNA, 20 bp, Artificial Sequence
  Description of Artificial Sequence: Synthetic oligonucleotide
  Target: FXN; (-) strand; PAM type: NRG; PAM sequence: CAG
actggtgggaaggtcaaatg

SEQ ID NO: 10173 - DNA, 20 bp, Artificial Sequence
  Description of Artificial Sequence: Synthetic oligonucleotide
  Target: FXN; (-) strand; PAM type: NRG; PAM sequence: AGG
gatggttgttactggtggga

SEQ ID NO: 10174 - DNA, 20 bp, Artificial Sequence
  Description of Artificial Sequence: Synthetic oligonucleotide
  Target: FXN; (-) strand; PAM type: NRG; PAM sequence: AAG
tgatggttgttactggtggg

SEQ ID NO: 10175 - DNA, 20 bp, Artificial Sequence
  Description of Artificial Sequence: Synthetic oligonucleotide
  Target: FXN; (-) strand; PAM type: NRG; PAM sequence: GGG
atttgatggttgttactggt

SEQ ID NO: 10176 - DNA, 20 bp, Artificial Sequence
  Description of Artificial Sequence: Synthetic oligonucleotide
  Target: FXN; (-) strand; PAM type: NRG; PAM sequence: TGG
gatttgatggttgttactgg

SEQ ID NO: 10177 - DNA, 20 bp, Artificial Sequence
  Description of Artificial Sequence: Synthetic oligonucleotide
  Target: FXN; (-) strand; PAM type: NRG; PAM sequence: TGG
agagatttgatggttgttac

SEQ ID NO: 10178 - DNA, 20 bp, Artificial Sequence
  Description of Artificial Sequence: Synthetic oligonucleotide
  Target: FXN; (-) strand; PAM type: NRG; PAM sequence: TGG
ttaatttaatagagatttga

SEQ ID NO: 10179 - DNA, 20 bp, Artificial Sequence
  Description of Artificial Sequence: Synthetic oligonucleotide
  Target: FXN; (-) strand; PAM type: NRG; PAM sequence: GAG
tgtgtgtgtttaatttaata

SEQ ID NO: 10180 - DNA, 20 bp, Artificial Sequence
  Description of Artificial Sequence: Synthetic oligonucleotide
  Target: FXN; (-) strand; PAM type: NRG; PAM sequence: TAG
tgtgtgtgtgtttaatttaa

SEQ ID NO: 10181 - DNA, 20 bp, Artificial Sequence
  Description of Artificial Sequence: Synthetic oligonucleotide
  Target: FXN; (-) strand; PAM type: NRG; PAM sequence: TAG
agtcgctgataccttcacaa

SEQ ID NO: 10182 - DNA, 20 bp, Artificial Sequence
  Description of Artificial Sequence: Synthetic oligonucleotide
  Target: FXN; (-) strand; PAM type: NRG; PAM sequence: TAG
ccctcaaaccttagttgtct

SEQ ID NO: 10183 - DNA, 20 bp, Artificial Sequence
  Description of Artificial Sequence: Synthetic oligonucleotide
  Target: FXN; (-) strand; PAM type: NRG; PAM sequence: TAG
gatcctggcccctcaaacct

SEQ ID NO: 10184 - DNA, 20 bp, Artificial Sequence
  Description of Artificial Sequence: Synthetic oligonucleotide
  Target: FXN; (-) strand; PAM type: NRG; PAM sequence: TGG
tttccatctctccaggatcc

SEQ ID NO: 10185 - DNA, 20 bp, Artificial Sequence
  Description of Artificial Sequence: Synthetic oligonucleotide
  Target: FXN; (-) strand; PAM type: NRG; PAM sequence: AGG
agggaagtttccatctctcc

SEQ ID NO: 10186 - DNA, 20 bp, Artificial Sequence
  Description of Artificial Sequence: Synthetic oligonucleotide
  Target: FXN; (-) strand; PAM type: NRG; PAM sequence: CAG
cagggaagtttccatctctc

SEQ ID NO: 10187 - DNA, 20 bp, Artificial Sequence
  Description of Artificial Sequence: Synthetic oligonucleotide
  Target: FXN; (-) strand; PAM type: NRG; PAM sequence: AAG
atgtggggctcacctcaggg

SEQ ID NO: 10188 - DNA, 20 bp, Artificial Sequence
  Description of Artificial Sequence: Synthetic oligonucleotide
  Target: FXN; (-) strand; PAM type: NRG; PAM sequence: GGG
agaatgtggggctcacctca

SEQ ID NO: 10189 - DNA, 20 bp, Artificial Sequence
  Description of Artificial Sequence: Synthetic oligonucleotide
  Target: FXN; (-) strand; PAM type: NRG; PAM sequence: AGG
gagaatgtggggctcacctc

SEQ ID NO: 10190 - DNA, 20 bp, Artificial Sequence
  Description of Artificial Sequence: Synthetic oligonucleotide
  Target: FXN; (-) strand; PAM type: NRG; PAM sequence: CAG
tgagaatgtggggctcacct

SEQ ID NO: 10191 - DNA, 20 bp, Artificial Sequence
  Description of Artificial Sequence: Synthetic oligonucleotide
  Target: FXN; (-) strand; PAM type: NRG; PAM sequence: GGG
gaaaagtgtctgagaatgtg

SEQ ID NO: 10192 - DNA, 20 bp, Artificial Sequence
  Description of Artificial Sequence: Synthetic oligonucleotide
  Target: FXN; (-) strand; PAM type: NRG; PAM sequence: GGG
ggaaaagtgtctgagaatgt

SEQ ID NO: 10193 - DNA, 20 bp, Artificial Sequence
  Description of Artificial Sequence: Synthetic oligonucleotide
  Target: FXN; (-) strand; PAM type: NRG; PAM sequence: TGG
aggaaaagtgtctgagaatg

SEQ ID NO: 10194 - DNA, 20 bp, Artificial Sequence
  Description of Artificial Sequence: Synthetic oligonucleotide
  Target: FXN; (-) strand; PAM type: NRG; PAM sequence: GAG
acatccaaggaaaagtgtct

SEQ ID NO: 10195 - DNA, 20 bp, Artificial Sequence
  Description of Artificial Sequence: Synthetic oligonucleotide
  Target: FXN; (-) strand; PAM type: NRG; PAM sequence: AAG
tgctcaaaacatccaaggaa

SEQ ID NO: 10196 - DNA, 20 bp, Artificial Sequence
  Description of Artificial Sequence: Synthetic oligonucleotide
  Target: FXN; (-) strand; PAM type: NRG; PAM sequence: AGG
agcagtgctcaaaacatcca

SEQ ID NO: 10197 - DNA, 20 bp, Artificial Sequence
  Description of Artificial Sequence: Synthetic oligonucleotide
  Target: FXN; (-) strand; PAM type: NRG; PAM sequence: AAG
aagcagtgctcaaaacatcc

SEQ ID NO: 10198 - DNA, 20 bp, Artificial Sequence
  Description of Artificial Sequence: Synthetic oligonucleotide
  Target: FXN; (-) strand; PAM type: NRG; PAM sequence: CAG
tgttttcccaggaattaaag

SEQ ID NO: 10199 - DNA, 20 bp, Artificial Sequence
  Description of Artificial Sequence: Synthetic oligonucleotide
  Target: FXN; (-) strand; PAM type: NRG; PAM sequence: AAG
aattgttttcccaggaatta

SEQ ID NO: 10200 - DNA, 20 bp, Artificial Sequence
  Description of Artificial Sequence: Synthetic oligonucleotide
  Target: FXN; (-) strand; PAM type: NRG; PAM sequence: AGG
gtggaaggaattgttttccc

SEQ ID NO: 10201 - DNA, 20 bp, Artificial Sequence
  Description of Artificial Sequence: Synthetic oligonucleotide
  Target: FXN; (-) strand; PAM type: NRG; PAM sequence: CAG
agtggaaggaattgttttcc

SEQ ID NO: 10202 - DNA, 20 bp, Artificial Sequence
  Description of Artificial Sequence: Synthetic oligonucleotide
  Target: FXN; (-) strand; PAM type: NRG; PAM sequence: AGG
cagagtctgtgcacagtgga

SEQ ID NO: 10203 - DNA, 20 bp, Artificial Sequence
  Description of Artificial Sequence: Synthetic oligonucleotide
  Target: FXN; (-) strand; PAM type: NRG; PAM sequence: AAG
ccagagtctgtgcacagtgg

SEQ ID NO: 10204 - DNA, 20 bp, Artificial Sequence
  Description of Artificial Sequence: Synthetic oligonucleotide
  Target: FXN; (-) strand; PAM type: NRG; PAM sequence: TGG
gccccagagtctgtgcacag

SEQ ID NO: 10205 - DNA, 20 bp, Artificial Sequence
  Description of Artificial Sequence: Synthetic oligonucleotide
  Target: FXN; (-) strand; PAM type: NRG; PAM sequence: CAG
ctggccccagagtctgtgca

SEQ ID NO: 10206 - DNA, 20 bp, Artificial Sequence
  Description of Artificial Sequence: Synthetic oligonucleotide
  Target: FXN; (-) strand; PAM type: NRG; PAM sequence: GAG
acccaagctgtctggcccca

SEQ ID NO: 10207 - DNA, 20 bp, Artificial Sequence
  Description of Artificial Sequence: Synthetic oligonucleotide
  Target: FXN; (-) strand; PAM type: NRG; PAM sequence: CAG
gaacccaagctgtctggccc

SEQ ID NO: 10208 - DNA, 20 bp, Artificial Sequence
  Description of Artificial Sequence: Synthetic oligonucleotide
  Target: FXN; (-) strand; PAM type: NRG; PAM sequence: TGG
gggattgaacccaagctgtc

SEQ ID NO: 10209 - DNA, 20 bp, Artificial Sequence
  Description of Artificial Sequence: Synthetic oligonucleotide
  Target: FXN; (-) strand; PAM type: NRG; PAM sequence: AAG
gcagagctgggattgaaccc

SEQ ID NO: 10210 - DNA, 20 bp, Artificial Sequence
  Description of Artificial Sequence: Synthetic oligonucleotide
  Target: FXN; (-) strand; PAM type: NRG; PAM sequence: GGG
agacattaagtggcagagct

SEQ ID NO: 10211 - DNA, 20 bp, Artificial Sequence
  Description of Artificial Sequence: Synthetic oligonucleotide
  Target: FXN; (-) strand; PAM type: NRG; PAM sequence: TGG
cagacattaagtggcagagc

SEQ ID NO: 10212 - DNA, 20 bp, Artificial Sequence
  Description of Artificial Sequence: Synthetic oligonucleotide
  Target: FXN; (-) strand; PAM type: NRG; PAM sequence: GAG
tacacagacattaagtggca

SEQ ID NO: 10213 - DNA, 20 bp, Artificial Sequence
  Description of Artificial Sequence: Synthetic oligonucleotide
  Target: FXN; (-) strand; PAM type: NRG; PAM sequence: CAG
gatacacagacattaagtgg

SEQ ID NO: 10214 - DNA, 20 bp, Artificial Sequence
  Description of Artificial Sequence: Synthetic oligonucleotide
  Target: FXN; (-) strand; PAM type: NRG; PAM sequence: TGG
acagatacacagacattaag

SEQ ID NO: 10215 - DNA, 20 bp, Artificial Sequence
  Description of Artificial Sequence: Synthetic oligonucleotide
  Target: FXN; (-) strand; PAM type: NRG; PAM sequence: AAG
tacacagatacacagacatt

SEQ ID NO: 10216 - DNA, 20 bp, Artificial Sequence
  Description of Artificial Sequence: Synthetic oligonucleotide
  Target: FXN; (-) strand; PAM type: NRG; PAM sequence: CAG
aacttgcctacacagataca

SEQ ID NO: 10217 - DNA, 20 bp, Artificial Sequence
  Description of Artificial Sequence: Synthetic oligonucleotide
  Target: FXN; (-) strand; PAM type: NRG; PAM sequence: CAG
caaagggtaacttgcctaca

SEQ ID NO: 10218 - DNA, 20 bp, Artificial Sequence
  Description of Artificial Sequence: Synthetic oligonucleotide
  Target: FXN; (-) strand; PAM type: NRG; PAM sequence: GGG
gaggaaactgacgcaccaaa

SEQ ID NO: 10219 - DNA, 20 bp, Artificial Sequence
  Description of Artificial Sequence: Synthetic oligonucleotide
  Target: FXN; (-) strand; PAM type: NRG; PAM sequence: AGG
tgaggaaactgacgcaccaa

SEQ ID NO: 10220 - DNA, 20 bp, Artificial Sequence
  Description of Artificial Sequence: Synthetic oligonucleotide
  Target: FXN; (-) strand; PAM type: NRG; PAM sequence: AAG
atgaggaaactgacgcacca

SEQ ID NO: 10221 - DNA, 20 bp, Artificial Sequence
  Description of Artificial Sequence: Synthetic oligonucleotide
  Target: FXN; (-) strand; PAM type: NRG; PAM sequence: AGG
atagttgtgttttacagatg

SEQ ID NO: 10222 - DNA, 20 bp, Artificial Sequence
  Description of Artificial Sequence: Synthetic oligonucleotide
  Target: FXN; (-) strand; PAM type: NRG; PAM sequence: GAG
tatagttgtgttttacagat

SEQ ID NO: 10223 - DNA, 20 bp, Artificial Sequence
  Description of Artificial Sequence: Synthetic oligonucleotide
  Target: FXN; (-) strand; PAM type: NRG; PAM sequence: CAG
tcaactatagttgtgtttta

SEQ ID NO: 10224 - DNA, 20 bp, Artificial Sequence
  Description of Artificial Sequence: Synthetic oligonucleotide
  Target: FXN; (-) strand; PAM type: NRG; PAM sequence: TAG
taacgaatgaggatcaacta

SEQ ID NO: 10225 - DNA, 20 bp, Artificial Sequence
  Description of Artificial Sequence: Synthetic oligonucleotide
  Target: FXN; (-) strand; PAM type: NRG; PAM sequence: AGG
gtacagactcttaacgaatg

SEQ ID NO: 10226 - DNA, 20 bp, Artificial Sequence
  Description of Artificial Sequence: Synthetic oligonucleotide
  Target: FXN; (-) strand; PAM type: NRG; PAM sequence: GAG
agtacagactcttaacgaat

SEQ ID NO: 10227 - DNA, 20 bp, Artificial Sequence
  Description of Artificial Sequence: Synthetic oligonucleotide
  Target: FXN; (-) strand; PAM type: NRG; PAM sequence: CAG
agtgagcaaattaacaagta

SEQ ID NO: 10228 - DNA, 20 bp, Artificial Sequence
  Description of Artificial Sequence: Synthetic oligonucleotide
  Target: FXN; (-) strand; PAM type: NRG; PAM sequence: AAG
tagcaagtgagcaaattaac

SEQ ID NO: 10229 - DNA, 20 bp, Artificial Sequence
  Description of Artificial Sequence: Synthetic oligonucleotide
  Target: FXN; (-) strand; PAM type: NRG; PAM sequence: GAG
ggtaacaaattttagcaagt

SEQ ID NO: 10230 - DNA, 20 bp, Artificial Sequence
  Description of Artificial Sequence: Synthetic oligonucleotide
  Target: FXN; (-) strand; PAM type: NRG; PAM sequence: AAG
ttggggtaacaaattttagc

SEQ ID NO: 10231 - DNA, 20 bp, Artificial Sequence
  Description of Artificial Sequence: Synthetic oligonucleotide
  Target: FXN; (-) strand; PAM type: NRG; PAM sequence: TAG
gattttggggtaacaaattt

SEQ ID NO: 10232 - DNA, 20 bp, Artificial Sequence
  Description of Artificial Sequence: Synthetic oligonucleotide
  Target: FXN; (-) strand; PAM type: NRG; PAM sequence: GGG
ggctaggggtactgattttg

SEQ ID NO: 10233 - DNA, 20 bp, Artificial Sequence
  Description of Artificial Sequence: Synthetic oligonucleotide
  Target: FXN; (-) strand; PAM type: NRG; PAM sequence: GGG
aggctaggggtactgatttt

SEQ ID NO: 10234 - DNA, 20 bp, Artificial Sequence
  Description of Artificial Sequence: Synthetic oligonucleotide
  Target: FXN; (-) strand; PAM type: NRG; PAM sequence: TGG
aaggctaggggtactgattt

SEQ ID NO: 10235 - DNA, 20 bp, Artificial Sequence
  Description of Artificial Sequence: Synthetic oligonucleotide
  Target: FXN; (-) strand; PAM type: NRG; PAM sequence: GGG
aaacgaccccaaaaggctag

SEQ ID NO: 10236 - DNA, 20 bp, Artificial Sequence
  Description of Artificial Sequence: Synthetic oligonucleotide
  Target: FXN; (-) strand; PAM type: NRG; PAM sequence: GGG
gaaacgaccccaaaaggcta

SEQ ID NO: 10237 - DNA, 20 bp, Artificial Sequence
  Description of Artificial Sequence: Synthetic oligonucleotide
  Target: FXN; (-) strand; PAM type: NRG; PAM sequence: AGG
tgaaacgaccccaaaaggct

SEQ ID NO: 10238 - DNA, 20 bp, Artificial Sequence
  Description of Artificial Sequence: Synthetic oligonucleotide
  Target: FXN; (-) strand; PAM type: NRG; PAM sequence: TAG
ttgaaacgaccccaaaaggc

SEQ ID NO: 10239 - DNA, 20 bp, Artificial Sequence
  Description of Artificial Sequence: Synthetic oligonucleotide
  Target: FXN; (-) strand; PAM type: NRG; PAM sequence: AGG
atctttgaaacgaccccaaa

SEQ ID NO: 10240 - DNA, 20 bp, Artificial Sequence
  Description of Artificial Sequence: Synthetic oligonucleotide
  Target: FXN; (-) strand; PAM type: NRG; PAM sequence: AAG
catctttgaaacgaccccaa

SEQ ID NO: 10241 - DNA, 20 bp, Artificial Sequence
  Description of Artificial Sequence: Synthetic oligonucleotide
  Target: FXN; (-) strand; PAM type: NRG; PAM sequence: GAG
ctgggaacatgagcctggag

SEQ ID NO: 10242 - DNA, 20 bp, Artificial Sequence
  Description of Artificial Sequence: Synthetic oligonucleotide
  Target: FXN; (-) strand; PAM type: NRG; PAM sequence: AGG
ggctgggaacatgagcctgg

SEQ ID NO: 10243 - DNA, 20 bp, Artificial Sequence
  Description of Artificial Sequence: Synthetic oligonucleotide
  Target: FXN; (-) strand; PAM type: NRG; PAM sequence: GAG
tggctgggaacatgagcctg

SEQ ID NO: 10244 - DNA, 20 bp, Artificial Sequence
  Description of Artificial Sequence: Synthetic oligonucleotide
  Target: FXN; (-) strand; PAM type: NRG; PAM sequence: TGG
cttggctgggaacatgagcc

SEQ ID NO: 10245 - DNA, 20 bp, Artificial Sequence
  Description of Artificial Sequence: Synthetic oligonucleotide
  Target: FXN; (-) strand; PAM type: NRG; PAM sequence: GAG
tggaccttggctgggaacat

SEQ ID NO: 10246 - DNA, 20 bp, Artificial Sequence
  Description of Artificial Sequence: Synthetic oligonucleotide
  Target: FXN; (-) strand; PAM type: NRG; PAM sequence: GGG
cactttgttggaccttggct

SEQ ID NO: 10247 - DNA, 20 bp, Artificial Sequence
  Description of Artificial Sequence: Synthetic oligonucleotide
  Target: FXN; (-) strand; PAM type: NRG; PAM sequence: TGG
gcactttgttggaccttggc

SEQ ID NO: 10248 - DNA, 20 bp, Artificial Sequence
  Description of Artificial Sequence: Synthetic oligonucleotide
  Target: FXN; (-) strand; PAM type: NRG; PAM sequence: TGG
ggcagcactttgttggacct

SEQ ID NO: 10249 - DNA, 20 bp, Artificial Sequence
  Description of Artificial Sequence: Synthetic oligonucleotide
  Target: FXN; (-) strand; PAM type: NRG; PAM sequence: TGG
aaggcagggcagcactttgt

SEQ ID NO: 10250 - DNA, 20 bp, Artificial Sequence
  Description of Artificial Sequence: Synthetic oligonucleotide
  Target: FXN; (-) strand; PAM type: NRG; PAM sequence: CAG
gctgaaataagaaggcaggg

SEQ ID NO: 10251 - DNA, 20 bp, Artificial Sequence
  Description of Artificial Sequence: Synthetic oligonucleotide
  Target: FXN; (-) strand; PAM type: NRG; PAM sequence: GGG
acagctgaaataagaaggca

SEQ ID NO: 10252 - DNA, 20 bp, Artificial Sequence
  Description of Artificial Sequence: Synthetic oligonucleotide
  Target: FXN; (-) strand; PAM type: NRG; PAM sequence: AGG
gacagctgaaataagaaggc

SEQ ID NO: 10253 - DNA, 20 bp, Artificial Sequence
  Description of Artificial Sequence: Synthetic oligonucleotide
  Target: FXN; (-) strand; PAM type: NRG; PAM sequence: CAG
tgacagctgaaataagaagg

SEQ ID NO: 10254 - DNA, 20 bp, Artificial Sequence
  Description of Artificial Sequence: Synthetic oligonucleotide
  Target: FXN; (-) strand; PAM type: NRG; PAM sequence: AGG
ctatgacagctgaaataaga

SEQ ID NO: 10255 - DNA, 20 bp, Artificial Sequence
  Description of Artificial Sequence: Synthetic oligonucleotide
  Target: FXN; (-) strand; PAM type: NRG; PAM sequence: AAG
actatgacagctgaaataag

SEQ ID NO: 10256 - DNA, 20 bp, Artificial Sequence
  Description of Artificial Sequence: Synthetic oligonucleotide
  Target: FXN; (-) strand; PAM type: NRG; PAM sequence: AAG
tacactatgacagctgaaat

SEQ ID NO: 10257 - DNA, 20 bp, Artificial Sequence
  Description of Artificial Sequence: Synthetic oligonucleotide
  Target: FXN; (-) strand; PAM type: NRG; PAM sequence: CAG
ggacacagtttacactatga

SEQ ID NO: 10258 - DNA, 20 bp, Artificial Sequence
  Description of Artificial Sequence: Synthetic oligonucleotide
  Target: FXN; (-) strand; PAM type: NRG; PAM sequence: CAG
atcagactgtgaaaaggaca

SEQ ID NO: 10259 - DNA, 20 bp, Artificial Sequence
  Description of Artificial Sequence: Synthetic oligonucleotide
  Target: FXN; (-) strand; PAM type: NRG; PAM sequence: AGG
gcactaatcagactgtgaaa

SEQ ID NO: 10260 - DNA, 20 bp, Artificial Sequence
  Description of Artificial Sequence: Synthetic oligonucleotide
  Target: FXN; (-) strand; PAM type: NRG; PAM sequence: AAG
ggcactaatcagactgtgaa

SEQ ID NO: 10261 - DNA, 20 bp, Artificial Sequence
  Description of Artificial Sequence: Synthetic oligonucleotide
  Target: FXN; (-) strand; PAM type: NRG; PAM sequence: CAG
ctgaaaaacatggcactaat

SEQ ID NO: 10262 - DNA, 20 bp, Artificial Sequence
  Description of Artificial Sequence: Synthetic oligonucleotide
  Target: FXN; (-) strand; PAM type: NRG; PAM sequence: TGG
gcataaaaatctgaaaaaca

SEQ ID NO: 10263 - DNA, 20 bp, Artificial Sequence
  Description of Artificial Sequence: Synthetic oligonucleotide
  Target: FXN; (-) strand; PAM type: NRG; PAM sequence: AAG
cagagaaataaccaagaaaa

SEQ ID NO: 10264 - DNA, 20 bp, Artificial Sequence
  Description of Artificial Sequence: Synthetic oligonucleotide
  Target: FXN; (-) strand; PAM type: NRG; PAM sequence: AAG
attttaacagagaaataacc

SEQ ID NO: 10265 - DNA, 20 bp, Artificial Sequence
  Description of Artificial Sequence: Synthetic oligonucleotide
  Target: FXN; (-) strand; PAM type: NRG; PAM sequence: GAG
acttggagacaattttaaca

SEQ ID NO: 10266 - DNA, 20 bp, Artificial Sequence
  Description of Artificial Sequence: Synthetic oligonucleotide
  Target: FXN; (-) strand; PAM type: NRG; PAM sequence: CAG
acacttggagacaattttaa

SEQ ID NO: 10267 - DNA, 20 bp, Artificial Sequence
  Description of Artificial Sequence: Synthetic oligonucleotide
  Target: FXN; (-) strand; PAM type: NRG; PAM sequence: GAG
taaactttgcactacacttg

SEQ ID NO: 10268 - DNA, 20 bp, Artificial Sequence
  Description of Artificial Sequence: Synthetic oligonucleotide
  Target: FXN; (-) strand; PAM type: NRG; PAM sequence: TGG
gctaaactttgcactacact

SEQ ID NO: 10269 - DNA, 20 bp, Artificial Sequence
  Description of Artificial Sequence: Synthetic oligonucleotide
  Target: FXN; (-) strand; PAM type: NRG; PAM sequence: CAG
tttctctgtaaggaacatca

SEQ ID NO: 10270 - DNA, 20 bp, Artificial Sequence
  Description of Artificial Sequence: Synthetic oligonucleotide
  Target: FXN; (-) strand; PAM type: NRG; PAM sequence: AGG
acacatgcattttctctgta

SEQ ID NO: 10271 - DNA, 20 bp, Artificial Sequence
  Description of Artificial Sequence: Synthetic oligonucleotide
  Target: FXN; (-) strand; PAM type: NRG; PAM sequence: AAG
aacacatgcattttctctgt

SEQ ID NO: 10272 - DNA, 20 bp, Artificial Sequence
  Description of Artificial Sequence: Synthetic oligonucleotide
  Target: FXN; (-) strand; PAM type: NRG; PAM sequence: AAG
accttaactcatgcctgaca

SEQ ID NO: 10273 - DNA, 20 bp, Artificial Sequence
  Description of Artificial Sequence: Synthetic oligonucleotide
  Target: FXN; (-) strand; PAM type: NRG; PAM sequence: CAG
attaattgatctcaggacaa

SEQ ID NO: 10274 - DNA, 20 bp, Artificial Sequence
  Description of Artificial Sequence: Synthetic oligonucleotide
  Target: FXN; (-) strand; PAM type: NRG; PAM sequence: AGG
acaacaaattaattgatctc

SEQ ID NO: 10275 - DNA, 20 bp, Artificial Sequence
  Description of Artificial Sequence: Synthetic oligonucleotide
  Target: FXN; (-) strand; PAM type: NRG; PAM sequence: CAG
aacaacaaattaattgatct

SEQ ID NO: 10276 - DNA, 20 bp, Artificial Sequence
  Description of Artificial Sequence: Synthetic oligonucleotide
  Target: FXN; (-) strand; PAM type: NRG; PAM sequence: GAG
agcagcctgggcaacagagg

SEQ ID NO: 10277 - DNA, 20 bp, Artificial Sequence
  Description of Artificial Sequence: Synthetic oligonucleotide
  Target: FXN; (-) strand; PAM type: NRG; PAM sequence: GGG
ccagcagcctgggcaacaga

SEQ ID NO: 10278 - DNA, 20 bp, Artificial Sequence
  Description of Artificial Sequence: Synthetic oligonucleotide
  Target: FXN; (-) strand; PAM type: NRG; PAM sequence: AGG
tccagcagcctgggcaacag

SEQ ID NO: 10279 - DNA, 20 bp, Artificial Sequence
  Description of Artificial Sequence: Synthetic oligonucleotide
  Target: FXN; (-) strand; PAM type: NRG; PAM sequence: GAG
ctccagcagcctgggcaaca

SEQ ID NO: 10280 - DNA, 20 bp, Artificial Sequence
  Description of Artificial Sequence: Synthetic oligonucleotide
  Target: FXN; (-) strand; PAM type: NRG; PAM sequence: CAG
cactccagcagcctgggcaa

SEQ ID NO: 10281 - DNA, 20 bp, Artificial Sequence
  Description of Artificial Sequence: Synthetic oligonucleotide
  Target: FXN; (-) strand; PAM type: NRG; PAM sequence: GGG
ccattgcactccagcagcct

SEQ ID NO: 10282 - DNA, 20 bp, Artificial Sequence
  Description of Artificial Sequence: Synthetic oligonucleotide
  Target: FXN; (-) strand; PAM type: NRG; PAM sequence: TGG
accattgcactccagcagcc

SEQ ID NO: 10283 - DNA, 20 bp, Artificial Sequence
  Description of Artificial Sequence: Synthetic oligonucleotide
  Target: FXN; (-) strand; PAM type: NRG; PAM sequence: CAG
attacaccattgcactccag

SEQ ID NO: 10284 - DNA, 20 bp, Artificial Sequence
  Description of Artificial Sequence: Synthetic oligonucleotide
  Target: FXN; (-) strand; PAM type: NRG; PAM sequence: CAG
atgattacaccattgcactc

SEQ ID NO: 10285 - DNA, 20 bp, Artificial Sequence
  Description of Artificial Sequence: Synthetic oligonucleotide
  Target: FXN; (-) strand; PAM type: NRG; PAM sequence: GAG
agagaggtagaggctgcagt

SEQ ID NO: 10286 - DNA, 20 bp, Artificial Sequence
  Description of Artificial Sequence: Synthetic oligonucleotide
  Target: FXN; (-) strand; PAM type: NRG; PAM sequence: CAG
agccagagaggtagaggctg

SEQ ID NO: 10287 - DNA, 20 bp, Artificial Sequence
  Description of Artificial Sequence: Synthetic oligonucleotide
  Target: FXN; (-) strand; PAM type: NRG; PAM sequence: AGG
tgcttgagccagagaggtag

SEQ ID NO: 10288 - DNA, 20 bp, Artificial Sequence
  Description of Artificial Sequence: Synthetic oligonucleotide
  Target: FXN; (-) strand; PAM type: NRG; PAM sequence: GAG
ttgcttgagccagagaggta

SEQ ID NO: 10289 - DNA, 20 bp, Artificial Sequence
  Description of Artificial Sequence: Synthetic oligonucleotide
  Target: FXN; (-) strand; PAM type: NRG; PAM sequence: TAG
gattgcttgagccagagagg

SEQ ID NO: 10290 - DNA, 20 bp, Artificial Sequence
  Description of Artificial Sequence: Synthetic oligonucleotide
  Target: FXN; (-) strand; PAM type: NRG; PAM sequence: AGG
gaggattgcttgagccagag

SEQ ID NO: 10291 - DNA, 20 bp, Artificial Sequence
  Description of Artificial Sequence: Synthetic oligonucleotide
  Target: FXN; (-) strand; PAM type: NRG; PAM sequence: GAG
ggaggattgcttgagccaga

SEQ ID NO: 10292 - DNA, 20 bp, Artificial Sequence
  Description of Artificial Sequence: Synthetic oligonucleotide
  Target: FXN; (-) strand; PAM type: NRG; PAM sequence: GAG
tgggaggattgcttgagcca

SEQ ID NO: 10293 - DNA, 20 bp, Artificial Sequence
  Description of Artificial Sequence: Synthetic oligonucleotide
  Target: FXN; (-) strand; PAM type: NRG; PAM sequence: CAG
ggtgggaggattgcttgagc

SEQ ID NO: 10294 - DNA, 20 bp, Artificial Sequence
  Description of Artificial Sequence: Synthetic oligonucleotide
  Target: FXN; (-) strand; PAM type: NRG; PAM sequence: GAG
ccgaggtgggaggattgctt

SEQ ID NO: 10295 - DNA, 20 bp, Artificial Sequence
  Description of Artificial Sequence: Synthetic oligonucleotide
  Target: FXN; (-) strand; PAM type: NRG; PAM sequence: AGG
actcaggaggccgaggtggg

SEQ ID NO: 10296 - DNA, 20 bp, Artificial Sequence
  Description of Artificial Sequence: Synthetic oligonucleotide
  Target: FXN; (-) strand; PAM type: NRG; PAM sequence: GAG
tactcaggaggccgaggtgg

SEQ ID NO: 10297 - DNA, 20 bp, Artificial Sequence
  Description of Artificial Sequence: Synthetic oligonucleotide
  Target: FXN; (-) strand; PAM type: NRG; PAM sequence: GGG
gctactcaggaggccgaggt

SEQ ID NO: 10298 - DNA, 20 bp, Artificial Sequence
  Description of Artificial Sequence: Synthetic oligonucleotide
  Target: FXN; (-) strand; PAM type: NRG; PAM sequence: TGG
agctactcaggaggccgagg

SEQ ID NO: 10299 - DNA, 20 bp, Artificial Sequence
  Description of Artificial Sequence: Synthetic oligonucleotide
  Target: FXN; (-) strand; PAM type: NRG; PAM sequence: AGG
cccagctactcaggaggccg

SEQ ID NO: 10300 - DNA, 20 bp, Artificial Sequence
  Description of Artificial Sequence: Synthetic oligonucleotide
  Target: FXN; (-) strand; PAM type: NRG; PAM sequence: GAG
tcccagctactcaggaggcc

SEQ ID NO: 10301 - DNA, 20 bp, Artificial Sequence
  Description of Artificial Sequence: Synthetic oligonucleotide
  Target: FXN; (-) strand; PAM type: NRG; PAM sequence: AGG
tgtagtcccagctactcagg

SEQ ID NO: 10302 - DNA, 20 bp, Artificial Sequence
  Description of Artificial Sequence: Synthetic oligonucleotide
  Target: FXN; (-) strand; PAM type: NRG; PAM sequence: GAG
ctgtagtcccagctactcag

SEQ ID NO: 10303 - DNA, 20 bp, Artificial Sequence
  Description of Artificial Sequence: Synthetic oligonucleotide
  Target: FXN; (-) strand; PAM type: NRG; PAM sequence: AGG
acctgtagtcccagctactc

SEQ ID NO: 10304 - DNA, 20 bp, Artificial Sequence
  Description of Artificial Sequence: Synthetic oligonucleotide
  Target: FXN; (-) strand; PAM type: NRG; PAM sequence: CAG
tacctgtagtcccagctact

SEQ ID NO: 10305 - DNA, 20 bp, Artificial Sequence
  Description of Artificial Sequence: Synthetic oligonucleotide
  Target: FXN; (-) strand; PAM type: NRG; PAM sequence: CAG
gtggggtgtacctgtagtcc

SEQ ID NO: 10306 - DNA, 20 bp, Artificial Sequence
  Description of Artificial Sequence: Synthetic oligonucleotide
  Target: FXN; (-) strand; PAM type: NRG; PAM sequence: TAG
ggtgtggtggggtgtacctg

SEQ ID NO: 10307 - DNA, 20 bp, Artificial Sequence
  Description of Artificial Sequence: Synthetic oligonucleotide
  Target: FXN; (-) strand; PAM type: NRG; PAM sequence: GGG
aacattatctgggtgtggtg

SEQ ID NO: 10308 - DNA, 20 bp, Artificial Sequence
  Description of Artificial Sequence: Synthetic oligonucleotide
  Target: FXN; (-) strand; PAM type: NRG; PAM sequence: GGG
aaacattatctgggtgtggt

SEQ ID NO: 10309 - DNA, 20 bp, Artificial Sequence
  Description of Artificial Sequence: Synthetic oligonucleotide
  Target: FXN; (-) strand; PAM type: NRG; PAM sequence: TGG
aaaacattatctgggtgtgg

SEQ ID NO: 10310 - DNA, 20 bp, Artificial Sequence
  Description of Artificial Sequence: Synthetic oligonucleotide
  Target: FXN; (-) strand; PAM type: NRG; PAM sequence: TGG
tcaaaaacattatctgggtg

SEQ ID NO: 10311 - DNA, 20 bp, Artificial Sequence
  Description of Artificial Sequence: Synthetic oligonucleotide
  Target: FXN; (-) strand; PAM type: NRG; PAM sequence: GGG
aaatatcaaaaacattatct

SEQ ID NO: 10312 - DNA, 20 bp, Artificial Sequence
  Description of Artificial Sequence: Synthetic oligonucleotide
  Target: FXN; (-) strand; PAM type: NRG; PAM sequence: TGG
aaaatatcaaaaacattatc

SEQ ID NO: 10313 - DNA, 20 bp, Artificial Sequence
  Description of Artificial Sequence: Synthetic oligonucleotide
  Target: FXN; (-) strand; PAM type: NRG; PAM sequence: GAG
tgcactccagcctgggtgat

SEQ ID NO: 10314 - DNA, 20 bp, Artificial Sequence
  Description of Artificial Sequence: Synthetic oligonucleotide
  Target: FXN; (-) strand; PAM type: NRG; PAM sequence: GGG
gcaccattgcactccagcct

SEQ ID NO: 10315 - DNA, 20 bp, Artificial Sequence
  Description of Artificial Sequence: Synthetic oligonucleotide
  Target: FXN; (-) strand; PAM type: NRG; PAM sequence: TGG
cgcaccattgcactccagcc

SEQ ID NO: 10316 - DNA, 20 bp, Artificial Sequence
  Description of Artificial Sequence: Synthetic oligonucleotide
  Target: FXN; (-) strand; PAM type: NRG; PAM sequence: CAG
aggatcgcaccattgcactc

SEQ ID NO: 10317 - DNA, 20 bp, Artificial Sequence
  Description of Artificial Sequence: Synthetic oligonucleotide
  Target: FXN; (-) strand; PAM type: NRG; PAM sequence: AGG
ggtggaggttgcagtgagcc

SEQ ID NO: 10318 - DNA, 20 bp, Artificial Sequence
  Description of Artificial Sequence: Synthetic oligonucleotide
  Target: FXN; (-) strand; PAM type: NRG; PAM sequence: CAG
aggtggaggttgcagtgagc

SEQ ID NO: 10319 - DNA, 20 bp, Artificial Sequence
  Description of Artificial Sequence: Synthetic oligonucleotide
  Target: FXN; (-) strand; PAM type: NRG; PAM sequence: GAG
cgggaggtggaggttgcagt

SEQ ID NO: 10320 - DNA, 20 bp, Artificial Sequence
  Description of Artificial Sequence: Synthetic oligonucleotide
  Target: FXN; (-) strand; PAM type: NRG; PAM sequence: CAG
aatccgggaggtggaggttg

SEQ ID NO: 10321 - DNA, 20 bp, Artificial Sequence
  Description of Artificial Sequence: Synthetic oligonucleotide
  Target: FXN; (-) strand; PAM type: NRG; PAM sequence: AGG
tgcttgaatccgggaggtgg

SEQ ID NO: 10322 - DNA, 20 bp, Artificial Sequence
  Description of Artificial Sequence: Synthetic oligonucleotide
  Target: FXN; (-) strand; PAM type: NRG; PAM sequence: GAG
ttgcttgaatccgggaggtg

SEQ ID NO: 10323 - DNA, 20 bp, Artificial Sequence
  Description of Artificial Sequence: Synthetic oligonucleotide
  Target: FXN; (-) strand; PAM type: NRG; PAM sequence: TGG
aattgcttgaatccgggagg

SEQ ID NO: 10324 - DNA, 20 bp, Artificial Sequence
  Description of Artificial Sequence: Synthetic oligonucleotide
  Target: FXN; (-) strand; PAM type: NRG; PAM sequence: AGG
aagaattgcttgaatccggg

SEQ ID NO: 10325 - DNA, 20 bp, Artificial Sequence
  Description of Artificial Sequence: Synthetic oligonucleotide
  Target: FXN; (-) strand; PAM type: NRG; PAM sequence: GAG
gaagaattgcttgaatccgg

SEQ ID NO: 10326 - DNA, 20 bp, Artificial Sequence
  Description of Artificial Sequence: Synthetic oligonucleotide
  Target: FXN; (-) strand; PAM type: NRG; PAM sequence: GGG
cagaagaattgcttgaatcc

SEQ ID NO: 10327 - DNA, 20 bp, Artificial Sequence
  Description of Artificial Sequence: Synthetic oligonucleotide
  Target: FXN; (-) strand; PAM type: NRG; PAM sequence: CGG
gcagaagaattgcttgaatc

SEQ ID NO: 10328 - DNA, 20 bp, Artificial Sequence
  Description of Artificial Sequence: Synthetic oligonucleotide
  Target: FXN; (-) strand; PAM type: NRG; PAM sequence: AAG
tactcaggaggctgaggcag

SEQ ID NO: 10329 - DNA, 20 bp, Artificial Sequence
  Description of Artificial Sequence: Synthetic oligonucleotide
  Target: FXN; (-) strand; PAM type: NRG; PAM sequence: CAG
tgctactcaggaggctgagg

SEQ ID NO: 10330 - DNA, 20 bp, Artificial Sequence
  Description of Artificial Sequence: Synthetic oligonucleotide
  Target: FXN; (-) strand; PAM type: NRG; PAM sequence: AGG
ctgtgctactcaggaggctg

SEQ ID NO: 10331 - DNA, 20 bp, Artificial Sequence
  Description of Artificial Sequence: Synthetic oligonucleotide
  Target: FXN; (-) strand; PAM type: NRG; PAM sequence: GAG
tctgtgctactcaggaggct

SEQ ID NO: 10332 - DNA, 20 bp, Artificial Sequence
  Description of Artificial Sequence: Synthetic oligonucleotide
  Target: FXN; (-) strand; PAM type: NRG; PAM sequence: AGG
tgtaatctgtgctactcagg

SEQ ID NO: 10333 - DNA, 20 bp, Artificial Sequence
  Description of Artificial Sequence: Synthetic oligonucleotide
  Target: FXN; (-) strand; PAM type: NRG; PAM sequence: GAG
ctgtaatctgtgctactcag

SEQ ID NO: 10334 - DNA, 20 bp, Artificial Sequence
  Description of Artificial Sequence: Synthetic oligonucleotide
  Target: FXN; (-) strand; PAM type: NRG; PAM sequence: AGG
gcctgtaatctgtgctactc

SEQ ID NO: 10335 - DNA, 20 bp, Artificial Sequence
  Description of Artificial Sequence: Synthetic oligonucleotide
  Target: FXN; (-) strand; PAM type: NRG; PAM sequence: CAG
tgcctgtaatctgtgctact

SEQ ID NO: 10336 - DNA, 20 bp, Artificial Sequence
  Description of Artificial Sequence: Synthetic oligonucleotide
  Target: FXN; (-) strand; PAM type: NRG; PAM sequence: AGG
taaaaacacaaaaattagca

SEQ ID NO: 10337 - DNA, 20 bp, Artificial Sequence
  Description of Artificial Sequence: Synthetic oligonucleotide
  Target: FXN; (-) strand; PAM type: NRG; PAM sequence: AAG
ctaaaaacacaaaaattagc

SEQ ID NO: 10338 - DNA, 20 bp, Artificial Sequence
  Description of Artificial Sequence: Synthetic oligonucleotide
  Target: FXN; (-) strand; PAM type: NRG; PAM sequence: TAG
tctactaaaaacacaaaaat

SEQ ID NO: 10339 - DNA, 20 bp, Artificial Sequence
  Description of Artificial Sequence: Synthetic oligonucleotide
  Target: FXN; (-) strand; PAM type: NRG; PAM sequence: TGG
caagactagcctggccaaca

SEQ ID NO: 10340 - DNA, 20 bp, Artificial Sequence
  Description of Artificial Sequence: Synthetic oligonucleotide
  Target: FXN; (-) strand; PAM type: NRG; PAM sequence: TGG
tcaggagttcaagactagcc

SEQ ID NO: 10341 - DNA, 20 bp, Artificial Sequence
  Description of Artificial Sequence: Synthetic oligonucleotide
  Target: FXN; (-) strand; PAM type: NRG; PAM sequence: TAG
tgaggtcaggagttcaagac

SEQ ID NO: 10342 - DNA, 20 bp, Artificial Sequence
  Description of Artificial Sequence: Synthetic oligonucleotide
  Target: FXN; (-) strand; PAM type: NRG; PAM sequence: AAG
tcacctgaggtcaggagttc

SEQ ID NO: 10343 - DNA, 20 bp, Artificial Sequence
  Description of Artificial Sequence: Synthetic oligonucleotide
  Target: FXN; (-) strand; PAM type: NRG; PAM sequence: GAG
ggtggatcacctgaggtcag

SEQ ID NO: 10344 - DNA, 20 bp, Artificial Sequence
  Description of Artificial Sequence: Synthetic oligonucleotide
  Target: FXN; (-) strand; PAM type: NRG; PAM sequence: AGG
cgggtggatcacctgaggtc

SEQ ID NO: 10345 - DNA, 20 bp, Artificial Sequence
  Description of Artificial Sequence: Synthetic oligonucleotide
  Target: FXN; (-) strand; PAM type: NRG; PAM sequence: CAG
gcgggtggatcacctgaggt

SEQ ID NO: 10346 - DNA, 20 bp, Artificial Sequence
  Description of Artificial Sequence: Synthetic oligonucleotide
  Target: FXN; (-) strand; PAM type: NRG; PAM sequence: AGG
ggaggcgggtggatcacctg

SEQ ID NO: 10347 - DNA, 20 bp, Artificial Sequence
  Description of Artificial Sequence: Synthetic oligonucleotide
  Target: FXN; (-) strand; PAM type: NRG; PAM sequence: GAG
cggaggcgggtggatcacct

SEQ ID NO: 10348 - DNA, 20 bp, Artificial Sequence
  Description of Artificial Sequence: Synthetic oligonucleotide
  Target: FXN; (-) strand; PAM type: NRG; PAM sequence: TGG
gtttgggaggcggaggcggg

SEQ ID NO: 10349 - DNA, 20 bp, Artificial Sequence
  Description of Artificial Sequence: Synthetic oligonucleotide
  Target: FXN; (-) strand; PAM type: NRG; PAM sequence: GGG
gcagtttgggaggcggaggc

SEQ ID NO: 10350 - DNA, 20 bp, Artificial Sequence
  Description of Artificial Sequence: Synthetic oligonucleotide
  Target: FXN; (-) strand; PAM type: NRG; PAM sequence: CGG
tgcagtttgggaggcggagg

SEQ ID NO: 10351 - DNA, 20 bp, Artificial Sequence
  Description of Artificial Sequence: Synthetic oligonucleotide
  Target: FXN; (-) strand; PAM type: NRG; PAM sequence: AGG
ctctgcagtttgggaggcgg

SEQ ID NO: 10352 - DNA, 20 bp, Artificial Sequence
  Description of Artificial Sequence: Synthetic oligonucleotide
  Target: FXN; (-) strand; PAM type: NRG; PAM sequence: GAG
tctctgcagtttgggaggcg

SEQ ID NO: 10353 - DNA, 20 bp, Artificial Sequence
  Description of Artificial Sequence: Synthetic oligonucleotide
  Target: FXN; (-) strand; PAM type: NRG; PAM sequence: CGG
aatctctgcagtttgggagg

SEQ ID NO: 10354 - DNA, 20 bp, Artificial Sequence
  Description of Artificial Sequence: Synthetic oligonucleotide
  Target: FXN; (-) strand; PAM type: NRG; PAM sequence: AGG
tataatctctgcagtttggg

SEQ ID NO: 10355 - DNA, 20 bp, Artificial Sequence
  Description of Artificial Sequence: Synthetic oligonucleotide
  Target: FXN; (-) strand; PAM type: NRG; PAM sequence: GAG
ctataatctctgcagtttgg

SEQ ID NO: 10356 - DNA, 20 bp, Artificial Sequence
  Description of Artificial Sequence: Synthetic oligonucleotide
  Target: FXN; (-) strand; PAM type: NRG; PAM sequence: GGG
gcctataatctctgcagttt

SEQ ID NO: 10357 - DNA, 20 bp, Artificial Sequence
  Description of Artificial Sequence: Synthetic oligonucleotide
  Target: FXN; (-) strand; PAM type: NRG; PAM sequence: TGG
tgcctataatctctgcagtt

SEQ ID NO: 10358 - DNA, 20 bp, Artificial Sequence
  Description of Artificial Sequence: Synthetic oligonucleotide
  Target: FXN; (-) strand; PAM type: NRG; PAM sequence: CAG
gttcgtgcctataatctctg

SEQ ID NO: 10359 - DNA, 20 bp, Artificial Sequence
  Description of Artificial Sequence: Synthetic oligonucleotide
  Target: FXN; (-) strand; PAM type: NRG; PAM sequence: TGG
aaacatgaggccgggcattg

SEQ ID NO: 10360 - DNA, 20 bp, Artificial Sequence
  Description of Artificial Sequence: Synthetic oligonucleotide
  Target: FXN; (-) strand; PAM type: NRG; PAM sequence: GGG
aaaataaaaaacatgaggcc

SEQ ID NO: 10361 - DNA, 20 bp, Artificial Sequence
  Description of Artificial Sequence: Synthetic oligonucleotide
  Target: FXN; (-) strand; PAM type: NRG; PAM sequence: CGG
aaaaataaaaaacatgaggc

SEQ ID NO: 10362 - DNA, 20 bp, Artificial Sequence
  Description of Artificial Sequence: Synthetic oligonucleotide
  Target: FXN; (-) strand; PAM type: NRG; PAM sequence: AGG
cttgaaaaataaaaaacatg

SEQ ID NO: 10363 - DNA, 20 bp, Artificial Sequence
  Description of Artificial Sequence: Synthetic oligonucleotide
  Target: FXN; (-) strand; PAM type: NRG; PAM sequence: GAG
acttgaaaaataaaaaacat

SEQ ID NO: 10364 - DNA, 20 bp, Artificial Sequence
  Description of Artificial Sequence: Synthetic oligonucleotide
  Target: FXN; (-) strand; PAM type: NRG; PAM sequence: GAG
accaacctgggcaacataga

SEQ ID NO: 10365 - DNA, 20 bp, Artificial Sequence
  Description of Artificial Sequence: Synthetic oligonucleotide
  Target: FXN; (-) strand; PAM type: NRG; PAM sequence: GAG
agaccaacctgggcaacata

SEQ ID NO: 10366 - DNA, 20 bp, Artificial Sequence
  Description of Artificial Sequence: Synthetic oligonucleotide
  Target: FXN; (-) strand; PAM type: NRG; PAM sequence: TAG
tgagaccaacctgggcaaca

SEQ ID NO: 10367 - DNA, 20 bp, Artificial Sequence
  Description of Artificial Sequence: Synthetic oligonucleotide
  Target: FXN; (-) strand; PAM type: NRG; PAM sequence: GGG
caagagtttgagaccaacct

SEQ ID NO: 10368 - DNA, 20 bp, Artificial Sequence
  Description of Artificial Sequence: Synthetic oligonucleotide
  Target: FXN; (-) strand; PAM type: NRG; PAM sequence: TGG
tcaagagtttgagaccaacc

SEQ ID NO: 10369 - DNA, 20 bp, Artificial Sequence
  Description of Artificial Sequence: Synthetic oligonucleotide
  Target: FXN; (-) strand; PAM type: NRG; PAM sequence: GAG
ttacttgagctcaagagttt

SEQ ID NO: 10370 - DNA, 20 bp, Artificial Sequence
  Description of Artificial Sequence: Synthetic oligonucleotide
  Target: FXN; (-) strand; PAM type: NRG; PAM sequence: GAG
ggaggattacttgagctcaa

SEQ ID NO: 10371 - DNA, 20 bp, Artificial Sequence
  Description of Artificial Sequence: Synthetic oligonucleotide
  Target: FXN; (-) strand; PAM type: NRG; PAM sequence: AAG
tgggaggattacttgagctc

SEQ ID NO: 10372 - DNA, 20 bp, Artificial Sequence
  Description of Artificial Sequence: Synthetic oligonucleotide
  Target: FXN; (-) strand; PAM type: NRG; PAM sequence: GAG
ccaaggtgggaggattactt

SEQ ID NO: 10373 - DNA, 20 bp, Artificial Sequence
  Description of Artificial Sequence: Synthetic oligonucleotide
  Target: FXN; (-) strand; PAM type: NRG; PAM sequence: AGG
ctttgggaggccaaggtggg

SEQ ID NO: 10374 - DNA, 20 bp, Artificial Sequence
  Description of Artificial Sequence: Synthetic oligonucleotide
  Target: FXN; (-) strand; PAM type: NRG; PAM sequence: GAG
actttgggaggccaaggtgg

SEQ ID NO: 10375 - DNA, 20 bp, Artificial Sequence
  Description of Artificial Sequence: Synthetic oligonucleotide
  Target: FXN; (-) strand; PAM type: NRG; PAM sequence: GGG
gcactttgggaggccaaggt

SEQ ID NO: 10376 - DNA, 20 bp, Artificial Sequence
  Description of Artificial Sequence: Synthetic oligonucleotide
  Target: FXN; (-) strand; PAM type: NRG; PAM sequence: TGG
cgcactttgggaggccaagg

SEQ ID NO: 10377 - DNA, 20 bp, Artificial Sequence
  Description of Artificial Sequence: Synthetic oligonucleotide
  Target: FXN; (-) strand; PAM type: NRG; PAM sequence: AGG
ccccgcactttgggaggcca

SEQ ID NO: 10378 - DNA, 20 bp, Artificial Sequence
  Description of Artificial Sequence: Synthetic oligonucleotide
  Target: FXN; (-) strand; PAM type: NRG; PAM sequence: AAG
tccccgcactttgggaggcc

SEQ ID NO: 10379 - DNA, 20 bp, Artificial Sequence
  Description of Artificial Sequence: Synthetic oligonucleotide
  Target: FXN; (-) strand; PAM type: NRG; PAM sequence: AGG
tgtaatccccgcactttggg

SEQ ID NO: 10380 - DNA, 20 bp, Artificial Sequence
  Description of Artificial Sequence: Synthetic oligonucleotide
  Target: FXN; (-) strand; PAM type: NRG; PAM sequence: GAG
ctgtaatccccgcactttgg

SEQ ID NO: 10381 - DNA, 20 bp, Artificial Sequence
  Description of Artificial Sequence: Synthetic oligonucleotide
  Target: FXN; (-) strand; PAM type: NRG; PAM sequence: GGG
acctgtaatccccgcacttt

SEQ ID NO: 10382 - DNA, 20 bp, Artificial Sequence
  Description of Artificial Sequence: Synthetic oligonucleotide
  Target: FXN; (-) strand; PAM type: NRG; PAM sequence: TGG
cacctgtaatccccgcactt

SEQ ID NO: 10383 - DNA, 20 bp, Artificial Sequence
  Description of Artificial Sequence: Synthetic oligonucleotide
  Target: FXN; (-) strand; PAM type: NRG; PAM sequence: TAG
ctgatcttggctgggcatgg

SEQ ID NO: 10384 - DNA, 20 bp, Artificial Sequence
  Description of Artificial Sequence: Synthetic oligonucleotide
  Target: FXN; (-) strand; PAM type: NRG; PAM sequence: TGG
acactgatcttggctgggca

SEQ ID NO: 10385 - DNA, 20 bp, Artificial Sequence
  Description of Artificial Sequence: Synthetic oligonucleotide
  Target: FXN; (-) strand; PAM type: NRG; PAM sequence: GGG
cattaacactgatcttggct

SEQ ID NO: 10386 - DNA, 20 bp, Artificial Sequence
  Description of Artificial Sequence: Synthetic oligonucleotide
  Target: FXN; (-) strand; PAM type: NRG; PAM sequence: TGG
tcattaacactgatcttggc

SEQ ID NO: 10387 - DNA, 20 bp, Artificial Sequence
  Description of Artificial Sequence: Synthetic oligonucleotide
  Target: FXN; (-) strand; PAM type: NRG; PAM sequence: TGG
tgattcattaacactgatct

SEQ ID NO: 10388 - DNA, 20 bp, Artificial Sequence
  Description of Artificial Sequence: Synthetic oligonucleotide
  Target: FXN; (-) strand; PAM type: NRG; PAM sequence: TAG
gacaccttatgtaatatata

SEQ ID NO: 10389 - DNA, 20 bp, Artificial Sequence
  Description of Artificial Sequence: Synthetic oligonucleotide
  Target: FXN; (-) strand; PAM type: NRG; PAM sequence: AAG
tataaccttatttctgttta

SEQ ID NO: 10390 - DNA, 20 bp, Artificial Sequence
  Description of Artificial Sequence: Synthetic oligonucleotide
  Target: FXN; (-) strand; PAM type: NRG; PAM sequence: TGG
ctaggtaccctgtaagctgc

SEQ ID NO: 10391 - DNA, 20 bp, Artificial Sequence
  Description of Artificial Sequence: Synthetic oligonucleotide
  Target: FXN; (-) strand; PAM type: NRG; PAM sequence: AAG
tacaaggctaggtaccctgt

SEQ ID NO: 10392 - DNA, 20 bp, Artificial Sequence
  Description of Artificial Sequence: Synthetic oligonucleotide
  Target: FXN; (-) strand; PAM type: NRG; PAM sequence: AGG
tataggagaaatacaaggct

SEQ ID NO: 10393 - DNA, 20 bp, Artificial Sequence
  Description of Artificial Sequence: Synthetic oligonucleotide
  Target: FXN; (-) strand; PAM type: NRG; PAM sequence: TAG
ttataggagaaatacaaggc

SEQ ID NO: 10394 - DNA, 20 bp, Artificial Sequence
  Description of Artificial Sequence: Synthetic oligonucleotide
  Target: FXN; (-) strand; PAM type: NRG; PAM sequence: AGG
ttatttataggagaaataca

SEQ ID NO: 10395 - DNA, 20 bp, Artificial Sequence
  Description of Artificial Sequence: Synthetic oligonucleotide
  Target: FXN; (-) strand; PAM type: NRG; PAM sequence: AAG
attatttataggagaaatac

SEQ ID NO: 10396 - DNA, 20 bp, Artificial Sequence
  Description of Artificial Sequence: Synthetic oligonucleotide
  Target: FXN; (-) strand; PAM type: NRG; PAM sequence: GAG
aacgagcaaattatttatag

SEQ ID NO: 10397 - DNA, 20 bp, Artificial Sequence
  Description of Artificial Sequence: Synthetic oligonucleotide
  Target: FXN; (-) strand; PAM type: NRG; PAM sequence: AGG
tcaacgagcaaattatttat

SEQ ID NO: 10398 - DNA, 20 bp, Artificial Sequence
  Description of Artificial Sequence: Synthetic oligonucleotide
  Target: FXN; (-) strand; PAM type: NRG; PAM sequence: TAG
ctcaacgagcaaattattta

SEQ ID NO: 10399 - DNA, 20 bp, Artificial Sequence
  Description of Artificial Sequence: Synthetic oligonucleotide
  Target: FXN; (-) strand; PAM type: NRG; PAM sequence: GAG
agttgccacaaacactcaac

SEQ ID NO: 10400 - DNA, 20 bp, Artificial Sequence
  Description of Artificial Sequence: Synthetic oligonucleotide
  Target: FXN; (-) strand; PAM type: NRG; PAM sequence: AAG
cttggtagttatgtgctaca

SEQ ID NO: 10401 - DNA, 20 bp, Artificial Sequence
  Description of Artificial Sequence: Synthetic oligonucleotide
  Target: FXN; (-) strand; PAM type: NRG; PAM sequence: TAG
attacagtccttattcttgg

SEQ ID NO: 10402 - DNA, 20 bp, Artificial Sequence
  Description of Artificial Sequence: Synthetic oligonucleotide
  Target: FXN; (-) strand; PAM type: NRG; PAM sequence: TGG
cttattacagtccttattct

SEQ ID NO: 10403 - DNA, 20 bp, Artificial Sequence
  Description of Artificial Sequence: Synthetic oligonucleotide
  Target: FXN; (-) strand; PAM type: NRG; PAM sequence: CAG
tgagggacgtactcttatta

SEQ ID NO: 10404 - DNA, 20 bp, Artificial Sequence
  Description of Artificial Sequence: Synthetic oligonucleotide
  Target: FXN; (-) strand; PAM type: NRG; PAM sequence: GGG
tcttcattacaatcctgtga

SEQ ID NO: 10405 - DNA, 20 bp, Artificial Sequence
  Description of Artificial Sequence: Synthetic oligonucleotide
  Target: FXN; (-) strand; PAM type: NRG; PAM sequence: AGG
gtcttcattacaatcctgtg

SEQ ID NO: 10406 - DNA, 20 bp, Artificial Sequence
  Description of Artificial Sequence: Synthetic oligonucleotide
  Target: FXN; (-) strand; PAM type: NRG; PAM sequence: GAG
agtcttcattacaatcctgt

SEQ ID NO: 10407 - DNA, 20 bp, Artificial Sequence
  Description of Artificial Sequence: Synthetic oligonucleotide
  Target: FXN; (-) strand; PAM type: NRG; PAM sequence: CAG
agcctttatgtaaatggact

SEQ ID NO: 10408 - DNA, 20 bp, Artificial Sequence
  Description of Artificial Sequence: Synthetic oligonucleotide
  Target: FXN; (-) strand; PAM type: NRG; PAM sequence: TGG
gctctcagcctttatgtaaa

SEQ ID NO: 10409 - DNA, 20 bp, Artificial Sequence
  Description of Artificial Sequence: Synthetic oligonucleotide
  Target: FXN; (-) strand; PAM type: NRG; PAM sequence: CAG
catctgcttgacactgctct

SEQ ID NO: 10410 - DNA, 20 bp, Artificial Sequence
  Description of Artificial Sequence: Synthetic oligonucleotide
  Target: FXN; (-) strand; PAM type: NRG; PAM sequence: CAG
tagagctatcgcacattcta

SEQ ID NO: 10411 - DNA, 20 bp, Artificial Sequence
  Description of Artificial Sequence: Synthetic oligonucleotide
  Target: FXN; (-) strand; PAM type: NRG; PAM sequence: GAG
agccatgataaccactgtta

SEQ ID NO: 10412 - DNA, 20 bp, Artificial Sequence
  Description of Artificial Sequence: Synthetic oligonucleotide
  Target: FXN; (-) strand; PAM type: NRG; PAM sequence: TAG
gcagccatgataaccactgt

SEQ ID NO: 10413 - DNA, 20 bp, Artificial Sequence
  Description of Artificial Sequence: Synthetic oligonucleotide
  Target: FXN; (-) strand; PAM type: NRG; PAM sequence: CAG
tctctgaagaagtgagaggg

SEQ ID NO: 10414 - DNA, 20 bp, Artificial Sequence
  Description of Artificial Sequence: Synthetic oligonucleotide
  Target: FXN; (-) strand; PAM type: NRG; PAM sequence: GGG
atgtctctgaagaagtgaga

SEQ ID NO: 10415 - DNA, 20 bp, Artificial Sequence
  Description of Artificial Sequence: Synthetic oligonucleotide
  Target: FXN; (-) strand; PAM type: NRG; PAM sequence: AGG
catgtctctgaagaagtgag

SEQ ID NO: 10416 - DNA, 20 bp, Artificial Sequence
  Description of Artificial Sequence: Synthetic oligonucleotide
  Target: FXN; (-) strand; PAM type: NRG; PAM sequence: GAG
acatgtctctgaagaagtga

SEQ ID NO: 10417 - DNA, 20 bp, Artificial Sequence
  Description of Artificial Sequence: Synthetic oligonucleotide
  Target: FXN; (-) strand; PAM type: NRG; PAM sequence: GAG
acacatgtctctgaagaagt

SEQ ID NO: 10418 - DNA, 20 bp, Artificial Sequence
  Description of Artificial Sequence: Synthetic oligonucleotide
  Target: FXN; (-) strand; PAM type: NRG; PAM sequence: AAG
agaaacacatgtctctgaag

SEQ ID NO: 10419 - DNA, 20 bp, Artificial Sequence
  Description of Artificial Sequence: Synthetic oligonucleotide
  Target: FXN; (-) strand; PAM type: NRG; PAM sequence: AAG
cttagaaacacatgtctctg

SEQ ID NO: 10420 - DNA, 20 bp, Artificial Sequence
  Description of Artificial Sequence: Synthetic oligonucleotide
  Target: FXN; (-) strand; PAM type: NRG; PAM sequence: TAG
gtggggcagagtgcagacct

SEQ ID NO: 10421 - DNA, 20 bp, Artificial Sequence
  Description of Artificial Sequence: Synthetic oligonucleotide
  Target: FXN; (-) strand; PAM type: NRG; PAM sequence: CAG
ggggagggtggggcagagtg

SEQ ID NO: 10422 - DNA, 20 bp, Artificial Sequence
  Description of Artificial Sequence: Synthetic oligonucleotide
  Target: FXN; (-) strand; PAM type: NRG; PAM sequence: GAG
tggatggggagggtggggca

SEQ ID NO: 10423 - DNA, 20 bp, Artificial Sequence
  Description of Artificial Sequence: Synthetic oligonucleotide
  Target: FXN; (-) strand; PAM type: NRG; PAM sequence: CAG
agtggatggggagggtgggg

SEQ ID NO: 10424 - DNA, 20 bp, Artificial Sequence
  Description of Artificial Sequence: Synthetic oligonucleotide
  Target: FXN; (-) strand; PAM type: NRG; PAM sequence: GGG
gacagtggatggggagggtg

SEQ ID NO: 10425 - DNA, 20 bp, Artificial Sequence
  Description of Artificial Sequence: Synthetic oligonucleotide
  Target: FXN; (-) strand; PAM type: NRG; PAM sequence: GGG
ggacagtggatggggagggt

SEQ ID NO: 10426 - DNA, 20 bp, Artificial Sequence
  Description of Artificial Sequence: Synthetic oligonucleotide
  Target: FXN; (-) strand; PAM type: NRG; PAM sequence: TGG
gggacagtggatggggaggg

SEQ ID NO: 10427 - DNA, 20 bp, Artificial Sequence
  Description of Artificial Sequence: Synthetic oligonucleotide
  Target: FXN; (-) strand; PAM type: NRG; PAM sequence: GGG
tgggggacagtggatgggga

SEQ ID NO: 10428 - DNA, 20 bp, Artificial Sequence
  Description of Artificial Sequence: Synthetic oligonucleotide
  Target: FXN; (-) strand; PAM type: NRG; PAM sequence: AGG
ctgggggacagtggatgggg

SEQ ID NO: 10429 - DNA, 20 bp, Artificial Sequence
  Description of Artificial Sequence: Synthetic oligonucleotide
  Target: FXN; (-) strand; PAM type: NRG; PAM sequence: GAG
gctgggggacagtggatggg

SEQ ID NO: 10430 - DNA, 20 bp, Artificial Sequence
  Description of Artificial Sequence: Synthetic oligonucleotide
  Target: FXN; (-) strand; PAM type: NRG; PAM sequence: GGG
gggctgggggacagtggatg

SEQ ID NO: 10431 - DNA, 20 bp, Artificial Sequence
  Description of Artificial Sequence: Synthetic oligonucleotide
  Target: FXN; (-) strand; PAM type: NRG; PAM sequence: GGG
cgggctgggggacagtggat

SEQ ID NO: 10432 - DNA, 20 bp, Artificial Sequence
  Description of Artificial Sequence: Synthetic oligonucleotide
  Target: FXN; (-) strand; PAM type: NRG; PAM sequence: TGG
acgggctgggggacagtgga

SEQ ID NO: 10433 - DNA, 20 bp, Artificial Sequence
  Description of Artificial Sequence: Synthetic oligonucleotide
  Target: FXN; (-) strand; PAM type: NRG; PAM sequence: TGG
ggaaacgggctgggggacag

SEQ ID NO: 10434 - DNA, 20 bp, Artificial Sequence
  Description of Artificial Sequence: Synthetic oligonucleotide
  Target: FXN; (-) strand; PAM type: NRG; PAM sequence: CAG
ggaggaaacgggctggggga

SEQ ID NO: 10435 - DNA, 20 bp, Artificial Sequence
  Description of Artificial Sequence: Synthetic oligonucleotide
  Target: FXN; (-) strand; PAM type: NRG; PAM sequence: GGG
tggaggaggaaacgggctgg

SEQ ID NO: 10436 - DNA, 20 bp, Artificial Sequence
  Description of Artificial Sequence: Synthetic oligonucleotide
  Target: FXN; (-) strand; PAM type: NRG; PAM sequence: GGG
gtggaggaggaaacgggctg

SEQ ID NO: 10437 - DNA, 20 bp, Artificial Sequence
  Description of Artificial Sequence: Synthetic oligonucleotide
  Target: FXN; (-) strand; PAM type: NRG; PAM sequence: GGG
agtggaggaggaaacgggct

SEQ ID NO: 10438 - DNA, 20 bp, Artificial Sequence
  Description of Artificial Sequence: Synthetic oligonucleotide
  Target: FXN; (-) strand; PAM type: NRG; PAM sequence: TGG
aagtggaggaggaaacgggc

SEQ ID NO: 10439 - DNA, 20 bp, Artificial Sequence
  Description of Artificial Sequence: Synthetic oligonucleotide
  Target: FXN; (-) strand; PAM type: NRG; PAM sequence: GGG
aagtaagtggaggaggaaac

SEQ ID NO: 10440 - DNA, 20 bp, Artificial Sequence
  Description of Artificial Sequence: Synthetic oligonucleotide
  Target: FXN; (-) strand; PAM type: NRG; PAM sequence: CGG
gaagtaagtggaggaggaaa

SEQ ID NO: 10441 - DNA, 20 bp, Artificial Sequence
  Description of Artificial Sequence: Synthetic oligonucleotide
  Target: FXN; (-) strand; PAM type: NRG; PAM sequence: AGG
ggctgggaagtaagtggagg

SEQ ID NO: 10442 - DNA, 20 bp, Artificial Sequence
  Description of Artificial Sequence: Synthetic oligonucleotide
  Target: FXN; (-) strand; PAM type: NRG; PAM sequence: GAG
gggctgggaagtaagtggag

SEQ ID NO: 10443 - DNA, 20 bp, Artificial Sequence
  Description of Artificial Sequence: Synthetic oligonucleotide
  Target: FXN; (-) strand; PAM type: NRG; PAM sequence: AGG
cagggctgggaagtaagtgg

SEQ ID NO: 10444 - DNA, 20 bp, Artificial Sequence
  Description of Artificial Sequence: Synthetic oligonucleotide
  Target: FXN; (-) strand; PAM type: NRG; PAM sequence: GAG
acagggctgggaagtaagtg

SEQ ID NO: 10445 - DNA, 20 bp, Artificial Sequence
  Description of Artificial Sequence: Synthetic oligonucleotide
  Target: FXN; (-) strand; PAM type: NRG; PAM sequence: TGG
gcacagggctgggaagtaag

SEQ ID NO: 10446 - DNA, 20 bp, Artificial Sequence
  Description of Artificial Sequence: Synthetic oligonucleotide
  Target: FXN; (-) strand; PAM type: NRG; PAM sequence: AAG
aaggcacagggctgggaagt

SEQ ID NO: 10447 - DNA, 20 bp, Artificial Sequence
  Description of Artificial Sequence: Synthetic oligonucleotide
  Target: FXN; (-) strand; PAM type: NRG; PAM sequence: AAG
gcagaaggcacagggctggg

SEQ ID NO: 10448 - DNA, 20 bp, Artificial Sequence
  Description of Artificial Sequence: Synthetic oligonucleotide
  Target: FXN; (-) strand; PAM type: NRG; PAM sequence: GGG
aaggcagaaggcacagggct

SEQ ID NO: 10449 - DNA, 20 bp, Artificial Sequence
  Description of Artificial Sequence: Synthetic oligonucleotide
  Target: FXN; (-) strand; PAM type: NRG; PAM sequence: TGG
gaaggcagaaggcacagggc

SEQ ID NO: 10450 - DNA, 20 bp, Artificial Sequence
  Description of Artificial Sequence: Synthetic oligonucleotide
  Target: FXN; (-) strand; PAM type: NRG; PAM sequence: GGG
aagagaaggcagaaggcaca

SEQ ID NO: 10451 - DNA, 20 bp, Artificial Sequence
  Description of Artificial Sequence: Synthetic oligonucleotide
  Target: FXN; (-) strand; PAM type: NRG; PAM sequence: AGG
aaagagaaggcagaaggcac

SEQ ID NO: 10452 - DNA, 20 bp, Artificial Sequence
  Description of Artificial Sequence: Synthetic oligonucleotide
  Target: FXN; (-) strand; PAM type: NRG; PAM sequence: CAG
aaaagagaaggcagaaggca

SEQ ID NO: 10453 - DNA, 20 bp, Artificial Sequence
  Description of Artificial Sequence: Synthetic oligonucleotide
  Target: FXN; (-) strand; PAM type: NRG; PAM sequence: AGG
ctcagaaaagagaaggcaga

SEQ ID NO: 10454 - DNA, 20 bp, Artificial Sequence
  Description of Artificial Sequence: Synthetic oligonucleotide
  Target: FXN; (-) strand; PAM type: NRG; PAM sequence: AAG
actcagaaaagagaaggcag

SEQ ID NO: 10455 - DNA, 20 bp, Artificial Sequence
  Description of Artificial Sequence: Synthetic oligonucleotide
  Target: FXN; (-) strand; PAM type: NRG; PAM sequence: CAG
caaactcagaaaagagaagg

SEQ ID NO: 10456 - DNA, 20 bp, Artificial Sequence
  Description of Artificial Sequence: Synthetic oligonucleotide
  Target: FXN; (-) strand; PAM type: NRG; PAM sequence: AGG
tagcaaactcagaaaagaga

SEQ ID NO: 10457 - DNA, 20 bp, Artificial Sequence
  Description of Artificial Sequence: Synthetic oligonucleotide
  Target: FXN; (-) strand; PAM type: NRG; PAM sequence: AAG
ttagcaaactcagaaaagag

SEQ ID NO: 10458 - DNA, 20 bp, Artificial Sequence
  Description of Artificial Sequence: Synthetic oligonucleotide
  Target: FXN; (-) strand; PAM type: NRG; PAM sequence: GAG
cccttagcaaactcagaaaa

SEQ ID NO: 10459 - DNA, 20 bp, Artificial Sequence
  Description of Artificial Sequence: Synthetic oligonucleotide
  Target: FXN; (-) strand; PAM type: NRG; PAM sequence: AAG
tgcccttagcaaactcagaa

SEQ ID NO: 10460 - DNA, 20 bp, Artificial Sequence
  Description of Artificial Sequence: Synthetic oligonucleotide
  Target: FXN; (-) strand; PAM type: NRG; PAM sequence: CAG
agcagtgcccttagcaaact

SEQ ID NO: 10461 - DNA, 20 bp, Artificial Sequence
  Description of Artificial Sequence: Synthetic oligonucleotide
  Target: FXN; (-) strand; PAM type: NRG; PAM sequence: TAG
tcttgagccagcagtgccct

SEQ ID NO: 10462 - DNA, 20 bp, Artificial Sequence
  Description of Artificial Sequence: Synthetic oligonucleotide
  Target: FXN; (-) strand; PAM type: NRG; PAM sequence: CAG
agttactgctcttgagccag

SEQ ID NO: 10463 - DNA, 20 bp, Artificial Sequence
  Description of Artificial Sequence: Synthetic oligonucleotide
  Target: FXN; (-) strand; PAM type: NRG; PAM sequence: CAG
gttagttactgctcttgagc

SEQ ID NO: 10464 - DNA, 20 bp, Artificial Sequence
  Description of Artificial Sequence: Synthetic oligonucleotide
  Target: FXN; (-) strand; PAM type: NRG; PAM sequence: GAG
gactgttagttactgctctt

SEQ ID NO: 10465 - DNA, 20 bp, Artificial Sequence
  Description of Artificial Sequence: Synthetic oligonucleotide
  Target: FXN; (-) strand; PAM type: NRG; PAM sequence: TAG
gagaagaggcgagagactgt

SEQ ID NO: 10466 - DNA, 20 bp, Artificial Sequence
  Description of Artificial Sequence: Synthetic oligonucleotide
  Target: FXN; (-) strand; PAM type: NRG; PAM sequence: GAG
gccatggagagaagaggcga

SEQ ID NO: 10467 - DNA, 20 bp, Artificial Sequence
  Description of Artificial Sequence: Synthetic oligonucleotide
  Target: FXN; (-) strand; PAM type: NRG; PAM sequence: GAG
ttgccatggagagaagaggc

SEQ ID NO: 10468 - DNA, 20 bp, Artificial Sequence
  Description of Artificial Sequence: Synthetic oligonucleotide
  Target: FXN; (-) strand; PAM type: NRG; PAM sequence: AGG
ctggttgccatggagagaag

SEQ ID NO: 10469 - DNA, 20 bp, Artificial Sequence
  Description of Artificial Sequence: Synthetic oligonucleotide
  Target: FXN; (-) strand; PAM type: NRG; PAM sequence: GAG
actggttgccatggagagaa

SEQ ID NO: 10470 - DNA, 20 bp, Artificial Sequence
  Description of Artificial Sequence: Synthetic oligonucleotide
  Target: FXN; (-) strand; PAM type: NRG; PAM sequence: AAG
tcactggttgccatggagag

SEQ ID NO: 10471 - DNA, 20 bp, Artificial Sequence
  Description of Artificial Sequence: Synthetic oligonucleotide
  Target: FXN; (-) strand; PAM type: NRG; PAM sequence: GAG
aggtcactggttgccatgga

SEQ ID NO: 10472 - DNA, 20 bp, Artificial Sequence
  Description of Artificial Sequence: Synthetic oligonucleotide
  Target: FXN; (-) strand; PAM type: NRG; PAM sequence: GAG
aaaggtcactggttgccatg

SEQ ID NO: 10473 - DNA, 20 bp, Artificial Sequence
  Description of Artificial Sequence: Synthetic oligonucleotide
  Target: FXN; (-) strand; PAM type: NRG; PAM sequence: TGG
ccaaaggtcactggttgcca

SEQ ID NO: 10474 - DNA, 20 bp, Artificial Sequence
  Description of Artificial Sequence: Synthetic oligonucleotide
  Target: FXN; (-) strand; PAM type: NRG; PAM sequence: TGG
ttacattctccaaaggtcac

SEQ ID NO: 10475 - DNA, 20 bp, Artificial Sequence
  Description of Artificial Sequence: Synthetic oligonucleotide
  Target: FXN; (-) strand; PAM type: NRG; PAM sequence: AGG
ataaggtttacattctccaa

SEQ ID NO: 10476 - DNA, 20 bp, Artificial Sequence
  Description of Artificial Sequence: Synthetic oligonucleotide
  Target: FXN; (-) strand; PAM type: NRG; PAM sequence: AAG
gataaggtttacattctcca

SEQ ID NO: 10477 - DNA, 20 bp, Artificial Sequence
  Description of Artificial Sequence: Synthetic oligonucleotide
  Target: FXN; (-) strand; PAM type: NRG; PAM sequence: AGG
gctttaagagattggtgata

SEQ ID NO: 10478 - DNA, 20 bp, Artificial Sequence
  Description of Artificial Sequence: Synthetic oligonucleotide
  Target: FXN; (-) strand; PAM type: NRG; PAM sequence: AAG
ggctttaagagattggtgat

SEQ ID NO: 10479 - DNA, 20 bp, Artificial Sequence
  Description of Artificial Sequence: Synthetic oligonucleotide
  Target: FXN; (-) strand; PAM type: NRG; PAM sequence: TGG
accgaagggctttaagagat

SEQ ID NO: 10480 - DNA, 20 bp, Artificial Sequence
  Description of Artificial Sequence: Synthetic oligonucleotide
  Target: FXN; (-) strand; PAM type: NRG; PAM sequence: GAG
aaggcaccgaagggctttaa

SEQ ID NO: 10481 - DNA, 20 bp, Artificial Sequence
  Description of Artificial Sequence: Synthetic oligonucleotide
  Target: FXN; (-) strand; PAM type: NRG; PAM sequence: AAG
ggaaggcaccgaagggcttt

SEQ ID NO: 10482 - DNA, 20 bp, Artificial Sequence
  Description of Artificial Sequence: Synthetic oligonucleotide
  Target: FXN; (-) strand; PAM type: NRG; PAM sequence: GGG
catcctgggaaggcaccgaa

SEQ ID NO: 10483 - DNA, 20 bp, Artificial Sequence
  Description of Artificial Sequence: Synthetic oligonucleotide
  Target: FXN; (-) strand; PAM type: NRG; PAM sequence: AGG
tcatcctgggaaggcaccga

SEQ ID NO: 10484 - DNA, 20 bp, Artificial Sequence
  Description of Artificial Sequence: Synthetic oligonucleotide
  Target: FXN; (-) strand; PAM type: NRG; PAM sequence: AAG
gtcatcctgggaaggcaccg

SEQ ID NO: 10485 - DNA, 20 bp, Artificial Sequence
  Description of Artificial Sequence: Synthetic oligonucleotide
  Target: FXN; (-) strand; PAM type: NRG; PAM sequence: AGG
agctggacgtcatcctggga

SEQ ID NO: 10486 - DNA, 20 bp, Artificial Sequence
  Description of Artificial Sequence: Synthetic oligonucleotide
  Target: FXN; (-) strand; PAM type: NRG; PAM sequence: AAG
cagctggacgtcatcctggg

SEQ ID NO: 10487 - DNA, 20 bp, Artificial Sequence
  Description of Artificial Sequence: Synthetic oligonucleotide
  Target: FXN; (-) strand; PAM type: NRG; PAM sequence: GGG
cctcagctggacgtcatcct

SEQ ID NO: 10488 - DNA, 20 bp, Artificial Sequence
  Description of Artificial Sequence: Synthetic oligonucleotide
  Target: FXN; (-) strand; PAM type: NRG; PAM sequence: TGG
acctcagctggacgtcatcc

SEQ ID NO: 10489 - DNA, 20 bp, Artificial Sequence
  Description of Artificial Sequence: Synthetic oligonucleotide
  Target: FXN; (-) strand; PAM type: NRG; PAM sequence: TGG
gtcttgccaaggacctcagc

SEQ ID NO: 10490 - DNA, 20 bp, Artificial Sequence
  Description of Artificial Sequence: Synthetic oligonucleotide
  Target: FXN; (-) strand; PAM type: NRG; PAM sequence: CAG
ctgggtcttgccaaggacct

SEQ ID NO: 10491 - DNA, 20 bp, Artificial Sequence
  Description of Artificial Sequence: Synthetic oligonucleotide
  Target: FXN; (-) strand; PAM type: NRG; PAM sequence: AGG
gggcgccctgggtcttgcca

SEQ ID NO: 10492 - DNA, 20 bp, Artificial Sequence
  Description of Artificial Sequence: Synthetic oligonucleotide
  Target: FXN; (-) strand; PAM type: NRG; PAM sequence: AAG
ggggcgccctgggtcttgcc

SEQ ID NO: 10493 - DNA, 20 bp, Artificial Sequence
  Description of Artificial Sequence: Synthetic oligonucleotide
  Target: FXN; (-) strand; PAM type: NRG; PAM sequence: GGG
gagcgaggagggggcgccct

SEQ ID NO: 10494 - DNA, 20 bp, Artificial Sequence
  Description of Artificial Sequence: Synthetic oligonucleotide
  Target: FXN; (-) strand; PAM type: NRG; PAM sequence: TGG
ggagcgaggagggggcgccc

SEQ ID NO: 10495 - DNA, 20 bp, Artificial Sequence
  Description of Artificial Sequence: Synthetic oligonucleotide
  Target: FXN; (-) strand; PAM type: NRG; PAM sequence: GGG
gaggtgatggagcgaggagg

SEQ ID NO: 10496 - DNA, 20 bp, Artificial Sequence
  Description of Artificial Sequence: Synthetic oligonucleotide
  Target: FXN; (-) strand; PAM type: NRG; PAM sequence: GGG
ggaggtgatggagcgaggag

SEQ ID NO: 10497 - DNA, 20 bp, Artificial Sequence
  Description of Artificial Sequence: Synthetic oligonucleotide
  Target: FXN; (-) strand; PAM type: NRG; PAM sequence: GGG
gggaggtgatggagcgagga

SEQ ID NO: 10498 - DNA, 20 bp, Artificial Sequence
  Description of Artificial Sequence: Synthetic oligonucleotide
  Target: FXN; (-) strand; PAM type: NRG; PAM sequence: AGG
ggggaggtgatggagcgagg

SEQ ID NO: 10499 - DNA, 20 bp, Artificial Sequence
  Description of Artificial Sequence: Synthetic oligonucleotide
  Target: FXN; (-) strand; PAM type: NRG; PAM sequence: GAG
aggggaggtgatggagcgag

SEQ ID NO: 10500 - DNA, 20 bp, Artificial Sequence
  Description of Artificial Sequence: Synthetic oligonucleotide
  Target: FXN; (-) strand; PAM type: NRG; PAM sequence: AGG
acaggggaggtgatggagcg

SEQ ID NO: 10501 - DNA, 20 bp, Artificial Sequence
  Description of Artificial Sequence: Synthetic oligonucleotide
  Target: FXN; (-) strand; PAM type: NRG; PAM sequence: GAG
gacaggggaggtgatggagc

SEQ ID NO: 10502 - DNA, 20 bp, Artificial Sequence
  Description of Artificial Sequence: Synthetic oligonucleotide
  Target: FXN; (-) strand; PAM type: NRG; PAM sequence: GAG
aggtgacaggggaggtgatg

SEQ ID NO: 10503 - DNA, 20 bp, Artificial Sequence
  Description of Artificial Sequence: Synthetic oligonucleotide
  Target: FXN; (-) strand; PAM type: NRG; PAM sequence: TGG
ggaggtgacaggggaggtga

SEQ ID NO: 10504 - DNA, 20 bp, Artificial Sequence
  Description of Artificial Sequence: Synthetic oligonucleotide
  Target: FXN; (-) strand; PAM type: NRG; PAM sequence: AGG
tgcaggggaggtgacagggg

SEQ ID NO: 10505 - DNA, 20 bp, Artificial Sequence
  Description of Artificial Sequence: Synthetic oligonucleotide
  Target: FXN; (-) strand; PAM type: NRG; PAM sequence: GAG
atgcaggggaggtgacaggg

SEQ ID NO: 10506 - DNA, 20 bp, Artificial Sequence
  Description of Artificial Sequence: Synthetic oligonucleotide
  Target: FXN; (-) strand; PAM type: NRG; PAM sequence: GGG
agatgcaggggaggtgacag

SEQ ID NO: 10507 - DNA, 20 bp, Artificial Sequence
  Description of Artificial Sequence: Synthetic oligonucleotide
  Target: FXN; (-) strand; PAM type: NRG; PAM sequence: GGG
gagatgcaggggaggtgaca

SEQ ID NO: 10508 - DNA, 20 bp, Artificial Sequence
  Description of Artificial Sequence: Synthetic oligonucleotide
  Target: FXN; (-) strand; PAM type: NRG; PAM sequence: AGG
ggagatgcaggggaggtgac

SEQ ID NO: 10509 - DNA, 20 bp, Artificial Sequence
  Description of Artificial Sequence: Synthetic oligonucleotide
  Target: FXN; (-) strand; PAM type: NRG; PAM sequence: CAG
gggagatgcaggggaggtga

SEQ ID NO: 10510 - DNA, 20 bp, Artificial Sequence
  Description of Artificial Sequence: Synthetic oligonucleotide
  Target: FXN; (-) strand; PAM type: NRG; PAM sequence: AGG
ggagtagggagatgcagggg

SEQ ID NO: 10511 - DNA, 20 bp, Artificial Sequence
  Description of Artificial Sequence: Synthetic oligonucleotide
  Target: FXN; (-) strand; PAM type: NRG; PAM sequence: GAG
tggagtagggagatgcaggg

SEQ ID NO: 10512 - DNA, 20 bp, Artificial Sequence
  Description of Artificial Sequence: Synthetic oligonucleotide
  Target: FXN; (-) strand; PAM type: NRG; PAM sequence: GGG
gctggagtagggagatgcag

SEQ ID NO: 10513 - DNA, 20 bp, Artificial Sequence
  Description of Artificial Sequence: Synthetic oligonucleotide
  Target: FXN; (-) strand; PAM type: NRG; PAM sequence: GGG
agctggagtagggagatgca

SEQ ID NO: 10514 - DNA, 20 bp, Artificial Sequence
  Description of Artificial Sequence: Synthetic oligonucleotide
  Target: FXN; (-) strand; PAM type: NRG; PAM sequence: AGG
cagctggagtagggagatgc

SEQ ID NO: 10515 - DNA, 20 bp, Artificial Sequence
  Description of Artificial Sequence: Synthetic oligonucleotide
  Target: FXN; (-) strand; PAM type: NRG; PAM sequence: CAG
gcagctggagtagggagatg

SEQ ID NO: 10516 - DNA, 20 bp, Artificial Sequence
  Description of Artificial Sequence: Synthetic oligonucleotide
  Target: FXN; (-) strand; PAM type: NRG; PAM sequence: GAG
agtggtgcagctggagtagg

SEQ ID NO: 10517 - DNA, 20 bp, Artificial Sequence
  Description of Artificial Sequence: Synthetic oligonucleotide
  Target: FXN; (-) strand; PAM type: NRG; PAM sequence: GGG
agagtggtgcagctggagta

SEQ ID NO: 10518 - DNA, 20 bp, Artificial Sequence
  Description of Artificial Sequence: Synthetic oligonucleotide
  Target: FXN; (-) strand; PAM type: NRG; PAM sequence: AGG
aagagtggtgcagctggagt

SEQ ID NO: 10519 - DNA, 20 bp, Artificial Sequence
  Description of Artificial Sequence: Synthetic oligonucleotide
  Target: FXN; (-) strand; PAM type: NRG; PAM sequence: TAG
caagagtggtgcagctggag

SEQ ID NO: 10520 - DNA, 20 bp, Artificial Sequence
  Description of Artificial Sequence: Synthetic oligonucleotide
  Target: FXN; (-) strand; PAM type: NRG; PAM sequence: GAG
gcacaagagtggtgcagctg

SEQ ID NO: 10521 - DNA, 20 bp, Artificial Sequence
  Description of Artificial Sequence: Synthetic oligonucleotide
  Target: FXN; (-) strand; PAM type: NRG; PAM sequence: TGG
gggcacaagagtggtgcagc

SEQ ID NO: 10522 - DNA, 20 bp, Artificial Sequence
  Description of Artificial Sequence: Synthetic oligonucleotide
  Target: FXN; (-) strand; PAM type: NRG; PAM sequence: CAG
actggggcacaagagtggtg

SEQ ID NO: 10523 - DNA, 20 bp, Artificial Sequence
  Description of Artificial Sequence: Synthetic oligonucleotide
  Target: FXN; (-) strand; PAM type: NRG; PAM sequence: TGG
gagccactggggcacaagag

SEQ ID NO: 10524 - DNA, 20 bp, Artificial Sequence
  Description of Artificial Sequence: Synthetic oligonucleotide
  Target: FXN; (-) strand; PAM type: NRG; PAM sequence: GAG
caagagccactggggcacaa

SEQ ID NO: 10525 - DNA, 20 bp, Artificial Sequence
  Description of Artificial Sequence: Synthetic oligonucleotide
  Target: FXN; (-) strand; PAM type: NRG; PAM sequence: AAG
gacaagagccactggggcac

SEQ ID NO: 10526 - DNA, 20 bp, Artificial Sequence
  Description of Artificial Sequence: Synthetic oligonucleotide
  Target: FXN; (-) strand; PAM type: NRG; PAM sequence: GGG
taatcagacaagagccactg

SEQ ID NO: 10527 - DNA, 20 bp, Artificial Sequence
  Description of Artificial Sequence: Synthetic oligonucleotide
  Target: FXN; (-) strand; PAM type: NRG; PAM sequence: GGG
ataatcagacaagagccact

SEQ ID NO: 10528 - DNA, 20 bp, Artificial Sequence
  Description of Artificial Sequence: Synthetic oligonucleotide
  Target: FXN; (-) strand; PAM type: NRG; PAM sequence: TGG
aataatcagacaagagccac

SEQ ID NO: 10529 - DNA, 20 bp, Artificial Sequence
  Description of Artificial Sequence: Synthetic oligonucleotide
  Target: FXN; (-) strand; PAM type: NRG; PAM sequence: GAG
tgaaggaaataatcagacaa

SEQ ID NO: 10530 - DNA, 20 bp, Artificial Sequence
  Description of Artificial Sequence: Synthetic oligonucleotide
  Target: FXN; (-) strand; PAM type: NRG; PAM sequence: AAG
gatgaaggaaataatcagac

SEQ ID NO: 10531 - DNA, 20 bp, Artificial Sequence
  Description of Artificial Sequence: Synthetic oligonucleotide
  Target: FXN; (-) strand; PAM type: NRG; PAM sequence: CAG
ggggagatgaaggaaataat

SEQ ID NO: 10532 - DNA, 20 bp, Artificial Sequence
  Description of Artificial Sequence: Synthetic oligonucleotide
  Target: FXN; (-) strand; PAM type: NRG; PAM sequence: AGG
ctgaccagctggggagatga

SEQ ID NO: 10533 - DNA, 20 bp, Artificial Sequence
  Description of Artificial Sequence: Synthetic oligonucleotide
  Target: FXN; (-) strand; PAM type: NRG; PAM sequence: AAG
gctgaccagctggggagatg

SEQ ID NO: 10534 - DNA, 20 bp, Artificial Sequence
  Description of Artificial Sequence: Synthetic oligonucleotide
  Target: FXN; (-) strand; PAM type: NRG; PAM sequence: GAG
agctctgctgaccagctggg

SEQ ID NO: 10535 - DNA, 20 bp, Artificial Sequence
  Description of Artificial Sequence: Synthetic oligonucleotide
  Target: FXN; (-) strand; PAM type: NRG; PAM sequence: GGG
ccagctctgctgaccagctg

SEQ ID NO: 10536 - DNA, 20 bp, Artificial Sequence
  Description of Artificial Sequence: Synthetic oligonucleotide
  Target: FXN; (-) strand; PAM type: NRG; PAM sequence: GGG
accagctctgctgaccagct

SEQ ID NO: 10537 - DNA, 20 bp, Artificial Sequence
  Description of Artificial Sequence: Synthetic oligonucleotide
  Target: FXN; (-) strand; PAM type: NRG; PAM sequence: TGG
caccagctctgctgaccagc

SEQ ID NO: 10538 - DNA, 20 bp, Artificial Sequence
  Description of Artificial Sequence: Synthetic oligonucleotide
  Target: FXN; (-) strand; PAM type: NRG; PAM sequence: CAG
ttaccaccagctctgctgac

SEQ ID NO: 10539 - DNA, 20 bp, Artificial Sequence
  Description of Artificial Sequence: Synthetic oligonucleotide
  Target: FXN; (-) strand; PAM type: NRG; PAM sequence: CAG
gggtctgagttgattaccac

SEQ ID NO: 10540 - DNA, 20 bp, Artificial Sequence
  Description of Artificial Sequence: Synthetic oligonucleotide
  Target: FXN; (-) strand; PAM type: NRG; PAM sequence: GAG
acatccaggtgacagggtct

SEQ ID NO: 10541 - DNA, 20 bp, Artificial Sequence
  Description of Artificial Sequence: Synthetic oligonucleotide
  Target: FXN; (-) strand; PAM type: NRG; PAM sequence: GGG
tgctggacatccaggtgaca

SEQ ID NO: 10542 - DNA, 20 bp, Artificial Sequence
  Description of Artificial Sequence: Synthetic oligonucleotide
  Target: FXN; (-) strand; PAM type: NRG; PAM sequence: AGG
ctgctggacatccaggtgac

SEQ ID NO: 10543 - DNA, 20 bp, Artificial Sequence
  Description of Artificial Sequence: Synthetic oligonucleotide
  Target: FXN; (-) strand; PAM type: NRG; PAM sequence: CAG
actgctggacatccaggtga

SEQ ID NO: 10544 - DNA, 20 bp, Artificial Sequence
  Description of Artificial Sequence: Synthetic oligonucleotide
  Target: FXN; (-) strand; PAM type: NRG; PAM sequence: AGG
tccctaactgctggacatcc

SEQ ID NO: 10545 - DNA, 20 bp, Artificial Sequence
  Description of Artificial Sequence: Synthetic oligonucleotide
  Target: FXN; (-) strand; PAM type: NRG; PAM sequence: CAG
gtccctaactgctggacatc

SEQ ID NO: 10546 - DNA, 20 bp, Artificial Sequence
  Description of Artificial Sequence: Synthetic oligonucleotide
  Target: FXN; (-) strand; PAM type: NRG; PAM sequence: TGG
tttttttagtccctaactgc

SEQ ID NO: 10547 - DNA, 20 bp, Artificial Sequence
  Description of Artificial Sequence: Synthetic oligonucleotide
  Target: FXN; (-) strand; PAM type: NRG; PAM sequence: TAG
tgtgacctgttgattttttt

SEQ ID NO: 10548 - DNA, 20 bp, Artificial Sequence
  Description of Artificial Sequence: Synthetic oligonucleotide
  Target: FXN; (-) strand; PAM type: NRG; PAM sequence: CAG
tattatcatgatctgcagga

SEQ ID NO: 10549 - DNA, 20 bp, Artificial Sequence
  Description of Artificial Sequence: Synthetic oligonucleotide
  Target: FXN; (-) strand; PAM type: NRG; PAM sequence: AGG
atcttattatcatgatctgc

SEQ ID NO: 10550 - DNA, 20 bp, Artificial Sequence
  Description of Artificial Sequence: Synthetic oligonucleotide
  Target: FXN; (-) strand; PAM type: NRG; PAM sequence: CAG
gatcttattatcatgatctg

SEQ ID NO: 10551 - DNA, 20 bp, Artificial Sequence
  Description of Artificial Sequence: Synthetic oligonucleotide
  Target: FXN; (-) strand; PAM type: NRG; PAM sequence: CAG
gactgctgactgctgtctga

SEQ ID NO: 10552 - DNA, 20 bp, Artificial Sequence
  Description of Artificial Sequence: Synthetic oligonucleotide
  Target: FXN; (-) strand; PAM type: NRG; PAM sequence: TGG
ctgctgaagtccagaagatt

SEQ ID NO: 10553 - DNA, 20 bp, Artificial Sequence
  Description of Artificial Sequence: Synthetic oligonucleotide
  Target: FXN; (-) strand; PAM type: NRG; PAM sequence: AAG
agaatcctgctgaagtccag

SEQ ID NO: 10554 - DNA, 20 bp, Artificial Sequence
  Description of Artificial Sequence: Synthetic oligonucleotide
  Target: FXN; (-) strand; PAM type: NRG; PAM sequence: CAG
ggcagaatcctgctgaagtc

SEQ ID NO: 10555 - DNA, 20 bp, Artificial Sequence
  Description of Artificial Sequence: Synthetic oligonucleotide
  Target: FXN; (-) strand; PAM type: NRG; PAM sequence: AAG
caagaggcagaatcctgctg

SEQ ID NO: 10556 - DNA, 20 bp, Artificial Sequence
  Description of Artificial Sequence: Synthetic oligonucleotide
  Target: FXN; (-) strand; PAM type: NRG; PAM sequence: CAG
caacaggaaatagcaagagg

SEQ ID NO: 10557 - DNA, 20 bp, Artificial Sequence
  Description of Artificial Sequence: Synthetic oligonucleotide
  Target: FXN; (-) strand; PAM type: NRG; PAM sequence: AGG
aggcaacaggaaatagcaag

SEQ ID NO: 10558 - DNA, 20 bp, Artificial Sequence
  Description of Artificial Sequence: Synthetic oligonucleotide
  Target: FXN; (-) strand; PAM type: NRG; PAM sequence: GAG
gaggcaacaggaaatagcaa

SEQ ID NO: 10559 - DNA, 20 bp, Artificial Sequence
  Description of Artificial Sequence: Synthetic oligonucleotide
  Target: FXN; (-) strand; PAM type: NRG; PAM sequence: AAG
gagaggcaacaggaaatagc

SEQ ID NO: 10560 - DNA, 20 bp, Artificial Sequence
  Description of Artificial Sequence: Synthetic oligonucleotide
  Target: FXN; (-) strand; PAM type: NRG; PAM sequence: TAG
ctaagagaggcaacaggaaa

SEQ ID NO: 10561 - DNA, 20 bp, Artificial Sequence
  Description of Artificial Sequence: Synthetic oligonucleotide
  Target: FXN; (-) strand; PAM type: NRG; PAM sequence: AGG
aggtcactaagagaggcaac

SEQ ID NO: 10562 - DNA, 20 bp, Artificial Sequence
  Description of Artificial Sequence: Synthetic oligonucleotide
  Target: FXN; (-) strand; PAM type: NRG; PAM sequence: CAG
aaggtcactaagagaggcaa

SEQ ID NO: 10563 - DNA, 20 bp, Artificial Sequence
  Description of Artificial Sequence: Synthetic oligonucleotide
  Target: FXN; (-) strand; PAM type: NRG; PAM sequence: AGG
tcttaaaaggtcactaagag

SEQ ID NO: 10564 - DNA, 20 bp, Artificial Sequence
  Description of Artificial Sequence: Synthetic oligonucleotide
  Target: FXN; (-) strand; PAM type: NRG; PAM sequence: GAG
ctcttaaaaggtcactaaga

SEQ ID NO: 10565 - DNA, 20 bp, Artificial Sequence
  Description of Artificial Sequence: Synthetic oligonucleotide
  Target: FXN; (-) strand; PAM type: NRG; PAM sequence: GAG
tgctcttaaaaggtcactaa

SEQ ID NO: 10566 - DNA, 20 bp, Artificial Sequence
  Description of Artificial Sequence: Synthetic oligonucleotide
  Target: FXN; (-) strand; PAM type: NRG; PAM sequence: AAG
aatgctcttaaaaggtcact

SEQ ID NO: 10567 - DNA, 20 bp, Artificial Sequence
  Description of Artificial Sequence: Synthetic oligonucleotide
  Target: FXN; (-) strand; PAM type: NRG; PAM sequence: AGG
gcatccacaatgctcttaaa

SEQ ID NO: 10568 - DNA, 20 bp, Artificial Sequence
  Description of Artificial Sequence: Synthetic oligonucleotide
  Target: FXN; (-) strand; PAM type: NRG; PAM sequence: AAG
ggcatccacaatgctcttaa

SEQ ID NO: 10569 - DNA, 20 bp, Artificial Sequence
  Description of Artificial Sequence: Synthetic oligonucleotide
  Target: FXN; (-) strand; PAM type: NRG; PAM sequence: AGG
gtggttagcaggaggctggg

SEQ ID NO: 10570 - DNA, 20 bp, Artificial Sequence
  Description of Artificial Sequence: Synthetic oligonucleotide
  Target: FXN; (-) strand; PAM type: NRG; PAM sequence: GAG
ggtggttagcaggaggctgg

SEQ ID NO: 10571 - DNA, 20 bp, Artificial Sequence
  Description of Artificial Sequence: Synthetic oligonucleotide
  Target: FXN; (-) strand; PAM type: NRG; PAM sequence: GGG
agggtggttagcaggaggct

SEQ ID NO: 10572 - DNA, 20 bp, Artificial Sequence
  Description of Artificial Sequence: Synthetic oligonucleotide
  Target: FXN; (-) strand; PAM type: NRG; PAM sequence: TGG
cagggtggttagcaggaggc

SEQ ID NO: 10573 - DNA, 20 bp, Artificial Sequence
  Description of Artificial Sequence: Synthetic oligonucleotide
  Target: FXN; (-) strand; PAM type: NRG; PAM sequence: AGG
gttacagggtggttagcagg

SEQ ID NO: 10574 - DNA, 20 bp, Artificial Sequence
  Description of Artificial Sequence: Synthetic oligonucleotide
  Target: FXN; (-) strand; PAM type: NRG; PAM sequence: GAG
ggttacagggtggttagcag

SEQ ID NO: 10575 - DNA, 20 bp, Artificial Sequence
  Description of Artificial Sequence: Synthetic oligonucleotide
  Target: FXN; (-) strand; PAM type: NRG; PAM sequence: AGG
caggttacagggtggttagc

SEQ ID NO: 10576 - DNA, 20 bp, Artificial Sequence
  Description of Artificial Sequence: Synthetic oligonucleotide
  Target: FXN; (-) strand; PAM type: NRG; PAM sequence: CAG
tcaggttacagggtggttag

SEQ ID NO: 10577 - DNA, 20 bp, Artificial Sequence
  Description of Artificial Sequence: Synthetic oligonucleotide
  Target: FXN; (-) strand; PAM type: NRG; PAM sequence: TAG
tgttcaggttacagggtggt

SEQ ID NO: 10578 - DNA, 20 bp, Artificial Sequence
  Description of Artificial Sequence: Synthetic oligonucleotide
  Target: FXN; (-) strand; PAM type: NRG; PAM sequence: TGG
aggctgttcaggttacaggg

SEQ ID NO: 10579 - DNA, 20 bp, Artificial Sequence
  Description of Artificial Sequence: Synthetic oligonucleotide
  Target: FXN; (-) strand; PAM type: NRG; PAM sequence: GGG
tgcaggctgttcaggttaca

SEQ ID NO: 10580 - DNA, 20 bp, Artificial Sequence
  Description of Artificial Sequence: Synthetic oligonucleotide
  Target: FXN; (-) strand; PAM type: NRG; PAM sequence: AGG
ctgcaggctgttcaggttac

SEQ ID NO: 10581 - DNA, 20 bp, Artificial Sequence
  Description of Artificial Sequence: Synthetic oligonucleotide
  Target: FXN; (-) strand; PAM type: NRG; PAM sequence: CAG
gctgcaggctgttcaggtta

SEQ ID NO: 10582 - DNA, 20 bp, Artificial Sequence
  Description of Artificial Sequence: Synthetic oligonucleotide
  Target: FXN; (-) strand; PAM type: NRG; PAM sequence: AGG
agggctgctgcaggctgttc

SEQ ID NO: 10583 - DNA, 20 bp, Artificial Sequence
  Description of Artificial Sequence: Synthetic oligonucleotide
  Target: FXN; (-) strand; PAM type: NRG; PAM sequence: CAG
cagggctgctgcaggctgtt

SEQ ID NO: 10584 - DNA, 20 bp, Artificial Sequence
  Description of Artificial Sequence: Synthetic oligonucleotide
  Target: FXN; (-) strand; PAM type: NRG; PAM sequence: AGG
ctactgggcagggctgctgc

SEQ ID NO: 10585 - DNA, 20 bp, Artificial Sequence
  Description of Artificial Sequence: Synthetic oligonucleotide
  Target: FXN; (-) strand; PAM type: NRG; PAM sequence: CAG
tctactgggcagggctgctg

SEQ ID NO: 10586 - DNA, 20 bp, Artificial Sequence
  Description of Artificial Sequence: Synthetic oligonucleotide
  Target: FXN; (-) strand; PAM type: NRG; PAM sequence: GGG
tcaggaagttctactgggca

SEQ ID NO: 10587 - DNA, 20 bp, Artificial Sequence
  Description of Artificial Sequence: Synthetic oligonucleotide
  Target: FXN; (-) strand; PAM type: NRG; PAM sequence: AGG
atcaggaagttctactgggc

SEQ ID NO: 10588 - DNA, 20 bp, Artificial Sequence
  Description of Artificial Sequence: Synthetic oligonucleotide
  Target: FXN; (-) strand; PAM type: NRG; PAM sequence: CAG
catcaggaagttctactggg

SEQ ID NO: 10589 - DNA, 20 bp, Artificial Sequence
  Description of Artificial Sequence: Synthetic oligonucleotide
  Target: FXN; (-) strand; PAM type: NRG; PAM sequence: GGG
tcacatcaggaagttctact

SEQ ID NO: 10590 - DNA, 20 bp, Artificial Sequence
  Description of Artificial Sequence: Synthetic oligonucleotide
  Target: FXN; (-) strand; PAM type: NRG; PAM sequence: TGG
atcacatcaggaagttctac

SEQ ID NO: 10591 - DNA, 20 bp, Artificial Sequence
  Description of Artificial Sequence: Synthetic oligonucleotide
  Target: FXN; (-) strand; PAM type: NRG; PAM sequence: AAG
agcatttccatcacatcagg

SEQ ID NO: 10592 - DNA, 20 bp, Artificial Sequence
  Description of Artificial Sequence: Synthetic oligonucleotide
  Target: FXN; (-) strand; PAM type: NRG; PAM sequence: AGG
cacagcatttccatcacatc

SEQ ID NO: 10593 - DNA, 20 bp, Artificial Sequence
  Description of Artificial Sequence: Synthetic oligonucleotide
  Target: FXN; (-) strand; PAM type: NRG; PAM sequence: CAG
acacagcatttccatcacat

SEQ ID NO: 10594 - DNA, 20 bp, Artificial Sequence
  Description of Artificial Sequence: Synthetic oligonucleotide
  Target: FXN; (-) strand; PAM type: NRG; PAM sequence: CAG
tgtggctagtggtgcagaca

SEQ ID NO: 10595 - DNA, 20 bp, Artificial Sequence
  Description of Artificial Sequence: Synthetic oligonucleotide
  Target: FXN; (-) strand; PAM type: NRG; PAM sequence: CAG
gccacatgtggctagtggtg

SEQ ID NO: 10596 - DNA, 20 bp, Artificial Sequence
  Description of Artificial Sequence: Synthetic oligonucleotide
  Target: FXN; (-) strand; PAM type: NRG; PAM sequence: TGG
ctgtggccacatgtggctag

SEQ ID NO: 10597 - DNA, 20 bp, Artificial Sequence
  Description of Artificial Sequence: Synthetic oligonucleotide
  Target: FXN; (-) strand; PAM type: NRG; PAM sequence: TAG
atcctgtggccacatgtggc

SEQ ID NO: 10598 - DNA, 20 bp, Artificial Sequence
  Description of Artificial Sequence: Synthetic oligonucleotide
  Target: FXN; (-) strand; PAM type: NRG; PAM sequence: TGG
gagaatcctgtggccacatg

SEQ ID NO: 10599 - DNA, 20 bp, Artificial Sequence
  Description of Artificial Sequence: Synthetic oligonucleotide
  Target: FXN; (-) strand; PAM type: NRG; PAM sequence: TGG
caccagtttcgagaatcctg

SEQ ID NO: 10600 - DNA, 20 bp, Artificial Sequence
  Description of Artificial Sequence: Synthetic oligonucleotide
  Target: FXN; (-) strand; PAM type: NRG; PAM sequence: GAG
tcaactgcaccaccagtttc

SEQ ID NO: 10601 - DNA, 20 bp, Artificial Sequence
  Description of Artificial Sequence: Synthetic oligonucleotide
  Target: FXN; (-) strand; PAM type: NRG; PAM sequence: CAG
cagctcctcaactgcaccac

SEQ ID NO: 10602 - DNA, 20 bp, Artificial Sequence
  Description of Artificial Sequence: Synthetic oligonucleotide
  Target: FXN; (-) strand; PAM type: NRG; PAM sequence: CAG
aatgagataaaatataaagt

SEQ ID NO: 10603 - DNA, 20 bp, Artificial Sequence
  Description of Artificial Sequence: Synthetic oligonucleotide
  Target: FXN; (-) strand; PAM type: NRG; PAM sequence: AAG
atttaatgagataaaatata

SEQ ID NO: 10604 - DNA, 20 bp, Artificial Sequence
  Description of Artificial Sequence: Synthetic oligonucleotide
  Target: FXN; (-) strand; PAM type: NRG; PAM sequence: GAG
tatttacatttaaatttaat

SEQ ID NO: 10605 - DNA, 20 bp, Artificial Sequence
  Description of Artificial Sequence: Synthetic oligonucleotide
  Target: FXN; (-) strand; PAM type: NRG; PAM sequence: TAG
gctagccaacaagccacacg

SEQ ID NO: 10606 - DNA, 20 bp, Artificial Sequence
  Description of Artificial Sequence: Synthetic oligonucleotide
  Target: FXN; (-) strand; PAM type: NRG; PAM sequence: AAG
tttccaataggctagccaac

SEQ ID NO: 10607 - DNA, 20 bp, Artificial Sequence
  Description of Artificial Sequence: Synthetic oligonucleotide
  Target: FXN; (-) strand; PAM type: NRG; PAM sequence: TAG
gcccgtgttttccaataggc

SEQ ID NO: 10608 - DNA, 20 bp, Artificial Sequence
  Description of Artificial Sequence: Synthetic oligonucleotide
  Target: FXN; (-) strand; PAM type: NRG; PAM sequence: AGG
ctaagcccgtgttttccaat

SEQ ID NO: 10609 - DNA, 20 bp, Artificial Sequence
  Description of Artificial Sequence: Synthetic oligonucleotide
  Target: FXN; (-) strand; PAM type: NRG; PAM sequence: TAG
tctaagcccgtgttttccaa

SEQ ID NO: 10610 - DNA, 20 bp, Artificial Sequence
  Description of Artificial Sequence: Synthetic oligonucleotide
  Target: FXN; (-) strand; PAM type: NRG; PAM sequence: AAG
gattctccctgtgtctctct

SEQ ID NO: 10611 - DNA, 20 bp, Artificial Sequence
  Description of Artificial Sequence: Synthetic oligonucleotide
  Target: FXN; (-) strand; PAM type: NRG; PAM sequence: CAG
taccttcttttagtgcatta

SEQ ID NO: 10612 - DNA, 20 bp, Artificial Sequence
  Description of Artificial Sequence: Synthetic oligonucleotide
  Target: FXN; (-) strand; PAM type: NRG; PAM sequence: TAG
tttttttttttaccttcttt

SEQ ID NO: 10613 - DNA, 20 bp, Artificial Sequence
  Description of Artificial Sequence: Synthetic oligonucleotide
  Target: FXN; (-) strand; PAM type: NRG; PAM sequence: AGG
gtattttaggaatatttctt

SEQ ID NO: 10614 - DNA, 20 bp, Artificial Sequence
  Description of Artificial Sequence: Synthetic oligonucleotide
  Target: FXN; (-) strand; PAM type: NRG; PAM sequence: TAG
agtattttaggaatatttct

SEQ ID NO: 10615 - DNA, 20 bp, Artificial Sequence
  Description of Artificial Sequence: Synthetic oligonucleotide
  Target: FXN; (-) strand; PAM type: NRG; PAM sequence: AGG
gccctatattaaagtatttt

SEQ ID NO: 10616 - DNA, 20 bp, Artificial Sequence
  Description of Artificial Sequence: Synthetic oligonucleotide
  Target: FXN; (-) strand; PAM type: NRG; PAM sequence: TAG
agccctatattaaagtattt

SEQ ID NO: 10617 - DNA, 20 bp, Artificial Sequence
  Description of Artificial Sequence: Synthetic oligonucleotide
  Target: FXN; (-) strand; PAM type: NRG; PAM sequence: AAG
ccgcacccagccctatatta

SEQ ID NO: 10618 - DNA, 20 bp, Artificial Sequence
  Description of Artificial Sequence: Synthetic oligonucleotide
  Target: FXN; (-) strand; PAM type: NRG; PAM sequence: CAG
tggatgtgagccaccgcacc

SEQ ID NO: 10619 - DNA, 20 bp, Artificial Sequence
  Description of Artificial Sequence: Synthetic oligonucleotide
  Target: FXN; (-) strand; PAM type: NRG; PAM sequence: GAG
cttcccaaaatgctggatgt

SEQ ID NO: 10620 - DNA, 20 bp, Artificial Sequence
  Description of Artificial Sequence: Synthetic oligonucleotide
  Target: FXN; (-) strand; PAM type: NRG; PAM sequence: TGG
tcctcagcttcccaaaatgc

SEQ ID NO: 10621 - DNA, 20 bp, Artificial Sequence
  Description of Artificial Sequence: Synthetic oligonucleotide
  Target: FXN; (-) strand; PAM type: NRG; PAM sequence: CAG
ctcaagtgatctgccctcct

SEQ ID NO: 10622 - DNA, 20 bp, Artificial Sequence
  Description of Artificial Sequence: Synthetic oligonucleotide
  Target: FXN; (-) strand; PAM type: NRG; PAM sequence: AAG
ggtcttgaactcctggcctc

SEQ ID NO: 10623 - DNA, 20 bp, Artificial Sequence
  Description of Artificial Sequence: Synthetic oligonucleotide
  Target: FXN; (-) strand; PAM type: NRG; PAM sequence: TGG
ccaggctggtcttgaactcc

SEQ ID NO: 10624 - DNA, 20 bp, Artificial Sequence
  Description of Artificial Sequence: Synthetic oligonucleotide
  Target: FXN; (-) strand; PAM type: NRG; PAM sequence: TGG
tttcaccatgttggccaggc

SEQ ID NO: 10625 - DNA, 20 bp, Artificial Sequence
  Description of Artificial Sequence: Synthetic oligonucleotide
  Target: FXN; (-) strand; PAM type: NRG; PAM sequence: AGG
ggggtttcaccatgttggcc

SEQ ID NO: 10626 - DNA, 20 bp, Artificial Sequence
  Description of Artificial Sequence: Synthetic oligonucleotide
  Target: FXN; (-) strand; PAM type: NRG; PAM sequence: CAG
cggggtttcaccatgttggc

SEQ ID NO: 10627 - DNA, 20 bp, Artificial Sequence
  Description of Artificial Sequence: Synthetic oligonucleotide
  Target: FXN; (-) strand; PAM type: NRG; PAM sequence: TGG
gagacggggtttcaccatgt

SEQ ID NO: 10628 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagagacg

SEQ ID NO: 10629 - DNA, 20 bp, Artificial Sequence
  Description of Artificial Sequence: Synthetic oligonucleotide
  Target: FXN; (-) strand; PAM type: NRG; PAM sequence: GGG
tttgtatttttagtagagac

SEQ ID NO: 10630 - DNA, 20 bp, Artificial Sequence
  Description of Artificial Sequence: Synthetic oligonucleotide
  Target: FXN; (-) strand; PAM type: NRG; PAM sequence: CGG
ttttgtatttttagtagaga

SEQ ID NO: 10631 - DNA, 20 bp, Artificial Sequence
  Description of Artificial Sequence: Synthetic oligonucleotide
  Target: FXN; (-) strand; PAM type: NRG; PAM sequence: GAG
gattttttgtatttttagta

SEQ ID NO: 10632 - DNA, 20 bp, Artificial Sequence
  Description of Artificial Sequence: Synthetic oligonucleotide
  Target: FXN; (-) strand; PAM type: NRG; PAM sequence: TAG
ccgattttttgtatttttag

SEQ ID NO: 10633 - DNA, 20 bp, Artificial Sequence
  Description of Artificial Sequence: Synthetic oligonucleotide
  Target: FXN; (-) strand; PAM type: NRG; PAM sequence: TAG
cacccgattttttgtatttt

SEQ ID NO: 10634 - DNA, 20 bp, Artificial Sequence
  Description of Artificial Sequence: Synthetic oligonucleotide
  Target: FXN; (-) strand; PAM type: NRG; PAM sequence: AGG
tcccgcgtagctgggattac

SEQ ID NO: 10635 - DNA, 20 bp, Artificial Sequence
  Description of Artificial Sequence: Synthetic oligonucleotide
  Target: FXN; (-) strand; PAM type: NRG; PAM sequence: CAG
ctcccgcgtagctgggatta

SEQ ID NO: 10636 - DNA, 20 bp, Artificial Sequence
  Description of Artificial Sequence: Synthetic oligonucleotide
  Target: FXN; (-) strand; PAM type: NRG; PAM sequence: GGG
cctcagcctcccgcgtagct

SEQ ID NO: 10637 - DNA, 20 bp, Artificial Sequence
  Description of Artificial Sequence: Synthetic oligonucleotide
  Target: FXN; (-) strand; PAM type: NRG; PAM sequence: TGG
gcctcagcctcccgcgtagc

SEQ ID NO: 10638 - DNA, 20 bp, Artificial Sequence
  Description of Artificial Sequence: Synthetic oligonucleotide
  Target: FXN; (-) strand; PAM type: NRG; PAM sequence: TAG
tcgtgcctcagcctcccgcg

SEQ ID NO: 10639 - DNA, 20 bp, Artificial Sequence
  Description of Artificial Sequence: Synthetic oligonucleotide
  Target: FXN; (-) strand; PAM type: NRG; PAM sequence: CAG
ttcgagtgattctcgtgcct

SEQ ID NO: 10640 - DNA, 20 bp, Artificial Sequence
  Description of Artificial Sequence: Synthetic oligonucleotide
  Target: FXN; (-) strand; PAM type: NRG; PAM sequence: GAG
aacccccgcctcccgggttc

SEQ ID NO: 10641 - DNA, 20 bp, Artificial Sequence
  Description of Artificial Sequence: Synthetic oligonucleotide
  Target: FXN; (-) strand; PAM type: NRG; PAM sequence: GGG
cactgcaacccccgcctccc

SEQ ID NO: 10642 - DNA, 20 bp, Artificial Sequence
  Description of Artificial Sequence: Synthetic oligonucleotide
  Target: FXN; (-) strand; PAM type: NRG; PAM sequence: CGG
tcactgcaacccccgcctcc

SEQ ID NO: 10643 - DNA, 20 bp, Artificial Sequence
  Description of Artificial Sequence: Synthetic oligonucleotide
  Target: FXN; (-) strand; PAM type: NRG; PAM sequence: CGG
ggagtgcagtggcacgatct

SEQ ID NO: 10644 - DNA, 20 bp, Artificial Sequence
  Description of Artificial Sequence: Synthetic oligonucleotide
  Target: FXN; (-) strand; PAM type: NRG; PAM sequence: TGG
tcgcccaggctggagtgcag

SEQ ID NO: 10645 - DNA, 20 bp, Artificial Sequence
  Description of Artificial Sequence: Synthetic oligonucleotide
  Target: FXN; (-) strand; PAM type: NRG; PAM sequence: CAG
ctgtcgcccaggctggagtg

SEQ ID NO: 10646 - DNA, 20 bp, Artificial Sequence
  Description of Artificial Sequence: Synthetic oligonucleotide
  Target: FXN; (-) strand; PAM type: NRG; PAM sequence: GAG
tcgctctgtcgcccaggctg

SEQ ID NO: 10647 - DNA, 20 bp, Artificial Sequence
  Description of Artificial Sequence: Synthetic oligonucleotide
  Target: FXN; (-) strand; PAM type: NRG; PAM sequence: TGG
tctcgctctgtcgcccaggc

SEQ ID NO: 10648 - DNA, 20 bp, Artificial Sequence
  Description of Artificial Sequence: Synthetic oligonucleotide
  Target: FXN; (-) strand; PAM type: NRG; PAM sequence: AGG
gaagtctcgctctgtcgccc

SEQ ID NO: 10649 - DNA, 20 bp, Artificial Sequence
  Description of Artificial Sequence: Synthetic oligonucleotide
  Target: FXN; (-) strand; PAM type: NRG; PAM sequence: CAG
tgaagtctcgctctgtcgcc

SEQ ID NO: 10650 - DNA, 20 bp, Artificial Sequence
  Description of Artificial Sequence: Synthetic oligonucleotide
  Target: FXN; (-) strand; PAM type: NRG; PAM sequence: AAG
tgttttttgtttttgagatg

SEQ ID NO: 10651 - DNA, 20 bp, Artificial Sequence
  Description of Artificial Sequence: Synthetic oligonucleotide
  Target: FXN; (-) strand; PAM type: NRG; PAM sequence: GAG
ggtttttgttttttgttttt

SEQ ID NO: 10652 - DNA, 20 bp, Artificial Sequence
  Description of Artificial Sequence: Synthetic oligonucleotide
  Target: FXN; (-) strand; PAM type: NRG; PAM sequence: TGG
catgctgaagtttttttttt

SEQ ID NO: 10653 - DNA, 20 bp, Artificial Sequence
  Description of Artificial Sequence: Synthetic oligonucleotide
  Target: FXN; (-) strand; PAM type: NRG; PAM sequence: AAG
ttggttaaataatcatgctg

SEQ ID NO: 10654 - DNA, 20 bp, Artificial Sequence
  Description of Artificial Sequence: Synthetic oligonucleotide
  Target: FXN; (-) strand; PAM type: NRG; PAM sequence: TGG
tgaacaactaacctgcattt

SEQ ID NO: 10655 - DNA, 20 bp, Artificial Sequence
  Description of Artificial Sequence: Synthetic oligonucleotide
  Target: FXN; (-) strand; PAM type: NRG; PAM sequence: CGG
tgttaattggactctgcatc

SEQ ID NO: 10656 - DNA, 20 bp, Artificial Sequence
  Description of Artificial Sequence: Synthetic oligonucleotide
  Target: FXN; (-) strand; PAM type: NRG; PAM sequence: TGG
caggccttgctcttgttaat

SEQ ID NO: 10657 - DNA, 20 bp, Artificial Sequence
  Description of Artificial Sequence: Synthetic oligonucleotide
  Target: FXN; (-) strand; PAM type: NRG; PAM sequence: AGG
aattcactttttttggtacc

SEQ ID NO: 10658 - DNA, 20 bp, Artificial Sequence
  Description of Artificial Sequence: Synthetic oligonucleotide
  Target: FXN; (-) strand; PAM type: NRG; PAM sequence: CAG
aaattcactttttttggtac

SEQ ID NO: 10659 - DNA, 20 bp, Artificial Sequence
  Description of Artificial Sequence: Synthetic oligonucleotide
  Target: FXN; (-) strand; PAM type: NRG; PAM sequence: TGG
cggagtaaattcactttttt

SEQ ID NO: 10660 - DNA, 20 bp, Artificial Sequence
  Description of Artificial Sequence: Synthetic oligonucleotide
  Target: FXN; (-) strand; PAM type: NRG; PAM sequence: GAG
cctcacccaagctagtttcg

SEQ ID NO: 10661 - DNA, 20 bp, Artificial Sequence
  Description of Artificial Sequence: Synthetic oligonucleotide
  Target: FXN; (-) strand; PAM type: NRG; PAM sequence: CGG
cccctcacccaagctagttt

SEQ ID NO: 10662 - DNA, 20 bp, Artificial Sequence
  Description of Artificial Sequence: Synthetic oligonucleotide
  Target: FXN; (-) strand; PAM type: NRG; PAM sequence: TAG
tttgtacccctcacccaagc

SEQ ID NO: 10663 - DNA, 20 bp, Artificial Sequence
  Description of Artificial Sequence: Synthetic oligonucleotide
  Target: FXN; (-) strand; PAM type: NRG; PAM sequence: AAG
atgctttgtacccctcaccc

SEQ ID NO: 10664 - DNA, 20 bp, Artificial Sequence
  Description of Artificial Sequence: Synthetic oligonucleotide
  Target: FXN; (-) strand; PAM type: NRG; PAM sequence: AGG
cagcacttttaaagaaaggc

SEQ ID NO: 10665 - DNA, 20 bp, Artificial Sequence
  Description of Artificial Sequence: Synthetic oligonucleotide
  Target: FXN; (-) strand; PAM type: NRG; PAM sequence: CAG
gcagcacttttaaagaaagg

SEQ ID NO: 10666 - DNA, 20 bp, Artificial Sequence
  Description of Artificial Sequence: Synthetic oligonucleotide
  Target: FXN; (-) strand; PAM type: NRG; PAM sequence: AGG
gaagcagcacttttaaagaa

SEQ ID NO: 10667 - DNA, 20 bp, Artificial Sequence
  Description of Artificial Sequence: Synthetic oligonucleotide
  Target: FXN; (-) strand; PAM type: NRG; PAM sequence: AAG
ggaagcagcacttttaaaga

SEQ ID NO: 10668 - DNA, 20 bp, Artificial Sequence
  Description of Artificial Sequence: Synthetic oligonucleotide
  Target: FXN; (-) strand; PAM type: NRG; PAM sequence: AAG
aaggggaagcagcactttta

SEQ ID NO: 10669 - DNA, 20 bp, Artificial Sequence
  Description of Artificial Sequence: Synthetic oligonucleotide
  Target: FXN; (-) strand; PAM type: NRG; PAM sequence: CAG
tttctacttccaaggggaag

SEQ ID NO: 10670 - DNA, 20 bp, Artificial Sequence
  Description of Artificial Sequence: Synthetic oligonucleotide
  Target: FXN; (-) strand; PAM type: NRG; PAM sequence: AAG
cactttctacttccaagggg

SEQ ID NO: 10671 - DNA, 20 bp, Artificial Sequence
  Description of Artificial Sequence: Synthetic oligonucleotide
  Target: FXN; (-) strand; PAM type: NRG; PAM sequence: GGG
gtccactttctacttccaag

SEQ ID NO: 10672 - DNA, 20 bp, Artificial Sequence
  Description of Artificial Sequence: Synthetic oligonucleotide
  Target: FXN; (-) strand; PAM type: NRG; PAM sequence: GGG
tgtccactttctacttccaa

SEQ ID NO: 10673 - DNA, 20 bp, Artificial Sequence
  Description of Artificial Sequence: Synthetic oligonucleotide
  Target: FXN; (-) strand; PAM type: NRG; PAM sequence: AGG
gtgtccactttctacttcca

SEQ ID NO: 10674 - DNA, 20 bp, Artificial Sequence
  Description of Artificial Sequence: Synthetic oligonucleotide
  Target: FXN; (-) strand; PAM type: NRG; PAM sequence: AAG
agtgtccactttctacttcc

SEQ ID NO: 10675 - DNA, 20 bp, Artificial Sequence
  Description of Artificial Sequence: Synthetic oligonucleotide
  Target: FXN; (-) strand; PAM type: NRG; PAM sequence: AAG
cttccccccttaccttataa

SEQ ID NO: 10676 - DNA, 20 bp, Artificial Sequence
  Description of Artificial Sequence: Synthetic oligonucleotide
  Target: FXN; (-) strand; PAM type: NRG; PAM sequence: GGG
gtatgcacggaactagcaga

SEQ ID NO: 10677 - DNA, 20 bp, Artificial Sequence
  Description of Artificial Sequence: Synthetic oligonucleotide
  Target: FXN; (-) strand; PAM type: NRG; PAM sequence: AGG
agtatgcacggaactagcag

SEQ ID NO: 10678 - DNA, 20 bp, Artificial Sequence
  Description of Artificial Sequence: Synthetic oligonucleotide
  Target: FXN; (-) strand; PAM type: NRG; PAM sequence: GAG
gagtatgcacggaactagca

SEQ ID NO: 10679 - DNA, 20 bp, Artificial Sequence
  Description of Artificial Sequence: Synthetic oligonucleotide
  Target: FXN; (-) strand; PAM type: NRG; PAM sequence: CAG
tagagtatgcacggaactag

SEQ ID NO: 10680 - DNA, 20 bp, Artificial Sequence
  Description of Artificial Sequence: Synthetic oligonucleotide
  Target: FXN; (-) strand; PAM type: NRG; PAM sequence: TAG
ctgtagagtatgcacggaac

SEQ ID NO: 10681 - DNA, 20 bp, Artificial Sequence
  Description of Artificial Sequence: Synthetic oligonucleotide
  Target: FXN; (-) strand; PAM type: NRG; PAM sequence: CGG
actgtcctgtagagtatgca

SEQ ID NO: 10682 - DNA, 20 bp, Artificial Sequence
  Description of Artificial Sequence: Synthetic oligonucleotide
  Target: FXN; (-) strand; PAM type: NRG; PAM sequence: GAG
gccaagtcaactgtcctgta

SEQ ID NO: 10683 - DNA, 20 bp, Artificial Sequence
  Description of Artificial Sequence: Synthetic oligonucleotide
  Target: FXN; (-) strand; PAM type: NRG; PAM sequence: TAG
gtgccaagtcaactgtcctg

SEQ ID NO: 10684 - DNA, 20 bp, Artificial Sequence
  Description of Artificial Sequence: Synthetic oligonucleotide
  Target: FXN; (-) strand; PAM type: NRG; PAM sequence: AAG
ttactaaccaggaaggtgcc

SEQ ID NO: 10685 - DNA, 20 bp, Artificial Sequence
  Description of Artificial Sequence: Synthetic oligonucleotide
  Target: FXN; (-) strand; PAM type: NRG; PAM sequence: AGG
cagcttattactaaccagga

SEQ ID NO: 10686 - DNA, 20 bp, Artificial Sequence
  Description of Artificial Sequence: Synthetic oligonucleotide
  Target: FXN; (-) strand; PAM type: NRG; PAM sequence: AAG
acagcttattactaaccagg

SEQ ID NO: 10687 - DNA, 20 bp, Artificial Sequence
  Description of Artificial Sequence: Synthetic oligonucleotide
  Target: FXN; (-) strand; PAM type: NRG; PAM sequence: AGG
gctacagcttattactaacc

SEQ ID NO: 10688 - DNA, 20 bp, Artificial Sequence
  Description of Artificial Sequence: Synthetic oligonucleotide
  Target: FXN; (-) strand; PAM type: NRG; PAM sequence: CAG
tgctacagcttattactaac

SEQ ID NO: 10689 - DNA, 20 bp, Artificial Sequence
  Description of Artificial Sequence: Synthetic oligonucleotide
  Target: FXN; (-) strand; PAM type: NRG; PAM sequence: CAG
tgcccacttggccactgcta

SEQ ID NO: 10690 - DNA, 20 bp, Artificial Sequence
  Description of Artificial Sequence: Synthetic oligonucleotide
  Target: FXN; (-) strand; PAM type: NRG; PAM sequence: TGG
atactgaaagcatgcccact

SEQ ID NO: 10691 - DNA, 20 bp, Artificial Sequence
  Description of Artificial Sequence: Synthetic oligonucleotide
  Target: FXN; (-) strand; PAM type: NRG; PAM sequence: AAG
tcactgggagggcatactga

SEQ ID NO: 10692 - DNA, 20 bp, Artificial Sequence
  Description of Artificial Sequence: Synthetic oligonucleotide
  Target: FXN; (-) strand; PAM type: NRG; PAM sequence: GGG
aggactttcattcactggga

SEQ ID NO: 10693 - DNA, 20 bp, Artificial Sequence
  Description of Artificial Sequence: Synthetic oligonucleotide
  Target: FXN; (-) strand; PAM type: NRG; PAM sequence: AGG
caggactttcattcactggg

SEQ ID NO: 10694 - DNA, 20 bp, Artificial Sequence
  Description of Artificial Sequence: Synthetic oligonucleotide
  Target: FXN; (-) strand; PAM type: NRG; PAM sequence: GAG
tcaggactttcattcactgg

SEQ ID NO: 10695 - DNA, 20 bp, Artificial Sequence
  Description of Artificial Sequence: Synthetic oligonucleotide
  Target: FXN; (-) strand; PAM type: NRG; PAM sequence: GGG
cctcaggactttcattcact

SEQ ID NO: 10696 - DNA, 20 bp, Artificial Sequence
  Description of Artificial Sequence: Synthetic oligonucleotide
  Target: FXN; (-) strand; PAM type: NRG; PAM sequence: TGG
gcctcaggactttcattcac

SEQ ID NO: 10697 - DNA, 20 bp, Artificial Sequence
  Description of Artificial Sequence: Synthetic oligonucleotide
  Target: FXN; (-) strand; PAM type: NRG; PAM sequence: AGG
ccacccttgggggttgcctc

SEQ ID NO: 10698 - DNA, 20 bp, Artificial Sequence
  Description of Artificial Sequence: Synthetic oligonucleotide
  Target: FXN; (-) strand; PAM type: NRG; PAM sequence: CAG
tccacccttgggggttgcct

SEQ ID NO: 10699 - DNA, 20 bp, Artificial Sequence
  Description of Artificial Sequence: Synthetic oligonucleotide
  Target: FXN; (-) strand; PAM type: NRG; PAM sequence: GGG
cctggcacttccacccttgg

SEQ ID NO: 10700 - DNA, 20 bp, Artificial Sequence
  Description of Artificial Sequence: Synthetic oligonucleotide
  Target: FXN; (-) strand; PAM type: NRG; PAM sequence: GGG
gcctggcacttccacccttg

SEQ ID NO: 10701 - DNA, 20 bp, Artificial Sequence
  Description of Artificial Sequence: Synthetic oligonucleotide
  Target: FXN; (-) strand; PAM type: NRG; PAM sequence: GGG
ggcctggcacttccaccctt

SEQ ID NO: 10702 - DNA, 20 bp, Artificial Sequence
  Description of Artificial Sequence: Synthetic oligonucleotide
  Target: FXN; (-) strand; PAM type: NRG; PAM sequence: TGG
tggcctggcacttccaccct

SEQ ID NO: 10703 - DNA, 20 bp, Artificial Sequence
  Description of Artificial Sequence: Synthetic oligonucleotide
  Target: FXN; (-) strand; PAM type: NRG; PAM sequence: TGG
acctccagtgggtggtggcc

SEQ ID NO: 10704 - DNA, 20 bp, Artificial Sequence
  Description of Artificial Sequence: Synthetic oligonucleotide
  Target: FXN; (-) strand; PAM type: NRG; PAM sequence: TGG
ctttcacctccagtgggtgg

SEQ ID NO: 10705 - DNA, 20 bp, Artificial Sequence
  Description of Artificial Sequence: Synthetic oligonucleotide
  Target: FXN; (-) strand; PAM type: NRG; PAM sequence: TGG
gaactttcacctccagtggg

SEQ ID NO: 10706 - DNA, 20 bp, Artificial Sequence
  Description of Artificial Sequence: Synthetic oligonucleotide
  Target: FXN; (-) strand; PAM type: NRG; PAM sequence: GGG
acggaactttcacctccagt

SEQ ID NO: 10707 - DNA, 20 bp, Artificial Sequence
  Description of Artificial Sequence: Synthetic oligonucleotide
  Target: FXN; (-) strand; PAM type: NRG; PAM sequence: TGG
cacggaactttcacctccag

SEQ ID NO: 10708 - DNA, 20 bp, Artificial Sequence
  Description of Artificial Sequence: Synthetic oligonucleotide
  Target: FXN; (-) strand; PAM type: NRG; PAM sequence: CAG
catcacggaactttcacctc

SEQ ID NO: 10709 - DNA, 20 bp, Artificial Sequence
  Description of Artificial Sequence: Synthetic oligonucleotide
  Target: FXN; (-) strand; PAM type: NRG; PAM sequence: CGG
agaccaaagcaaacccatca

SEQ ID NO: 10710 - DNA, 20 bp, Artificial Sequence
  Description of Artificial Sequence: Synthetic oligonucleotide
  Target: FXN; (-) strand; PAM type: NRG; PAM sequence: AAG
gacagtagattcgcagacca

SEQ ID NO: 10711 - DNA, 20 bp, Artificial Sequence
  Description of Artificial Sequence: Synthetic oligonucleotide
  Target: FXN; (-) strand; PAM type: NRG; PAM sequence: CAG
tccacatgacagtagattcg

SEQ ID NO: 10712 - DNA, 20 bp, Artificial Sequence
  Description of Artificial Sequence: Synthetic oligonucleotide
  Target: FXN; (-) strand; PAM type: NRG; PAM sequence: TAG
cagatctctccacatgacag

SEQ ID NO: 10713 - DNA, 20 bp, Artificial Sequence
  Description of Artificial Sequence: Synthetic oligonucleotide
  Target: FXN; (-) strand; PAM type: NRG; PAM sequence: CAG
gcacagatctctccacatga

SEQ ID NO: 10714 - DNA, 20 bp, Artificial Sequence
  Description of Artificial Sequence: Synthetic oligonucleotide
  Target: FXN; (-) strand; PAM type: NRG; PAM sequence: CAG
ctgtatgctcttccagagca

SEQ ID NO: 10715 - DNA, 20 bp, Artificial Sequence
  Description of Artificial Sequence: Synthetic oligonucleotide
  Target: FXN; (-) strand; PAM type: NRG; PAM sequence: GAG
tctaactgtatgctcttcca

SEQ ID NO: 10716 - DNA, 20 bp, Artificial Sequence
  Description of Artificial Sequence: Synthetic oligonucleotide
  Target: FXN; (-) strand; PAM type: NRG; PAM sequence: CAG
tttctaactgtatgctcttc

SEQ ID NO: 10717 - DNA, 20 bp, Artificial Sequence
  Description of Artificial Sequence: Synthetic oligonucleotide
  Target: FXN; (-) strand; PAM type: NRG; PAM sequence: AAG
ccatacattcccttcagggc

SEQ ID NO: 10718 - DNA, 20 bp, Artificial Sequence
  Description of Artificial Sequence: Synthetic oligonucleotide
  Target: FXN; (-) strand; PAM type: NRG; PAM sequence: GGG
ttcaccatacattcccttca

SEQ ID NO: 10719 - DNA, 20 bp, Artificial Sequence
  Description of Artificial Sequence: Synthetic oligonucleotide
  Target: FXN; (-) strand; PAM type: NRG; PAM sequence: AGG
cttcaccatacattcccttc

SEQ ID NO: 10720 - DNA, 20 bp, Artificial Sequence
  Description of Artificial Sequence: Synthetic oligonucleotide
  Target: FXN; (-) strand; PAM type: NRG; PAM sequence: CAG
ccttcaccatacattccctt

SEQ ID NO: 10721 - DNA, 20 bp, Artificial Sequence
  Description of Artificial Sequence: Synthetic oligonucleotide
  Target: FXN; (-) strand; PAM type: NRG; PAM sequence: CAG
cggtttcctacttagccctt

SEQ ID NO: 10722 - DNA, 20 bp, Artificial Sequence
  Description of Artificial Sequence: Synthetic oligonucleotide
  Target: FXN; (-) strand; PAM type: NRG; PAM sequence: TAG
ctggttcccggtttcctact

SEQ ID NO: 10723 - DNA, 20 bp, Artificial Sequence
  Description of Artificial Sequence: Synthetic oligonucleotide
  Target: FXN; (-) strand; PAM type: NRG; PAM sequence: CGG
ttctcctctcccctggttcc

SEQ ID NO: 10724 - DNA, 20 bp, Artificial Sequence
  Description of Artificial Sequence: Synthetic oligonucleotide
  Target: FXN; (-) strand; PAM type: NRG; PAM sequence: TGG
tcttctcttctcctctcccc

SEQ ID NO: 10725 - DNA, 20 bp, Artificial Sequence
  Description of Artificial Sequence: Synthetic oligonucleotide
  Target: FXN; (-) strand; PAM type: NRG; PAM sequence: GGG
tccattttttctaagaaaaa

SEQ ID NO: 10726 - DNA, 20 bp, Artificial Sequence
  Description of Artificial Sequence: Synthetic oligonucleotide
  Target: FXN; (-) strand; PAM type: NRG; PAM sequence: AGG
ctccattttttctaagaaaa

SEQ ID NO: 10727 - DNA, 20 bp, Artificial Sequence
  Description of Artificial Sequence: Synthetic oligonucleotide
  Target: FXN; (-) strand; PAM type: NRG; PAM sequence: AAG
gctccattttttctaagaaa

SEQ ID NO: 10728 - DNA, 20 bp, Artificial Sequence
  Description of Artificial Sequence: Synthetic oligonucleotide
  Target: FXN; (-) strand; PAM type: NRG; PAM sequence: AAG
ccgagtgctccattttttct

SEQ ID NO: 10729 - DNA, 20 bp, Artificial Sequence
  Description of Artificial Sequence: Synthetic oligonucleotide
  Target: FXN; (-) strand; PAM type: NRG; PAM sequence: GAG
acattcgagtgcctgtaacc

SEQ ID NO: 10730 - DNA, 20 bp, Artificial Sequence
  Description of Artificial Sequence: Synthetic oligonucleotide
  Target: FXN; (-) strand; PAM type: NRG; PAM sequence: GAG
atattgctacttctacattc

SEQ ID NO: 10731 - DNA, 20 bp, Artificial Sequence
  Description of Artificial Sequence: Synthetic oligonucleotide
  Target: FXN; (-) strand; PAM type: NRG; PAM sequence: CAG
agaagtacgttactattttt

SEQ ID NO: 10732 - DNA, 20 bp, Artificial Sequence
  Description of Artificial Sequence: Synthetic oligonucleotide
  Target: FXN; (-) strand; PAM type: NRG; PAM sequence: AAG
ctctgaaagccaaagttaag

SEQ ID NO: 10733 - DNA, 20 bp, Artificial Sequence
  Description of Artificial Sequence: Synthetic oligonucleotide
  Target: FXN; (-) strand; PAM type: NRG; PAM sequence: AAG
gaactctgaaagccaaagtt

SEQ ID NO: 10734 - DNA, 20 bp, Artificial Sequence
  Description of Artificial Sequence: Synthetic oligonucleotide
  Target: FXN; (-) strand; PAM type: NRG; PAM sequence: AAG
ggttcgaactctgaaagcca

SEQ ID NO: 10735 - DNA, 20 bp, Artificial Sequence
  Description of Artificial Sequence: Synthetic oligonucleotide
  Target: FXN; (-) strand; PAM type: NRG; PAM sequence: AAG
cacgttggttcgaactctga

SEQ ID NO: 10736 - DNA, 20 bp, Artificial Sequence
  Description of Artificial Sequence: Synthetic oligonucleotide
  Target: FXN; (-) strand; PAM type: NRG; PAM sequence: TGG
aaatctggttgaggccacgt

SEQ ID NO: 10737 - DNA, 20 bp, Artificial Sequence
  Description of Artificial Sequence: Synthetic oligonucleotide
  Target: FXN; (-) strand; PAM type: NRG; PAM sequence: AGG
tgacattccaaatctggttg

SEQ ID NO: 10738 - DNA, 20 bp, Artificial Sequence
  Description of Artificial Sequence: Synthetic oligonucleotide
  Target: FXN; (-) strand; PAM type: NRG; PAM sequence: GAG
ttgacattccaaatctggtt

SEQ ID NO: 10739 - DNA, 20 bp, Artificial Sequence
  Description of Artificial Sequence: Synthetic oligonucleotide
  Target: FXN; (-) strand; PAM type: NRG; PAM sequence: TGG
gctttttgacattccaaatc

SEQ ID NO: 10740 - DNA, 20 bp, Artificial Sequence
  Description of Artificial Sequence: Synthetic oligonucleotide
  Target: FXN; (-) strand; PAM type: NRG; PAM sequence: TAG
atttcctcaaattcatcaaa

SEQ ID NO: 10741 - DNA, 20 bp, Artificial Sequence
  Description of Artificial Sequence: Synthetic oligonucleotide
  Target: FXN; (-) strand; PAM type: NRG; PAM sequence: CAG
ccctgggtggcccaaagttc

SEQ ID NO: 10742 - DNA, 20 bp, Artificial Sequence
  Description of Artificial Sequence: Synthetic oligonucleotide
  Target: FXN; (-) strand; PAM type: NRG; PAM sequence: AAG
atcttaccctgggtggccca

SEQ ID NO: 10743 - DNA, 20 bp, Artificial Sequence
  Description of Artificial Sequence: Synthetic oligonucleotide
  Target: FXN; (-) strand; PAM type: NRG; PAM sequence: TGG
gtgttttatcttaccctggg

SEQ ID NO: 10744 - DNA, 20 bp, Artificial Sequence
  Description of Artificial Sequence: Synthetic oligonucleotide
  Target: FXN; (-) strand; PAM type: NRG; PAM sequence: GGG
aaggtgttttatcttaccct

SEQ ID NO: 10745 - DNA, 20 bp, Artificial Sequence
  Description of Artificial Sequence: Synthetic oligonucleotide
  Target: FXN; (-) strand; PAM type: NRG; PAM sequence: TGG
gaaggtgttttatcttaccc

SEQ ID NO: 10746 - DNA, 20 bp, Artificial Sequence
  Description of Artificial Sequence: Synthetic oligonucleotide
  Target: FXN; (-) strand; PAM type: NRG; PAM sequence: AGG
gaagatacctatgacgtgga

SEQ ID NO: 10747 - DNA, 20 bp, Artificial Sequence
  Description of Artificial Sequence: Synthetic oligonucleotide
  Target: FXN; (-) strand; PAM type: NRG; PAM sequence: AAG
ggaagatacctatgacgtgg

SEQ ID NO: 10748 - DNA, 20 bp, Artificial Sequence
  Description of Artificial Sequence: Synthetic oligonucleotide
  Target: FXN; (-) strand; PAM type: NRG; PAM sequence: TGG
agaggaagatacctatgacg

SEQ ID NO: 10749 - DNA, 20 bp, Artificial Sequence
  Description of Artificial Sequence: Synthetic oligonucleotide
  Target: FXN; (-) strand; PAM type: NRG; PAM sequence: AAG
gaggcagggaaggagagagg

SEQ ID NO: 10750 - DNA, 20 bp, Artificial Sequence
  Description of Artificial Sequence: Synthetic oligonucleotide
  Target: FXN; (-) strand; PAM type: NRG; PAM sequence: AGG
ggagaggcagggaaggagag

SEQ ID NO: 10751 - DNA, 20 bp, Artificial Sequence
  Description of Artificial Sequence: Synthetic oligonucleotide
  Target: FXN; (-) strand; PAM type: NRG; PAM sequence: GAG
gggagaggcagggaaggaga

SEQ ID NO: 10752 - DNA, 20 bp, Artificial Sequence
  Description of Artificial Sequence: Synthetic oligonucleotide
  Target: FXN; (-) strand; PAM type: NRG; PAM sequence: GAG
atgggagaggcagggaagga

SEQ ID NO: 10753 - DNA, 20 bp, Artificial Sequence
  Description of Artificial Sequence: Synthetic oligonucleotide
  Target: FXN; (-) strand; PAM type: NRG; PAM sequence: GAG
taatgggagaggcagggaag

SEQ ID NO: 10754 - DNA, 20 bp, Artificial Sequence
  Description of Artificial Sequence: Synthetic oligonucleotide
  Target: FXN; (-) strand; PAM type: NRG; PAM sequence: AGG
tctaatgggagaggcaggga

SEQ ID NO: 10755 - DNA, 20 bp, Artificial Sequence
  Description of Artificial Sequence: Synthetic oligonucleotide
  Target: FXN; (-) strand; PAM type: NRG; PAM sequence: AAG
ttctaatgggagaggcaggg

SEQ ID NO: 10756 - DNA, 20 bp, Artificial Sequence
  Description of Artificial Sequence: Synthetic oligonucleotide
  Target: FXN; (-) strand; PAM type: NRG; PAM sequence: GGG
aggttctaatgggagaggca

SEQ ID NO: 10757 - DNA, 20 bp, Artificial Sequence
  Description of Artificial Sequence: Synthetic oligonucleotide
  Target: FXN; (-) strand; PAM type: NRG; PAM sequence: AGG
caggttctaatgggagaggc

SEQ ID NO: 10758 - DNA, 20 bp, Artificial Sequence
  Description of Artificial Sequence: Synthetic oligonucleotide
  Target: FXN; (-) strand; PAM type: NRG; PAM sequence: CAG
ccaggttctaatgggagagg

SEQ ID NO: 10759 - DNA, 20 bp, Artificial Sequence
  Description of Artificial Sequence: Synthetic oligonucleotide
  Target: FXN; (-) strand; PAM type: NRG; PAM sequence: AGG
aaaccaggttctaatgggag

SEQ ID NO: 10760 - DNA, 20 bp, Artificial Sequence
  Description of Artificial Sequence: Synthetic oligonucleotide
  Target: FXN; (-) strand; PAM type: NRG; PAM sequence: GAG
aaaaccaggttctaatggga

SEQ ID NO: 10761 - DNA, 20 bp, Artificial Sequence
  Description of Artificial Sequence: Synthetic oligonucleotide
  Target: FXN; (-) strand; PAM type: NRG; PAM sequence: GAG
agaaaaccaggttctaatgg

SEQ ID NO: 10762 - DNA, 20 bp, Artificial Sequence
  Description of Artificial Sequence: Synthetic oligonucleotide
  Target: FXN; (-) strand; PAM type: NRG; PAM sequence: GGG
gaagaaaaccaggttctaat

SEQ ID NO: 10763 - DNA, 20 bp, Artificial Sequence
  Description of Artificial Sequence: Synthetic oligonucleotide
  Target: FXN; (-) strand; PAM type: NRG; PAM sequence: TGG
ggaagaaaaccaggttctaa

SEQ ID NO: 10764 - DNA, 20 bp, Artificial Sequence
  Description of Artificial Sequence: Synthetic oligonucleotide
  Target: FXN; (-) strand; PAM type: NRG; PAM sequence: AGG
tgctgctcaggaagaaaacc

SEQ ID NO: 10765 - DNA, 20 bp, Artificial Sequence
  Description of Artificial Sequence: Synthetic oligonucleotide
  Target: FXN; (-) strand; PAM type: NRG; PAM sequence: CAG
ttgctgctcaggaagaaaac

SEQ ID NO: 10766 - DNA, 20 bp, Artificial Sequence
  Description of Artificial Sequence: Synthetic oligonucleotide
  Target: FXN; (-) strand; PAM type: NRG; PAM sequence: AAG
taagattgttgctgctcagg

SEQ ID NO: 10767 - DNA, 20 bp, Artificial Sequence
  Description of Artificial Sequence: Synthetic oligonucleotide
  Target: FXN; (-) strand; PAM type: NRG; PAM sequence: AGG
gcctaagattgttgctgctc

SEQ ID NO: 10768 - DNA, 20 bp, Artificial Sequence
  Description of Artificial Sequence: Synthetic oligonucleotide
  Target: FXN; (-) strand; PAM type: NRG; PAM sequence: CAG
tgcctaagattgttgctgct

SEQ ID NO: 10769 - DNA, 20 bp, Artificial Sequence
  Description of Artificial Sequence: Synthetic oligonucleotide
  Target: FXN; (-) strand; PAM type: NRG; PAM sequence: AAG
agtcacatggaaagatgcct

SEQ ID NO: 10770 - DNA, 20 bp, Artificial Sequence
  Description of Artificial Sequence: Synthetic oligonucleotide
  Target: FXN; (-) strand; PAM type: NRG; PAM sequence: AAG
tggatactcagtcacatgga

SEQ ID NO: 10771 - DNA, 20 bp, Artificial Sequence
  Description of Artificial Sequence: Synthetic oligonucleotide
  Target: FXN; (-) strand; PAM type: NRG; PAM sequence: TGG
gtggtggatactcagtcaca

SEQ ID NO: 10772 - DNA, 20 bp, Artificial Sequence
  Description of Artificial Sequence: Synthetic oligonucleotide
  Target: FXN; (-) strand; PAM type: NRG; PAM sequence: CAG
aaaataatgtggtggatact

SEQ ID NO: 10773 - DNA, 20 bp, Artificial Sequence
  Description of Artificial Sequence: Synthetic oligonucleotide
  Target: FXN; (-) strand; PAM type: NRG; PAM sequence: TGG
tttcattaaaaataatgtgg

SEQ ID NO: 10774 - DNA, 20 bp, Artificial Sequence
  Description of Artificial Sequence: Synthetic oligonucleotide
  Target: FXN; (-) strand; PAM type: NRG; PAM sequence: TGG
ctatttcattaaaaataatg

SEQ ID NO: 10775 - DNA, 20 bp, Artificial Sequence
  Description of Artificial Sequence: Synthetic oligonucleotide
  Target: FXN; (-) strand; PAM type: NRG; PAM sequence: TGG
acagtaggggatgggttaaa

SEQ ID NO: 10776 - DNA, 20 bp, Artificial Sequence
  Description of Artificial Sequence: Synthetic oligonucleotide
  Target: FXN; (-) strand; PAM type: NRG; PAM sequence: GGG
aatgtccaacagtaggggat

SEQ ID NO: 10777 - DNA, 20 bp, Artificial Sequence
  Description of Artificial Sequence: Synthetic oligonucleotide
  Target: FXN; (-) strand; PAM type: NRG; PAM sequence: TGG
gaatgtccaacagtagggga

SEQ ID NO: 10778 - DNA, 20 bp, Artificial Sequence
  Description of Artificial Sequence: Synthetic oligonucleotide
  Target: FXN; (-) strand; PAM type: NRG; PAM sequence: GGG
acctgaatgtccaacagtag

SEQ ID NO: 10779 - DNA, 20 bp, Artificial Sequence
  Description of Artificial Sequence: Synthetic oligonucleotide
  Target: FXN; (-) strand; PAM type: NRG; PAM sequence: GGG
aacctgaatgtccaacagta

SEQ ID NO: 10780 - DNA, 20 bp, Artificial Sequence
  Description of Artificial Sequence: Synthetic oligonucleotide
  Target: FXN; (-) strand; PAM type: NRG; PAM sequence: AGG
caacctgaatgtccaacagt

SEQ ID NO: 10781 - DNA, 20 bp, Artificial Sequence
  Description of Artificial Sequence: Synthetic oligonucleotide
  Target: FXN; (-) strand; PAM type: NRG; PAM sequence: TAG
acaacctgaatgtccaacag

SEQ ID NO: 10782 - DNA, 20 bp, Artificial Sequence
  Description of Artificial Sequence: Synthetic oligonucleotide
  Target: FXN; (-) strand; PAM type: NRG; PAM sequence: CAG
gaaacaacctgaatgtccaa

SEQ ID NO: 10783 - DNA, 20 bp, Artificial Sequence
  Description of Artificial Sequence: Synthetic oligonucleotide
  Target: FXN; (-) strand; PAM type: NRG; PAM sequence: TGG
ataaaataatattgaaactc

SEQ ID NO: 10784 - DNA, 20 bp, Artificial Sequence
  Description of Artificial Sequence: Synthetic oligonucleotide
  Target: FXN; (-) strand; PAM type: NRG; PAM sequence: GGG
atggcctgctctaactatta

SEQ ID NO: 10785 - DNA, 20 bp, Artificial Sequence
  Description of Artificial Sequence: Synthetic oligonucleotide
  Target: FXN; (-) strand; PAM type: NRG; PAM sequence: AGG
catggcctgctctaactatt

SEQ ID NO: 10786 - DNA, 20 bp, Artificial Sequence
  Description of Artificial Sequence: Synthetic oligonucleotide
  Target: FXN; (-) strand; PAM type: NRG; PAM sequence: TAG
gcatggcctgctctaactat

SEQ ID NO: 10787 - DNA, 20 bp, Artificial Sequence
  Description of Artificial Sequence: Synthetic oligonucleotide
  Target: FXN; (-) strand; PAM type: NRG; PAM sequence: TGG
gtctatttgtgatagcagca

SEQ ID NO: 10788 - DNA, 20 bp, Artificial Sequence
  Description of Artificial Sequence: Synthetic oligonucleotide
  Target: FXN; (-) strand; PAM type: NRG; PAM sequence: CAG
tttgggtctatttgtgatag

SEQ ID NO: 10789 - DNA, 20 bp, Artificial Sequence
  Description of Artificial Sequence: Synthetic oligonucleotide
  Target: FXN; (-) strand; PAM type: NRG; PAM sequence: TAG
atatttgggtctatttgtga

SEQ ID NO: 10790 - DNA, 20 bp, Artificial Sequence
  Description of Artificial Sequence: Synthetic oligonucleotide
  Target: FXN; (-) strand; PAM type: NRG; PAM sequence: GGG
gtttgagctattaaatattt

SEQ ID NO: 10791 - DNA, 20 bp, Artificial Sequence
  Description of Artificial Sequence: Synthetic oligonucleotide
  Target: FXN; (-) strand; PAM type: NRG; PAM sequence: TGG
ggtttgagctattaaatatt

SEQ ID NO: 10792 - DNA, 20 bp, Artificial Sequence
  Description of Artificial Sequence: Synthetic oligonucleotide
  Target: FXN; (-) strand; PAM type: NRG; PAM sequence: GAG
gacacaaacgttattggttt

SEQ ID NO: 10793 - DNA, 20 bp, Artificial Sequence
  Description of Artificial Sequence: Synthetic oligonucleotide
  Target: FXN; (-) strand; PAM type: NRG; PAM sequence: TGG
gaggaggacacaaacgttat

SEQ ID NO: 10794 - DNA, 20 bp, Artificial Sequence
  Description of Artificial Sequence: Synthetic oligonucleotide
  Target: FXN; (-) strand; PAM type: NRG; PAM sequence: AGG
ccctgtactgcccagagagg

SEQ ID NO: 10795 - DNA, 20 bp, Artificial Sequence
  Description of Artificial Sequence: Synthetic oligonucleotide
  Target: FXN; (-) strand; PAM type: NRG; PAM sequence: GAG
accctgtactgcccagagag

SEQ ID NO: 10796 - DNA, 20 bp, Artificial Sequence
  Description of Artificial Sequence: Synthetic oligonucleotide
  Target: FXN; (-) strand; PAM type: NRG; PAM sequence: AGG
caaccctgtactgcccagag

SEQ ID NO: 10797 - DNA, 20 bp, Artificial Sequence
  Description of Artificial Sequence: Synthetic oligonucleotide
  Target: FXN; (-) strand; PAM type: NRG; PAM sequence: GAG
ccaaccctgtactgcccaga

SEQ ID NO: 10798 - DNA, 20 bp, Artificial Sequence
  Description of Artificial Sequence: Synthetic oligonucleotide
  Target: FXN; (-) strand; PAM type: NRG; PAM sequence: GAG
tgccaaccctgtactgccca

SEQ ID NO: 10799 - DNA, 20 bp, Artificial Sequence
  Description of Artificial Sequence: Synthetic oligonucleotide
  Target: FXN; (-) strand; PAM type: NRG; PAM sequence: CAG
tatgccaaccctgtactgcc

SEQ ID NO: 10800 - DNA, 20 bp, Artificial Sequence
  Description of Artificial Sequence: Synthetic oligonucleotide
  Target: FXN; (-) strand; PAM type: NRG; PAM sequence: AGG
agttcctaattcacttcagg

SEQ ID NO: 10801 - DNA, 20 bp, Artificial Sequence
  Description of Artificial Sequence: Synthetic oligonucleotide
  Target: FXN; (-) strand; PAM type: NRG; PAM sequence: GAG
tagttcctaattcacttcag

SEQ ID NO: 10802 - DNA, 20 bp, Artificial Sequence
  Description of Artificial Sequence: Synthetic oligonucleotide
  Target: FXN; (-) strand; PAM type: NRG; PAM sequence: AGG
tgtagttcctaattcacttc

SEQ ID NO: 10803 - DNA, 20 bp, Artificial Sequence
  Description of Artificial Sequence: Synthetic oligonucleotide
  Target: FXN; (-) strand; PAM type: NRG; PAM sequence: CAG
gtgtagttcctaattcactt

SEQ ID NO: 10804 - DNA, 20 bp, Artificial Sequence
  Description of Artificial Sequence: Synthetic oligonucleotide
  Target: FXN; (-) strand; PAM type: NRG; PAM sequence: TAG
actggaagctggaatgagtg

SEQ ID NO: 10805 - DNA, 20 bp, Artificial Sequence
  Description of Artificial Sequence: Synthetic oligonucleotide
  Target: FXN; (-) strand; PAM type: NRG; PAM sequence: GAG
accaaactggaagctggaat

SEQ ID NO: 10806 - DNA, 20 bp, Artificial Sequence
  Description of Artificial Sequence: Synthetic oligonucleotide
  Target: FXN; (-) strand; PAM type: NRG; PAM sequence: TGG
ataaagaccaaactggaagc

SEQ ID NO: 10807 - DNA, 20 bp, Artificial Sequence
  Description of Artificial Sequence: Synthetic oligonucleotide
  Target: FXN; (-) strand; PAM type: NRG; PAM sequence: AAG
acagataaagaccaaactgg

SEQ ID NO: 10808 - DNA, 20 bp, Artificial Sequence
  Description of Artificial Sequence: Synthetic oligonucleotide
  Target: FXN; (-) strand; PAM type: NRG; PAM sequence: TGG
ctgacagataaagaccaaac

SEQ ID NO: 10809 - DNA, 20 bp, Artificial Sequence
  Description of Artificial Sequence: Synthetic oligonucleotide
  Target: FXN; (-) strand; PAM type: NRG; PAM sequence: AAG
cagtaaggcactgacagata

SEQ ID NO: 10810 - DNA, 20 bp, Artificial Sequence
  Description of Artificial Sequence: Synthetic oligonucleotide
  Target: FXN; (-) strand; PAM type: NRG; PAM sequence: CAG
agaggacagtaaggcactga

SEQ ID NO: 10811 - DNA, 20 bp, Artificial Sequence
  Description of Artificial Sequence: Synthetic oligonucleotide
  Target: FXN; (-) strand; PAM type: NRG; PAM sequence: AGG
caacaatgcagaggacagta

SEQ ID NO: 10812 - DNA, 20 bp, Artificial Sequence
  Description of Artificial Sequence: Synthetic oligonucleotide
  Target: FXN; (-) strand; PAM type: NRG; PAM sequence: AAG
tcaacaatgcagaggacagt

SEQ ID NO: 10813 - DNA, 20 bp, Artificial Sequence
  Description of Artificial Sequence: Synthetic oligonucleotide
  Target: FXN; (-) strand; PAM type: NRG; PAM sequence: CAG
agactcaacaatgcagagga

SEQ ID NO: 10814 - DNA, 20 bp, Artificial Sequence
  Description of Artificial Sequence: Synthetic oligonucleotide
  Target: FXN; (-) strand; PAM type: NRG; PAM sequence: AGG
actgagactcaacaatgcag

SEQ ID NO: 10815 - DNA, 20 bp, Artificial Sequence
  Description of Artificial Sequence: Synthetic oligonucleotide
  Target: FXN; (-) strand; PAM type: NRG; PAM sequence: GAG
gactgagactcaacaatgca

SEQ ID NO: 10816 - DNA, 20 bp, Artificial Sequence
  Description of Artificial Sequence: Synthetic oligonucleotide
  Target: FXN; (-) strand; PAM type: NRG; PAM sequence: CAG
gtgactgagactcaacaatg

SEQ ID NO: 10817 - DNA, 20 bp, Artificial Sequence
  Description of Artificial Sequence: Synthetic oligonucleotide
  Target: FXN; (-) strand; PAM type: NRG; PAM sequence: GAG
ggaacttggacaaggtgact

SEQ ID NO: 10818 - DNA, 20 bp, Artificial Sequence
  Description of Artificial Sequence: Synthetic oligonucleotide
  Target: FXN; (-) strand; PAM type: NRG; PAM sequence: AGG
tggccaatggaacttggaca

SEQ ID NO: 10819 - DNA, 20 bp, Artificial Sequence
  Description of Artificial Sequence: Synthetic oligonucleotide
  Target: FXN; (-) strand; PAM type: NRG; PAM sequence: AAG
ctggccaatggaacttggac

SEQ ID NO: 10820 - DNA, 20 bp, Artificial Sequence
  Description of Artificial Sequence: Synthetic oligonucleotide
  Target: FXN; (-) strand; PAM type: NRG; PAM sequence: TGG
cctttctggccaatggaact

SEQ ID NO: 10821 - DNA, 20 bp, Artificial Sequence
  Description of Artificial Sequence: Synthetic oligonucleotide
  Target: FXN; (-) strand; PAM type: NRG; PAM sequence: TGG
ttctagccctttctggccaa

SEQ ID NO: 10822 - DNA, 20 bp, Artificial Sequence
  Description of Artificial Sequence: Synthetic oligonucleotide
  Target: FXN; (-) strand; PAM type: NRG; PAM sequence: TGG
tctgtgcttctagccctttc

SEQ ID NO: 10823 - DNA, 20 bp, Artificial Sequence
  Description of Artificial Sequence: Synthetic oligonucleotide
  Target: FXN; (-) strand; PAM type: NRG; PAM sequence: TAG
ttccagcccttctgtgcttc

SEQ ID NO: 10824 - DNA, 20 bp, Artificial Sequence
  Description of Artificial Sequence: Synthetic oligonucleotide
  Target: FXN; (-) strand; PAM type: NRG; PAM sequence: CAG
tgaggaacaaatgccacttc

SEQ ID NO: 10825 - DNA, 20 bp, Artificial Sequence
  Description of Artificial Sequence: Synthetic oligonucleotide
  Target: FXN; (-) strand; PAM type: NRG; PAM sequence: AGG
ttcccaccagaatgtgagtg

SEQ ID NO: 10826 - DNA, 20 bp, Artificial Sequence
  Description of Artificial Sequence: Synthetic oligonucleotide
  Target: FXN; (-) strand; PAM type: NRG; PAM sequence: GAG
cttcccaccagaatgtgagt

SEQ ID NO: 10827 - DNA, 20 bp, Artificial Sequence
  Description of Artificial Sequence: Synthetic oligonucleotide
  Target: FXN; (-) strand; PAM type: NRG; PAM sequence: GAG
agttcttcccaccagaatgt

SEQ ID NO: 10828 - DNA, 20 bp, Artificial Sequence
  Description of Artificial Sequence: Synthetic oligonucleotide
  Target: FXN; (-) strand; PAM type: NRG; PAM sequence: CAG
caccactaagttcttcccac

SEQ ID NO: 10829 - DNA, 20 bp, Artificial Sequence
  Description of Artificial Sequence: Synthetic oligonucleotide
  Target: FXN; (-) strand; PAM type: NRG; PAM sequence: AAG
tcagctaaggccacaccact

SEQ ID NO: 10830 - DNA, 20 bp, Artificial Sequence
  Description of Artificial Sequence: Synthetic oligonucleotide
  Target: FXN; (-) strand; PAM type: NRG; PAM sequence: AGG
gcctcccttacagtcagcta

SEQ ID NO: 10831 - DNA, 20 bp, Artificial Sequence
  Description of Artificial Sequence: Synthetic oligonucleotide
  Target: FXN; (-) strand; PAM type: NRG; PAM sequence: AAG
agcctcccttacagtcagct

SEQ ID NO: 10832 - DNA, 20 bp, Artificial Sequence
  Description of Artificial Sequence: Synthetic oligonucleotide
  Target: FXN; (-) strand; PAM type: NRG; PAM sequence: CAG
ttcccagcctcccttacagt

SEQ ID NO: 10833 - DNA, 20 bp, Artificial Sequence
  Description of Artificial Sequence: Synthetic oligonucleotide
  Target: FXN; (-) strand; PAM type: NRG; PAM sequence: CAG
atatttcccagcctccctta

SEQ ID NO: 10834 - DNA, 20 bp, Artificial Sequence
  Description of Artificial Sequence: Synthetic oligonucleotide
  Target: FXN; (-) strand; PAM type: NRG; PAM sequence: CAG
actcgctagactatatttcc

SEQ ID NO: 10835 - DNA, 20 bp, Artificial Sequence
  Description of Artificial Sequence: Synthetic oligonucleotide
  Target: FXN; (-) strand; PAM type: NRG; PAM sequence: TAG
gctttttccagggcactcgc

SEQ ID NO: 10836 - DNA, 20 bp, Artificial Sequence
  Description of Artificial Sequence: Synthetic oligonucleotide
  Target: FXN; (-) strand; PAM type: NRG; PAM sequence: GGG
tgccgtgccggctttttcca

SEQ ID NO: 10837 - DNA, 20 bp, Artificial Sequence
  Description of Artificial Sequence: Synthetic oligonucleotide
  Target: FXN; (-) strand; PAM type: NRG; PAM sequence: AGG
atgccgtgccggctttttcc

SEQ ID NO: 10838 - DNA, 20 bp, Artificial Sequence
  Description of Artificial Sequence: Synthetic oligonucleotide
  Target: FXN; (-) strand; PAM type: NRG; PAM sequence: CAG
aatgccgtgccggctttttc

SEQ ID NO: 10839 - DNA, 20 bp, Artificial Sequence
  Description of Artificial Sequence: Synthetic oligonucleotide
  Target: FXN; (-) strand; PAM type: NRG; PAM sequence: CGG
ttccatggggaatgccgtgc

SEQ ID NO: 10840 - DNA, 20 bp, Artificial Sequence
  Description of Artificial Sequence: Synthetic oligonucleotide
  Target: FXN; (-) strand; PAM type: NRG; PAM sequence: GGG
gtgcctgacagctttccatg

SEQ ID NO: 10841 - DNA, 20 bp, Artificial Sequence
  Description of Artificial Sequence: Synthetic oligonucleotide
  Target: FXN; (-) strand; PAM type: NRG; PAM sequence: GGG
cgtgcctgacagctttccat

SEQ ID NO: 10842 - DNA, 20 bp, Artificial Sequence
  Description of Artificial Sequence: Synthetic oligonucleotide
  Target: FXN; (-) strand; PAM type: NRG; PAM sequence: TGG
ccgtgcctgacagctttcca

SEQ ID NO: 10843 - DNA, 20 bp, Artificial Sequence
  Description of Artificial Sequence: Synthetic oligonucleotide
  Target: FXN; (-) strand; PAM type: NRG; PAM sequence: CAG
tagactgtagccgtgcctga

SEQ ID NO: 10844 - DNA, 20 bp, Artificial Sequence
  Description of Artificial Sequence: Synthetic oligonucleotide
  Target: FXN; (-) strand; PAM type: NRG; PAM sequence: TAG
ggttggcagggggtagactg

SEQ ID NO: 10845 - DNA, 20 bp, Artificial Sequence
  Description of Artificial Sequence: Synthetic oligonucleotide
  Target: FXN; (-) strand; PAM type: NRG; PAM sequence: TAG
agatactggttggcaggggg

SEQ ID NO: 10846 - DNA, 20 bp, Artificial Sequence
  Description of Artificial Sequence: Synthetic oligonucleotide
  Target: FXN; (-) strand; PAM type: NRG; PAM sequence: GGG
tgcagatactggttggcagg

SEQ ID NO: 10847 - DNA, 20 bp, Artificial Sequence
  Description of Artificial Sequence: Synthetic oligonucleotide
  Target: FXN; (-) strand; PAM type: NRG; PAM sequence: GGG
atgcagatactggttggcag

SEQ ID NO: 10848 - DNA, 20 bp, Artificial Sequence
  Description of Artificial Sequence: Synthetic oligonucleotide
  Target: FXN; (-) strand; PAM type: NRG; PAM sequence: GGG
catgcagatactggttggca

SEQ ID NO: 10849 - DNA, 20 bp, Artificial Sequence
  Description of Artificial Sequence: Synthetic oligonucleotide
  Target: FXN; (-) strand; PAM type: NRG; PAM sequence: AGG
ccatgcagatactggttggc

SEQ ID NO: 10850 - DNA, 20 bp, Artificial Sequence
  Description of Artificial Sequence: Synthetic oligonucleotide
  Target: FXN; (-) strand; PAM type: NRG; PAM sequence: CAG
tccatgcagatactggttgg

SEQ ID NO: 10851 - DNA, 20 bp, Artificial Sequence
  Description of Artificial Sequence: Synthetic oligonucleotide
  Target: FXN; (-) strand; PAM type: NRG; PAM sequence: TGG
gggtccatgcagatactggt

SEQ ID NO: 10852 - DNA, 20 bp, Artificial Sequence
  Description of Artificial Sequence: Synthetic oligonucleotide
  Target: FXN; (-) strand; PAM type: NRG; PAM sequence: TGG
aggagggtccatgcagatac

SEQ ID NO: 10853 - DNA, 20 bp, Artificial Sequence
  Description of Artificial Sequence: Synthetic oligonucleotide
  Target: FXN; (-) strand; PAM type: NRG; PAM sequence: CAG
gtgtggaaggagggtccatg

SEQ ID NO: 10854 - DNA, 20 bp, Artificial Sequence
  Description of Artificial Sequence: Synthetic oligonucleotide
  Target: FXN; (-) strand; PAM type: NRG; PAM sequence: GGG
tgcatctgagtgtggaagga

SEQ ID NO: 10855 - DNA, 20 bp, Artificial Sequence
  Description of Artificial Sequence: Synthetic oligonucleotide
  Target: FXN; (-) strand; PAM type: NRG; PAM sequence: AGG
atgcatctgagtgtggaagg

SEQ ID NO: 10856 - DNA, 20 bp, Artificial Sequence
  Description of Artificial Sequence: Synthetic oligonucleotide
  Target: FXN; (-) strand; PAM type: NRG; PAM sequence: GAG
aatgcatctgagtgtggaag

SEQ ID NO: 10857 - DNA, 20 bp, Artificial Sequence
  Description of Artificial Sequence: Synthetic oligonucleotide
  Target: FXN; (-) strand; PAM type: NRG; PAM sequence: AGG
taaatgcatctgagtgtgga

SEQ ID NO: 10858 - DNA, 20 bp, Artificial Sequence
  Description of Artificial Sequence: Synthetic oligonucleotide
  Target: FXN; (-) strand; PAM type: NRG; PAM sequence: AAG
gtaaatgcatctgagtgtgg

SEQ ID NO: 10859 - DNA, 20 bp, Artificial Sequence
  Description of Artificial Sequence: Synthetic oligonucleotide
  Target: FXN; (-) strand; PAM type: NRG; PAM sequence: TGG
ggggtaaatgcatctgagtg

SEQ ID NO: 10860 - DNA, 20 bp, Artificial Sequence
  Description of Artificial Sequence: Synthetic oligonucleotide
  Target: FXN; (-) strand; PAM type: NRG; PAM sequence: GAG
ggctgggggtaaatgcatct

SEQ ID NO: 10861 - DNA, 20 bp, Artificial Sequence
  Description of Artificial Sequence: Synthetic oligonucleotide
  Target: FXN; (-) strand; PAM type: NRG; PAM sequence: GGG
gttggctctcttggggctgg

SEQ ID NO: 10862 - DNA, 20 bp, Artificial Sequence
  Description of Artificial Sequence: Synthetic oligonucleotide
  Target: FXN; (-) strand; PAM type: NRG; PAM sequence: GGG
ggttggctctcttggggctg

SEQ ID NO: 10863 - DNA, 20 bp, Artificial Sequence
  Description of Artificial Sequence: Synthetic oligonucleotide
  Target: FXN; (-) strand; PAM type: NRG; PAM sequence: GGG
cggttggctctcttggggct

SEQ ID NO: 10864 - DNA, 20 bp, Artificial Sequence
  Description of Artificial Sequence: Synthetic oligonucleotide
  Target: FXN; (-) strand; PAM type: NRG; PAM sequence: TGG
tcggttggctctcttggggc

SEQ ID NO: 10865 - DNA, 20 bp, Artificial Sequence
  Description of Artificial Sequence: Synthetic oligonucleotide
  Target: FXN; (-) strand; PAM type: NRG; PAM sequence: GGG
ggcatcggttggctctcttg

SEQ ID NO: 10866 - DNA, 20 bp, Artificial Sequence
  Description of Artificial Sequence: Synthetic oligonucleotide
  Target: FXN; (-) strand; PAM type: NRG; PAM sequence: GGG
gggcatcggttggctctctt

SEQ ID NO: 10867 - DNA, 20 bp, Artificial Sequence
  Description of Artificial Sequence: Synthetic oligonucleotide
  Target: FXN; (-) strand; PAM type: NRG; PAM sequence: TGG
tgggcatcggttggctctct

SEQ ID NO: 10868 - DNA, 20 bp, Artificial Sequence
  Description of Artificial Sequence: Synthetic oligonucleotide
  Target: FXN; (-) strand; PAM type: NRG; PAM sequence: TGG
gtgaccacatgggcatcggt

SEQ ID NO: 10869 - DNA, 20 bp, Artificial Sequence
  Description of Artificial Sequence: Synthetic oligonucleotide
  Target: FXN; (-) strand; PAM type: NRG; PAM sequence: CGG
tgtggtgaccacatgggcat

SEQ ID NO: 10870 - DNA, 20 bp, Artificial Sequence
  Description of Artificial Sequence: Synthetic oligonucleotide
  Target: FXN; (-) strand; PAM type: NRG; PAM sequence: GGG
ggtggctgtggtgaccacat

SEQ ID NO: 10871 - DNA, 20 bp, Artificial Sequence
  Description of Artificial Sequence: Synthetic oligonucleotide
  Target: FXN; (-) strand; PAM type: NRG; PAM sequence: TGG
aggtggctgtggtgaccaca

SEQ ID NO: 10872 - DNA, 20 bp, Artificial Sequence
  Description of Artificial Sequence: Synthetic oligonucleotide
  Target: FXN; (-) strand; PAM type: NRG; PAM sequence: TGG
cttggactcggaggtggctg

SEQ ID NO: 10873 - DNA, 20 bp, Artificial Sequence
  Description of Artificial Sequence: Synthetic oligonucleotide
  Target: FXN; (-) strand; PAM type: NRG; PAM sequence: TGG
ggaaatcttggactcggagg

SEQ ID NO: 10874 - DNA, 20 bp, Artificial Sequence
  Description of Artificial Sequence: Synthetic oligonucleotide
  Target: FXN; (-) strand; PAM type: NRG; PAM sequence: AGG
cctggaaatcttggactcgg

SEQ ID NO: 10875 - DNA, 20 bp, Artificial Sequence
  Description of Artificial Sequence: Synthetic oligonucleotide
  Target: FXN; (-) strand; PAM type: NRG; PAM sequence: GAG
acctggaaatcttggactcg

SEQ ID NO: 10876 - DNA, 20 bp, Artificial Sequence
  Description of Artificial Sequence: Synthetic oligonucleotide
  Target: FXN; (-) strand; PAM type: NRG; PAM sequence: CGG
tcacctggaaatcttggact

SEQ ID NO: 10877 - DNA, 20 bp, Artificial Sequence
  Description of Artificial Sequence: Synthetic oligonucleotide
  Target: FXN; (-) strand; PAM type: NRG; PAM sequence: TGG
tgcatgtcacctggaaatct

SEQ ID NO: 10878 - DNA, 20 bp, Artificial Sequence
  Description of Artificial Sequence: Synthetic oligonucleotide
  Target: FXN; (-) strand; PAM type: NRG; PAM sequence: TGG
agaggagactgcatgtcacc

SEQ ID NO: 10879 - DNA, 20 bp, Artificial Sequence
  Description of Artificial Sequence: Synthetic oligonucleotide
  Target: FXN; (-) strand; PAM type: NRG; PAM sequence: GAG
ttcctaaagctgggagagag

SEQ ID NO: 10880 - DNA, 20 bp, Artificial Sequence
  Description of Artificial Sequence: Synthetic oligonucleotide
  Target: FXN; (-) strand; PAM type: NRG; PAM sequence: AGG
cattcctaaagctgggagag

SEQ ID NO: 10881 - DNA, 20 bp, Artificial Sequence
  Description of Artificial Sequence: Synthetic oligonucleotide
  Target: FXN; (-) strand; PAM type: NRG; PAM sequence: GAG
ccattcctaaagctgggaga

SEQ ID NO: 10882 - DNA, 20 bp, Artificial Sequence
  Description of Artificial Sequence: Synthetic oligonucleotide
  Target: FXN; (-) strand; PAM type: NRG; PAM sequence: GAG
agccattcctaaagctggga

SEQ ID NO: 10883 - DNA, 20 bp, Artificial Sequence
  Description of Artificial Sequence: Synthetic oligonucleotide
  Target: FXN; (-) strand; PAM type: NRG; PAM sequence: GAG
gaagccattcctaaagctgg

SEQ ID NO: 10884 - DNA, 20 bp, Artificial Sequence
  Description of Artificial Sequence: Synthetic oligonucleotide
  Target: FXN; (-) strand; PAM type: NRG; PAM sequence: GGG
aagaagccattcctaaagct

SEQ ID NO: 10885 - DNA, 20 bp, Artificial Sequence
  Description of Artificial Sequence: Synthetic oligonucleotide
  Target: FXN; (-) strand; PAM type: NRG; PAM sequence: TGG
gaagaagccattcctaaagc

SEQ ID NO: 10886 - DNA, 20 bp, Artificial Sequence
  Description of Artificial Sequence: Synthetic oligonucleotide
  Target: FXN; (-) strand; PAM type: NRG; PAM sequence: AAG
atcagaagaagccattccta

SEQ ID NO: 10887 - DNA, 20 bp, Artificial Sequence
  Description of Artificial Sequence: Synthetic oligonucleotide
  Target: FXN; (-) strand; PAM type: NRG; PAM sequence: AAG
gtctgtgtgtagatcagaag

SEQ ID NO: 10888 - DNA, 20 bp, Artificial Sequence
  Description of Artificial Sequence: Synthetic oligonucleotide
  Target: FXN; (-) strand; PAM type: NRG; PAM sequence: AAG
tgtgtctgtgtgtagatcag

SEQ ID NO: 10889 - DNA, 20 bp, Artificial Sequence
  Description of Artificial Sequence: Synthetic oligonucleotide
  Target: FXN; (-) strand; PAM type: NRG; PAM sequence: CAG
gtctgtgtctgtgtgtagat

SEQ ID NO: 10890 - DNA, 20 bp, Artificial Sequence
  Description of Artificial Sequence: Synthetic oligonucleotide
  Target: FXN; (-) strand; PAM type: NRG; PAM sequence: TAG
tgtgtgtctgtgtctgtgtg

SEQ ID NO: 10891 - DNA, 20 bp, Artificial Sequence
  Description of Artificial Sequence: Synthetic oligonucleotide
  Target: FXN; (-) strand; PAM type: NRG; PAM sequence: CAG
tctgaatggagttacagttg

SEQ ID NO: 10892 - DNA, 20 bp, Artificial Sequence
  Description of Artificial Sequence: Synthetic oligonucleotide
  Target: FXN; (-) strand; PAM type: NRG; PAM sequence: CAG
ctcttttctgaatggagtta

SEQ ID NO: 10893 - DNA, 20 bp, Artificial Sequence
  Description of Artificial Sequence: Synthetic oligonucleotide
  Target: FXN; (-) strand; PAM type: NRG; PAM sequence: GAG
ctgtgcctcttttctgaatg

SEQ ID NO: 10894 - DNA, 20 bp, Artificial Sequence
  Description of Artificial Sequence: Synthetic oligonucleotide
  Target: FXN; (-) strand; PAM type: NRG; PAM sequence: TGG
tgctgtgcctcttttctgaa

SEQ ID NO: 10895 - DNA, 20 bp, Artificial Sequence
  Description of Artificial Sequence: Synthetic oligonucleotide
  Target: FXN; (-) strand; PAM type: NRG; PAM sequence: TAG
gctccagtgctgcgggcagc

SEQ ID NO: 10896 - DNA, 20 bp, Artificial Sequence
  Description of Artificial Sequence: Synthetic oligonucleotide
  Target: FXN; (-) strand; PAM type: NRG; PAM sequence: CAG
cagggctccagtgctgcggg

SEQ ID NO: 10897 - DNA, 20 bp, Artificial Sequence
  Description of Artificial Sequence: Synthetic oligonucleotide
  Target: FXN; (-) strand; PAM type: NRG; PAM sequence: GGG
cagcagggctccagtgctgc

SEQ ID NO: 10898 - DNA, 20 bp, Artificial Sequence
  Description of Artificial Sequence: Synthetic oligonucleotide
  Target: FXN; (-) strand; PAM type: NRG; PAM sequence: CGG
ccagcagggctccagtgctg

SEQ ID NO: 10899 - DNA, 20 bp, Artificial Sequence
  Description of Artificial Sequence: Synthetic oligonucleotide
  Target: FXN; (-) strand; PAM type: NRG; PAM sequence: CAG
agtgctgcccagcagggctc

SEQ ID NO: 10900 - DNA, 20 bp, Artificial Sequence
  Description of Artificial Sequence: Synthetic oligonucleotide
  Target: FXN; (-) strand; PAM type: NRG; PAM sequence: GGG
tgatccagtgctgcccagca

SEQ ID NO: 10901 - DNA, 20 bp, Artificial Sequence
  Description of Artificial Sequence: Synthetic oligonucleotide
  Target: FXN; (-) strand; PAM type: NRG; PAM sequence: AGG
ttgatccagtgctgcccagc

SEQ ID NO: 10902 - DNA, 20 bp, Artificial Sequence
  Description of Artificial Sequence: Synthetic oligonucleotide
  Target: FXN; (-) strand; PAM type: NRG; PAM sequence: CAG
gttgatccagtgctgcccag

SEQ ID NO: 10903 - DNA, 20 bp, Artificial Sequence
  Description of Artificial Sequence: Synthetic oligonucleotide
  Target: FXN; (-) strand; PAM type: NRG; PAM sequence: CAG
gaggttgatccagtgctgcc

SEQ ID NO: 10904 - DNA, 20 bp, Artificial Sequence
  Description of Artificial Sequence: Synthetic oligonucleotide
  Target: FXN; (-) strand; PAM type: NRG; PAM sequence: CAG
tgccagggcagaggttgatc

SEQ ID NO: 10905 - DNA, 20 bp, Artificial Sequence
  Description of Artificial Sequence: Synthetic oligonucleotide
  Target: FXN; (-) strand; PAM type: NRG; PAM sequence: AGG
atgctcctctgccagggcag

SEQ ID NO: 10906 - DNA, 20 bp, Artificial Sequence
  Description of Artificial Sequence: Synthetic oligonucleotide
  Target: FXN; (-) strand; PAM type: NRG; PAM sequence: GAG
catgctcctctgccagggca

SEQ ID NO: 10907 - DNA, 20 bp, Artificial Sequence
  Description of Artificial Sequence: Synthetic oligonucleotide
  Target: FXN; (-) strand; PAM type: NRG; PAM sequence: CAG
aacatgctcctctgccaggg

SEQ ID NO: 10908 - DNA, 20 bp, Artificial Sequence
  Description of Artificial Sequence: Synthetic oligonucleotide
  Target: FXN; (-) strand; PAM type: NRG; PAM sequence: GGG
aggaacatgctcctctgcca

SEQ ID NO: 10909 - DNA, 20 bp, Artificial Sequence
  Description of Artificial Sequence: Synthetic oligonucleotide
  Target: FXN; (-) strand; PAM type: NRG; PAM sequence: AGG
gaggaacatgctcctctgcc

SEQ ID NO: 10910 - DNA, 20 bp, Artificial Sequence
  Description of Artificial Sequence: Synthetic oligonucleotide
  Target: FXN; (-) strand; PAM type: NRG; PAM sequence: CAG
ggaggaacatgctcctctgc

SEQ ID NO: 10911 - DNA, 20 bp, Artificial Sequence
  Description of Artificial Sequence: Synthetic oligonucleotide
  Target: FXN; (-) strand; PAM type: NRG; PAM sequence: AGG
gctgaagcagggatttgtgg

SEQ ID NO: 10912 - DNA, 20 bp, Artificial Sequence
  Description of Artificial Sequence: Synthetic oligonucleotide
  Target: FXN; (-) strand; PAM type: NRG; PAM sequence: GAG
ggctgaagcagggatttgtg

SEQ ID NO: 10913 - DNA, 20 bp, Artificial Sequence
  Description of Artificial Sequence: Synthetic oligonucleotide
  Target: FXN; (-) strand; PAM type: NRG; PAM sequence: TGG
gaggctgaagcagggatttg

SEQ ID NO: 10914 - DNA, 20 bp, Artificial Sequence
  Description of Artificial Sequence: Synthetic oligonucleotide
  Target: FXN; (-) strand; PAM type: NRG; PAM sequence: GGG
cctctcgagaggctgaagca

SEQ ID NO: 10915 - DNA, 20 bp, Artificial Sequence
  Description of Artificial Sequence: Synthetic oligonucleotide
  Target: FXN; (-) strand; PAM type: NRG; PAM sequence: AGG
gcctctcgagaggctgaagc

SEQ ID NO: 10916 - DNA, 20 bp, Artificial Sequence
  Description of Artificial Sequence: Synthetic oligonucleotide
  Target: FXN; (-) strand; PAM type: NRG; PAM sequence: CAG
agcctctcgagaggctgaag

SEQ ID NO: 10917 - DNA, 20 bp, Artificial Sequence
  Description of Artificial Sequence: Synthetic oligonucleotide
  Target: FXN; (-) strand; PAM type: NRG; PAM sequence: AAG
aggagcctctcgagaggctg

SEQ ID NO: 10918 - DNA, 20 bp, Artificial Sequence
  Description of Artificial Sequence: Synthetic oligonucleotide
  Target: FXN; (-) strand; PAM type: NRG; PAM sequence: AGG
acaaggaggagcctctcgag

SEQ ID NO: 10919 - DNA, 20 bp, Artificial Sequence
  Description of Artificial Sequence: Synthetic oligonucleotide
  Target: FXN; (-) strand; PAM type: NRG; PAM sequence: GAG
gacaaggaggagcctctcga

SEQ ID NO: 10920 - DNA, 20 bp, Artificial Sequence
  Description of Artificial Sequence: Synthetic oligonucleotide
  Target: FXN; (-) strand; PAM type: NRG; PAM sequence: GAG
cagacaaggaggagcctctc

SEQ ID NO: 10921 - DNA, 20 bp, Artificial Sequence
  Description of Artificial Sequence: Synthetic oligonucleotide
  Target: FXN; (-) strand; PAM type: NRG; PAM sequence: GAG
ggaaaataacagacaaggag

SEQ ID NO: 10922 - DNA, 20 bp, Artificial Sequence
  Description of Artificial Sequence: Synthetic oligonucleotide
  Target: FXN; (-) strand; PAM type: NRG; PAM sequence: AGG
aaggaaaataacagacaagg

SEQ ID NO: 10923 - DNA, 20 bp, Artificial Sequence
  Description of Artificial Sequence: Synthetic oligonucleotide
  Target: FXN; (-) strand; PAM type: NRG; PAM sequence: GAG
caaggaaaataacagacaag

SEQ ID NO: 10924 - DNA, 20 bp, Artificial Sequence
  Description of Artificial Sequence: Synthetic oligonucleotide
  Target: FXN; (-) strand; PAM type: NRG; PAM sequence: AGG
gccaaggaaaataacagaca

SEQ ID NO: 10925 - DNA, 20 bp, Artificial Sequence
  Description of Artificial Sequence: Synthetic oligonucleotide
  Target: FXN; (-) strand; PAM type: NRG; PAM sequence: AAG
ggccaaggaaaataacagac

SEQ ID NO: 10926 - DNA, 20 bp, Artificial Sequence
  Description of Artificial Sequence: Synthetic oligonucleotide
  Target: FXN; (-) strand; PAM type: NRG; PAM sequence: CAG
cttgtggccaaggaaaataa

SEQ ID NO: 10927 - DNA, 20 bp, Artificial Sequence
  Description of Artificial Sequence: Synthetic oligonucleotide
  Target: FXN; (-) strand; PAM type: NRG; PAM sequence: AGG
gcctgcctgccttgtggcca

SEQ ID NO: 10928 - DNA, 20 bp, Artificial Sequence
  Description of Artificial Sequence: Synthetic oligonucleotide
  Target: FXN; (-) strand; PAM type: NRG; PAM sequence: AAG
tgcctgcctgccttgtggcc

SEQ ID NO: 10929 - DNA, 20 bp, Artificial Sequence
  Description of Artificial Sequence: Synthetic oligonucleotide
  Target: FXN; (-) strand; PAM type: NRG; PAM sequence: TGG
cccactgcctgcctgccttg

SEQ ID NO: 10930 - DNA, 20 bp, Artificial Sequence
  Description of Artificial Sequence: Synthetic oligonucleotide
  Target: FXN; (-) strand; PAM type: NRG; PAM sequence: GGG
aggctccttgccccggagga

SEQ ID NO: 10931 - DNA, 20 bp, Artificial Sequence
  Description of Artificial Sequence: Synthetic oligonucleotide
  Target: FXN; (-) strand; PAM type: NRG; PAM sequence: AGG
aaggctccttgccccggagg

SEQ ID NO: 10932 - DNA, 20 bp, Artificial Sequence
  Description of Artificial Sequence: Synthetic oligonucleotide
  Target: FXN; (-) strand; PAM type: NRG; PAM sequence: GAG
gaaggctccttgccccggag

SEQ ID NO: 10933 - DNA, 20 bp, Artificial Sequence
  Description of Artificial Sequence: Synthetic oligonucleotide
  Target: FXN; (-) strand; PAM type: NRG; PAM sequence: AGG
gtgaaggctccttgccccgg

SEQ ID NO: 10934 - DNA, 20 bp, Artificial Sequence
  Description of Artificial Sequence: Synthetic oligonucleotide
  Target: FXN; (-) strand; PAM type: NRG; PAM sequence: GAG
tgtgaaggctccttgccccg

SEQ ID NO: 10935 - DNA, 20 bp, Artificial Sequence
  Description of Artificial Sequence: Synthetic oligonucleotide
  Target: FXN; (-) strand; PAM type: NRG; PAM sequence: CGG
gctgtgaaggctccttgccc

SEQ ID NO: 10936 - DNA, 20 bp, Artificial Sequence
  Description of Artificial Sequence: Synthetic oligonucleotide
  Target: FXN; (-) strand; PAM type: NRG; PAM sequence: AGG
tagcaggaagtgggctgtga

SEQ ID NO: 10937 - DNA, 20 bp, Artificial Sequence
  Description of Artificial Sequence: Synthetic oligonucleotide
  Target: FXN; (-) strand; PAM type: NRG; PAM sequence: AAG
ttagcaggaagtgggctgtg

SEQ ID NO: 10938 - DNA, 20 bp, Artificial Sequence
  Description of Artificial Sequence: Synthetic oligonucleotide
  Target: FXN; (-) strand; PAM type: NRG; PAM sequence: GGG
aactgttattagcaggaagt

SEQ ID NO: 10939 - DNA, 20 bp, Artificial Sequence
  Description of Artificial Sequence: Synthetic oligonucleotide
  Target: FXN; (-) strand; PAM type: NRG; PAM sequence: TGG
aaactgttattagcaggaag

SEQ ID NO: 10940 - DNA, 20 bp, Artificial Sequence
  Description of Artificial Sequence: Synthetic oligonucleotide
  Target: FXN; (-) strand; PAM type: NRG; PAM sequence: AAG
cccaaactgttattagcagg

SEQ ID NO: 10941 - DNA, 20 bp, Artificial Sequence
  Description of Artificial Sequence: Synthetic oligonucleotide
  Target: FXN; (-) strand; PAM type: NRG; PAM sequence: AGG
aaccccaaactgttattagc

SEQ ID NO: 10942 - DNA, 20 bp, Artificial Sequence
  Description of Artificial Sequence: Synthetic oligonucleotide
  Target: FXN; (-) strand; PAM type: NRG; PAM sequence: CAG
gaaccccaaactgttattag

SEQ ID NO: 10943 - DNA, 20 bp, Artificial Sequence
  Description of Artificial Sequence: Synthetic oligonucleotide
  Target: FXN; (-) strand; PAM type: NRG; PAM sequence: TAG
gtggaaccccaaactgttat

SEQ ID NO: 10944 - DNA, 20 bp, Artificial Sequence
  Description of Artificial Sequence: Synthetic oligonucleotide
  Target: FXN; (-) strand; PAM type: NRG; PAM sequence: TGG
tggagtcttaaaacaccctg

SEQ ID NO: 10945 - DNA, 20 bp, Artificial Sequence
  Description of Artificial Sequence: Synthetic oligonucleotide
  Target: FXN; (-) strand; PAM type: NRG; PAM sequence: GAG
tggcctaaaatagctgactg

SEQ ID NO: 10946 - DNA, 20 bp, Artificial Sequence
  Description of Artificial Sequence: Synthetic oligonucleotide
  Target: FXN; (-) strand; PAM type: NRG; PAM sequence: TGG
tctggcctaaaatagctgac

SEQ ID NO: 10947 - DNA, 20 bp, Artificial Sequence
  Description of Artificial Sequence: Synthetic oligonucleotide
  Target: FXN; (-) strand; PAM type: NRG; PAM sequence: TAG
gaaatgagtctggcctaaaa

SEQ ID NO: 10948 - DNA, 20 bp, Artificial Sequence
  Description of Artificial Sequence: Synthetic oligonucleotide
  Target: FXN; (-) strand; PAM type: NRG; PAM sequence: TGG
gagagagagagaaatgagtc

SEQ ID NO: 10949 - DNA, 20 bp, Artificial Sequence
  Description of Artificial Sequence: Synthetic oligonucleotide
  Target: FXN; (-) strand; PAM type: NRG; PAM sequence: GAG
agagagagagagagagaaat

SEQ ID NO: 10950 - DNA, 20 bp, Artificial Sequence
  Description of Artificial Sequence: Synthetic oligonucleotide
  Target: FXN; (-) strand; PAM type: NRG; PAM sequence: GAG
aaaaaaaagagagagagaga

SEQ ID NO: 10951 - DNA, 20 bp, Artificial Sequence
  Description of Artificial Sequence: Synthetic oligonucleotide
  Target: FXN; (-) strand; PAM type: NRG; PAM sequence: GAG
gaaaaaaaaagagagagaga

SEQ ID NO: 10952 - DNA, 20 bp, Artificial Sequence
  Description of Artificial Sequence: Synthetic oligonucleotide
  Target: FXN; (-) strand; PAM type: NRG; PAM sequence: GAG
aagaaaaaaaaagagagaga

SEQ ID NO: 10953 - DNA, 20 bp, Artificial Sequence
  Description of Artificial Sequence: Synthetic oligonucleotide
  Target: FXN; (-) strand; PAM type: NRG; PAM sequence: GAG
aaaagaaaaaaaaagagaga

SEQ ID NO: 10954 - DNA, 20 bp, Artificial Sequence
  Description of Artificial Sequence: Synthetic oligonucleotide
  Target: FXN; (-) strand; PAM type: NRG; PAM sequence: GAG
ataaaagaaaaaaaaagaga

SEQ ID NO: 10955 - DNA, 20 bp, Artificial Sequence
  Description of Artificial Sequence: Synthetic oligonucleotide
  Target: FXN; (-) strand; PAM type: NRG; PAM sequence: GAG
tcataaaagaaaaaaaaaga

SEQ ID NO: 10956 - DNA, 20 bp, Artificial Sequence
  Description of Artificial Sequence: Synthetic oligonucleotide
  Target: FXN; (-) strand; PAM type: NRG; PAM sequence: GAG
tttcataaaagaaaaaaaaa

SEQ ID NO: 10957 - DNA, 20 bp, Artificial Sequence
  Description of Artificial Sequence: Synthetic oligonucleotide
  Target: FXN; (-) strand; PAM type: NRG; PAM sequence: AAG
gatttcataaaagaaaaaaa

SEQ ID NO: 10958 - DNA, 20 bp, Artificial Sequence
  Description of Artificial Sequence: Synthetic oligonucleotide
  Target: FXN; (-) strand; PAM type: NRG; PAM sequence: AAG
ctcagggtgtgatttcataa

SEQ ID NO: 10959 - DNA, 20 bp, Artificial Sequence
  Description of Artificial Sequence: Synthetic oligonucleotide
  Target: FXN; (-) strand; PAM type: NRG; PAM sequence: GGG
gcactccagcctgggtctca

SEQ ID NO: 10960 - DNA, 20 bp, Artificial Sequence
  Description of Artificial Sequence: Synthetic oligonucleotide
  Target: FXN; (-) strand; PAM type: NRG; PAM sequence: AGG
tgcactccagcctgggtctc

SEQ ID NO: 10961 - DNA, 20 bp, Artificial Sequence
  Description of Artificial Sequence: Synthetic oligonucleotide
  Target: FXN; (-) strand; PAM type: NRG; PAM sequence: CAG
ctgcactccagcctgggtct

SEQ ID NO: 10962 - DNA, 20 bp, Artificial Sequence
  Description of Artificial Sequence: Synthetic oligonucleotide
  Target: FXN; (-) strand; PAM type: NRG; PAM sequence: GGG
gcaccactgcactccagcct

SEQ ID NO: 10963 - DNA, 20 bp, Artificial Sequence
  Description of Artificial Sequence: Synthetic oligonucleotide
  Target: FXN; (-) strand; PAM type: NRG; PAM sequence: TGG
cgcaccactgcactccagcc

SEQ ID NO: 10964 - DNA, 20 bp, Artificial Sequence
  Description of Artificial Sequence: Synthetic oligonucleotide
  Target: FXN; (-) strand; PAM type: NRG; PAM sequence: CAG
gagatcgcaccactgcactc

SEQ ID NO: 10965 - DNA, 20 bp, Artificial Sequence
  Description of Artificial Sequence: Synthetic oligonucleotide
  Target: FXN; (-) strand; PAM type: NRG; PAM sequence: GAG
ggcggaggctgcagtgagcc

SEQ ID NO: 10966 - DNA, 20 bp, Artificial Sequence
  Description of Artificial Sequence: Synthetic oligonucleotide
  Target: FXN; (-) strand; PAM type: NRG; PAM sequence: GAG
cgggaggcggaggctgcagt

SEQ ID NO: 10967 - DNA, 20 bp, Artificial Sequence
  Description of Artificial Sequence: Synthetic oligonucleotide
  Target: FXN; (-) strand; PAM type: NRG; PAM sequence: CAG
aacccgggaggcggaggctg

SEQ ID NO: 10968 - DNA, 20 bp, Artificial Sequence
  Description of Artificial Sequence: Synthetic oligonucleotide
  Target: FXN; (-) strand; PAM type: NRG; PAM sequence: AGG
tgcttgaacccgggaggcgg

SEQ ID NO: 10969 - DNA, 20 bp, Artificial Sequence
  Description of Artificial Sequence: Synthetic oligonucleotide
  Target: FXN; (-) strand; PAM type: NRG; PAM sequence: GAG
ttgcttgaacccgggaggcg

SEQ ID NO: 10970 - DNA, 20 bp, Artificial Sequence
  Description of Artificial Sequence: Synthetic oligonucleotide
  Target: FXN; (-) strand; PAM type: NRG; PAM sequence: CGG
gattgcttgaacccgggagg

SEQ ID NO: 10971 - DNA, 20 bp, Artificial Sequence
  Description of Artificial Sequence: Synthetic oligonucleotide
  Target: FXN; (-) strand; PAM type: NRG; PAM sequence: AGG
gaggattgcttgaacccggg

SEQ ID NO: 10972 - DNA, 20 bp, Artificial Sequence
  Description of Artificial Sequence: Synthetic oligonucleotide
  Target: FXN; (-) strand; PAM type: NRG; PAM sequence: GAG
ggaggattgcttgaacccgg

SEQ ID NO: 10973 - DNA, 20 bp, Artificial Sequence
  Description of Artificial Sequence: Synthetic oligonucleotide
  Target: FXN; (-) strand; PAM type: NRG; PAM sequence: GGG
caggaggattgcttgaaccc

SEQ ID NO: 10974 - DNA, 20 bp, Artificial Sequence
  Description of Artificial Sequence: Synthetic oligonucleotide
  Target: FXN; (-) strand; PAM type: NRG; PAM sequence: CGG
gcaggaggattgcttgaacc

SEQ ID NO: 10975 - DNA, 20 bp, Artificial Sequence
  Description of Artificial Sequence: Synthetic oligonucleotide
  Target: FXN; (-) strand; PAM type: NRG; PAM sequence: AGG
actcaggaggctgaggcagg

SEQ ID NO: 10976 - DNA, 20 bp, Artificial Sequence
  Description of Artificial Sequence: Synthetic oligonucleotide
  Target: FXN; (-) strand; PAM type: NRG; PAM sequence: GAG
tactcaggaggctgaggcag

SEQ ID NO: 10977 - DNA, 20 bp, Artificial Sequence
  Description of Artificial Sequence: Synthetic oligonucleotide
  Target: FXN; (-) strand; PAM type: NRG; PAM sequence: AGG
gctactcaggaggctgaggc

SEQ ID NO: 10978 - DNA, 20 bp, Artificial Sequence
  Description of Artificial Sequence: Synthetic oligonucleotide
  Target: FXN; (-) strand; PAM type: NRG; PAM sequence: CAG
agctactcaggaggctgagg

SEQ ID NO: 10979 - DNA, 20 bp, Artificial Sequence
  Description of Artificial Sequence: Synthetic oligonucleotide
  Target: FXN; (-) strand; PAM type: NRG; PAM sequence: AGG
cccagctactcaggaggctg

SEQ ID NO: 10980 - DNA, 20 bp, Artificial Sequence
  Description of Artificial Sequence: Synthetic oligonucleotide
  Target: FXN; (-) strand; PAM type: NRG; PAM sequence: GAG
tcccagctactcaggaggct

SEQ ID NO: 10981 - DNA, 20 bp, Artificial Sequence
  Description of Artificial Sequence: Synthetic oligonucleotide
  Target: FXN; (-) strand; PAM type: NRG; PAM sequence: AGG
tatagtcccagctactcagg

SEQ ID NO: 10982 - DNA, 20 bp, Artificial Sequence
  Description of Artificial Sequence: Synthetic oligonucleotide
  Target: FXN; (-) strand; PAM type: NRG; PAM sequence: GAG
ctatagtcccagctactcag

SEQ ID NO: 10983 - DNA, 20 bp, Artificial Sequence
  Description of Artificial Sequence: Synthetic oligonucleotide
  Target: FXN; (-) strand; PAM type: NRG; PAM sequence: AGG
gcctatagtcccagctactc

SEQ ID NO: 10984 - DNA, 20 bp, Artificial Sequence
  Description of Artificial Sequence: Synthetic oligonucleotide
  Target: FXN; (-) strand; PAM type: NRG; PAM sequence: CAG
cgcctatagtcccagctact

SEQ ID NO: 10985 - DNA, 20 bp, Artificial Sequence
  Description of Artificial Sequence: Synthetic oligonucleotide
  Target: FXN; (-) strand; PAM type: NRG; PAM sequence: CAG
gcactgcacgcctatagtcc

SEQ ID NO: 10986 - DNA, 20 bp, Artificial Sequence
  Description of Artificial Sequence: Synthetic oligonucleotide
  Target: FXN; (-) strand; PAM type: NRG; PAM sequence: TAG
ggtgtggcactgcacgccta

SEQ ID NO: 10987 - DNA, 20 bp, Artificial Sequence
  Description of Artificial Sequence: Synthetic oligonucleotide
  Target: FXN; (-) strand; PAM type: NRG; PAM sequence: TGG
atacaaaaattagctaggtg

SEQ ID NO: 10988 - DNA, 20 bp, Artificial Sequence
  Description of Artificial Sequence: Synthetic oligonucleotide
  Target: FXN; (-) strand; PAM type: NRG; PAM sequence: AGG
taaaaatacaaaaattagct

SEQ ID NO: 10989 - DNA, 20 bp, Artificial Sequence
  Description of Artificial Sequence: Synthetic oligonucleotide
  Target: FXN; (-) strand; PAM type: NRG; PAM sequence: TAG
ctaaaaatacaaaaattagc

SEQ ID NO: 10990 - DNA, 20 bp, Artificial Sequence
  Description of Artificial Sequence: Synthetic oligonucleotide
  Target: FXN; (-) strand; PAM type: NRG; PAM sequence: TAG
tttactaaaaatacaaaaat

SEQ ID NO: 10991 - DNA, 20 bp, Artificial Sequence
  Description of Artificial Sequence: Synthetic oligonucleotide
  Target: FXN; (-) strand; PAM type: NRG; PAM sequence: TGG
caagaccagcctggccaaca

SEQ ID NO: 10992 - DNA, 20 bp, Artificial Sequence
  Description of Artificial Sequence: Synthetic oligonucleotide
  Target: FXN; (-) strand; PAM type: NRG; PAM sequence: TGG
tcaggagttcaagaccagcc

SEQ ID NO: 10993 - DNA, 20 bp, Artificial Sequence
  Description of Artificial Sequence: Synthetic oligonucleotide
  Target: FXN; (-) strand; PAM type: NRG; PAM sequence: CAG
tgaggtcaggagttcaagac

SEQ ID NO: 10994 - DNA, 20 bp, Artificial Sequence
  Description of Artificial Sequence: Synthetic oligonucleotide
  Target: FXN; (-) strand; PAM type: NRG; PAM sequence: AAG
tcatctgaggtcaggagttc

SEQ ID NO: 10995 - DNA, 20 bp, Artificial Sequence
  Description of Artificial Sequence: Synthetic oligonucleotide
  Target: FXN; (-) strand; PAM type: NRG; PAM sequence: GAG
ggcggatcatctgaggtcag

SEQ ID NO: 10996 - DNA, 20 bp, Artificial Sequence
  Description of Artificial Sequence: Synthetic oligonucleotide
  Target: FXN; (-) strand; PAM type: NRG; PAM sequence: AGG
cgggcggatcatctgaggtc

SEQ ID NO: 10997 - DNA, 20 bp, Artificial Sequence
  Description of Artificial Sequence: Synthetic oligonucleotide
  Target: FXN; (-) strand; PAM type: NRG; PAM sequence: CAG
gcgggcggatcatctgaggt

SEQ ID NO: 10998 - DNA, 20 bp, Artificial Sequence
  Description of Artificial Sequence: Synthetic oligonucleotide
  Target: FXN; (-) strand; PAM type: NRG; PAM sequence: AGG
cgaggcgggcggatcatctg

SEQ ID NO: 10999 - DNA, 20 bp, Artificial Sequence
  Description of Artificial Sequence: Synthetic oligonucleotide
  Target: FXN; (-) strand; PAM type: NRG; PAM sequence: GAG
ccgaggcgggcggatcatct

SEQ ID NO: 11000 - DNA, 20 bp, Artificial Sequence
  Description of Artificial Sequence: Synthetic oligonucleotide
  Target: FXN; (-) strand; PAM type: NRG; PAM sequence: CGG
ctttgggaggccgaggcggg

SEQ ID NO: 11001 - DNA, 20 bp, Artificial Sequence
  Description of Artificial Sequence: Synthetic oligonucleotide
  Target: FXN; (-) strand; PAM type: NRG; PAM sequence: GGG
gcactttgggaggccgaggc

SEQ ID NO: 11002 - DNA, 20 bp, Artificial Sequence
  Description of Artificial Sequence: Synthetic oligonucleotide
  Target: FXN; (-) strand; PAM type: NRG; PAM sequence: CGG
agcactttgggaggccgagg

SEQ ID NO: 11003 - DNA, 20 bp, Artificial Sequence
  Description of Artificial Sequence: Synthetic oligonucleotide
  Target: FXN; (-) strand; PAM type: NRG; PAM sequence: AGG
cccagcactttgggaggccg

SEQ ID NO: 11004 - DNA, 20 bp, Artificial Sequence
  Description of Artificial Sequence: Synthetic oligonucleotide
  Target: FXN; (-) strand; PAM type: NRG; PAM sequence: GAG
tcccagcactttgggaggcc

SEQ ID NO: 11005 - DNA, 20 bp, Artificial Sequence
  Description of Artificial Sequence: Synthetic oligonucleotide
  Target: FXN; (-) strand; PAM type: NRG; PAM sequence: AGG
agtaatcccagcactttggg

SEQ ID NO: 11006 - DNA, 20 bp, Artificial Sequence
  Description of Artificial Sequence: Synthetic oligonucleotide
  Target: FXN; (-) strand; PAM type: NRG; PAM sequence: GAG
cagtaatcccagcactttgg

SEQ ID NO: 11007 - DNA, 20 bp, Artificial Sequence
  Description of Artificial Sequence: Synthetic oligonucleotide
  Target: FXN; (-) strand; PAM type: NRG; PAM sequence: GGG
gccagtaatcccagcacttt

SEQ ID NO: 11008 - DNA, 20 bp, Artificial Sequence
  Description of Artificial Sequence: Synthetic oligonucleotide
  Target: FXN; (-) strand; PAM type: NRG; PAM sequence: TGG
tgccagtaatcccagcactt

SEQ ID NO: 11009 - DNA, 20 bp, Artificial Sequence
  Description of Artificial Sequence: Synthetic oligonucleotide
  Target: FXN; (-) strand; PAM type: NRG; PAM sequence: CAG
gtggctcatgccagtaatcc

SEQ ID NO: 11010 - DNA, 20 bp, Artificial Sequence
  Description of Artificial Sequence: Synthetic oligonucleotide
  Target: FXN; (-) strand; PAM type: NRG; PAM sequence: CAG
ctgggcgcagtggctcatgc

SEQ ID NO: 11011 - DNA, 20 bp, Artificial Sequence
  Description of Artificial Sequence: Synthetic oligonucleotide
  Target: FXN; (-) strand; PAM type: NRG; PAM sequence: TGG
tgagtctgggctgggcgcag

SEQ ID NO: 11012 - DNA, 20 bp, Artificial Sequence
  Description of Artificial Sequence: Synthetic oligonucleotide
  Target: FXN; (-) strand; PAM type: NRG; PAM sequence: CAG
aaatgagtctgggctgggcg

SEQ ID NO: 11013 - DNA, 20 bp, Artificial Sequence
  Description of Artificial Sequence: Synthetic oligonucleotide
  Target: FXN; (-) strand; PAM type: NRG; PAM sequence: GGG
aagaaaaatgagtctgggct

SEQ ID NO: 11014 - DNA, 20 bp, Artificial Sequence
  Description of Artificial Sequence: Synthetic oligonucleotide
  Target: FXN; (-) strand; PAM type: NRG; PAM sequence: TGG
aaagaaaaatgagtctgggc

SEQ ID NO: 11015 - DNA, 20 bp, Artificial Sequence
  Description of Artificial Sequence: Synthetic oligonucleotide
  Target: FXN; (-) strand; PAM type: NRG; PAM sequence: GGG
tctcaaagaaaaatgagtct

SEQ ID NO: 11016 - DNA, 20 bp, Artificial Sequence
  Description of Artificial Sequence: Synthetic oligonucleotide
  Target: FXN; (-) strand; PAM type: NRG; PAM sequence: TGG
ctctcaaagaaaaatgagtc

SEQ ID NO: 11017 - DNA, 20 bp, Artificial Sequence
  Description of Artificial Sequence: Synthetic oligonucleotide
  Target: FXN; (-) strand; PAM type: NRG; PAM sequence: GAG
gcctactctcaaagaaaaat

SEQ ID NO: 11018 - DNA, 20 bp, Artificial Sequence
  Description of Artificial Sequence: Synthetic oligonucleotide
  Target: FXN; (-) strand; PAM type: NRG; PAM sequence: AAG
ttgggaaaagcctactctca

SEQ ID NO: 11019 - DNA, 20 bp, Artificial Sequence
  Description of Artificial Sequence: Synthetic oligonucleotide
  Target: FXN; (-) strand; PAM type: NRG; PAM sequence: AAG
cagaagcctacttttgggaa

SEQ ID NO: 11020 - DNA, 20 bp, Artificial Sequence
  Description of Artificial Sequence: Synthetic oligonucleotide
  Target: FXN; (-) strand; PAM type: NRG; PAM sequence: GGG
tagctcagaagcctactttt

SEQ ID NO: 11021 - DNA, 20 bp, Artificial Sequence
  Description of Artificial Sequence: Synthetic oligonucleotide
  Target: FXN; (-) strand; PAM type: NRG; PAM sequence: TGG
atagctcagaagcctacttt

SEQ ID NO: 11022 - DNA, 20 bp, Artificial Sequence
  Description of Artificial Sequence: Synthetic oligonucleotide
  Target: FXN; (-) strand; PAM type: NRG; PAM sequence: AAG
cctgaaagtgaatagctcag

SEQ ID NO: 11023 - DNA, 20 bp, Artificial Sequence
  Description of Artificial Sequence: Synthetic oligonucleotide
  Target: FXN; (-) strand; PAM type: NRG; PAM sequence: CAG
ctgcctgaaagtgaatagct

SEQ ID NO: 11024 - DNA, 20 bp, Artificial Sequence
  Description of Artificial Sequence: Synthetic oligonucleotide
  Target: FXN; (-) strand; PAM type: NRG; PAM sequence: TAG
tgggactgcctgaaagtgaa

SEQ ID NO: 11025 - DNA, 20 bp, Artificial Sequence
  Description of Artificial Sequence: Synthetic oligonucleotide
  Target: FXN; (-) strand; PAM type: NRG; PAM sequence: AAG
tggcacatgggactgcctga

SEQ ID NO: 11026 - DNA, 20 bp, Artificial Sequence
  Description of Artificial Sequence: Synthetic oligonucleotide
  Target: FXN; (-) strand; PAM type: NRG; PAM sequence: GGG
ggatgtggttcctggcacat

SEQ ID NO: 11027 - DNA, 20 bp, Artificial Sequence
  Description of Artificial Sequence: Synthetic oligonucleotide
  Target: FXN; (-) strand; PAM type: NRG; PAM sequence: TGG
tggatgtggttcctggcaca

SEQ ID NO: 11028 - DNA, 20 bp, Artificial Sequence
  Description of Artificial Sequence: Synthetic oligonucleotide
  Target: FXN; (-) strand; PAM type: NRG; PAM sequence: TGG
ggaaatttggatgtggttcc

SEQ ID NO: 11029 - DNA, 20 bp, Artificial Sequence
  Description of Artificial Sequence: Synthetic oligonucleotide
  Target: FXN; (-) strand; PAM type: NRG; PAM sequence: TGG
ccacggaggaaatttggatg

SEQ ID NO: 11030 - DNA, 20 bp, Artificial Sequence
  Description of Artificial Sequence: Synthetic oligonucleotide
  Target: FXN; (-) strand; PAM type: NRG; PAM sequence: TGG
tcccatccacggaggaaatt

SEQ ID NO: 11031 - DNA, 20 bp, Artificial Sequence
  Description of Artificial Sequence: Synthetic oligonucleotide
  Target: FXN; (-) strand; PAM type: NRG; PAM sequence: AGG
cctgagactcccatccacgg

SEQ ID NO: 11032 - DNA, 20 bp, Artificial Sequence
  Description of Artificial Sequence: Synthetic oligonucleotide
  Target: FXN; (-) strand; PAM type: NRG; PAM sequence: GAG
gcctgagactcccatccacg

SEQ ID NO: 11033 - DNA, 20 bp, Artificial Sequence
  Description of Artificial Sequence: Synthetic oligonucleotide
  Target: FXN; (-) strand; PAM type: NRG; PAM sequence: CGG
cagcctgagactcccatcca

SEQ ID NO: 11034 - DNA, 20 bp, Artificial Sequence
  Description of Artificial Sequence: Synthetic oligonucleotide
  Target: FXN; (-) strand; PAM type: NRG; PAM sequence: GAG
gcaaggagataaggcagcct

SEQ ID NO: 11035 - DNA, 20 bp, Artificial Sequence
  Description of Artificial Sequence: Synthetic oligonucleotide
  Target: FXN; (-) strand; PAM type: NRG; PAM sequence: CAG
ggacatgcaaggagataagg

SEQ ID NO: 11036 - DNA, 20 bp, Artificial Sequence
  Description of Artificial Sequence: Synthetic oligonucleotide
  Target: FXN; (-) strand; PAM type: NRG; PAM sequence: AGG
tggggacatgcaaggagata

SEQ ID NO: 11037 - DNA, 20 bp, Artificial Sequence
  Description of Artificial Sequence: Synthetic oligonucleotide
  Target: FXN; (-) strand; PAM type: NRG; PAM sequence: AAG
atggggacatgcaaggagat

SEQ ID NO: 11038 - DNA, 20 bp, Artificial Sequence
  Description of Artificial Sequence: Synthetic oligonucleotide
  Target: FXN; (-) strand; PAM type: NRG; PAM sequence: GAG
tgggcatggggacatgcaag

SEQ ID NO: 11039 - DNA, 20 bp, Artificial Sequence
  Description of Artificial Sequence: Synthetic oligonucleotide
  Target: FXN; (-) strand; PAM type: NRG; PAM sequence: AGG
gctgggcatggggacatgca

SEQ ID NO: 11040 - DNA, 20 bp, Artificial Sequence
  Description of Artificial Sequence: Synthetic oligonucleotide
  Target: FXN; (-) strand; PAM type: NRG; PAM sequence: AAG
agctgggcatggggacatgc

SEQ ID NO: 11041 - DNA, 20 bp, Artificial Sequence
  Description of Artificial Sequence: Synthetic oligonucleotide
  Target: FXN; (-) strand; PAM type: NRG; PAM sequence: GGG
ggctgagacagctgggcatg

SEQ ID NO: 11042 - DNA, 20 bp, Artificial Sequence
  Description of Artificial Sequence: Synthetic oligonucleotide
  Target: FXN; (-) strand; PAM type: NRG; PAM sequence: GGG
aggctgagacagctgggcat

SEQ ID NO: 11043 - DNA, 20 bp, Artificial Sequence
  Description of Artificial Sequence: Synthetic oligonucleotide
  Target: FXN; (-) strand; PAM type: NRG; PAM sequence: TGG
taggctgagacagctgggca

SEQ ID NO: 11044 - DNA, 20 bp, Artificial Sequence
  Description of Artificial Sequence: Synthetic oligonucleotide
  Target: FXN; (-) strand; PAM type: NRG; PAM sequence: GGG
gcccttaggctgagacagct

SEQ ID NO: 11045 - DNA, 20 bp, Artificial Sequence
  Description of Artificial Sequence: Synthetic oligonucleotide
  Target: FXN; (-) strand; PAM type: NRG; PAM sequence: TGG
tgcccttaggctgagacagc

SEQ ID NO: 11046 - DNA, 20 bp, Artificial Sequence
  Description of Artificial Sequence: Synthetic oligonucleotide
  Target: FXN; (-) strand; PAM type: NRG; PAM sequence: CAG
tacctgcccttaggctgaga

SEQ ID NO: 11047 - DNA, 20 bp, Artificial Sequence
  Description of Artificial Sequence: Synthetic oligonucleotide
  Target: FXN; (-) strand; PAM type: NRG; PAM sequence: GAG
aaggtacctgcccttaggct

SEQ ID NO: 11048 - DNA, 20 bp, Artificial Sequence
  Description of Artificial Sequence: Synthetic oligonucleotide
  Target: FXN; (-) strand; PAM type: NRG; PAM sequence: AGG
acttcaaggtacctgccctt

SEQ ID NO: 11049 - DNA, 20 bp, Artificial Sequence
  Description of Artificial Sequence: Synthetic oligonucleotide
  Target: FXN; (-) strand; PAM type: NRG; PAM sequence: TAG
gacttcaaggtacctgccct

SEQ ID NO: 11050 - DNA, 20 bp, Artificial Sequence
  Description of Artificial Sequence: Synthetic oligonucleotide
  Target: FXN; (-) strand; PAM type: NRG; PAM sequence: AGG
tattgtttaacttgacttca

SEQ ID NO: 11051 - DNA, 20 bp, Artificial Sequence
  Description of Artificial Sequence: Synthetic oligonucleotide
  Target: FXN; (-) strand; PAM type: NRG; PAM sequence: AAG
ttattgtttaacttgacttc

SEQ ID NO: 11052 - DNA, 20 bp, Artificial Sequence
  Description of Artificial Sequence: Synthetic oligonucleotide
  Target: FXN; (-) strand; PAM type: NRG; PAM sequence: TGG
aaccaggctgagggcattgc

SEQ ID NO: 11053 - DNA, 20 bp, Artificial Sequence
  Description of Artificial Sequence: Synthetic oligonucleotide
  Target: FXN; (-) strand; PAM type: NRG; PAM sequence: GGG
tgctgcaaaaaccaggctga

SEQ ID NO: 11054 - DNA, 20 bp, Artificial Sequence
  Description of Artificial Sequence: Synthetic oligonucleotide
  Target: FXN; (-) strand; PAM type: NRG; PAM sequence: AGG
ctgctgcaaaaaccaggctg

SEQ ID NO: 11055 - DNA, 20 bp, Artificial Sequence
  Description of Artificial Sequence: Synthetic oligonucleotide
  Target: FXN; (-) strand; PAM type: NRG; PAM sequence: GAG
cctgctgcaaaaaccaggct

SEQ ID NO: 11056 - DNA, 20 bp, Artificial Sequence
  Description of Artificial Sequence: Synthetic oligonucleotide
  Target: FXN; (-) strand; PAM type: NRG; PAM sequence: AGG
tcagtcctgctgcaaaaacc

SEQ ID NO: 11057 - DNA, 20 bp, Artificial Sequence
  Description of Artificial Sequence: Synthetic oligonucleotide
  Target: FXN; (-) strand; PAM type: NRG; PAM sequence: CAG
ctcagtcctgctgcaaaaac

SEQ ID NO: 11058 - DNA, 20 bp, Artificial Sequence
  Description of Artificial Sequence: Synthetic oligonucleotide
  Target: FXN; (-) strand; PAM type: NRG; PAM sequence: CAG
ttgagccaaaacaagggact

SEQ ID NO: 11059 - DNA, 20 bp, Artificial Sequence
  Description of Artificial Sequence: Synthetic oligonucleotide
  Target: FXN; (-) strand; PAM type: NRG; PAM sequence: GGG
ttcccattgagccaaaacaa

SEQ ID NO: 11060 - DNA, 20 bp, Artificial Sequence
  Description of Artificial Sequence: Synthetic oligonucleotide
  Target: FXN; (-) strand; PAM type: NRG; PAM sequence: AGG
cttcccattgagccaaaaca

SEQ ID NO: 11061 - DNA, 20 bp, Artificial Sequence
  Description of Artificial Sequence: Synthetic oligonucleotide
  Target: FXN; (-) strand; PAM type: NRG; PAM sequence: AAG
acttcccattgagccaaaac

SEQ ID NO: 11062 - DNA, 20 bp, Artificial Sequence
  Description of Artificial Sequence: Synthetic oligonucleotide
  Target: FXN; (-) strand; PAM type: NRG; PAM sequence: GAG
aacagcaaagacttcccatt

SEQ ID NO: 11063 - DNA, 20 bp, Artificial Sequence
  Description of Artificial Sequence: Synthetic oligonucleotide
  Target: FXN; (-) strand; PAM type: NRG; PAM sequence: AAG
agctaaggctttgaacagca

SEQ ID NO: 11064 - DNA, 20 bp, Artificial Sequence
  Description of Artificial Sequence: Synthetic oligonucleotide
  Target: FXN; (-) strand; PAM type: NRG; PAM sequence: CAG
agagaagctaaggctttgaa

SEQ ID NO: 11065 - DNA, 20 bp, Artificial Sequence
  Description of Artificial Sequence: Synthetic oligonucleotide
  Target: FXN; (-) strand; PAM type: NRG; PAM sequence: AGG
gcactcagccagagaagcta

SEQ ID NO: 11066 - DNA, 20 bp, Artificial Sequence
  Description of Artificial Sequence: Synthetic oligonucleotide
  Target: FXN; (-) strand; PAM type: NRG; PAM sequence: AAG
cgcactcagccagagaagct

SEQ ID NO: 11067 - DNA, 20 bp, Artificial Sequence
  Description of Artificial Sequence: Synthetic oligonucleotide
  Target: FXN; (-) strand; PAM type: NRG; PAM sequence: AAG
gccaccgcactcagccagag

SEQ ID NO: 11068 - DNA, 20 bp, Artificial Sequence
  Description of Artificial Sequence: Synthetic oligonucleotide
  Target: FXN; (-) strand; PAM type: NRG; PAM sequence: GAG
tgagccaccgcactcagcca

SEQ ID NO: 11069 - DNA, 20 bp, Artificial Sequence
  Description of Artificial Sequence: Synthetic oligonucleotide
  Target: FXN; (-) strand; PAM type: NRG; PAM sequence: CAG
cgtgagccaccgcactcagc

SEQ ID NO: 11070 - DNA, 20 bp, Artificial Sequence
  Description of Artificial Sequence: Synthetic oligonucleotide
  Target: FXN; (-) strand; PAM type: NRG; PAM sequence: CAG
caggcgtgagccaccgcact

SEQ ID NO: 11071 - DNA, 20 bp, Artificial Sequence
  Description of Artificial Sequence: Synthetic oligonucleotide
  Target: FXN; (-) strand; PAM type: NRG; PAM sequence: GAG
agagctaggatgacaggcgt

SEQ ID NO: 11072 - DNA, 20 bp, Artificial Sequence
  Description of Artificial Sequence: Synthetic oligonucleotide
  Target: FXN; (-) strand; PAM type: NRG; PAM sequence: AGG
tcccaaagagctaggatgac

SEQ ID NO: 11073 - DNA, 20 bp, Artificial Sequence
  Description of Artificial Sequence: Synthetic oligonucleotide
  Target: FXN; (-) strand; PAM type: NRG; PAM sequence: CAG
ctcccaaagagctaggatga

SEQ ID NO: 11074 - DNA, 20 bp, Artificial Sequence
  Description of Artificial Sequence: Synthetic oligonucleotide
  Target: FXN; (-) strand; PAM type: NRG; PAM sequence: AGG
cctcggcctcccaaagagct

SEQ ID NO: 11075 - DNA, 20 bp, Artificial Sequence
  Description of Artificial Sequence: Synthetic oligonucleotide
  Target: FXN; (-) strand; PAM type: NRG; PAM sequence: TAG
acctcggcctcccaaagagc

SEQ ID NO: 11076 - DNA, 20 bp, Artificial Sequence
  Description of Artificial Sequence: Synthetic oligonucleotide
  Target: FXN; (-) strand; PAM type: NRG; PAM sequence: GAG
gctcacctcggcctcccaaa

SEQ ID NO: 11077 - DNA, 20 bp, Artificial Sequence
  Description of Artificial Sequence: Synthetic oligonucleotide
  Target: FXN; (-) strand; PAM type: NRG; PAM sequence: AAG
ctgctcacctcggcctccca

SEQ ID NO: 11078 - DNA, 20 bp, Artificial Sequence
  Description of Artificial Sequence: Synthetic oligonucleotide
  Target: FXN; (-) strand; PAM type: NRG; PAM sequence: CGG
cctcagtgatctgctcacct

SEQ ID NO: 11079 - DNA, 20 bp, Artificial Sequence
  Description of Artificial Sequence: Synthetic oligonucleotide
  Target: FXN; (-) strand; PAM type: NRG; PAM sequence: CAG
tggtcttgaactcctggcct

SEQ ID NO: 11080 - DNA, 20 bp, Artificial Sequence
  Description of Artificial Sequence: Synthetic oligonucleotide
  Target: FXN; (-) strand; PAM type: NRG; PAM sequence: TGG
ccaggctggtcttgaactcc

SEQ ID NO: 11081 - DNA, 20 bp, Artificial Sequence
  Description of Artificial Sequence: Synthetic oligonucleotide
  Target: FXN; (-) strand; PAM type: NRG; PAM sequence: TGG
tttcaccatgttggccaggc

SEQ ID NO: 11082 - DNA, 20 bp, Artificial Sequence
  Description of Artificial Sequence: Synthetic oligonucleotide
  Target: FXN; (-) strand; PAM type: NRG; PAM sequence: AGG
agggtttcaccatgttggcc

SEQ ID NO: 11083 - DNA, 20 bp, Artificial Sequence
  Description of Artificial Sequence: Synthetic oligonucleotide
  Target: FXN; (-) strand; PAM type: NRG; PAM sequence: CAG
cagggtttcaccatgttggc

SEQ ID NO: 11084 - DNA, 20 bp, Artificial Sequence
  Description of Artificial Sequence: Synthetic oligonucleotide
  Target: FXN; (-) strand; PAM type: NRG; PAM sequence: TGG
gagacagggtttcaccatgt

SEQ ID NO: 11085 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagagaca

SEQ ID NO: 11086 - DNA, 20 bp, Artificial Sequence
  Description of Artificial Sequence: Synthetic oligonucleotide
  Target: FXN; (-) strand; PAM type: NRG; PAM sequence: AGG
tttgtatttttagtagagac

SEQ ID NO: 11087 - DNA, 20 bp, Artificial Sequence
  Description of Artificial Sequence: Synthetic oligonucleotide
  Target: FXN; (-) strand; PAM type: NRG; PAM sequence: CAG
ttttgtatttttagtagaga

SEQ ID NO: 11088 - DNA, 20 bp, Artificial Sequence
  Description of Artificial Sequence: Synthetic oligonucleotide
  Target: FXN; (-) strand; PAM type: NRG; PAM sequence: GAG
aactttttgtatttttagta

SEQ ID NO: 11089 - DNA, 20 bp, Artificial Sequence
  Description of Artificial Sequence: Synthetic oligonucleotide
  Target: FXN; (-) strand; PAM type: NRG; PAM sequence: TAG
ctaactttttgtatttttag

SEQ ID NO: 11090 - DNA, 20 bp, Artificial Sequence
  Description of Artificial Sequence: Synthetic oligonucleotide
  Target: FXN; (-) strand; PAM type: NRG; PAM sequence: TAG
tggctaactttttgtatttt

SEQ ID NO: 11091 - DNA, 20 bp, Artificial Sequence
  Description of Artificial Sequence: Synthetic oligonucleotide
  Target: FXN; (-) strand; PAM type: NRG; PAM sequence: TGG
caggtgcctgccaccacgcc

SEQ ID NO: 11092 - DNA, 20 bp, Artificial Sequence
  Description of Artificial Sequence: Synthetic oligonucleotide
  Target: FXN; (-) strand; PAM type: NRG; PAM sequence: AGG
tcccgagtagctgggattac

SEQ ID NO: 11093 - DNA, 20 bp, Artificial Sequence
  Description of Artificial Sequence: Synthetic oligonucleotide
  Target: FXN; (-) strand; PAM type: NRG; PAM sequence: CAG
ctcccgagtagctgggatta

SEQ ID NO: 11094 - DNA, 20 bp, Artificial Sequence
  Description of Artificial Sequence: Synthetic oligonucleotide
  Target: FXN; (-) strand; PAM type: NRG; PAM sequence: GGG
cctcaggctcccgagtagct

SEQ ID NO: 11095 - DNA, 20 bp, Artificial Sequence
  Description of Artificial Sequence: Synthetic oligonucleotide
  Target: FXN; (-) strand; PAM type: NRG; PAM sequence: TGG
gcctcaggctcccgagtagc

SEQ ID NO: 11096 - DNA, 20 bp, Artificial Sequence
  Description of Artificial Sequence: Synthetic oligonucleotide
  Target: FXN; (-) strand; PAM type: NRG; PAM sequence: TAG
tcctgcctcaggctcccgag

SEQ ID NO: 11097 - DNA, 20 bp, Artificial Sequence
  Description of Artificial Sequence: Synthetic oligonucleotide
  Target: FXN; (-) strand; PAM type: NRG; PAM sequence: GAG
ttctcctgcctcaggctccc

SEQ ID NO: 11098 - DNA, 20 bp, Artificial Sequence
  Description of Artificial Sequence: Synthetic oligonucleotide
  Target: FXN; (-) strand; PAM type: NRG; PAM sequence: AGG
ttaagcgattctcctgcctc

SEQ ID NO: 11099 - DNA, 20 bp, Artificial Sequence
  Description of Artificial Sequence: Synthetic oligonucleotide
  Target: FXN; (-) strand; PAM type: NRG; PAM sequence: CAG
tttaagcgattctcctgcct

SEQ ID NO: 11100 - DNA, 20 bp, Artificial Sequence
  Description of Artificial Sequence: Synthetic oligonucleotide
  Target: FXN; (-) strand; PAM type: NRG; PAM sequence: AAG
agcctccatctcctgggttt

SEQ ID NO: 11101 - DNA, 20 bp, Artificial Sequence
  Description of Artificial Sequence: Synthetic oligonucleotide
  Target: FXN; (-) strand; PAM type: NRG; PAM sequence: GGG
cactgcagcctccatctcct

SEQ ID NO: 11102 - DNA, 20 bp, Artificial Sequence
  Description of Artificial Sequence: Synthetic oligonucleotide
  Target: FXN; (-) strand; PAM type: NRG; PAM sequence: TGG
tcactgcagcctccatctcc

SEQ ID NO: 11103 - DNA, 20 bp, Artificial Sequence
  Description of Artificial Sequence: Synthetic oligonucleotide
  Target: FXN; (-) strand; PAM type: NRG; PAM sequence: CAG
ggcatgatctcagctcactg

SEQ ID NO: 11104 - DNA, 20 bp, Artificial Sequence
  Description of Artificial Sequence: Synthetic oligonucleotide
  Target: FXN; (-) strand; PAM type: NRG; PAM sequence: CAG
ggagtgcaatggcatgatct

SEQ ID NO: 11105 - DNA, 20 bp, Artificial Sequence
  Description of Artificial Sequence: Synthetic oligonucleotide
  Target: FXN; (-) strand; PAM type: NRG; PAM sequence: TGG
ttacccaggctggagtgcaa

SEQ ID NO: 11106 - DNA, 20 bp, Artificial Sequence
  Description of Artificial Sequence: Synthetic oligonucleotide
  Target: FXN; (-) strand; PAM type: NRG; PAM sequence: GAG
ttcgctcgttacccaggctg

SEQ ID NO: 11107 - DNA, 20 bp, Artificial Sequence
  Description of Artificial Sequence: Synthetic oligonucleotide
  Target: FXN; (-) strand; PAM type: NRG; PAM sequence: TGG
atttcgctcgttacccaggc

SEQ ID NO: 11108 - DNA, 20 bp, Artificial Sequence
  Description of Artificial Sequence: Synthetic oligonucleotide
  Target: FXN; (-) strand; PAM type: NRG; PAM sequence: AGG
tggaatttcgctcgttaccc

SEQ ID NO: 11109 - DNA, 20 bp, Artificial Sequence
  Description of Artificial Sequence: Synthetic oligonucleotide
  Target: FXN; (-) strand; PAM type: NRG; PAM sequence: CAG
atggaatttcgctcgttacc

SEQ ID NO: 11110 - DNA, 20 bp, Artificial Sequence
  Description of Artificial Sequence: Synthetic oligonucleotide
  Target: FXN; (-) strand; PAM type: NRG; PAM sequence: TGG
ttttttcttttttttagaga

SEQ ID NO: 11111 - DNA, 20 bp, Artificial Sequence
  Description of Artificial Sequence: Synthetic oligonucleotide
  Target: FXN; (-) strand; PAM type: NRG; PAM sequence: GAG
ttttttttttctttttttta

SEQ ID NO: 11112 - DNA, 20 bp, Artificial Sequence
  Description of Artificial Sequence: Synthetic oligonucleotide
  Target: FXN; (-) strand; PAM type: NRG; PAM sequence: TAG
ccttttttttttcttttttt

SEQ ID NO: 11113 - DNA, 20 bp, Artificial Sequence
  Description of Artificial Sequence: Synthetic oligonucleotide
  Target: FXN; (-) strand; PAM type: NRG; PAM sequence: AGG
aaagtcaaagggagaatcta

SEQ ID NO: 11114 - DNA, 20 bp, Artificial Sequence
  Description of Artificial Sequence: Synthetic oligonucleotide
  Target: FXN; (-) strand; PAM type: NRG; PAM sequence: AAG
gaaagtcaaagggagaatct

SEQ ID NO: 11115 - DNA, 20 bp, Artificial Sequence
  Description of Artificial Sequence: Synthetic oligonucleotide
  Target: FXN; (-) strand; PAM type: NRG; PAM sequence: GAG
caaacgtggaaagtcaaagg

SEQ ID NO: 11116 - DNA, 20 bp, Artificial Sequence
  Description of Artificial Sequence: Synthetic oligonucleotide
  Target: FXN; (-) strand; PAM type: NRG; PAM sequence: GGG
cacaaacgtggaaagtcaaa

SEQ ID NO: 11117 - DNA, 20 bp, Artificial Sequence
  Description of Artificial Sequence: Synthetic oligonucleotide
  Target: FXN; (-) strand; PAM type: NRG; PAM sequence: AGG
gcacaaacgtggaaagtcaa

SEQ ID NO: 11118 - DNA, 20 bp, Artificial Sequence
  Description of Artificial Sequence: Synthetic oligonucleotide
  Target: FXN; (-) strand; PAM type: NRG; PAM sequence: AAG
tgcacaaacgtggaaagtca

SEQ ID NO: 11119 - DNA, 20 bp, Artificial Sequence
  Description of Artificial Sequence: Synthetic oligonucleotide
  Target: FXN; (-) strand; PAM type: NRG; PAM sequence: AAG
aaaggctgcacaaacgtgga

SEQ ID NO: 11120 - DNA, 20 bp, Artificial Sequence
  Description of Artificial Sequence: Synthetic oligonucleotide
  Target: FXN; (-) strand; PAM type: NRG; PAM sequence: TGG
gataaaaggctgcacaaacg

SEQ ID NO: 11121 - DNA, 20 bp, Artificial Sequence
  Description of Artificial Sequence: Synthetic oligonucleotide
  Target: FXN; (-) strand; PAM type: NRG; PAM sequence: AGG
aatggagcattggagataaa

SEQ ID NO: 11122 - DNA, 20 bp, Artificial Sequence
  Description of Artificial Sequence: Synthetic oligonucleotide
  Target: FXN; (-) strand; PAM type: NRG; PAM sequence: AAG
aaatggagcattggagataa

SEQ ID NO: 11123 - DNA, 20 bp, Artificial Sequence
  Description of Artificial Sequence: Synthetic oligonucleotide
  Target: FXN; (-) strand; PAM type: NRG; PAM sequence: GAG
tggaatgaaatggagcattg

SEQ ID NO: 11124 - DNA, 20 bp, Artificial Sequence
  Description of Artificial Sequence: Synthetic oligonucleotide
  Target: FXN; (-) strand; PAM type: NRG; PAM sequence: TGG
gatggaatgaaatggagcat

SEQ ID NO: 11125 - DNA, 20 bp, Artificial Sequence
  Description of Artificial Sequence: Synthetic oligonucleotide
  Target: FXN; (-) strand; PAM type: NRG; PAM sequence: GAG
ccaggagatggaatgaaatg

SEQ ID NO: 11126 - DNA, 20 bp, Artificial Sequence
  Description of Artificial Sequence: Synthetic oligonucleotide
  Target: FXN; (-) strand; PAM type: NRG; PAM sequence: TGG
agccaggagatggaatgaaa

SEQ ID NO: 11127 - DNA, 20 bp, Artificial Sequence
  Description of Artificial Sequence: Synthetic oligonucleotide
  Target: FXN; (-) strand; PAM type: NRG; PAM sequence: TGG
gaaaagaataagccaggaga

SEQ ID NO: 11128 - DNA, 20 bp, Artificial Sequence
  Description of Artificial Sequence: Synthetic oligonucleotide
  Target: FXN; (-) strand; PAM type: NRG; PAM sequence: GAG
acaagaaaagaataagccag

SEQ ID NO: 11129 - DNA, 20 bp, Artificial Sequence
  Description of Artificial Sequence: Synthetic oligonucleotide
  Target: FXN; (-) strand; PAM type: NRG; PAM sequence: AGG
tgacaagaaaagaataagcc

SEQ ID NO: 11130 - DNA, 20 bp, Artificial Sequence
  Description of Artificial Sequence: Synthetic oligonucleotide
  Target: FXN; (-) strand; PAM type: NRG; PAM sequence: CAG
gtgacaagaaaagaataagc

SEQ ID NO: 11131 - DNA, 20 bp, Artificial Sequence
  Description of Artificial Sequence: Synthetic oligonucleotide
  Target: FXN; (-) strand; PAM type: NRG; PAM sequence: AAG
agatgtgacaagaaaagaat

SEQ ID NO: 11132 - DNA, 20 bp, Artificial Sequence
  Description of Artificial Sequence: Synthetic oligonucleotide
  Target: FXN; (-) strand; PAM type: NRG; PAM sequence: AAG
tttagtagatgtgacaagaa

SEQ ID NO: 11133 - DNA, 20 bp, Artificial Sequence
  Description of Artificial Sequence: Synthetic oligonucleotide
  Target: FXN; (-) strand; PAM type: NRG; PAM sequence: AAG
ttgcttttagtagatgtgac

SEQ ID NO: 11134 - DNA, 20 bp, Artificial Sequence
  Description of Artificial Sequence: Synthetic oligonucleotide
  Target: FXN; (-) strand; PAM type: NRG; PAM sequence: TAG
tggcttcttgttgcttttag

SEQ ID NO: 11135 - DNA, 20 bp, Artificial Sequence
  Description of Artificial Sequence: Synthetic oligonucleotide
  Target: FXN; (-) strand; PAM type: NRG; PAM sequence: TAG
cggtggcttcttgttgcttt

SEQ ID NO: 11136 - DNA, 20 bp, Artificial Sequence
  Description of Artificial Sequence: Synthetic oligonucleotide
  Target: FXN; (-) strand; PAM type: NRG; PAM sequence: TGG
agaatgttcctgaataccgg

SEQ ID NO: 11137 - DNA, 20 bp, Artificial Sequence
  Description of Artificial Sequence: Synthetic oligonucleotide
  Target: FXN; (-) strand; PAM type: NRG; PAM sequence: CGG
ggtagaatgttcctgaatac

SEQ ID NO: 11138 - DNA, 20 bp, Artificial Sequence
  Description of Artificial Sequence: Synthetic oligonucleotide
  Target: FXN; (-) strand; PAM type: NRG; PAM sequence: TAG
catatagctctggggacagg

SEQ ID NO: 11139 - DNA, 20 bp, Artificial Sequence
  Description of Artificial Sequence: Synthetic oligonucleotide
  Target: FXN; (-) strand; PAM type: NRG; PAM sequence: AGG
gagcatatagctctggggac

SEQ ID NO: 11140 - DNA, 20 bp, Artificial Sequence
  Description of Artificial Sequence: Synthetic oligonucleotide
  Target: FXN; (-) strand; PAM type: NRG; PAM sequence: CAG
tgagcatatagctctgggga

SEQ ID NO: 11141 - DNA, 20 bp, Artificial Sequence
  Description of Artificial Sequence: Synthetic oligonucleotide
  Target: FXN; (-) strand; PAM type: NRG; PAM sequence: GGG
ctactgagcatatagctctg

SEQ ID NO: 11142 - DNA, 20 bp, Artificial Sequence
  Description of Artificial Sequence: Synthetic oligonucleotide
  Target: FXN; (-) strand; PAM type: NRG; PAM sequence: GGG
cctactgagcatatagctct

SEQ ID NO: 11143 - DNA, 20 bp, Artificial Sequence
  Description of Artificial Sequence: Synthetic oligonucleotide
  Target: FXN; (-) strand; PAM type: NRG; PAM sequence: TGG
gcctactgagcatatagctc

SEQ ID NO: 11144 - DNA, 20 bp, Artificial Sequence
  Description of Artificial Sequence: Synthetic oligonucleotide
  Target: FXN; (-) strand; PAM type: NRG; PAM sequence: TAG
ctgtatgcctactgagcata

SEQ ID NO: 11145 - DNA, 20 bp, Artificial Sequence
  Description of Artificial Sequence: Synthetic oligonucleotide
  Target: FXN; (-) strand; PAM type: NRG; PAM sequence: GAG
gggccaactgtatgcctact

SEQ ID NO: 11146 - DNA, 20 bp, Artificial Sequence
  Description of Artificial Sequence: Synthetic oligonucleotide
  Target: FXN; (-) strand; PAM type: NRG; PAM sequence: GGG
tgagtctcagataacctgga

SEQ ID NO: 11147 - DNA, 20 bp, Artificial Sequence
  Description of Artificial Sequence: Synthetic oligonucleotide
  Target: FXN; (-) strand; PAM type: NRG; PAM sequence: AGG
ctgagtctcagataacctgg

SEQ ID NO: 11148 - DNA, 20 bp, Artificial Sequence
  Description of Artificial Sequence: Synthetic oligonucleotide
  Target: FXN; (-) strand; PAM type: NRG; PAM sequence: GAG
tctgagtctcagataacctg

SEQ ID NO: 11149 - DNA, 20 bp, Artificial Sequence
  Description of Artificial Sequence: Synthetic oligonucleotide
  Target: FXN; (-) strand; PAM type: NRG; PAM sequence: TGG
aatctgagtctcagataacc

SEQ ID NO: 11150 - DNA, 20 bp, Artificial Sequence
  Description of Artificial Sequence: Synthetic oligonucleotide
  Target: FXN; (-) strand; PAM type: NRG; PAM sequence: CAG
ccctctggaaatctgagtct

SEQ ID NO: 11151 - DNA, 20 bp, Artificial Sequence
  Description of Artificial Sequence: Synthetic oligonucleotide
  Target: FXN; (-) strand; PAM type: NRG; PAM sequence: GAG
gcaaagccctctggaaatct

SEQ ID NO: 11152 - DNA, 20 bp, Artificial Sequence
  Description of Artificial Sequence: Synthetic oligonucleotide
  Target: FXN; (-) strand; PAM type: NRG; PAM sequence: TGG
gtgagccatgcaaagccctc

SEQ ID NO: 11153 - DNA, 20 bp, Artificial Sequence
  Description of Artificial Sequence: Synthetic oligonucleotide
  Target: FXN; (-) strand; PAM type: NRG; PAM sequence: AAG
cagaccttgtgagccatgca

SEQ ID NO: 11154 - DNA, 20 bp, Artificial Sequence
  Description of Artificial Sequence: Synthetic oligonucleotide
  Target: FXN; (-) strand; PAM type: NRG; PAM sequence: GAG
agaggttcttcagaccttgt

SEQ ID NO: 11155 - DNA, 20 bp, Artificial Sequence
  Description of Artificial Sequence: Synthetic oligonucleotide
  Target: FXN; (-) strand; PAM type: NRG; PAM sequence: CAG
cgggaggctcagaggttctt

SEQ ID NO: 11156 - DNA, 20 bp, Artificial Sequence
  Description of Artificial Sequence: Synthetic oligonucleotide
  Target: FXN; (-) strand; PAM type: NRG; PAM sequence: AGG
accgcaggcgggaggctcag

SEQ ID NO: 11157 - DNA, 20 bp, Artificial Sequence
  Description of Artificial Sequence: Synthetic oligonucleotide
  Target: FXN; (-) strand; PAM type: NRG; PAM sequence: GAG
caccgcaggcgggaggctca

SEQ ID NO: 11158 - DNA, 20 bp, Artificial Sequence
  Description of Artificial Sequence: Synthetic oligonucleotide
  Target: FXN; (-) strand; PAM type: NRG; PAM sequence: CAG
gacaccgcaggcgggaggct

SEQ ID NO: 11159 - DNA, 20 bp, Artificial Sequence
  Description of Artificial Sequence: Synthetic oligonucleotide
  Target: FXN; (-) strand; PAM type: NRG; PAM sequence: AGG
gaacagacaccgcaggcggg

SEQ ID NO: 11160 - DNA, 20 bp, Artificial Sequence
  Description of Artificial Sequence: Synthetic oligonucleotide
  Target: FXN; (-) strand; PAM type: NRG; PAM sequence: GAG
tgaacagacaccgcaggcgg

SEQ ID NO: 11161 - DNA, 20 bp, Artificial Sequence
  Description of Artificial Sequence: Synthetic oligonucleotide
  Target: FXN; (-) strand; PAM type: NRG; PAM sequence: GGG
aatgaacagacaccgcaggc

SEQ ID NO: 11162 - DNA, 20 bp, Artificial Sequence
  Description of Artificial Sequence: Synthetic oligonucleotide
  Target: FXN; (-) strand; PAM type: NRG; PAM sequence: CGG
caatgaacagacaccgcagg

SEQ ID NO: 11163 - DNA, 20 bp, Artificial Sequence
  Description of Artificial Sequence: Synthetic oligonucleotide
  Target: FXN; (-) strand; PAM type: NRG; PAM sequence: AGG
agtcaatgaacagacaccgc

SEQ ID NO: 11164 - DNA, 20 bp, Artificial Sequence
  Description of Artificial Sequence: Synthetic oligonucleotide
  Target: FXN; (-) strand; PAM type: NRG; PAM sequence: CAG
aagtcaatgaacagacaccg

SEQ ID NO: 11165 - DNA, 20 bp, Artificial Sequence
  Description of Artificial Sequence: Synthetic oligonucleotide
  Target: FXN; (-) strand; PAM type: NRG; PAM sequence: CAG
actgtggcaaagtcaatgaa

SEQ ID NO: 11166 - DNA, 20 bp, Artificial Sequence
  Description of Artificial Sequence: Synthetic oligonucleotide
  Target: FXN; (-) strand; PAM type: NRG; PAM sequence: AAG
gcctctttgagactgtggca

SEQ ID NO: 11167 - DNA, 20 bp, Artificial Sequence
  Description of Artificial Sequence: Synthetic oligonucleotide
  Target: FXN; (-) strand; PAM type: NRG; PAM sequence: TGG
gcagtgcctctttgagactg

SEQ ID NO: 11168 - DNA, 20 bp, Artificial Sequence
  Description of Artificial Sequence: Synthetic oligonucleotide
  Target: FXN; (-) strand; PAM type: NRG; PAM sequence: GAG
gcagcatgcagtgcctcttt

SEQ ID NO: 11169 - DNA, 20 bp, Artificial Sequence
  Description of Artificial Sequence: Synthetic oligonucleotide
  Target: FXN; (-) strand; PAM type: NRG; PAM sequence: CAG
aacctcaaacatgcagcatg

SEQ ID NO: 11170 - DNA, 20 bp, Artificial Sequence
  Description of Artificial Sequence: Synthetic oligonucleotide
  Target: FXN; (-) strand; PAM type: NRG; PAM sequence: CAG
aagcaaaaacctcaaacatg

SEQ ID NO: 11171 - DNA, 20 bp, Artificial Sequence
  Description of Artificial Sequence: Synthetic oligonucleotide
  Target: FXN; (-) strand; PAM type: NRG; PAM sequence: AAG
gctggaaatggatgccacca

SEQ ID NO: 11172 - DNA, 20 bp, Artificial Sequence
  Description of Artificial Sequence: Synthetic oligonucleotide
  Target: FXN; (-) strand; PAM type: NRG; PAM sequence: TGG
ccggaagccgaggctggaaa

SEQ ID NO: 11173 - DNA, 20 bp, Artificial Sequence
  Description of Artificial Sequence: Synthetic oligonucleotide
  Target: FXN; (-) strand; PAM type: NRG; PAM sequence: TGG
ggaatgccggaagccgaggc

SEQ ID NO: 11174 - DNA, 20 bp, Artificial Sequence
  Description of Artificial Sequence: Synthetic oligonucleotide
  Target: FXN; (-) strand; PAM type: NRG; PAM sequence: AGG
gggaggaatgccggaagccg

SEQ ID NO: 11175 - DNA, 20 bp, Artificial Sequence
  Description of Artificial Sequence: Synthetic oligonucleotide
  Target: FXN; (-) strand; PAM type: NRG; PAM sequence: GAG
ggggaggaatgccggaagcc

SEQ ID NO: 11176 - DNA, 20 bp, Artificial Sequence
  Description of Artificial Sequence: Synthetic oligonucleotide
  Target: FXN; (-) strand; PAM type: NRG; PAM sequence: AAG
tgctgggggaggaatgccgg

SEQ ID NO: 11177 - DNA, 20 bp, Artificial Sequence
  Description of Artificial Sequence: Synthetic oligonucleotide
  Target: FXN; (-) strand; PAM type: NRG; PAM sequence: CGG
gtctgctgggggaggaatgc

SEQ ID NO: 11178 - DNA, 20 bp, Artificial Sequence
  Description of Artificial Sequence: Synthetic oligonucleotide
  Target: FXN; (-) strand; PAM type: NRG; PAM sequence: AGG
agcagagagtctgctggggg

SEQ ID NO: 11179 - DNA, 20 bp, Artificial Sequence
  Description of Artificial Sequence: Synthetic oligonucleotide
  Target: FXN; (-) strand; PAM type: NRG; PAM sequence: GAG
cagcagagagtctgctgggg

SEQ ID NO: 11180 - DNA, 20 bp, Artificial Sequence
  Description of Artificial Sequence: Synthetic oligonucleotide
  Target: FXN; (-) strand; PAM type: NRG; PAM sequence: GGG
agcagcagagagtctgctgg

SEQ ID NO: 11181 - DNA, 20 bp, Artificial Sequence
  Description of Artificial Sequence: Synthetic oligonucleotide
  Target: FXN; (-) strand; PAM type: NRG; PAM sequence: GGG
aagcagcagagagtctgctg

SEQ ID NO: 11182 - DNA, 20 bp, Artificial Sequence
  Description of Artificial Sequence: Synthetic oligonucleotide
  Target: FXN; (-) strand; PAM type: NRG; PAM sequence: GGG
aaagcagcagagagtctgct

SEQ ID NO: 11183 - DNA, 20 bp, Artificial Sequence
  Description of Artificial Sequence: Synthetic oligonucleotide
  Target: FXN; (-) strand; PAM type: NRG; PAM sequence: TGG
gaaagcagcagagagtctgc

SEQ ID NO: 11184 - DNA, 20 bp, Artificial Sequence
  Description of Artificial Sequence: Synthetic oligonucleotide
  Target: FXN; (-) strand; PAM type: NRG; PAM sequence: GAG
agtaaggggaaagcagcaga

SEQ ID NO: 11185 - DNA, 20 bp, Artificial Sequence
  Description of Artificial Sequence: Synthetic oligonucleotide
  Target: FXN; (-) strand; PAM type: NRG; PAM sequence: GAG
ggagtaaggggaaagcagca

SEQ ID NO: 11186 - DNA, 20 bp, Artificial Sequence
  Description of Artificial Sequence: Synthetic oligonucleotide
  Target: FXN; (-) strand; PAM type: NRG; PAM sequence: CAG
aaggagtaaggggaaagcag

SEQ ID NO: 11187 - DNA, 20 bp, Artificial Sequence
  Description of Artificial Sequence: Synthetic oligonucleotide
  Target: FXN; (-) strand; PAM type: NRG; PAM sequence: CAG
cagaaggagtaaggggaaag

SEQ ID NO: 11188 - DNA, 20 bp, Artificial Sequence
  Description of Artificial Sequence: Synthetic oligonucleotide
  Target: FXN; (-) strand; PAM type: NRG; PAM sequence: AAG
tgccagaaggagtaagggga

SEQ ID NO: 11189 - DNA, 20 bp, Artificial Sequence
  Description of Artificial Sequence: Synthetic oligonucleotide
  Target: FXN; (-) strand; PAM type: NRG; PAM sequence: GGG
gaactgccagaaggagtaag

SEQ ID NO: 11190 - DNA, 20 bp, Artificial Sequence
  Description of Artificial Sequence: Synthetic oligonucleotide
  Target: FXN; (-) strand; PAM type: NRG; PAM sequence: GGG
agaactgccagaaggagtaa

SEQ ID NO: 11191 - DNA, 20 bp, Artificial Sequence
  Description of Artificial Sequence: Synthetic oligonucleotide
  Target: FXN; (-) strand; PAM type: NRG; PAM sequence: AGG
cagaactgccagaaggagta

SEQ ID NO: 11192 - DNA, 20 bp, Artificial Sequence
  Description of Artificial Sequence: Synthetic oligonucleotide
  Target: FXN; (-) strand; PAM type: NRG; PAM sequence: AAG
ccagaactgccagaaggagt

SEQ ID NO: 11193 - DNA, 20 bp, Artificial Sequence
  Description of Artificial Sequence: Synthetic oligonucleotide
  Target: FXN; (-) strand; PAM type: NRG; PAM sequence: GAG
cctcccagaactgccagaag

SEQ ID NO: 11194 - DNA, 20 bp, Artificial Sequence
  Description of Artificial Sequence: Synthetic oligonucleotide
  Target: FXN; (-) strand; PAM type: NRG; PAM sequence: AGG
aacctcccagaactgccaga

SEQ ID NO: 11195 - DNA, 20 bp, Artificial Sequence
  Description of Artificial Sequence: Synthetic oligonucleotide
  Target: FXN; (-) strand; PAM type: NRG; PAM sequence: AAG
caacctcccagaactgccag

SEQ ID NO: 11196 - DNA, 20 bp, Artificial Sequence
  Description of Artificial Sequence: Synthetic oligonucleotide
  Target: FXN; (-) strand; PAM type: NRG; PAM sequence: CAG
atgcaacctcccagaactgc

SEQ ID NO: 11197 - DNA, 20 bp, Artificial Sequence
  Description of Artificial Sequence: Synthetic oligonucleotide
  Target: FXN; (-) strand; PAM type: NRG; PAM sequence: CAG
aagggccctatgcaacctcc

SEQ ID NO: 11198 - DNA, 20 bp, Artificial Sequence
  Description of Artificial Sequence: Synthetic oligonucleotide
  Target: FXN; (-) strand; PAM type: NRG; PAM sequence: GGG
ggacttggggcatcctgcaa

SEQ ID NO: 11199 - DNA, 20 bp, Artificial Sequence
  Description of Artificial Sequence: Synthetic oligonucleotide
  Target: FXN; (-) strand; PAM type: NRG; PAM sequence: AGG
tggacttggggcatcctgca

SEQ ID NO: 11200 - DNA, 20 bp, Artificial Sequence
  Description of Artificial Sequence: Synthetic oligonucleotide
  Target: FXN; (-) strand; PAM type: NRG; PAM sequence: AAG
ctggacttggggcatcctgc

SEQ ID NO: 11201 - DNA, 20 bp, Artificial Sequence
  Description of Artificial Sequence: Synthetic oligonucleotide
  Target: FXN; (-) strand; PAM type: NRG; PAM sequence: GGG
gccagaggcagctggacttg

SEQ ID NO: 11202 - DNA, 20 bp, Artificial Sequence
  Description of Artificial Sequence: Synthetic oligonucleotide
  Target: FXN; (-) strand; PAM type: NRG; PAM sequence: GGG
ggccagaggcagctggactt

SEQ ID NO: 11203 - DNA, 20 bp, Artificial Sequence
  Description of Artificial Sequence: Synthetic oligonucleotide
  Target: FXN; (-) strand; PAM type: NRG; PAM sequence: TGG
aggccagaggcagctggact

SEQ ID NO: 11204 - DNA, 20 bp, Artificial Sequence
  Description of Artificial Sequence: Synthetic oligonucleotide
  Target: FXN; (-) strand; PAM type: NRG; PAM sequence: TGG
tcccagaggccagaggcagc

SEQ ID NO: 11205 - DNA, 20 bp, Artificial Sequence
  Description of Artificial Sequence: Synthetic oligonucleotide
  Target: FXN; (-) strand; PAM type: NRG; PAM sequence: CAG
tgcttcccagaggccagagg

SEQ ID NO: 11206 - DNA, 20 bp, Artificial Sequence
  Description of Artificial Sequence: Synthetic oligonucleotide
  Target: FXN; (-) strand; PAM type: NRG; PAM sequence: AGG
gtgtgcttcccagaggccag

SEQ ID NO: 11207 - DNA, 20 bp, Artificial Sequence
  Description of Artificial Sequence: Synthetic oligonucleotide
  Target: FXN; (-) strand; PAM type: NRG; PAM sequence: GAG
ggtgtgcttcccagaggcca

SEQ ID NO: 11208 - DNA, 20 bp, Artificial Sequence
  Description of Artificial Sequence: Synthetic oligonucleotide
  Target: FXN; (-) strand; PAM type: NRG; PAM sequence: CAG
agggtgtgcttcccagaggc

SEQ ID NO: 11209 - DNA, 20 bp, Artificial Sequence
  Description of Artificial Sequence: Synthetic oligonucleotide
  Target: FXN; (-) strand; PAM type: NRG; PAM sequence: AGG
gtcaagggtgtgcttcccag

SEQ ID NO: 11210 - DNA, 20 bp, Artificial Sequence
  Description of Artificial Sequence: Synthetic oligonucleotide
  Target: FXN; (-) strand; PAM type: NRG; PAM sequence: GAG
ggtcaagggtgtgcttccca

SEQ ID NO: 11211 - DNA, 20 bp, Artificial Sequence
  Description of Artificial Sequence: Synthetic oligonucleotide
  Target: FXN; (-) strand; PAM type: NRG; PAM sequence: CAG
caggtcaagggtgtgcttcc

SEQ ID NO: 11212 - DNA, 20 bp, Artificial Sequence
  Description of Artificial Sequence: Synthetic oligonucleotide
  Target: FXN; (-) strand; PAM type: NRG; PAM sequence: GGG
tcctacacatggcaggtcaa

SEQ ID NO: 11213 - DNA, 20 bp, Artificial Sequence
  Description of Artificial Sequence: Synthetic oligonucleotide
  Target: FXN; (-) strand; PAM type: NRG; PAM sequence: AGG
ttcctacacatggcaggtca

SEQ ID NO: 11214 - DNA, 20 bp, Artificial Sequence
  Description of Artificial Sequence: Synthetic oligonucleotide
  Target: FXN; (-) strand; PAM type: NRG; PAM sequence: AAG
cttcctacacatggcaggtc

SEQ ID NO: 11215 - DNA, 20 bp, Artificial Sequence
  Description of Artificial Sequence: Synthetic oligonucleotide
  Target: FXN; (-) strand; PAM type: NRG; PAM sequence: AGG
gctgtcttcctacacatggc

SEQ ID NO: 11216 - DNA, 20 bp, Artificial Sequence
  Description of Artificial Sequence: Synthetic oligonucleotide
  Target: FXN; (-) strand; PAM type: NRG; PAM sequence: CAG
ggctgtcttcctacacatgg

SEQ ID NO: 11217 - DNA, 20 bp, Artificial Sequence
  Description of Artificial Sequence: Synthetic oligonucleotide
  Target: FXN; (-) strand; PAM type: NRG; PAM sequence: TGG
gcgggctgtcttcctacaca

SEQ ID NO: 11218 - DNA, 20 bp, Artificial Sequence
  Description of Artificial Sequence: Synthetic oligonucleotide
  Target: FXN; (-) strand; PAM type: NRG; PAM sequence: GGG
agttgggccctggcagaagc

SEQ ID NO: 11219 - DNA, 20 bp, Artificial Sequence
  Description of Artificial Sequence: Synthetic oligonucleotide
  Target: FXN; (-) strand; PAM type: NRG; PAM sequence: CGG
gagttgggccctggcagaag

SEQ ID NO: 11220 - DNA, 20 bp, Artificial Sequence
  Description of Artificial Sequence: Synthetic oligonucleotide
  Target: FXN; (-) strand; PAM type: NRG; PAM sequence: AAG
gcagagttgggccctggcag

SEQ ID NO: 11221 - DNA, 20 bp, Artificial Sequence
  Description of Artificial Sequence: Synthetic oligonucleotide
  Target: FXN; (-) strand; PAM type: NRG; PAM sequence: CAG
ccggcagagttgggccctgg

SEQ ID NO: 11222 - DNA, 20 bp, Artificial Sequence
  Description of Artificial Sequence: Synthetic oligonucleotide
  Target: FXN; (-) strand; PAM type: NRG; PAM sequence: TGG
ctgccggcagagttgggccc

SEQ ID NO: 11223 - DNA, 20 bp, Artificial Sequence
  Description of Artificial Sequence: Synthetic oligonucleotide
  Target: FXN; (-) strand; PAM type: NRG; PAM sequence: GGG
tgctacctgccggcagagtt

SEQ ID NO: 11224 - DNA, 20 bp, Artificial Sequence
  Description of Artificial Sequence: Synthetic oligonucleotide
  Target: FXN; (-) strand; PAM type: NRG; PAM sequence: TGG
gtgctacctgccggcagagt

SEQ ID NO: 11225 - DNA, 20 bp, Artificial Sequence
  Description of Artificial Sequence: Synthetic oligonucleotide
  Target: FXN; (-) strand; PAM type: NRG; PAM sequence: GAG
gaaggtgctacctgccggca

SEQ ID NO: 11226 - DNA, 20 bp, Artificial Sequence
  Description of Artificial Sequence: Synthetic oligonucleotide
  Target: FXN; (-) strand; PAM type: NRG; PAM sequence: CAG
tggaaggtgctacctgccgg

SEQ ID NO: 11227 - DNA, 20 bp, Artificial Sequence
  Description of Artificial Sequence: Synthetic oligonucleotide
  Target: FXN; (-) strand; PAM type: NRG; PAM sequence: CGG
ggttggaaggtgctacctgc

SEQ ID NO: 11228 - DNA, 20 bp, Artificial Sequence
  Description of Artificial Sequence: Synthetic oligonucleotide
  Target: FXN; (-) strand; PAM type: NRG; PAM sequence: AGG
tccaaagtgaagaggttgga

SEQ ID NO: 11229 - DNA, 20 bp, Artificial Sequence
  Description of Artificial Sequence: Synthetic oligonucleotide
  Target: FXN; (-) strand; PAM type: NRG; PAM sequence: AAG
gtccaaagtgaagaggttgg

SEQ ID NO: 11230 - DNA, 20 bp, Artificial Sequence
  Description of Artificial Sequence: Synthetic oligonucleotide
  Target: FXN; (-) strand; PAM type: NRG; PAM sequence: TGG
aaagtccaaagtgaagaggt

SEQ ID NO: 11231 - DNA, 20 bp, Artificial Sequence
  Description of Artificial Sequence: Synthetic oligonucleotide
  Target: FXN; (-) strand; PAM type: NRG; PAM sequence: AGG
ttataaagtccaaagtgaag

SEQ ID NO: 11232 - DNA, 20 bp, Artificial Sequence
  Description of Artificial Sequence: Synthetic oligonucleotide
  Target: FXN; (-) strand; PAM type: NRG; PAM sequence: GAG
gttataaagtccaaagtgaa

SEQ ID NO: 11233 - DNA, 20 bp, Artificial Sequence
  Description of Artificial Sequence: Synthetic oligonucleotide
  Target: FXN; (-) strand; PAM type: NRG; PAM sequence: AAG
cagttataaagtccaaagtg

SEQ ID NO: 11234 - DNA, 20 bp, Artificial Sequence
  Description of Artificial Sequence: Synthetic oligonucleotide
  Target: FXN; (-) strand; PAM type: NRG; PAM sequence: AAG
cctgacagttataaagtcca

SEQ ID NO: 11235 - DNA, 20 bp, Artificial Sequence
  Description of Artificial Sequence: Synthetic oligonucleotide
  Target: FXN; (-) strand; PAM type: NRG; PAM sequence: AAG
ctttatacctgacagttata

SEQ ID NO: 11236 - DNA, 20 bp, Artificial Sequence
  Description of Artificial Sequence: Synthetic oligonucleotide
  Target: FXN; (-) strand; PAM type: NRG; PAM sequence: CAG
acaaccgactttatacctga

SEQ ID NO: 11237 - DNA, 20 bp, Artificial Sequence
  Description of Artificial Sequence: Synthetic oligonucleotide
  Target: FXN; (-) strand; PAM type: NRG; PAM sequence: AGG
tgaagaatttgagaaacgta

SEQ ID NO: 11238 - DNA, 20 bp, Artificial Sequence
  Description of Artificial Sequence: Synthetic oligonucleotide
  Target: FXN; (-) strand; PAM type: NRG; PAM sequence: AAG
ttgaagaatttgagaaacgt

SEQ ID NO: 11239 - DNA, 20 bp, Artificial Sequence
  Description of Artificial Sequence: Synthetic oligonucleotide
  Target: FXN; (-) strand; PAM type: NRG; PAM sequence: GAG
tgacgtgtcttgaagaattt

SEQ ID NO: 11240 - DNA, 20 bp, Artificial Sequence
  Description of Artificial Sequence: Synthetic oligonucleotide
  Target: FXN; (-) strand; PAM type: NRG; PAM sequence: AAG
aggctggttgacgtgtcttg

SEQ ID NO: 11241 - DNA, 20 bp, Artificial Sequence
  Description of Artificial Sequence: Synthetic oligonucleotide
  Target: FXN; (-) strand; PAM type: NRG; PAM sequence: TGG
agagaatgcgtaggagaggc

SEQ ID NO: 11242 - DNA, 20 bp, Artificial Sequence
  Description of Artificial Sequence: Synthetic oligonucleotide
  Target: FXN; (-) strand; PAM type: NRG; PAM sequence: AGG
ctggagagaatgcgtaggag

SEQ ID NO: 11243 - DNA, 20 bp, Artificial Sequence
  Description of Artificial Sequence: Synthetic oligonucleotide
  Target: FXN; (-) strand; PAM type: NRG; PAM sequence: GAG
gctggagagaatgcgtagga

SEQ ID NO: 11244 - DNA, 20 bp, Artificial Sequence
  Description of Artificial Sequence: Synthetic oligonucleotide
  Target: FXN; (-) strand; PAM type: NRG; PAM sequence: GAG
gagctggagagaatgcgtag

SEQ ID NO: 11245 - DNA, 20 bp, Artificial Sequence
  Description of Artificial Sequence: Synthetic oligonucleotide
  Target: FXN; (-) strand; PAM type: NRG; PAM sequence: AGG
ctgagctggagagaatgcgt

SEQ ID NO: 11246 - DNA, 20 bp, Artificial Sequence
  Description of Artificial Sequence: Synthetic oligonucleotide
  Target: FXN; (-) strand; PAM type: NRG; PAM sequence: TAG
actgagctggagagaatgcg

SEQ ID NO: 11247 - DNA, 20 bp, Artificial Sequence
  Description of Artificial Sequence: Synthetic oligonucleotide
  Target: FXN; (-) strand; PAM type: NRG; PAM sequence: GAG
tgttttgagactgagctgga

SEQ ID NO: 11248 - DNA, 20 bp, Artificial Sequence
  Description of Artificial Sequence: Synthetic oligonucleotide
  Target: FXN; (-) strand; PAM type: NRG; PAM sequence: GAG
tgtgttttgagactgagctg

SEQ ID NO: 11249 - DNA, 20 bp, Artificial Sequence
  Description of Artificial Sequence: Synthetic oligonucleotide
  Target: FXN; (-) strand; PAM type: NRG; PAM sequence: TGG
ggtgtgttttgagactgagc

SEQ ID NO: 11250 - DNA, 20 bp, Artificial Sequence
  Description of Artificial Sequence: Synthetic oligonucleotide
  Target: FXN; (-) strand; PAM type: NRG; PAM sequence: GAG
aaagggtgtgttttgagact

SEQ ID NO: 11251 - DNA, 20 bp, Artificial Sequence
  Description of Artificial Sequence: Synthetic oligonucleotide
  Target: FXN; (-) strand; PAM type: NRG; PAM sequence: GAG
ggagagaaagggtgtgtttt

SEQ ID NO: 11252 - DNA, 20 bp, Artificial Sequence
  Description of Artificial Sequence: Synthetic oligonucleotide
  Target: FXN; (-) strand; PAM type: NRG; PAM sequence: GGG
gagagtgagctggagagaaa

SEQ ID NO: 11253 - DNA, 20 bp, Artificial Sequence
  Description of Artificial Sequence: Synthetic oligonucleotide
  Target: FXN; (-) strand; PAM type: NRG; PAM sequence: AGG
tgagagtgagctggagagaa

SEQ ID NO: 11254 - DNA, 20 bp, Artificial Sequence
  Description of Artificial Sequence: Synthetic oligonucleotide
  Target: FXN; (-) strand; PAM type: NRG; PAM sequence: AAG
ttgagagtgagctggagaga

SEQ ID NO: 11255 - DNA, 20 bp, Artificial Sequence
  Description of Artificial Sequence: Synthetic oligonucleotide
  Target: FXN; (-) strand; PAM type: NRG; PAM sequence: GAG
tgttttgagagtgagctgga

SEQ ID NO: 11256 - DNA, 20 bp, Artificial Sequence
  Description of Artificial Sequence: Synthetic oligonucleotide
  Target: FXN; (-) strand; PAM type: NRG; PAM sequence: GAG
tgtgttttgagagtgagctg

SEQ ID NO: 11257 - DNA, 20 bp, Artificial Sequence
  Description of Artificial Sequence: Synthetic oligonucleotide
  Target: FXN; (-) strand; PAM type: NRG; PAM sequence: TGG
ggtgtgttttgagagtgagc

SEQ ID NO: 11258 - DNA, 20 bp, Artificial Sequence
  Description of Artificial Sequence: Synthetic oligonucleotide
  Target: FXN; (-) strand; PAM type: NRG; PAM sequence: GAG
atagggtgtgttttgagagt

SEQ ID NO: 11259 - DNA, 20 bp, Artificial Sequence
  Description of Artificial Sequence: Synthetic oligonucleotide
  Target: FXN; (-) strand; PAM type: NRG; PAM sequence: GAG
cctgatagggtgtgttttga

SEQ ID NO: 11260 - DNA, 20 bp, Artificial Sequence
  Description of Artificial Sequence: Synthetic oligonucleotide
  Target: FXN; (-) strand; PAM type: NRG; PAM sequence: GAG
ggcctgatagggtgtgtttt

SEQ ID NO: 11261 - DNA, 20 bp, Artificial Sequence
  Description of Artificial Sequence: Synthetic oligonucleotide
  Target: FXN; (-) strand; PAM type: NRG; PAM sequence: GGG
aaagagtggttggcctgata

SEQ ID NO: 11262 - DNA, 20 bp, Artificial Sequence
  Description of Artificial Sequence: Synthetic oligonucleotide
  Target: FXN; (-) strand; PAM type: NRG; PAM sequence: AGG
aaaagagtggttggcctgat

SEQ ID NO: 11263 - DNA, 20 bp, Artificial Sequence
  Description of Artificial Sequence: Synthetic oligonucleotide
  Target: FXN; (-) strand; PAM type: NRG; PAM sequence: TAG
aaaaagagtggttggcctga

SEQ ID NO: 11264 - DNA, 20 bp, Artificial Sequence
  Description of Artificial Sequence: Synthetic oligonucleotide
  Target: FXN; (-) strand; PAM type: NRG; PAM sequence: TGG
tgtcctttaaaaagagtggt

SEQ ID NO: 11265 - DNA, 20 bp, Artificial Sequence
  Description of Artificial Sequence: Synthetic oligonucleotide
  Target: FXN; (-) strand; PAM type: NRG; PAM sequence: TGG
gagctgtcctttaaaaagag

SEQ ID NO: 11266 - DNA, 20 bp, Artificial Sequence
  Description of Artificial Sequence: Synthetic oligonucleotide
  Target: FXN; (-) strand; PAM type: NRG; PAM sequence: GAG
gaggagctgtcctttaaaaa

SEQ ID NO: 11267 - DNA, 20 bp, Artificial Sequence
  Description of Artificial Sequence: Synthetic oligonucleotide
  Target: FXN; (-) strand; PAM type: NRG; PAM sequence: AAG
gtgaggagctgtcctttaaa

SEQ ID NO: 11268 - DNA, 20 bp, Artificial Sequence
  Description of Artificial Sequence: Synthetic oligonucleotide
  Target: FXN; (-) strand; PAM type: NRG; PAM sequence: GAG
tacctgactggattggtgag

SEQ ID NO: 11269 - DNA, 20 bp, Artificial Sequence
  Description of Artificial Sequence: Synthetic oligonucleotide
  Target: FXN; (-) strand; PAM type: NRG; PAM sequence: AGG
gctacctgactggattggtg

SEQ ID NO: 11270 - DNA, 20 bp, Artificial Sequence
  Description of Artificial Sequence: Synthetic oligonucleotide
  Target: FXN; (-) strand; PAM type: NRG; PAM sequence: GAG
ggctacctgactggattggt

SEQ ID NO: 11271 - DNA, 20 bp, Artificial Sequence
  Description of Artificial Sequence: Synthetic oligonucleotide
  Target: FXN; (-) strand; PAM type: NRG; PAM sequence: TGG
ggaaggctacctgactggat

SEQ ID NO: 11272 - DNA, 20 bp, Artificial Sequence
  Description of Artificial Sequence: Synthetic oligonucleotide
  Target: FXN; (-) strand; PAM type: NRG; PAM sequence: TGG
tgtggggaaggctacctgac

SEQ ID NO: 11273 - DNA, 20 bp, Artificial Sequence
  Description of Artificial Sequence: Synthetic oligonucleotide
  Target: FXN; (-) strand; PAM type: NRG; PAM sequence: AGG
tccaggatacaatgtgggga

SEQ ID NO: 11274 - DNA, 20 bp, Artificial Sequence
  Description of Artificial Sequence: Synthetic oligonucleotide
  Target: FXN; (-) strand; PAM type: NRG; PAM sequence: AAG
ttccaggatacaatgtgggg

SEQ ID NO: 11275 - DNA, 20 bp, Artificial Sequence
  Description of Artificial Sequence: Synthetic oligonucleotide
  Target: FXN; (-) strand; PAM type: NRG; PAM sequence: GGG
cacttccaggatacaatgtg

SEQ ID NO: 11276 - DNA, 20 bp, Artificial Sequence
  Description of Artificial Sequence: Synthetic oligonucleotide
  Target: FXN; (-) strand; PAM type: NRG; PAM sequence: GGG
ccacttccaggatacaatgt

SEQ ID NO: 11277 - DNA, 20 bp, Artificial Sequence
  Description of Artificial Sequence: Synthetic oligonucleotide
  Target: FXN; (-) strand; PAM type: NRG; PAM sequence: TGG
cccacttccaggatacaatg

SEQ ID NO: 11278 - DNA, 20 bp, Artificial Sequence
  Description of Artificial Sequence: Synthetic oligonucleotide
  Target: FXN; (-) strand; PAM type: NRG; PAM sequence: AGG
ccagtccatcacccacttcc

SEQ ID NO: 11279 - DNA, 20 bp, Artificial Sequence
  Description of Artificial Sequence: Synthetic oligonucleotide
  Target: FXN; (-) strand; PAM type: NRG; PAM sequence: CAG
cccagtccatcacccacttc

SEQ ID NO: 11280 - DNA, 20 bp, Artificial Sequence
  Description of Artificial Sequence: Synthetic oligonucleotide
  Target: FXN; (-) strand; PAM type: NRG; PAM sequence: CAG
atatgaccctcttccccacc

SEQ ID NO: 11281 - DNA, 20 bp, Artificial Sequence
  Description of Artificial Sequence: Synthetic oligonucleotide
  Target: FXN; (-) strand; PAM type: NRG; PAM sequence: CAG
gacaattactgtaagacata

SEQ ID NO: 11282 - DNA, 20 bp, Artificial Sequence
  Description of Artificial Sequence: Synthetic oligonucleotide
  Target: FXN; (-) strand; PAM type: NRG; PAM sequence: AAG
ggctgctagacaattactgt

SEQ ID NO: 11283 - DNA, 20 bp, Artificial Sequence
  Description of Artificial Sequence: Synthetic oligonucleotide
  Target: FXN; (-) strand; PAM type: NRG; PAM sequence: TAG
agtaagacaccaggggctgc

SEQ ID NO: 11284 - DNA, 20 bp, Artificial Sequence
  Description of Artificial Sequence: Synthetic oligonucleotide
  Target: FXN; (-) strand; PAM type: NRG; PAM sequence: GGG
ggcctaaagtaagacaccag

SEQ ID NO: 11285 - DNA, 20 bp, Artificial Sequence
  Description of Artificial Sequence: Synthetic oligonucleotide
  Target: FXN; (-) strand; PAM type: NRG; PAM sequence: GGG
gggcctaaagtaagacacca

SEQ ID NO: 11286 - DNA, 20 bp, Artificial Sequence
  Description of Artificial Sequence: Synthetic oligonucleotide
  Target: FXN; (-) strand; PAM type: NRG; PAM sequence: AGG
ggggcctaaagtaagacacc

SEQ ID NO: 11287 - DNA, 20 bp, Artificial Sequence
  Description of Artificial Sequence: Synthetic oligonucleotide
  Target: FXN; (-) strand; PAM type: NRG; PAM sequence: CAG
gggggcctaaagtaagacac

SEQ ID NO: 11288 - DNA, 20 bp, Artificial Sequence
  Description of Artificial Sequence: Synthetic oligonucleotide
  Target: FXN; (-) strand; PAM type: NRG; PAM sequence: AAG
gtttccagggggcctaaagt

SEQ ID NO: 11289 - DNA, 20 bp, Artificial Sequence
  Description of Artificial Sequence: Synthetic oligonucleotide
  Target: FXN; (-) strand; PAM type: NRG; PAM sequence: AAG
gaaagtttccagggggccta

SEQ ID NO: 11290 - DNA, 20 bp, Artificial Sequence
  Description of Artificial Sequence: Synthetic oligonucleotide
  Target: FXN; (-) strand; PAM type: NRG; PAM sequence: GGG
actatctgaaagtttccagg

SEQ ID NO: 11291 - DNA, 20 bp, Artificial Sequence
  Description of Artificial Sequence: Synthetic oligonucleotide
  Target: FXN; (-) strand; PAM type: NRG; PAM sequence: GGG
cactatctgaaagtttccag

SEQ ID NO: 11292 - DNA, 20 bp, Artificial Sequence
  Description of Artificial Sequence: Synthetic oligonucleotide
  Target: FXN; (-) strand; PAM type: NRG; PAM sequence: GGG
ccactatctgaaagtttcca

SEQ ID NO: 11293 - DNA, 20 bp, Artificial Sequence
  Description of Artificial Sequence: Synthetic oligonucleotide
  Target: FXN; (-) strand; PAM type: NRG; PAM sequence: AGG
tccactatctgaaagtttcc

SEQ ID NO: 11294 - DNA, 20 bp, Artificial Sequence
  Description of Artificial Sequence: Synthetic oligonucleotide
  Target: FXN; (-) strand; PAM type: NRG; PAM sequence: CAG
ctccactatctgaaagtttc

SEQ ID NO: 11295 - DNA, 20 bp, Artificial Sequence
  Description of Artificial Sequence: Synthetic oligonucleotide
  Target: FXN; (-) strand; PAM type: NRG; PAM sequence: AAG
cagacaactccactatctga

SEQ ID NO: 11296 - DNA, 20 bp, Artificial Sequence
  Description of Artificial Sequence: Synthetic oligonucleotide
  Target: FXN; (-) strand; PAM type: NRG; PAM sequence: CAG
gtaggttataagatatgtat

SEQ ID NO: 11297 - DNA, 20 bp, Artificial Sequence
  Description of Artificial Sequence: Synthetic oligonucleotide
  Target: FXN; (-) strand; PAM type: NRG; PAM sequence: AAG
tattaatatctgtaggttat

SEQ ID NO: 11298 - DNA, 20 bp, Artificial Sequence
  Description of Artificial Sequence: Synthetic oligonucleotide
  Target: FXN; (-) strand; PAM type: NRG; PAM sequence: AGG
gaggatatattaatatctgt

SEQ ID NO: 11299 - DNA, 20 bp, Artificial Sequence
  Description of Artificial Sequence: Synthetic oligonucleotide
  Target: FXN; (-) strand; PAM type: NRG; PAM sequence: TAG
tgaggatatattaatatctg

SEQ ID NO: 11300 - DNA, 20 bp, Artificial Sequence
  Description of Artificial Sequence: Synthetic oligonucleotide
  Target: FXN; (-) strand; PAM type: NRG; PAM sequence: AGG
agagcttttgtgcccctgtg

SEQ ID NO: 11301 - DNA, 20 bp, Artificial Sequence
  Description of Artificial Sequence: Synthetic oligonucleotide
  Target: FXN; (-) strand; PAM type: NRG; PAM sequence: GAG
aagagcttttgtgcccctgt

SEQ ID NO: 11302 - DNA, 20 bp, Artificial Sequence
  Description of Artificial Sequence: Synthetic oligonucleotide
  Target: FXN; (-) strand; PAM type: NRG; PAM sequence: GAG
tataataaacatccttgtaa

SEQ ID NO: 11303 - DNA, 20 bp, Artificial Sequence
  Description of Artificial Sequence: Synthetic oligonucleotide
  Target: FXN; (-) strand; PAM type: NRG; PAM sequence: AAG
attataataaacatccttgt

SEQ ID NO: 11304 - DNA, 20 bp, Artificial Sequence
  Description of Artificial Sequence: Synthetic oligonucleotide
  Target: FXN; (-) strand; PAM type: NRG; PAM sequence: TGG
ttttaaaatggttagtttta

SEQ ID NO: 11305 - DNA, 20 bp, Artificial Sequence
  Description of Artificial Sequence: Synthetic oligonucleotide
  Target: FXN; (-) strand; PAM type: NRG; PAM sequence: TAG
attatacattttaaaatggt

SEQ ID NO: 11306 - DNA, 20 bp, Artificial Sequence
  Description of Artificial Sequence: Synthetic oligonucleotide
  Target: FXN; (-) strand; PAM type: NRG; PAM sequence: TGG
ttgcattatacattttaaaa

SEQ ID NO: 11307 - DNA, 20 bp, Artificial Sequence
  Description of Artificial Sequence: Synthetic oligonucleotide
  Target: FXN; (-) strand; PAM type: NRG; PAM sequence: CAG
tgttctggaattagtagtga

SEQ ID NO: 11308 - DNA, 20 bp, Artificial Sequence
  Description of Artificial Sequence: Synthetic oligonucleotide
  Target: FXN; (-) strand; PAM type: NRG; PAM sequence: TAG
tgaaaatgttctggaattag

SEQ ID NO: 11309 - DNA, 20 bp, Artificial Sequence
  Description of Artificial Sequence: Synthetic oligonucleotide
  Target: FXN; (-) strand; PAM type: NRG; PAM sequence: TAG
taatgaaaatgttctggaat

SEQ ID NO: 11310 - DNA, 20 bp, Artificial Sequence
  Description of Artificial Sequence: Synthetic oligonucleotide
  Target: FXN; (-) strand; PAM type: NRG; PAM sequence: TGG
ctggaataatgaaaatgttc

SEQ ID NO: 11311 - DNA, 20 bp, Artificial Sequence
  Description of Artificial Sequence: Synthetic oligonucleotide
  Target: FXN; (-) strand; PAM type: NRG; PAM sequence: TGG
atatgaatagggtttccttc

SEQ ID NO: 11312 - DNA, 20 bp, Artificial Sequence
  Description of Artificial Sequence: Synthetic oligonucleotide
  Target: FXN; (-) strand; PAM type: NRG; PAM sequence: GGG
agtgattgctaatatgaata

SEQ ID NO: 11313 - DNA, 20 bp, Artificial Sequence
  Description of Artificial Sequence: Synthetic oligonucleotide
  Target: FXN; (-) strand; PAM type: NRG; PAM sequence: AGG
gagtgattgctaatatgaat

SEQ ID NO: 11314 - DNA, 20 bp, Artificial Sequence
  Description of Artificial Sequence: Synthetic oligonucleotide
  Target: FXN; (-) strand; PAM type: NRG; PAM sequence: TAG
ggagtgattgctaatatgaa

SEQ ID NO: 11315 - DNA, 20 bp, Artificial Sequence
  Description of Artificial Sequence: Synthetic oligonucleotide
  Target: FXN; (-) strand; PAM type: NRG; PAM sequence: GAG
tagggaaaggcggaatgggg

SEQ ID NO: 11316 - DNA, 20 bp, Artificial Sequence
  Description of Artificial Sequence: Synthetic oligonucleotide
  Target: FXN; (-) strand; PAM type: NRG; PAM sequence: GGG
tttagggaaaggcggaatgg

SEQ ID NO: 11317 - DNA, 20 bp, Artificial Sequence
  Description of Artificial Sequence: Synthetic oligonucleotide
  Target: FXN; (-) strand; PAM type: NRG; PAM sequence: GGG
ttttagggaaaggcggaatg

SEQ ID NO: 11318 - DNA, 20 bp, Artificial Sequence
  Description of Artificial Sequence: Synthetic oligonucleotide
  Target: FXN; (-) strand; PAM type: NRG; PAM sequence: GGG
gttttagggaaaggcggaat

SEQ ID NO: 11319 - DNA, 20 bp, Artificial Sequence
  Description of Artificial Sequence: Synthetic oligonucleotide
  Target: FXN; (-) strand; PAM type: NRG; PAM sequence: TGG
ggttttagggaaaggcggaa

SEQ ID NO: 11320 - DNA, 20 bp, Artificial Sequence
  Description of Artificial Sequence: Synthetic oligonucleotide
  Target: FXN; (-) strand; PAM type: NRG; PAM sequence: CGG
tgctgggttttagggaaagg

SEQ ID NO: 11321 - DNA, 20 bp, Artificial Sequence
  Description of Artificial Sequence: Synthetic oligonucleotide
  Target: FXN; (-) strand; PAM type: NRG; PAM sequence: AGG
gattgctgggttttagggaa

SEQ ID NO: 11322 - DNA, 20 bp, Artificial Sequence
  Description of Artificial Sequence: Synthetic oligonucleotide
  Target: FXN; (-) strand; PAM type: NRG; PAM sequence: AAG
tgattgctgggttttaggga

SEQ ID NO: 11323 - DNA, 20 bp, Artificial Sequence
  Description of Artificial Sequence: Synthetic oligonucleotide
  Target: FXN; (-) strand; PAM type: NRG; PAM sequence: GGG
ttagtgattgctgggtttta

SEQ ID NO: 11324 - DNA, 20 bp, Artificial Sequence
  Description of Artificial Sequence: Synthetic oligonucleotide
  Target: FXN; (-) strand; PAM type: NRG; PAM sequence: AGG
attagtgattgctgggtttt

SEQ ID NO: 11325 - DNA, 20 bp, Artificial Sequence
  Description of Artificial Sequence: Synthetic oligonucleotide
  Target: FXN; (-) strand; PAM type: NRG; PAM sequence: TAG
gattagtgattgctgggttt

SEQ ID NO: 11326 - DNA, 20 bp, Artificial Sequence
  Description of Artificial Sequence: Synthetic oligonucleotide
  Target: FXN; (-) strand; PAM type: NRG; PAM sequence: GGG
aaagtagattagtgattgct

SEQ ID NO: 11327 - DNA, 20 bp, Artificial Sequence
  Description of Artificial Sequence: Synthetic oligonucleotide
  Target: FXN; (-) strand; PAM type: NRG; PAM sequence: TGG
gaaagtagattagtgattgc

SEQ ID NO: 11328 - DNA, 20 bp, Artificial Sequence
  Description of Artificial Sequence: Synthetic oligonucleotide
  Target: FXN; (-) strand; PAM type: NRG; PAM sequence: TAG
cacagagacagaaagtagat

SEQ ID NO: 11329 - DNA, 20 bp, Artificial Sequence
  Description of Artificial Sequence: Synthetic oligonucleotide
  Target: FXN; (-) strand; PAM type: NRG; PAM sequence: TAG
aaatccacagagacagaaag

SEQ ID NO: 11330 - DNA, 20 bp, Artificial Sequence
  Description of Artificial Sequence: Synthetic oligonucleotide
  Target: FXN; (-) strand; PAM type: NRG; PAM sequence: AAG
tttaaatccacagagacaga

SEQ ID NO: 11331 - DNA, 20 bp, Artificial Sequence
  Description of Artificial Sequence: Synthetic oligonucleotide
  Target: FXN; (-) strand; PAM type: NRG; PAM sequence: CAG
ttactttaaatccacagaga

SEQ ID NO: 11332 - DNA, 20 bp, Artificial Sequence
  Description of Artificial Sequence: Synthetic oligonucleotide
  Target: FXN; (-) strand; PAM type: NRG; PAM sequence: GAG
aaaattactttaaatccaca

SEQ ID NO: 11333 - DNA, 20 bp, Artificial Sequence
  Description of Artificial Sequence: Synthetic oligonucleotide
  Target: FXN; (-) strand; PAM type: NRG; PAM sequence: CAG
ttaaaattactttaaatcca

SEQ ID NO: 11334 - DNA, 20 bp, Artificial Sequence
  Description of Artificial Sequence: Synthetic oligonucleotide
  Target: FXN; (-) strand; PAM type: NRG; PAM sequence: TAG
tgactagatacatttcctta

SEQ ID NO: 11335 - DNA, 20 bp, Artificial Sequence
  Description of Artificial Sequence: Synthetic oligonucleotide
  Target: FXN; (-) strand; PAM type: NRG; PAM sequence: TAG
tcaagctgtatgcttgtgac

SEQ ID NO: 11336 - DNA, 20 bp, Artificial Sequence
  Description of Artificial Sequence: Synthetic oligonucleotide
  Target: FXN; (-) strand; PAM type: NRG; PAM sequence: AAG
tcaatttttacaaattcatc

SEQ ID NO: 11337 - DNA, 20 bp, Artificial Sequence
  Description of Artificial Sequence: Synthetic oligonucleotide
  Target: FXN; (-) strand; PAM type: NRG; PAM sequence: AGG
agcttacagggtatgttcat

SEQ ID NO: 11338 - DNA, 20 bp, Artificial Sequence
  Description of Artificial Sequence: Synthetic oligonucleotide
  Target: FXN; (-) strand; PAM type: NRG; PAM sequence: TAG
gagcttacagggtatgttca

SEQ ID NO: 11339 - DNA, 20 bp, Artificial Sequence
  Description of Artificial Sequence: Synthetic oligonucleotide
  Target: FXN; (-) strand; PAM type: NRG; PAM sequence: GGG
ttctatgtcttgagcttaca

SEQ ID NO: 11340 - DNA, 20 bp, Artificial Sequence
  Description of Artificial Sequence: Synthetic oligonucleotide
  Target: FXN; (-) strand; PAM type: NRG; PAM sequence: AGG
attctatgtcttgagcttac

SEQ ID NO: 11341 - DNA, 20 bp, Artificial Sequence
  Description of Artificial Sequence: Synthetic oligonucleotide
  Target: FXN; (-) strand; PAM type: NRG; PAM sequence: CAG
cattctatgtcttgagctta

SEQ ID NO: 11342 - DNA, 20 bp, Artificial Sequence
  Description of Artificial Sequence: Synthetic oligonucleotide
  Target: FXN; (-) strand; PAM type: NRG; PAM sequence: GAG
ctggtaacattctatgtctt

SEQ ID NO: 11343 - DNA, 20 bp, Artificial Sequence
  Description of Artificial Sequence: Synthetic oligonucleotide
  Target: FXN; (-) strand; PAM type: NRG; PAM sequence: TGG
ggcagcttgcttgcaggggc

SEQ ID NO: 11344 - DNA, 20 bp, Artificial Sequence
  Description of Artificial Sequence: Synthetic oligonucleotide
  Target: FXN; (-) strand; PAM type: NRG; PAM sequence: GGG
agcaggcagcttgcttgcag

SEQ ID NO: 11345 - DNA, 20 bp, Artificial Sequence
  Description of Artificial Sequence: Synthetic oligonucleotide
  Target: FXN; (-) strand; PAM type: NRG; PAM sequence: GGG
gagcaggcagcttgcttgca

SEQ ID NO: 11346 - DNA, 20 bp, Artificial Sequence
  Description of Artificial Sequence: Synthetic oligonucleotide
  Target: FXN; (-) strand; PAM type: NRG; PAM sequence: AGG
tgagcaggcagcttgcttgc

SEQ ID NO: 11347 - DNA, 20 bp, Artificial Sequence
  Description of Artificial Sequence: Synthetic oligonucleotide
  Target: FXN; (-) strand; PAM type: NRG; PAM sequence: CAG
gtgagcaggcagcttgcttg

SEQ ID NO: 11348 - DNA, 20 bp, Artificial Sequence
  Description of Artificial Sequence: Synthetic oligonucleotide
  Target: FXN; (-) strand; PAM type: NRG; PAM sequence: CAG
aatgactagaagtgagcagg

SEQ ID NO: 11349 - DNA, 20 bp, Artificial Sequence
  Description of Artificial Sequence: Synthetic oligonucleotide
  Target: FXN; (-) strand; PAM type: NRG; PAM sequence: AGG
gttaatgactagaagtgagc

SEQ ID NO: 11350 - DNA, 20 bp, Artificial Sequence
  Description of Artificial Sequence: Synthetic oligonucleotide
  Target: FXN; (-) strand; PAM type: NRG; PAM sequence: CAG
ggttaatgactagaagtgag

SEQ ID NO: 11351 - DNA, 20 bp, Artificial Sequence
  Description of Artificial Sequence: Synthetic oligonucleotide
  Target: FXN; (-) strand; PAM type: NRG; PAM sequence: GAG
aggggttaatgactagaagt

SEQ ID NO: 11352 - DNA, 20 bp, Artificial Sequence
  Description of Artificial Sequence: Synthetic oligonucleotide
  Target: FXN; (-) strand; PAM type: NRG; PAM sequence: AAG
agggaggggttaatgactag

SEQ ID NO: 11353 - DNA, 20 bp, Artificial Sequence
  Description of Artificial Sequence: Synthetic oligonucleotide
  Target: FXN; (-) strand; PAM type: NRG; PAM sequence: TAG
aagagggaggggttaatgac

SEQ ID NO: 11354 - DNA, 20 bp, Artificial Sequence
  Description of Artificial Sequence: Synthetic oligonucleotide
  Target: FXN; (-) strand; PAM type: NRG; PAM sequence: GGG
actagaaggaaaagagggag

SEQ ID NO: 11355 - DNA, 20 bp, Artificial Sequence
  Description of Artificial Sequence: Synthetic oligonucleotide
  Target: FXN; (-) strand; PAM type: NRG; PAM sequence: GGG
gactagaaggaaaagaggga

SEQ ID NO: 11356 - DNA, 20 bp, Artificial Sequence
  Description of Artificial Sequence: Synthetic oligonucleotide
  Target: FXN; (-) strand; PAM type: NRG; PAM sequence: AGG
tgactagaaggaaaagaggg

SEQ ID NO: 11357 - DNA, 20 bp, Artificial Sequence
  Description of Artificial Sequence: Synthetic oligonucleotide
  Target: FXN; (-) strand; PAM type: NRG; PAM sequence: GAG
atgactagaaggaaaagagg

SEQ ID NO: 11358 - DNA, 20 bp, Artificial Sequence
  Description of Artificial Sequence: Synthetic oligonucleotide
  Target: FXN; (-) strand; PAM type: NRG; PAM sequence: GGG
taatgactagaaggaaaaga

SEQ ID NO: 11359 - DNA, 20 bp, Artificial Sequence
  Description of Artificial Sequence: Synthetic oligonucleotide
  Target: FXN; (-) strand; PAM type: NRG; PAM sequence: AGG
ttaatgactagaaggaaaag

SEQ ID NO: 11360 - DNA, 20 bp, Artificial Sequence
  Description of Artificial Sequence: Synthetic oligonucleotide
  Target: FXN; (-) strand; PAM type: NRG; PAM sequence: GAG
gttaatgactagaaggaaaa

SEQ ID NO: 11361 - DNA, 20 bp, Artificial Sequence
  Description of Artificial Sequence: Synthetic oligonucleotide
  Target: FXN; (-) strand; PAM type: NRG; PAM sequence: AAG
gggttaatgactagaaggaa

SEQ ID NO: 11362 - DNA, 20 bp, Artificial Sequence
  Description of Artificial Sequence: Synthetic oligonucleotide
  Target: FXN; (-) strand; PAM type: NRG; PAM sequence: AGG
ctgaagggttaatgactaga

SEQ ID NO: 11363 - DNA, 20 bp, Artificial Sequence
  Description of Artificial Sequence: Synthetic oligonucleotide
  Target: FXN; (-) strand; PAM type: NRG; PAM sequence: AAG
tctgaagggttaatgactag

SEQ ID NO: 11364 - DNA, 20 bp, Artificial Sequence
  Description of Artificial Sequence: Synthetic oligonucleotide
  Target: FXN; (-) strand; PAM type: NRG; PAM sequence: TAG
tactctgaagggttaatgac

SEQ ID NO: 11365 - DNA, 20 bp, Artificial Sequence
  Description of Artificial Sequence: Synthetic oligonucleotide
  Target: FXN; (-) strand; PAM type: NRG; PAM sequence: GGG
atcagaatagttactctgaa

SEQ ID NO: 11366 - DNA, 20 bp, Artificial Sequence
  Description of Artificial Sequence: Synthetic oligonucleotide
  Target: FXN; (-) strand; PAM type: NRG; PAM sequence: AGG
aatcagaatagttactctga

SEQ ID NO: 11367 - DNA, 20 bp, Artificial Sequence
  Description of Artificial Sequence: Synthetic oligonucleotide
  Target: FXN; (-) strand; PAM type: NRG; PAM sequence: AAG
taatcagaatagttactctg

SEQ ID NO: 11368 - DNA, 20 bp, Artificial Sequence
  Description of Artificial Sequence: Synthetic oligonucleotide
  Target: FXN; (-) strand; PAM type: NRG; PAM sequence: TAG
tatgctattggtaatcagaa

SEQ ID NO: 11369 - DNA, 20 bp, Artificial Sequence
  Description of Artificial Sequence: Synthetic oligonucleotide
  Target: FXN; (-) strand; PAM type: NRG; PAM sequence: CAG
taatctatgctattggtaat

SEQ ID NO: 11370 - DNA, 20 bp, Artificial Sequence
  Description of Artificial Sequence: Synthetic oligonucleotide
  Target: FXN; (-) strand; PAM type: NRG; PAM sequence: TGG
gcagaactaatctatgctat

SEQ ID NO: 11371 - DNA, 20 bp, Artificial Sequence
  Description of Artificial Sequence: Synthetic oligonucleotide
  Target: FXN; (-) strand; PAM type: NRG; PAM sequence: CAG
atataaagtaaaacaacagg

SEQ ID NO: 11372 - DNA, 20 bp, Artificial Sequence
  Description of Artificial Sequence: Synthetic oligonucleotide
  Target: FXN; (-) strand; PAM type: NRG; PAM sequence: AGG
tttatataaagtaaaacaac

SEQ ID NO: 11373 - DNA, 20 bp, Artificial Sequence
  Description of Artificial Sequence: Synthetic oligonucleotide
  Target: FXN; (-) strand; PAM type: NRG; PAM sequence: CAG
gtttatataaagtaaaacaa

SEQ ID NO: 11374 - DNA, 20 bp, Artificial Sequence
  Description of Artificial Sequence: Synthetic oligonucleotide
  Target: FXN; (-) strand; PAM type: NRG; PAM sequence: AAG
ttaatgagacagtttatata

SEQ ID NO: 11375 - DNA, 20 bp, Artificial Sequence
  Description of Artificial Sequence: Synthetic oligonucleotide
  Target: FXN; (-) strand; PAM type: NRG; PAM sequence: CAG
catgtttatacttaatgaga

SEQ ID NO: 11376 - DNA, 20 bp, Artificial Sequence
  Description of Artificial Sequence: Synthetic oligonucleotide
  Target: FXN; (-) strand; PAM type: NRG; PAM sequence: GAG
caaacatgtttatacttaat

SEQ ID NO: 11377 - DNA, 20 bp, Artificial Sequence
  Description of Artificial Sequence: Synthetic oligonucleotide
  Target: FXN; (-) strand; PAM type: NRG; PAM sequence: AAG
tgtgatagaaagaaatacac

SEQ ID NO: 11378 - DNA, 20 bp, Artificial Sequence
  Description of Artificial Sequence: Synthetic oligonucleotide
  Target: FXN; (-) strand; PAM type: NRG; PAM sequence: AAG
acaaacatcattgtgataga

SEQ ID NO: 11379 - DNA, 20 bp, Artificial Sequence
  Description of Artificial Sequence: Synthetic oligonucleotide
  Target: FXN; (-) strand; PAM type: NRG; PAM sequence: TAG
tctcacaaacatcattgtga

SEQ ID NO: 11380 - DNA, 20 bp, Artificial Sequence
  Description of Artificial Sequence: Synthetic oligonucleotide
  Target: FXN; (-) strand; PAM type: NRG; PAM sequence: TGG
aattgtctataggaacagca

SEQ ID NO: 11381 - DNA, 20 bp, Artificial Sequence
  Description of Artificial Sequence: Synthetic oligonucleotide
  Target: FXN; (-) strand; PAM type: NRG; PAM sequence: CAG
aatagaattgtctataggaa

SEQ ID NO: 11382 - DNA, 20 bp, Artificial Sequence
  Description of Artificial Sequence: Synthetic oligonucleotide
  Target: FXN; (-) strand; PAM type: NRG; PAM sequence: AGG
tgcaaaatagaattgtctat

SEQ ID NO: 11383 - DNA, 20 bp, Artificial Sequence
  Description of Artificial Sequence: Synthetic oligonucleotide
  Target: FXN; (-) strand; PAM type: NRG; PAM sequence: TAG
ctgcaaaatagaattgtcta

SEQ ID NO: 11384 - DNA, 20 bp, Artificial Sequence
  Description of Artificial Sequence: Synthetic oligonucleotide
  Target: FXN; (-) strand; PAM type: NRG; PAM sequence: TAG
tggaatactacgctgcaaaa

SEQ ID NO: 11385 - DNA, 20 bp, Artificial Sequence
  Description of Artificial Sequence: Synthetic oligonucleotide
  Target: FXN; (-) strand; PAM type: NRG; PAM sequence: TGG
attgtggtatagtcatgcaa

SEQ ID NO: 11386 - DNA, 20 bp, Artificial Sequence
  Description of Artificial Sequence: Synthetic oligonucleotide
  Target: FXN; (-) strand; PAM type: NRG; PAM sequence: TAG
atcacagataaattgtggta

SEQ ID NO: 11387 - DNA, 20 bp, Artificial Sequence
  Description of Artificial Sequence: Synthetic oligonucleotide
  Target: FXN; (-) strand; PAM type: NRG; PAM sequence: TGG
gtaatatcacagataaattg

SEQ ID NO: 11388 - DNA, 20 bp, Artificial Sequence
  Description of Artificial Sequence: Synthetic oligonucleotide
  Target: FXN; (-) strand; PAM type: NRG; PAM sequence: CAG
agtattcctttgtaatatca

SEQ ID NO: 11389 - DNA, 20 bp, Artificial Sequence
  Description of Artificial Sequence: Synthetic oligonucleotide
  Target: FXN; (-) strand; PAM type: NRG; PAM sequence: AAG
ccccaaactggaaactgccc

SEQ ID NO: 11390 - DNA, 20 bp, Artificial Sequence
  Description of Artificial Sequence: Synthetic oligonucleotide
  Target: FXN; (-) strand; PAM type: NRG; PAM sequence: TGG
actatcctatagccccaaac

SEQ ID NO: 11391 - DNA, 20 bp, Artificial Sequence
  Description of Artificial Sequence: Synthetic oligonucleotide
  Target: FXN; (-) strand; PAM type: NRG; PAM sequence: TAG
tttgtatcacaactatccta

SEQ ID NO: 11392 - DNA, 20 bp, Artificial Sequence
  Description of Artificial Sequence: Synthetic oligonucleotide
  Target: FXN; (-) strand; PAM type: NRG; PAM sequence: AAG
tgtgtacccaggttcaccaa

SEQ ID NO: 11393 - DNA, 20 bp, Artificial Sequence
  Description of Artificial Sequence: Synthetic oligonucleotide
  Target: FXN; (-) strand; PAM type: NRG; PAM sequence: AGG
cacaacagaaatgtgtaccc

SEQ ID NO: 11394 - DNA, 20 bp, Artificial Sequence
  Description of Artificial Sequence: Synthetic oligonucleotide
  Target: FXN; (-) strand; PAM type: NRG; PAM sequence: CAG
acacaacagaaatgtgtacc

SEQ ID NO: 11395 - DNA, 20 bp, Artificial Sequence
  Description of Artificial Sequence: Synthetic oligonucleotide
  Target: FXN; (-) strand; PAM type: NRG; PAM sequence: CAG
ctcttaaggggtatacacaa

SEQ ID NO: 11396 - DNA, 20 bp, Artificial Sequence
  Description of Artificial Sequence: Synthetic oligonucleotide
  Target: FXN; (-) strand; PAM type: NRG; PAM sequence: GGG
tcatcagctccactcttaag

SEQ ID NO: 11397 - DNA, 20 bp, Artificial Sequence
  Description of Artificial Sequence: Synthetic oligonucleotide
  Target: FXN; (-) strand; PAM type: NRG; PAM sequence: GGG
atcatcagctccactcttaa

SEQ ID NO: 11398 - DNA, 20 bp, Artificial Sequence
  Description of Artificial Sequence: Synthetic oligonucleotide
  Target: FXN; (-) strand; PAM type: NRG; PAM sequence: AGG
gatcatcagctccactctta

SEQ ID NO: 11399 - DNA, 20 bp, Artificial Sequence
  Description of Artificial Sequence: Synthetic oligonucleotide
  Target: FXN; (-) strand; PAM type: NRG; PAM sequence: AAG
ggatcatcagctccactctt

SEQ ID NO: 11400 - DNA, 20 bp, Artificial Sequence
  Description of Artificial Sequence: Synthetic oligonucleotide
  Target: FXN; (-) strand; PAM type: NRG; PAM sequence: CAG
accttgttagccaggatcat

SEQ ID NO: 11401 - DNA, 20 bp, Artificial Sequence
  Description of Artificial Sequence: Synthetic oligonucleotide
  Target: FXN; (-) strand; PAM type: NRG; PAM sequence: AGG
ggggtttcaccttgttagcc

SEQ ID NO: 11402 - DNA, 20 bp, Artificial Sequence
  Description of Artificial Sequence: Synthetic oligonucleotide
  Target: FXN; (-) strand; PAM type: NRG; PAM sequence: CAG
cggggtttcaccttgttagc

SEQ ID NO: 11403 - DNA, 20 bp, Artificial Sequence
  Description of Artificial Sequence: Synthetic oligonucleotide
  Target: FXN; (-) strand; PAM type: NRG; PAM sequence: TAG
gagacggggtttcaccttgt

SEQ ID NO: 11404 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagagacg

SEQ ID NO: 11405 - DNA, 20 bp, Artificial Sequence
  Description of Artificial Sequence: Synthetic oligonucleotide
  Target: FXN; (-) strand; PAM type: NRG; PAM sequence: GGG
tttgtatttttagtagagac

SEQ ID NO: 11406 - DNA, 20 bp, Artificial Sequence
  Description of Artificial Sequence: Synthetic oligonucleotide
  Target: FXN; (-) strand; PAM type: NRG; PAM sequence: CGG
ttttgtatttttagtagaga

SEQ ID NO: 11407 - DNA, 20 bp, Artificial Sequence
  Description of Artificial Sequence: Synthetic oligonucleotide
  Target: FXN; (-) strand; PAM type: NRG; PAM sequence: GAG
aattttttgtatttttagta

SEQ ID NO: 11408 - DNA, 20 bp, Artificial Sequence
  Description of Artificial Sequence: Synthetic oligonucleotide
  Target: FXN; (-) strand; PAM type: NRG; PAM sequence: TAG
ctaattttttgtatttttag

SEQ ID NO: 11409 - DNA, 20 bp, Artificial Sequence
  Description of Artificial Sequence: Synthetic oligonucleotide
  Target: FXN; (-) strand; PAM type: NRG; PAM sequence: TAG
cggctaattttttgtatttt

SEQ ID NO: 11410 - DNA, 20 bp, Artificial Sequence
  Description of Artificial Sequence: Synthetic oligonucleotide
  Target: FXN; (-) strand; PAM type: NRG; PAM sequence: CGG
caggcgcccgctaccacgcc

SEQ ID NO: 11411 - DNA, 20 bp, Artificial Sequence
  Description of Artificial Sequence: Synthetic oligonucleotide
  Target: FXN; (-) strand; PAM type: NRG; PAM sequence: AGG
tcccgagtagctgggactac

SEQ ID NO: 11412 - DNA, 20 bp, Artificial Sequence
  Description of Artificial Sequence: Synthetic oligonucleotide
  Target: FXN; (-) strand; PAM type: NRG; PAM sequence: CAG
ctcccgagtagctgggacta

SEQ ID NO: 11413 - DNA, 20 bp, Artificial Sequence
  Description of Artificial Sequence: Synthetic oligonucleotide
  Target: FXN; (-) strand; PAM type: NRG; PAM sequence: GGG
cctcagcctcccgagtagct

SEQ ID NO: 11414 - DNA, 20 bp, Artificial Sequence
  Description of Artificial Sequence: Synthetic oligonucleotide
  Target: FXN; (-) strand; PAM type: NRG; PAM sequence: TGG
gcctcagcctcccgagtagc

SEQ ID NO: 11415 - DNA, 20 bp, Artificial Sequence
  Description of Artificial Sequence: Synthetic oligonucleotide
  Target: FXN; (-) strand; PAM type: NRG; PAM sequence: TAG
tcctgcctcagcctcccgag

SEQ ID NO: 11416 - DNA, 20 bp, Artificial Sequence
  Description of Artificial Sequence: Synthetic oligonucleotide
  Target: FXN; (-) strand; PAM type: NRG; PAM sequence: GAG
ttctcctgcctcagcctccc

SEQ ID NO: 11417 - DNA, 20 bp, Artificial Sequence
  Description of Artificial Sequence: Synthetic oligonucleotide
  Target: FXN; (-) strand; PAM type: NRG; PAM sequence: CAG
ttcacgccattctcctgcct

SEQ ID NO: 11418 - DNA, 20 bp, Artificial Sequence
  Description of Artificial Sequence: Synthetic oligonucleotide
  Target: FXN; (-) strand; PAM type: NRG; PAM sequence: GGG
gcaagcaagctccgcctccc

SEQ ID NO: 11419 - DNA, 20 bp, Artificial Sequence
  Description of Artificial Sequence: Synthetic oligonucleotide
  Target: FXN; (-) strand; PAM type: NRG; PAM sequence: CGG
tgcaagcaagctccgcctcc

SEQ ID NO: 11420 - DNA, 20 bp, Artificial Sequence
  Description of Artificial Sequence: Synthetic oligonucleotide
  Target: FXN; (-) strand; PAM type: NRG; PAM sequence: AAG
gatctcggctcactgcaagc

SEQ ID NO: 11421 - DNA, 20 bp, Artificial Sequence
  Description of Artificial Sequence: Synthetic oligonucleotide
  Target: FXN; (-) strand; PAM type: NRG; PAM sequence: AAG
gcgcgatctcggctcactgc

SEQ ID NO: 11422 - DNA, 20 bp, Artificial Sequence
  Description of Artificial Sequence: Synthetic oligonucleotide
  Target: FXN; (-) strand; PAM type: NRG; PAM sequence: CGG
ggagtgcagtggcgcgatct

SEQ ID NO: 11423 - DNA, 20 bp, Artificial Sequence
  Description of Artificial Sequence: Synthetic oligonucleotide
  Target: FXN; (-) strand; PAM type: NRG; PAM sequence: TGG
tcgcccaggctggagtgcag

SEQ ID NO: 11424 - DNA, 20 bp, Artificial Sequence
  Description of Artificial Sequence: Synthetic oligonucleotide
  Target: FXN; (-) strand; PAM type: NRG; PAM sequence: CAG
ctgtcgcccaggctggagtg

SEQ ID NO: 11425 - DNA, 20 bp, Artificial Sequence
  Description of Artificial Sequence: Synthetic oligonucleotide
  Target: FXN; (-) strand; PAM type: NRG; PAM sequence: GAG
tcgctctgtcgcccaggctg

SEQ ID NO: 11426 - DNA, 20 bp, Artificial Sequence
  Description of Artificial Sequence: Synthetic oligonucleotide
  Target: FXN; (-) strand; PAM type: NRG; PAM sequence: TGG
tctcgctctgtcgcccaggc

SEQ ID NO: 11427 - DNA, 20 bp, Artificial Sequence
  Description of Artificial Sequence: Synthetic oligonucleotide
  Target: FXN; (-) strand; PAM type: NRG; PAM sequence: AGG
ggagtctcgctctgtcgccc

SEQ ID NO: 11428 - DNA, 20 bp, Artificial Sequence
  Description of Artificial Sequence: Synthetic oligonucleotide
  Target: FXN; (-) strand; PAM type: NRG; PAM sequence: CAG
cggagtctcgctctgtcgcc

SEQ ID NO: 11429 - DNA, 20 bp, Artificial Sequence
  Description of Artificial Sequence: Synthetic oligonucleotide
  Target: FXN; (-) strand; PAM type: NRG; PAM sequence: GAG
ttttttttttttttgagacg

SEQ ID NO: 11430 - DNA, 20 bp, Artificial Sequence
  Description of Artificial Sequence: Synthetic oligonucleotide
  Target: FXN; (-) strand; PAM type: NRG; PAM sequence: CGG
ttttttttttttttttgaga

SEQ ID NO: 11431 - DNA, 20 bp, Artificial Sequence
  Description of Artificial Sequence: Synthetic oligonucleotide
  Target: FXN; (-) strand; PAM type: NRG; PAM sequence: GAG
cttttttttttttttttttt

SEQ ID NO: 11432 - DNA, 20 bp, Artificial Sequence
  Description of Artificial Sequence: Synthetic oligonucleotide
  Target: FXN; (-) strand; PAM type: NRG; PAM sequence: CAG
atttacatgctatgacccat

SEQ ID NO: 11433 - DNA, 20 bp, Artificial Sequence
  Description of Artificial Sequence: Synthetic oligonucleotide
  Target: FXN; (-) strand; PAM type: NRG; PAM sequence: AAG
ctgttggacagtatctacta

SEQ ID NO: 11434 - DNA, 20 bp, Artificial Sequence
  Description of Artificial Sequence: Synthetic oligonucleotide
  Target: FXN; (-) strand; PAM type: NRG; PAM sequence: CAG
cactttggaaaactgttgga

SEQ ID NO: 11435 - DNA, 20 bp, Artificial Sequence
  Description of Artificial Sequence: Synthetic oligonucleotide
  Target: FXN; (-) strand; PAM type: NRG; PAM sequence: TGG
caatcactttggaaaactgt

SEQ ID NO: 11436 - DNA, 20 bp, Artificial Sequence
  Description of Artificial Sequence: Synthetic oligonucleotide
  Target: FXN; (-) strand; PAM type: NRG; PAM sequence: TGG
agtaagttggacaatcactt

SEQ ID NO: 11437 - DNA, 20 bp, Artificial Sequence
  Description of Artificial Sequence: Synthetic oligonucleotide
  Target: FXN; (-) strand; PAM type: NRG; PAM sequence: TGG
ctgctgataggcaagtaagt

SEQ ID NO: 11438 - DNA, 20 bp, Artificial Sequence
  Description of Artificial Sequence: Synthetic oligonucleotide
  Target: FXN; (-) strand; PAM type: NRG; PAM sequence: AAG
gatactgctgataggcaagt

SEQ ID NO: 11439 - DNA, 20 bp, Artificial Sequence
  Description of Artificial Sequence: Synthetic oligonucleotide
  Target: FXN; (-) strand; PAM type: NRG; PAM sequence: AAG
ttcagatactgctgataggc

SEQ ID NO: 11440 - DNA, 20 bp, Artificial Sequence
  Description of Artificial Sequence: Synthetic oligonucleotide
  Target: FXN; (-) strand; PAM type: NRG; PAM sequence: AGG
acttttcagatactgctgat

SEQ ID NO: 11441 - DNA, 20 bp, Artificial Sequence
  Description of Artificial Sequence: Synthetic oligonucleotide
  Target: FXN; (-) strand; PAM type: NRG; PAM sequence: TAG
gacttttcagatactgctga

SEQ ID NO: 11442 - DNA, 20 bp, Artificial Sequence
  Description of Artificial Sequence: Synthetic oligonucleotide
  Target: FXN; (-) strand; PAM type: NRG; PAM sequence: CAG
aaagaagcaactagactttt

SEQ ID NO: 11443 - DNA, 20 bp, Artificial Sequence
  Description of Artificial Sequence: Synthetic oligonucleotide
  Target: FXN; (-) strand; PAM type: NRG; PAM sequence: TAG
tggccaagaaaagaagcaac

SEQ ID NO: 11444 - DNA, 20 bp, Artificial Sequence
  Description of Artificial Sequence: Synthetic oligonucleotide
  Target: FXN; (-) strand; PAM type: NRG; PAM sequence: AAG
aaagagttggccaagaaaag

SEQ ID NO: 11445 - DNA, 20 bp, Artificial Sequence
  Description of Artificial Sequence: Synthetic oligonucleotide
  Target: FXN; (-) strand; PAM type: NRG; PAM sequence: AAG
aaaaaagagttggccaagaa

SEQ ID NO: 11446 - DNA, 20 bp, Artificial Sequence
  Description of Artificial Sequence: Synthetic oligonucleotide
  Target: FXN; (-) strand; PAM type: NRG; PAM sequence: AAG
aaaaaaaaaaagagttggcc

SEQ ID NO: 11447 - DNA, 20 bp, Artificial Sequence
  Description of Artificial Sequence: Synthetic oligonucleotide
  Target: FXN; (-) strand; PAM type: NRG; PAM sequence: TGG
ctcaaaaaaaaaaaaagagt

SEQ ID NO: 11448 - DNA, 20 bp, Artificial Sequence
  Description of Artificial Sequence: Synthetic oligonucleotide
  Target: FXN; (-) strand; PAM type: NRG; PAM sequence: GAG
ccatctcaaaaaaaaaaaaa

SEQ ID NO: 11449 - DNA, 20 bp, Artificial Sequence
  Description of Artificial Sequence: Synthetic oligonucleotide
  Target: FXN; (-) strand; PAM type: NRG; PAM sequence: AAG
ctccatctcaaaaaaaaaaa

SEQ ID NO: 11450 - DNA, 20 bp, Artificial Sequence
  Description of Artificial Sequence: Synthetic oligonucleotide
  Target: FXN; (-) strand; PAM type: NRG; PAM sequence: GAG
cgctccagcctgggcaacaa

SEQ ID NO: 11451 - DNA, 20 bp, Artificial Sequence
  Description of Artificial Sequence: Synthetic oligonucleotide
  Target: FXN; (-) strand; PAM type: NRG; PAM sequence: AAG
tgcgctccagcctgggcaac

SEQ ID NO: 11452 - DNA, 20 bp, Artificial Sequence
  Description of Artificial Sequence: Synthetic oligonucleotide
  Target: FXN; (-) strand; PAM type: NRG; PAM sequence: GGG
gtgccattgcgctccagcct

SEQ ID NO: 11453 - DNA, 20 bp, Artificial Sequence
  Description of Artificial Sequence: Synthetic oligonucleotide
  Target: FXN; (-) strand; PAM type: NRG; PAM sequence: TGG
cgtgccattgcgctccagcc

SEQ ID NO: 11454 - DNA, 20 bp, Artificial Sequence
  Description of Artificial Sequence: Synthetic oligonucleotide
  Target: FXN; (-) strand; PAM type: NRG; PAM sequence: CAG
gaggacgtgccattgcgctc

SEQ ID NO: 11455 - DNA, 20 bp, Artificial Sequence
  Description of Artificial Sequence: Synthetic oligonucleotide
  Target: FXN; (-) strand; PAM type: NRG; PAM sequence: AGG
gcggaggttgcagtgagcag

SEQ ID NO: 11456 - DNA, 20 bp, Artificial Sequence
  Description of Artificial Sequence: Synthetic oligonucleotide
  Target: FXN; (-) strand; PAM type: NRG; PAM sequence: GAG
ggcggaggttgcagtgagca

SEQ ID NO: 11457 - DNA, 20 bp, Artificial Sequence
  Description of Artificial Sequence: Synthetic oligonucleotide
  Target: FXN; (-) strand; PAM type: NRG; PAM sequence: CAG
gaggcggaggttgcagtgag

SEQ ID NO: 11458 - DNA, 20 bp, Artificial Sequence
  Description of Artificial Sequence: Synthetic oligonucleotide
  Target: FXN; (-) strand; PAM type: NRG; PAM sequence: GAG
caggaggcggaggttgcagt

SEQ ID NO: 11459 - DNA, 20 bp, Artificial Sequence
  Description of Artificial Sequence: Synthetic oligonucleotide
  Target: FXN; (-) strand; PAM type: NRG; PAM sequence: CAG
aacccaggaggcggaggttg

SEQ ID NO: 11460 - DNA, 20 bp, Artificial Sequence
  Description of Artificial Sequence: Synthetic oligonucleotide
  Target: FXN; (-) strand; PAM type: NRG; PAM sequence: AGG
tgcttgaacccaggaggcgg

SEQ ID NO: 11461 - DNA, 20 bp, Artificial Sequence
  Description of Artificial Sequence: Synthetic oligonucleotide
  Target: FXN; (-) strand; PAM type: NRG; PAM sequence: GAG
ttgcttgaacccaggaggcg

SEQ ID NO: 11462 - DNA, 20 bp, Artificial Sequence
  Description of Artificial Sequence: Synthetic oligonucleotide
  Target: FXN; (-) strand; PAM type: NRG; PAM sequence: CGG
aattgcttgaacccaggagg

SEQ ID NO: 11463 - DNA, 20 bp, Artificial Sequence
  Description of Artificial Sequence: Synthetic oligonucleotide
  Target: FXN; (-) strand; PAM type: NRG; PAM sequence: AGG
gagaattgcttgaacccagg

SEQ ID NO: 11464 - DNA, 20 bp, Artificial Sequence
  Description of Artificial Sequence: Synthetic oligonucleotide
  Target: FXN; (-) strand; PAM type: NRG; PAM sequence: GAG
ggagaattgcttgaacccag

SEQ ID NO: 11465 - DNA, 20 bp, Artificial Sequence
  Description of Artificial Sequence: Synthetic oligonucleotide
  Target: FXN; (-) strand; PAM type: NRG; PAM sequence: AGG
caggagaattgcttgaaccc

SEQ ID NO: 11466 - DNA, 20 bp, Artificial Sequence
  Description of Artificial Sequence: Synthetic oligonucleotide
  Target: FXN; (-) strand; PAM type: NRG; PAM sequence: CAG
gcaggagaattgcttgaacc

SEQ ID NO: 11467 - DNA, 20 bp, Artificial Sequence
  Description of Artificial Sequence: Synthetic oligonucleotide
  Target: FXN; (-) strand; PAM type: NRG; PAM sequence: GAG
tactcgggaggctgaggcag

SEQ ID NO: 11468 - DNA, 20 bp, Artificial Sequence
  Description of Artificial Sequence: Synthetic oligonucleotide
  Target: FXN; (-) strand; PAM type: NRG; PAM sequence: AGG
gctactcgggaggctgaggc

SEQ ID NO: 11469 - DNA, 20 bp, Artificial Sequence
  Description of Artificial Sequence: Synthetic oligonucleotide
  Target: FXN; (-) strand; PAM type: NRG; PAM sequence: CAG
agctactcgggaggctgagg

SEQ ID NO: 11470 - DNA, 20 bp, Artificial Sequence
  Description of Artificial Sequence: Synthetic oligonucleotide
  Target: FXN; (-) strand; PAM type: NRG; PAM sequence: AGG
cccagctactcgggaggctg

SEQ ID NO: 11471 - DNA, 20 bp, Artificial Sequence
  Description of Artificial Sequence: Synthetic oligonucleotide
  Target: FXN; (-) strand; PAM type: NRG; PAM sequence: GAG
tcccagctactcgggaggct

SEQ ID NO: 11472 - DNA, 20 bp, Artificial Sequence
  Description of Artificial Sequence: Synthetic oligonucleotide
  Target: FXN; (-) strand; PAM type: NRG; PAM sequence: AGG
tgtaatcccagctactcggg

SEQ ID NO: 11473 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagctactcgg

SEQ ID NO: 11474 - DNA, 20 bp, Artificial Sequence
  Description of Artificial Sequence: Synthetic oligonucleotide
  Target: FXN; (-) strand; PAM type: NRG; PAM sequence: GGG
gcctgtaatcccagctactc

SEQ ID NO: 11475 - DNA, 20 bp, Artificial Sequence
  Description of Artificial Sequence: Synthetic oligonucleotide
  Target: FXN; (-) strand; PAM type: NRG; PAM sequence: CGG
tgcctgtaatcccagctact

SEQ ID NO: 11476 - DNA, 20 bp, Artificial Sequence
  Description of Artificial Sequence: Synthetic oligonucleotide
  Target: FXN; (-) strand; PAM type: NRG; PAM sequence: CAG
gtggcgcatgcctgtaatcc

SEQ ID NO: 11477 - DNA, 20 bp, Artificial Sequence
  Description of Artificial Sequence: Synthetic oligonucleotide
  Target: FXN; (-) strand; PAM type: NRG; PAM sequence: TGG
acaaaattagccgggcatag

SEQ ID NO: 11478 - DNA, 20 bp, Artificial Sequence
  Description of Artificial Sequence: Synthetic oligonucleotide
  Target: FXN; (-) strand; PAM type: NRG; PAM sequence: TAG
aatacaaaattagccgggca

SEQ ID NO: 11479 - DNA, 20 bp, Artificial Sequence
  Description of Artificial Sequence: Synthetic oligonucleotide
  Target: FXN; (-) strand; PAM type: NRG; PAM sequence: GGG
ctaaaaatacaaaattagcc

SEQ ID NO: 11480 - DNA, 20 bp, Artificial Sequence
  Description of Artificial Sequence: Synthetic oligonucleotide
  Target: FXN; (-) strand; PAM type: NRG; PAM sequence: CGG
actaaaaatacaaaattagc

SEQ ID NO: 11481 - DNA, 20 bp, Artificial Sequence
  Description of Artificial Sequence: Synthetic oligonucleotide
  Target: FXN; (-) strand; PAM type: NRG; PAM sequence: TAG
ctctactaaaaatacaaaat

SEQ ID NO: 11482 - DNA, 20 bp, Artificial Sequence
  Description of Artificial Sequence: Synthetic oligonucleotide
  Target: FXN; (-) strand; PAM type: NRG; PAM sequence: GAG
agaccagcttgaccaacatg

SEQ ID NO: 11483 - DNA, 20 bp, Artificial Sequence
  Description of Artificial Sequence: Synthetic oligonucleotide
  Target: FXN; (-) strand; PAM type: NRG; PAM sequence: TGG
cgagaccagcttgaccaaca

SEQ ID NO: 11484 - DNA, 20 bp, Artificial Sequence
  Description of Artificial Sequence: Synthetic oligonucleotide
  Target: FXN; (-) strand; PAM type: NRG; PAM sequence: CAG
tgaggttaggagttcgagac

SEQ ID NO: 11485 - DNA, 20 bp, Artificial Sequence
  Description of Artificial Sequence: Synthetic oligonucleotide
  Target: FXN; (-) strand; PAM type: NRG; PAM sequence: GAG
tcacctgaggttaggagttc

SEQ ID NO: 11486 - DNA, 20 bp, Artificial Sequence
  Description of Artificial Sequence: Synthetic oligonucleotide
  Target: FXN; (-) strand; PAM type: NRG; PAM sequence: GAG
ggcggatcacctgaggttag

SEQ ID NO: 11487 - DNA, 20 bp, Artificial Sequence
  Description of Artificial Sequence: Synthetic oligonucleotide
  Target: FXN; (-) strand; PAM type: NRG; PAM sequence: AGG
cgggcggatcacctgaggtt

SEQ ID NO: 11488 - DNA, 20 bp, Artificial Sequence
  Description of Artificial Sequence: Synthetic oligonucleotide
  Target: FXN; (-) strand; PAM type: NRG; PAM sequence: TAG
gcgggcggatcacctgaggt

SEQ ID NO: 11489 - DNA, 20 bp, Artificial Sequence
  Description of Artificial Sequence: Synthetic oligonucleotide
  Target: FXN; (-) strand; PAM type: NRG; PAM sequence: AGG
cgaggcgggcggatcacctg

SEQ ID NO: 11490 - DNA, 20 bp, Artificial Sequence
  Description of Artificial Sequence: Synthetic oligonucleotide
  Target: FXN; (-) strand; PAM type: NRG; PAM sequence: GAG
ccgaggcgggcggatcacct

SEQ ID NO: 11491 - DNA, 20 bp, Artificial Sequence
  Description of Artificial Sequence: Synthetic oligonucleotide
  Target: FXN; (-) strand; PAM type: NRG; PAM sequence: CGG
cttcgggaggccgaggcggg

SEQ ID NO: 11492 - DNA, 20 bp, Artificial Sequence
  Description of Artificial Sequence: Synthetic oligonucleotide
  Target: FXN; (-) strand; PAM type: NRG; PAM sequence: GGG
gcacttcgggaggccgaggc

SEQ ID NO: 11493 - DNA, 20 bp, Artificial Sequence
  Description of Artificial Sequence: Synthetic oligonucleotide
  Target: FXN; (-) strand; PAM type: NRG; PAM sequence: CGG
agcacttcgggaggccgagg

SEQ ID NO: 11494 - DNA, 20 bp, Artificial Sequence
  Description of Artificial Sequence: Synthetic oligonucleotide
  Target: FXN; (-) strand; PAM type: NRG; PAM sequence: AGG
cccagcacttcgggaggccg

SEQ ID NO: 11495 - DNA, 20 bp, Artificial Sequence
  Description of Artificial Sequence: Synthetic oligonucleotide
  Target: FXN; (-) strand; PAM type: NRG; PAM sequence: GAG
tcccagcacttcgggaggcc

SEQ ID NO: 11496 - DNA, 20 bp, Artificial Sequence
  Description of Artificial Sequence: Synthetic oligonucleotide
  Target: FXN; (-) strand; PAM type: NRG; PAM sequence: AGG
tgtaatcccagcacttcggg

SEQ ID NO: 11497 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagcacttcgg

SEQ ID NO: 11498 - DNA, 20 bp, Artificial Sequence
  Description of Artificial Sequence: Synthetic oligonucleotide
  Target: FXN; (-) strand; PAM type: NRG; PAM sequence: GGG
gcctgtaatcccagcacttc

SEQ ID NO: 11499 - DNA, 20 bp, Artificial Sequence
  Description of Artificial Sequence: Synthetic oligonucleotide
  Target: FXN; (-) strand; PAM type: NRG; PAM sequence: CGG
tgcctgtaatcccagcactt

SEQ ID NO: 11500 - DNA, 20 bp, Artificial Sequence
  Description of Artificial Sequence: Synthetic oligonucleotide
  Target: FXN; (-) strand; PAM type: NRG; PAM sequence: CAG
gtggctcatgcctgtaatcc

SEQ ID NO: 11501 - DNA, 20 bp, Artificial Sequence
  Description of Artificial Sequence: Synthetic oligonucleotide
  Target: FXN; (-) strand; PAM type: NRG; PAM sequence: TGG
agttggccggcctggcgcgg

SEQ ID NO: 11502 - DNA, 20 bp, Artificial Sequence
  Description of Artificial Sequence: Synthetic oligonucleotide
  Target: FXN; (-) strand; PAM type: NRG; PAM sequence: CGG
aagagttggccggcctggcg

SEQ ID NO: 11503 - DNA, 20 bp, Artificial Sequence
  Description of Artificial Sequence: Synthetic oligonucleotide
  Target: FXN; (-) strand; PAM type: NRG; PAM sequence: TGG
taaaaaagagttggccggcc

SEQ ID NO: 11504 - DNA, 20 bp, Artificial Sequence
  Description of Artificial Sequence: Synthetic oligonucleotide
  Target: FXN; (-) strand; PAM type: NRG; PAM sequence: CGG
taaaataaaaaagagttggc

SEQ ID NO: 11505 - DNA, 20 bp, Artificial Sequence
  Description of Artificial Sequence: Synthetic oligonucleotide
  Target: FXN; (-) strand; PAM type: NRG; PAM sequence: TGG
aaaataaaataaaaaagagt

SEQ ID NO: 11506 - DNA, 20 bp, Artificial Sequence
  Description of Artificial Sequence: Synthetic oligonucleotide
  Target: FXN; (-) strand; PAM type: NRG; PAM sequence: GAG
aaataaaataaaataaaaaa

SEQ ID NO: 11507 - DNA, 20 bp, Artificial Sequence
  Description of Artificial Sequence: Synthetic oligonucleotide
  Target: FXN; (-) strand; PAM type: NRG; PAM sequence: AAG
taaaataaaataaaataaaa

SEQ ID NO: 11508 - DNA, 20 bp, Artificial Sequence
  Description of Artificial Sequence: Synthetic oligonucleotide
  Target: FXN; (-) strand; PAM type: NRG; PAM sequence: AAG
aaagtgaaaccctgtcttta

SEQ ID NO: 11509 - DNA, 20 bp, Artificial Sequence
  Description of Artificial Sequence: Synthetic oligonucleotide
  Target: FXN; (-) strand; PAM type: NRG; PAM sequence: AAG
gcattccatcctgggtgaca

SEQ ID NO: 11510 - DNA, 20 bp, Artificial Sequence
  Description of Artificial Sequence: Synthetic oligonucleotide
  Target: FXN; (-) strand; PAM type: NRG; PAM sequence: GGG
gtgccattgcattccatcct

SEQ ID NO: 11511 - DNA, 20 bp, Artificial Sequence
  Description of Artificial Sequence: Synthetic oligonucleotide
  Target: FXN; (-) strand; PAM type: NRG; PAM sequence: TGG
cgtgccattgcattccatcc

SEQ ID NO: 11512 - DNA, 20 bp, Artificial Sequence
  Description of Artificial Sequence: Synthetic oligonucleotide
  Target: FXN; (-) strand; PAM type: NRG; PAM sequence: GAG
agggaggtcaaggctgcagt

SEQ ID NO: 11513 - DNA, 20 bp, Artificial Sequence
  Description of Artificial Sequence: Synthetic oligonucleotide
  Target: FXN; (-) strand; PAM type: NRG; PAM sequence: CAG
agccagggaggtcaaggctg

SEQ ID NO: 11514 - DNA, 20 bp, Artificial Sequence
  Description of Artificial Sequence: Synthetic oligonucleotide
  Target: FXN; (-) strand; PAM type: NRG; PAM sequence: AGG
cacccgagccagggaggtca

SEQ ID NO: 11515 - DNA, 20 bp, Artificial Sequence
  Description of Artificial Sequence: Synthetic oligonucleotide
  Target: FXN; (-) strand; PAM type: NRG; PAM sequence: AAG
tcacccgagccagggaggtc

SEQ ID NO: 11516 - DNA, 20 bp, Artificial Sequence
  Description of Artificial Sequence: Synthetic oligonucleotide
  Target: FXN; (-) strand; PAM type: NRG; PAM sequence: AGG
agggatcacccgagccaggg

SEQ ID NO: 11517 - DNA, 20 bp, Artificial Sequence
  Description of Artificial Sequence: Synthetic oligonucleotide
  Target: FXN; (-) strand; PAM type: NRG; PAM sequence: GAG
gagggatcacccgagccagg

SEQ ID NO: 11518 - DNA, 20 bp, Artificial Sequence
  Description of Artificial Sequence: Synthetic oligonucleotide
  Target: FXN; (-) strand; PAM type: NRG; PAM sequence: GGG
gggagggatcacccgagcca

SEQ ID NO: 11519 - DNA, 20 bp, Artificial Sequence
  Description of Artificial Sequence: Synthetic oligonucleotide
  Target: FXN; (-) strand; PAM type: NRG; PAM sequence: AGG
tgggagggatcacccgagcc

SEQ ID NO: 11520 - DNA, 20 bp, Artificial Sequence
  Description of Artificial Sequence: Synthetic oligonucleotide
  Target: FXN; (-) strand; PAM type: NRG; PAM sequence: CAG
gtgggagggatcacccgagc

SEQ ID NO: 11521 - DNA, 20 bp, Artificial Sequence
  Description of Artificial Sequence: Synthetic oligonucleotide
  Target: FXN; (-) strand; PAM type: NRG; PAM sequence: GAG
tgaggtgggagggatcaccc

SEQ ID NO: 11522 - DNA, 20 bp, Artificial Sequence
  Description of Artificial Sequence: Synthetic oligonucleotide
  Target: FXN; (-) strand; PAM type: NRG; PAM sequence: GGG
ctcaggagcctgaggtggga

SEQ ID NO: 11523 - DNA, 20 bp, Artificial Sequence
  Description of Artificial Sequence: Synthetic oligonucleotide
  Target: FXN; (-) strand; PAM type: NRG; PAM sequence: AGG
cctcaggagcctgaggtggg

SEQ ID NO: 11524 - DNA, 20 bp, Artificial Sequence
  Description of Artificial Sequence: Synthetic oligonucleotide
  Target: FXN; (-) strand; PAM type: NRG; PAM sequence: GAG
tcctcaggagcctgaggtgg

SEQ ID NO: 11525 - DNA, 20 bp, Artificial Sequence
  Description of Artificial Sequence: Synthetic oligonucleotide
  Target: FXN; (-) strand; PAM type: NRG; PAM sequence: GGG
gctcctcaggagcctgaggt

SEQ ID NO: 11526 - DNA, 20 bp, Artificial Sequence
  Description of Artificial Sequence: Synthetic oligonucleotide
  Target: FXN; (-) strand; PAM type: NRG; PAM sequence: TGG
agctcctcaggagcctgagg

SEQ ID NO: 11527 - DNA, 20 bp, Artificial Sequence
  Description of Artificial Sequence: Synthetic oligonucleotide
  Target: FXN; (-) strand; PAM type: NRG; PAM sequence: AGG
tctagctcctcaggagcctg

SEQ ID NO: 11528 - DNA, 20 bp, Artificial Sequence
  Description of Artificial Sequence: Synthetic oligonucleotide
  Target: FXN; (-) strand; PAM type: NRG; PAM sequence: GAG
ttctagctcctcaggagcct

SEQ ID NO: 11529 - DNA, 20 bp, Artificial Sequence
  Description of Artificial Sequence: Synthetic oligonucleotide
  Target: FXN; (-) strand; PAM type: NRG; PAM sequence: GAG
ctgtagttctagctcctcag

SEQ ID NO: 11530 - DNA, 20 bp, Artificial Sequence
  Description of Artificial Sequence: Synthetic oligonucleotide
  Target: FXN; (-) strand; PAM type: NRG; PAM sequence: AGG
gcctgtagttctagctcctc

SEQ ID NO: 11531 - DNA, 20 bp, Artificial Sequence
  Description of Artificial Sequence: Synthetic oligonucleotide
  Target: FXN; (-) strand; PAM type: NRG; PAM sequence: CAG
tgcctgtagttctagctcct

SEQ ID NO: 11532 - DNA, 20 bp, Artificial Sequence
  Description of Artificial Sequence: Synthetic oligonucleotide
  Target: FXN; (-) strand; PAM type: NRG; PAM sequence: TAG
atggcccatgcctgtagttc

SEQ ID NO: 11533 - DNA, 20 bp, Artificial Sequence
  Description of Artificial Sequence: Synthetic oligonucleotide
  Target: FXN; (-) strand; PAM type: NRG; PAM sequence: TAG
ctgggcatggcccatgcctg

SEQ ID NO: 11534 - DNA, 20 bp, Artificial Sequence
  Description of Artificial Sequence: Synthetic oligonucleotide
  Target: FXN; (-) strand; PAM type: NRG; PAM sequence: TGG
attaaaaaattagctgggca

SEQ ID NO: 11535 - DNA, 20 bp, Artificial Sequence
  Description of Artificial Sequence: Synthetic oligonucleotide
  Target: FXN; (-) strand; PAM type: NRG; PAM sequence: GGG
caaaaattaaaaaattagct

SEQ ID NO: 11536 - DNA, 20 bp, Artificial Sequence
  Description of Artificial Sequence: Synthetic oligonucleotide
  Target: FXN; (-) strand; PAM type: NRG; PAM sequence: TGG
ccaaaaattaaaaaattagc

SEQ ID NO: 11537 - DNA, 20 bp, Artificial Sequence
  Description of Artificial Sequence: Synthetic oligonucleotide
  Target: FXN; (-) strand; PAM type: NRG; PAM sequence: TAG
tctaccaaaaattaaaaaat

SEQ ID NO: 11538 - DNA, 20 bp, Artificial Sequence
  Description of Artificial Sequence: Synthetic oligonucleotide
  Target: FXN; (-) strand; PAM type: NRG; PAM sequence: GAG
cccaggaatctgagacaaca

SEQ ID NO: 11539 - DNA, 20 bp, Artificial Sequence
  Description of Artificial Sequence: Synthetic oligonucleotide
  Target: FXN; (-) strand; PAM type: NRG; PAM sequence: CAG
aacccaggaatctgagacaa

SEQ ID NO: 11540 - DNA, 20 bp, Artificial Sequence
  Description of Artificial Sequence: Synthetic oligonucleotide
  Target: FXN; (-) strand; PAM type: NRG; PAM sequence: GAG
tcacttgaacccaggaatct

SEQ ID NO: 11541 - DNA, 20 bp, Artificial Sequence
  Description of Artificial Sequence: Synthetic oligonucleotide
  Target: FXN; (-) strand; PAM type: NRG; PAM sequence: AGG
gagaaggatcacttgaaccc

SEQ ID NO: 11542 - DNA, 20 bp, Artificial Sequence
  Description of Artificial Sequence: Synthetic oligonucleotide
  Target: FXN; (-) strand; PAM type: NRG; PAM sequence: CAG
ggagaaggatcacttgaacc

SEQ ID NO: 11543 - DNA, 20 bp, Artificial Sequence
  Description of Artificial Sequence: Synthetic oligonucleotide
  Target: FXN; (-) strand; PAM type: NRG; PAM sequence: AGG
ctttgggaggccaagggaga

SEQ ID NO: 11544 - DNA, 20 bp, Artificial Sequence
  Description of Artificial Sequence: Synthetic oligonucleotide
  Target: FXN; (-) strand; PAM type: NRG; PAM sequence: AAG
actttgggaggccaagggag

SEQ ID NO: 11545 - DNA, 20 bp, Artificial Sequence
  Description of Artificial Sequence: Synthetic oligonucleotide
  Target: FXN; (-) strand; PAM type: NRG; PAM sequence: GAG
agaactttgggaggccaagg

SEQ ID NO: 11546 - DNA, 20 bp, Artificial Sequence
  Description of Artificial Sequence: Synthetic oligonucleotide
  Target: FXN; (-) strand; PAM type: NRG; PAM sequence: GGG
ccagaactttgggaggccaa

SEQ ID NO: 11547 - DNA, 20 bp, Artificial Sequence
  Description of Artificial Sequence: Synthetic oligonucleotide
  Target: FXN; (-) strand; PAM type: NRG; PAM sequence: AGG
accagaactttgggaggcca

SEQ ID NO: 11548 - DNA, 20 bp, Artificial Sequence
  Description of Artificial Sequence: Synthetic oligonucleotide
  Target: FXN; (-) strand; PAM type: NRG; PAM sequence: AAG
taccagaactttgggaggcc

SEQ ID NO: 11549 - DNA, 20 bp, Artificial Sequence
  Description of Artificial Sequence: Synthetic oligonucleotide
  Target: FXN; (-) strand; PAM type: NRG; PAM sequence: AGG
tgtaataccagaactttggg

SEQ ID NO: 11550 - DNA, 20 bp, Artificial Sequence
  Description of Artificial Sequence: Synthetic oligonucleotide
  Target: FXN; (-) strand; PAM type: NRG; PAM sequence: GAG
ctgtaataccagaactttgg

SEQ ID NO: 11551 - DNA, 20 bp, Artificial Sequence
  Description of Artificial Sequence: Synthetic oligonucleotide
  Target: FXN; (-) strand; PAM type: NRG; PAM sequence: GGG
gcctgtaataccagaacttt

SEQ ID NO: 11552 - DNA, 20 bp, Artificial Sequence
  Description of Artificial Sequence: Synthetic oligonucleotide
  Target: FXN; (-) strand; PAM type: NRG; PAM sequence: TGG
tgcctgtaataccagaactt

SEQ ID NO: 11553 - DNA, 20 bp, Artificial Sequence
  Description of Artificial Sequence: Synthetic oligonucleotide
  Target: FXN; (-) strand; PAM type: NRG; PAM sequence: CAG
gtggctcatgcctgtaatac

SEQ ID NO: 11554 - DNA, 20 bp, Artificial Sequence
  Description of Artificial Sequence: Synthetic oligonucleotide
  Target: FXN; (-) strand; PAM type: NRG; PAM sequence: TGG
tggccatgggctgggtgcag

SEQ ID NO: 11555 - DNA, 20 bp, Artificial Sequence
  Description of Artificial Sequence: Synthetic oligonucleotide
  Target: FXN; (-) strand; PAM type: NRG; PAM sequence: CAG
agctggccatgggctgggtg

SEQ ID NO: 11556 - DNA, 20 bp, Artificial Sequence
  Description of Artificial Sequence: Synthetic oligonucleotide
  Target: FXN; (-) strand; PAM type: NRG; PAM sequence: GGG
tcaagagctggccatgggct

SEQ ID NO: 11557 - DNA, 20 bp, Artificial Sequence
  Description of Artificial Sequence: Synthetic oligonucleotide
  Target: FXN; (-) strand; PAM type: NRG; PAM sequence: TGG
atcaagagctggccatgggc

SEQ ID NO: 11558 - DNA, 20 bp, Artificial Sequence
  Description of Artificial Sequence: Synthetic oligonucleotide
  Target: FXN; (-) strand; PAM type: NRG; PAM sequence: GGG
tcgtatcaagagctggccat

SEQ ID NO: 11559 - DNA, 20 bp, Artificial Sequence
  Description of Artificial Sequence: Synthetic oligonucleotide
  Target: FXN; (-) strand; PAM type: NRG; PAM sequence: TGG
atcgtatcaagagctggcca

SEQ ID NO: 11560 - DNA, 20 bp, Artificial Sequence
  Description of Artificial Sequence: Synthetic oligonucleotide
  Target: FXN; (-) strand; PAM type: NRG; PAM sequence: TGG
agacagatcgtatcaagagc

SEQ ID NO: 11561 - DNA, 20 bp, Artificial Sequence
  Description of Artificial Sequence: Synthetic oligonucleotide
  Target: FXN; (-) strand; PAM type: NRG; PAM sequence: GAG
aaagagacagatcgtatcaa

SEQ ID NO: 11562 - DNA, 20 bp, Artificial Sequence
  Description of Artificial Sequence: Synthetic oligonucleotide
  Target: FXN; (-) strand; PAM type: NRG; PAM sequence: AAG
agaaagagacagatcgtatc

SEQ ID NO: 11563 - DNA, 20 bp, Artificial Sequence
  Description of Artificial Sequence: Synthetic oligonucleotide
  Target: FXN; (-) strand; PAM type: NRG; PAM sequence: CAG
aaaaaaagaaaagaaagaga

SEQ ID NO: 11564 - DNA, 20 bp, Artificial Sequence
  Description of Artificial Sequence: Synthetic oligonucleotide
  Target: FXN; (-) strand; PAM type: NRG; PAM sequence: GAG
aaaaaaaaaaagaaaagaaa

SEQ ID NO: 11565 - DNA, 20 bp, Artificial Sequence
  Description of Artificial Sequence: Synthetic oligonucleotide
  Target: FXN; (-) strand; PAM type: NRG; PAM sequence: AAG
aaaaaaaaaaaaagaaaaga

SEQ ID NO: 11566 - DNA, 20 bp, Artificial Sequence
  Description of Artificial Sequence: Synthetic oligonucleotide
  Target: FXN; (-) strand; PAM type: NRG; PAM sequence: AAG
aattaaaaaaaaaaaaagaa

SEQ ID NO: 11567 - DNA, 20 bp, Artificial Sequence
  Description of Artificial Sequence: Synthetic oligonucleotide
  Target: FXN; (-) strand; PAM type: NRG; PAM sequence: AAG
tctcaaattaaaaaaaaaaa

SEQ ID NO: 11568 - DNA, 20 bp, Artificial Sequence
  Description of Artificial Sequence: Synthetic oligonucleotide
  Target: FXN; (-) strand; PAM type: NRG; PAM sequence: AAG
tttatgtataatatcaaaga

SEQ ID NO: 11569 - DNA, 20 bp, Artificial Sequence
  Description of Artificial Sequence: Synthetic oligonucleotide
  Target: FXN; (-) strand; PAM type: NRG; PAM sequence: AAG
gtggtttatgtataatatca

SEQ ID NO: 11570 - DNA, 20 bp, Artificial Sequence
  Description of Artificial Sequence: Synthetic oligonucleotide
  Target: FXN; (-) strand; PAM type: NRG; PAM sequence: TGG
tactgaaagacattttggtg

SEQ ID NO: 11571 - DNA, 20 bp, Artificial Sequence
  Description of Artificial Sequence: Synthetic oligonucleotide
  Target: FXN; (-) strand; PAM type: NRG; PAM sequence: TGG
ttacttactgaaagacattt

SEQ ID NO: 11572 - DNA, 20 bp, Artificial Sequence
  Description of Artificial Sequence: Synthetic oligonucleotide
  Target: FXN; (-) strand; PAM type: NRG; PAM sequence: AAG
tggttcattttacttactga

SEQ ID NO: 11573 - DNA, 20 bp, Artificial Sequence
  Description of Artificial Sequence: Synthetic oligonucleotide
  Target: FXN; (-) strand; PAM type: NRG; PAM sequence: TGG
agaattttctgtatctaaaa

SEQ ID NO: 11574 - DNA, 20 bp, Artificial Sequence
  Description of Artificial Sequence: Synthetic oligonucleotide
  Target: FXN; (-) strand; PAM type: NRG; PAM sequence: TAG
cttaactatgccaatctaat

SEQ ID NO: 11575 - DNA, 20 bp, Artificial Sequence
  Description of Artificial Sequence: Synthetic oligonucleotide
  Target: FXN; (-) strand; PAM type: NRG; PAM sequence: TGG
caatgtcaactttatatttt

SEQ ID NO: 11576 - DNA, 20 bp, Artificial Sequence
  Description of Artificial Sequence: Synthetic oligonucleotide
  Target: FXN; (-) strand; PAM type: NRG; PAM sequence: TAG
ggcaagggctgaagataagg

SEQ ID NO: 11577 - DNA, 20 bp, Artificial Sequence
  Description of Artificial Sequence: Synthetic oligonucleotide
  Target: FXN; (-) strand; PAM type: NRG; PAM sequence: AGG
aaaggcaagggctgaagata

SEQ ID NO: 11578 - DNA, 20 bp, Artificial Sequence
  Description of Artificial Sequence: Synthetic oligonucleotide
  Target: FXN; (-) strand; PAM type: NRG; PAM sequence: AAG
taaaggcaagggctgaagat

SEQ ID NO: 11579 - DNA, 20 bp, Artificial Sequence
  Description of Artificial Sequence: Synthetic oligonucleotide
  Target: FXN; (-) strand; PAM type: NRG; PAM sequence: AAG
cctcttaaaggcaagggctg

SEQ ID NO: 11580 - DNA, 20 bp, Artificial Sequence
  Description of Artificial Sequence: Synthetic oligonucleotide
  Target: FXN; (-) strand; PAM type: NRG; PAM sequence: GGG
catttgcctcttaaaggcaa

SEQ ID NO: 11581 - DNA, 20 bp, Artificial Sequence
  Description of Artificial Sequence: Synthetic oligonucleotide
  Target: FXN; (-) strand; PAM type: NRG; PAM sequence: AGG
tcatttgcctcttaaaggca

SEQ ID NO: 11582 - DNA, 20 bp, Artificial Sequence
  Description of Artificial Sequence: Synthetic oligonucleotide
  Target: FXN; (-) strand; PAM type: NRG; PAM sequence: AAG
ttcatttgcctcttaaaggc

SEQ ID NO: 11583 - DNA, 20 bp, Artificial Sequence
  Description of Artificial Sequence: Synthetic oligonucleotide
  Target: FXN; (-) strand; PAM type: NRG; PAM sequence: AGG
tgtgttcatttgcctcttaa

SEQ ID NO: 11584 - DNA, 20 bp, Artificial Sequence
  Description of Artificial Sequence: Synthetic oligonucleotide
  Target: FXN; (-) strand; PAM type: NRG; PAM sequence: AAG
ttgtgttcatttgcctctta

SEQ ID NO: 11585 - DNA, 20 bp, Artificial Sequence
  Description of Artificial Sequence: Synthetic oligonucleotide
  Target: FXN; (-) strand; PAM type: NRG; PAM sequence: AAG
tcactgtctcagaaccaagc

SEQ ID NO: 11586 - DNA, 20 bp, Artificial Sequence
  Description of Artificial Sequence: Synthetic oligonucleotide
  Target: FXN; (-) strand; PAM type: NRG; PAM sequence: AAG
tccttcactgtctcagaacc

SEQ ID NO: 11587 - DNA, 20 bp, Artificial Sequence
  Description of Artificial Sequence: Synthetic oligonucleotide
  Target: FXN; (-) strand; PAM type: NRG; PAM sequence: CAG
gggaaagtccttcactgtct

SEQ ID NO: 11588 - DNA, 20 bp, Artificial Sequence
  Description of Artificial Sequence: Synthetic oligonucleotide
  Target: FXN; (-) strand; PAM type: NRG; PAM sequence: AAG
tatatttaaatactggggga

SEQ ID NO: 11589 - DNA, 20 bp, Artificial Sequence
  Description of Artificial Sequence: Synthetic oligonucleotide
  Target: FXN; (-) strand; PAM type: NRG; PAM sequence: GGG
taaatatatttaaatactgg

SEQ ID NO: 11590 - DNA, 20 bp, Artificial Sequence
  Description of Artificial Sequence: Synthetic oligonucleotide
  Target: FXN; (-) strand; PAM type: NRG; PAM sequence: GGG
gtaaatatatttaaatactg

SEQ ID NO: 11591 - DNA, 20 bp, Artificial Sequence
  Description of Artificial Sequence: Synthetic oligonucleotide
  Target: FXN; (-) strand; PAM type: NRG; PAM sequence: GGG
tgtaaatatatttaaatact

SEQ ID NO: 11592 - DNA, 20 bp, Artificial Sequence
  Description of Artificial Sequence: Synthetic oligonucleotide
  Target: FXN; (-) strand; PAM type: NRG; PAM sequence: TGG
atgtaaatatatttaaatac

SEQ ID NO: 11593 - DNA, 20 bp, Artificial Sequence
  Description of Artificial Sequence: Synthetic oligonucleotide
  Target: FXN; (-) strand; PAM type: NRG; PAM sequence: TGG
aatatttagatttatgtaac

SEQ ID NO: 11594 - DNA, 20 bp, Artificial Sequence
  Description of Artificial Sequence: Synthetic oligonucleotide
  Target: FXN; (-) strand; PAM type: NRG; PAM sequence: TAG
ttggagatttttttaatatt

SEQ ID NO: 11595 - DNA, 20 bp, Artificial Sequence
  Description of Artificial Sequence: Synthetic oligonucleotide
  Target: FXN; (-) strand; PAM type: NRG; PAM sequence: GAG
atgccatctaaaatctattg

SEQ ID NO: 11596 - DNA, 20 bp, Artificial Sequence
  Description of Artificial Sequence: Synthetic oligonucleotide
  Target: FXN; (-) strand; PAM type: NRG; PAM sequence: TGG
gaatgccatctaaaatctat

SEQ ID NO: 11597 - DNA, 20 bp, Artificial Sequence
  Description of Artificial Sequence: Synthetic oligonucleotide
  Target: FXN; (-) strand; PAM type: NRG; PAM sequence: TGG
tgttcaacttttcacaaaga

SEQ ID NO: 11598 - DNA, 20 bp, Artificial Sequence
  Description of Artificial Sequence: Synthetic oligonucleotide
  Target: FXN; (-) strand; PAM type: NRG; PAM sequence: AAG
gtaatgttcaacttttcaca

SEQ ID NO: 11599 - DNA, 20 bp, Artificial Sequence
  Description of Artificial Sequence: Synthetic oligonucleotide
  Target: FXN; (-) strand; PAM type: NRG; PAM sequence: TAG
aagatatgatcagatttcat

SEQ ID NO: 11600 - DNA, 20 bp, Artificial Sequence
  Description of Artificial Sequence: Synthetic oligonucleotide
  Target: FXN; (-) strand; PAM type: NRG; PAM sequence: CAG
tatccttctaaagatatgat

SEQ ID NO: 11601 - DNA, 20 bp, Artificial Sequence
  Description of Artificial Sequence: Synthetic oligonucleotide
  Target: FXN; (-) strand; PAM type: NRG; PAM sequence: AAG
tatcactgtttatccttcta

SEQ ID NO: 11602 - DNA, 20 bp, Artificial Sequence
  Description of Artificial Sequence: Synthetic oligonucleotide
  Target: FXN; (-) strand; PAM type: NRG; PAM sequence: CAG
aaaaaacagttattctgatt

SEQ ID NO: 11603 - DNA, 20 bp, Artificial Sequence
  Description of Artificial Sequence: Synthetic oligonucleotide
  Target: FXN; (-) strand; PAM type: NRG; PAM sequence: CAG
tcaaagaaaaccccaaaaaa

SEQ ID NO: 11604 - DNA, 20 bp, Artificial Sequence
  Description of Artificial Sequence: Synthetic oligonucleotide
  Target: FXN; (-) strand; PAM type: NRG; PAM sequence: AAG
aagagcaaaactccgtctca

SEQ ID NO: 11605 - DNA, 20 bp, Artificial Sequence
  Description of Artificial Sequence: Synthetic oligonucleotide
  Target: FXN; (-) strand; PAM type: NRG; PAM sequence: GAG
cactccagcctgggcaacaa

SEQ ID NO: 11606 - DNA, 20 bp, Artificial Sequence
  Description of Artificial Sequence: Synthetic oligonucleotide
  Target: FXN; (-) strand; PAM type: NRG; PAM sequence: AAG
tgcactccagcctgggcaac

SEQ ID NO: 11607 - DNA, 20 bp, Artificial Sequence
  Description of Artificial Sequence: Synthetic oligonucleotide
  Target: FXN; (-) strand; PAM type: NRG; PAM sequence: GGG
gcaccactgcactccagcct

SEQ ID NO: 11608 - DNA, 20 bp, Artificial Sequence
  Description of Artificial Sequence: Synthetic oligonucleotide
  Target: FXN; (-) strand; PAM type: NRG; PAM sequence: TGG
ggcaccactgcactccagcc

SEQ ID NO: 11609 - DNA, 20 bp, Artificial Sequence
  Description of Artificial Sequence: Synthetic oligonucleotide
  Target: FXN; (-) strand; PAM type: NRG; PAM sequence: CAG
gaggtggcaccactgcactc

SEQ ID NO: 11610 - DNA, 20 bp, Artificial Sequence
  Description of Artificial Sequence: Synthetic oligonucleotide
  Target: FXN; (-) strand; PAM type: NRG; PAM sequence: TGG
gaggttgcagtgagctgagg

SEQ ID NO: 11611 - DNA, 20 bp, Artificial Sequence
  Description of Artificial Sequence: Synthetic oligonucleotide
  Target: FXN; (-) strand; PAM type: NRG; PAM sequence: AGG
gcggaggttgcagtgagctg

SEQ ID NO: 11612 - DNA, 20 bp, Artificial Sequence
  Description of Artificial Sequence: Synthetic oligonucleotide
  Target: FXN; (-) strand; PAM type: NRG; PAM sequence: GAG
ggcggaggttgcagtgagct

SEQ ID NO: 11613 - DNA, 20 bp, Artificial Sequence
  Description of Artificial Sequence: Synthetic oligonucleotide
  Target: FXN; (-) strand; PAM type: NRG; PAM sequence: GAG
cagggggcggaggttgcagt

SEQ ID NO: 11614 - DNA, 20 bp, Artificial Sequence
  Description of Artificial Sequence: Synthetic oligonucleotide
  Target: FXN; (-) strand; PAM type: NRG; PAM sequence: CAG
aatccagggggcggaggttg

SEQ ID NO: 11615 - DNA, 20 bp, Artificial Sequence
  Description of Artificial Sequence: Synthetic oligonucleotide
  Target: FXN; (-) strand; PAM type: NRG; PAM sequence: AGG
ctcttgaatccagggggcgg

SEQ ID NO: 11616 - DNA, 20 bp, Artificial Sequence
  Description of Artificial Sequence: Synthetic oligonucleotide
  Target: FXN; (-) strand; PAM type: NRG; PAM sequence: GAG
tctcttgaatccagggggcg

SEQ ID NO: 11617 - DNA, 20 bp, Artificial Sequence
  Description of Artificial Sequence: Synthetic oligonucleotide
  Target: FXN; (-) strand; PAM type: NRG; PAM sequence: CGG
aatctcttgaatccaggggg

SEQ ID NO: 11618 - DNA, 20 bp, Artificial Sequence
  Description of Artificial Sequence: Synthetic oligonucleotide
  Target: FXN; (-) strand; PAM type: NRG; PAM sequence: GGG
gataatctcttgaatccagg

SEQ ID NO: 11619 - DNA, 20 bp, Artificial Sequence
  Description of Artificial Sequence: Synthetic oligonucleotide
  Target: FXN; (-) strand; PAM type: NRG; PAM sequence: GGG
ggataatctcttgaatccag

SEQ ID NO: 11620 - DNA, 20 bp, Artificial Sequence
  Description of Artificial Sequence: Synthetic oligonucleotide
  Target: FXN; (-) strand; PAM type: NRG; PAM sequence: GGG
aggataatctcttgaatcca

SEQ ID NO: 11621 - DNA, 20 bp, Artificial Sequence
  Description of Artificial Sequence: Synthetic oligonucleotide
  Target: FXN; (-) strand; PAM type: NRG; PAM sequence: AGG
caggataatctcttgaatcc

SEQ ID NO: 11622 - DNA, 20 bp, Artificial Sequence
  Description of Artificial Sequence: Synthetic oligonucleotide
  Target: FXN; (-) strand; PAM type: NRG; PAM sequence: CAG
gcaggataatctcttgaatc

SEQ ID NO: 11623 - DNA, 20 bp, Artificial Sequence
  Description of Artificial Sequence: Synthetic oligonucleotide
  Target: FXN; (-) strand; PAM type: NRG; PAM sequence: AGG
gctactcgggaggctgaggc

SEQ ID NO: 11624 - DNA, 20 bp, Artificial Sequence
  Description of Artificial Sequence: Synthetic oligonucleotide
  Target: FXN; (-) strand; PAM type: NRG; PAM sequence: CAG
agctactcgggaggctgagg

SEQ ID NO: 11625 - DNA, 20 bp, Artificial Sequence
  Description of Artificial Sequence: Synthetic oligonucleotide
  Target: FXN; (-) strand; PAM type: NRG; PAM sequence: AGG
cccagctactcgggaggctg

SEQ ID NO: 11626 - DNA, 20 bp, Artificial Sequence
  Description of Artificial Sequence: Synthetic oligonucleotide
  Target: FXN; (-) strand; PAM type: NRG; PAM sequence: GAG
tcccagctactcgggaggct

SEQ ID NO: 11627 - DNA, 20 bp, Artificial Sequence
  Description of Artificial Sequence: Synthetic oligonucleotide
  Target: FXN; (-) strand; PAM type: NRG; PAM sequence: AGG
tgtaatcccagctactcggg

SEQ ID NO: 11628 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagctactcgg

SEQ ID NO: 11629 - DNA, 20 bp, Artificial Sequence
  Description of Artificial Sequence: Synthetic oligonucleotide
  Target: FXN; (-) strand; PAM type: NRG; PAM sequence: GGG
gcctgtaatcccagctactc

SEQ ID NO: 11630 - DNA, 20 bp, Artificial Sequence
  Description of Artificial Sequence: Synthetic oligonucleotide
  Target: FXN; (-) strand; PAM type: NRG; PAM sequence: CGG
agcctgtaatcccagctact

SEQ ID NO: 11631 - DNA, 20 bp, Artificial Sequence
  Description of Artificial Sequence: Synthetic oligonucleotide
  Target: FXN; (-) strand; PAM type: NRG; PAM sequence: CAG
gtggggcgagcctgtaatcc

SEQ ID NO: 11632 - DNA, 20 bp, Artificial Sequence
  Description of Artificial Sequence: Synthetic oligonucleotide
  Target: FXN; (-) strand; PAM type: NRG; PAM sequence: GAG
ttagctgggcatggtggggc

SEQ ID NO: 11633 - DNA, 20 bp, Artificial Sequence
  Description of Artificial Sequence: Synthetic oligonucleotide
  Target: FXN; (-) strand; PAM type: NRG; PAM sequence: GGG
aaaattagctgggcatggtg

SEQ ID NO: 11634 - DNA, 20 bp, Artificial Sequence
  Description of Artificial Sequence: Synthetic oligonucleotide
  Target: FXN; (-) strand; PAM type: NRG; PAM sequence: GGG
aaaaattagctgggcatggt

SEQ ID NO: 11635 - DNA, 20 bp, Artificial Sequence
  Description of Artificial Sequence: Synthetic oligonucleotide
  Target: FXN; (-) strand; PAM type: NRG; PAM sequence: TGG
caaaaattagctgggcatgg

SEQ ID NO: 11636 - DNA, 20 bp, Artificial Sequence
  Description of Artificial Sequence: Synthetic oligonucleotide
  Target: FXN; (-) strand; PAM type: NRG; PAM sequence: TGG
atacaaaaattagctgggca

SEQ ID NO: 11637 - DNA, 20 bp, Artificial Sequence
  Description of Artificial Sequence: Synthetic oligonucleotide
  Target: FXN; (-) strand; PAM type: NRG; PAM sequence: GGG
taaaaatacaaaaattagct

SEQ ID NO: 11638 - DNA, 20 bp, Artificial Sequence
  Description of Artificial Sequence: Synthetic oligonucleotide
  Target: FXN; (-) strand; PAM type: NRG; PAM sequence: TGG
ctaaaaatacaaaaattagc

SEQ ID NO: 11639 - DNA, 20 bp, Artificial Sequence
  Description of Artificial Sequence: Synthetic oligonucleotide
  Target: FXN; (-) strand; PAM type: NRG; PAM sequence: TAG
tctactaaaaatacaaaaat

SEQ ID NO: 11640 - DNA, 20 bp, Artificial Sequence
  Description of Artificial Sequence: Synthetic oligonucleotide
  Target: FXN; (-) strand; PAM type: NRG; PAM sequence: TGG
caagaccagcctggctgaca

SEQ ID NO: 11641 - DNA, 20 bp, Artificial Sequence
  Description of Artificial Sequence: Synthetic oligonucleotide
  Target: FXN; (-) strand; PAM type: NRG; PAM sequence: TGG
tcaggagttcaagaccagcc

SEQ ID NO: 11642 - DNA, 20 bp, Artificial Sequence
  Description of Artificial Sequence: Synthetic oligonucleotide
  Target: FXN; (-) strand; PAM type: NRG; PAM sequence: CAG
tgaggtcaggagttcaagac

SEQ ID NO: 11643 - DNA, 20 bp, Artificial Sequence
  Description of Artificial Sequence: Synthetic oligonucleotide
  Target: FXN; (-) strand; PAM type: NRG; PAM sequence: AAG
tcacctgaggtcaggagttc

SEQ ID NO: 11644 - DNA, 20 bp, Artificial Sequence
  Description of Artificial Sequence: Synthetic oligonucleotide
  Target: FXN; (-) strand; PAM type: NRG; PAM sequence: GAG
ggtggatcacctgaggtcag

SEQ ID NO: 11645 - DNA, 20 bp, Artificial Sequence
  Description of Artificial Sequence: Synthetic oligonucleotide
  Target: FXN; (-) strand; PAM type: NRG; PAM sequence: AGG
cgggtggatcacctgaggtc

SEQ ID NO: 11646 - DNA, 20 bp, Artificial Sequence
  Description of Artificial Sequence: Synthetic oligonucleotide
  Target: FXN; (-) strand; PAM type: NRG; PAM sequence: CAG
gcgggtggatcacctgaggt

SEQ ID NO: 11647 - DNA, 20 bp, Artificial Sequence
  Description of Artificial Sequence: Synthetic oligonucleotide
  Target: FXN; (-) strand; PAM type: NRG; PAM sequence: AGG
tgaggcgggtggatcacctg

SEQ ID NO: 11648 - DNA, 20 bp, Artificial Sequence
  Description of Artificial Sequence: Synthetic oligonucleotide
  Target: FXN; (-) strand; PAM type: NRG; PAM sequence: GAG
ctgaggcgggtggatcacct

SEQ ID NO: 11649 - DNA, 20 bp, Artificial Sequence
  Description of Artificial Sequence: Synthetic oligonucleotide
  Target: FXN; (-) strand; PAM type: NRG; PAM sequence: TGG
ttttgggaggctgaggcggg

SEQ ID NO: 11650 - DNA, 20 bp, Artificial Sequence
  Description of Artificial Sequence: Synthetic oligonucleotide
  Target: FXN; (-) strand; PAM type: NRG; PAM sequence: GGG
gcattttgggaggctgaggc

SEQ ID NO: 11651 - DNA, 20 bp, Artificial Sequence
  Description of Artificial Sequence: Synthetic oligonucleotide
  Target: FXN; (-) strand; PAM type: NRG; PAM sequence: CGG
agcattttgggaggctgagg

SEQ ID NO: 11652 - DNA, 20 bp, Artificial Sequence
  Description of Artificial Sequence: Synthetic oligonucleotide
  Target: FXN; (-) strand; PAM type: NRG; PAM sequence: AGG
cctagcattttgggaggctg

SEQ ID NO: 11653 - DNA, 20 bp, Artificial Sequence
  Description of Artificial Sequence: Synthetic oligonucleotide
  Target: FXN; (-) strand; PAM type: NRG; PAM sequence: GAG
tcctagcattttgggaggct

SEQ ID NO: 11654 - DNA, 20 bp, Artificial Sequence
  Description of Artificial Sequence: Synthetic oligonucleotide
  Target: FXN; (-) strand; PAM type: NRG; PAM sequence: AGG
tgtaatcctagcattttggg

SEQ ID NO: 11655 - DNA, 20 bp, Artificial Sequence
  Description of Artificial Sequence: Synthetic oligonucleotide
  Target: FXN; (-) strand; PAM type: NRG; PAM sequence: GAG
ctgtaatcctagcattttgg

SEQ ID NO: 11656 - DNA, 20 bp, Artificial Sequence
  Description of Artificial Sequence: Synthetic oligonucleotide
  Target: FXN; (-) strand; PAM type: NRG; PAM sequence: GGG
gcctgtaatcctagcatttt

SEQ ID NO: 11657 - DNA, 20 bp, Artificial Sequence
  Description of Artificial Sequence: Synthetic oligonucleotide
  Target: FXN; (-) strand; PAM type: NRG; PAM sequence: TGG
cgcctgtaatcctagcattt

SEQ ID NO: 11658 - DNA, 20 bp, Artificial Sequence
  Description of Artificial Sequence: Synthetic oligonucleotide
  Target: FXN; (-) strand; PAM type: NRG; PAM sequence: TAG
gtggctcacgcctgtaatcc

SEQ ID NO: 11659 - DNA, 20 bp, Artificial Sequence
  Description of Artificial Sequence: Synthetic oligonucleotide
  Target: FXN; (-) strand; PAM type: NRG; PAM sequence: TGG
aaaaaataggctgggcctgg

SEQ ID NO: 11660 - DNA, 20 bp, Artificial Sequence
  Description of Artificial Sequence: Synthetic oligonucleotide
  Target: FXN; (-) strand; PAM type: NRG; PAM sequence: TGG
aaaaaaaaataggctgggcc

SEQ ID NO: 11661 - DNA, 20 bp, Artificial Sequence
  Description of Artificial Sequence: Synthetic oligonucleotide
  Target: FXN; (-) strand; PAM type: NRG; PAM sequence: GGG
aaaaaaaaaaaaaataggct

SEQ ID NO: 11662 - DNA, 20 bp, Artificial Sequence
  Description of Artificial Sequence: Synthetic oligonucleotide
  Target: FXN; (-) strand; PAM type: NRG; PAM sequence: TGG
gaaaaaaaaaaaaaataggc

SEQ ID NO: 11663 - DNA, 20 bp, Artificial Sequence
  Description of Artificial Sequence: Synthetic oligonucleotide
  Target: FXN; (-) strand; PAM type: NRG; PAM sequence: AGG
aaaagaaaaaaaaaaaaaat

SEQ ID NO: 11664 - DNA, 20 bp, Artificial Sequence
  Description of Artificial Sequence: Synthetic oligonucleotide
  Target: FXN; (-) strand; PAM type: NRG; PAM sequence: TAG
aaaaagaaaaaaaaaaaaaa

SEQ ID NO: 11665 - DNA, 20 bp, Artificial Sequence
  Description of Artificial Sequence: Synthetic oligonucleotide
  Target: FXN; (-) strand; PAM type: NRG; PAM sequence: AAG
gtgagactccgtctcaaaaa

SEQ ID NO: 11666 - DNA, 20 bp, Artificial Sequence
  Description of Artificial Sequence: Synthetic oligonucleotide
  Target: FXN; (-) strand; PAM type: NRG; PAM sequence: GAG
tccagcctgggtgacagagt

SEQ ID NO: 11667 - DNA, 20 bp, Artificial Sequence
  Description of Artificial Sequence: Synthetic oligonucleotide
  Target: FXN; (-) strand; PAM type: NRG; PAM sequence: GAG
gcactccagcctgggtgaca

SEQ ID NO: 11668 - DNA, 20 bp, Artificial Sequence
  Description of Artificial Sequence: Synthetic oligonucleotide
  Target: FXN; (-) strand; PAM type: NRG; PAM sequence: CAG
ctgcactccagcctgggtga

SEQ ID NO: 11669 - DNA, 20 bp, Artificial Sequence
  Description of Artificial Sequence: Synthetic oligonucleotide
  Target: FXN; (-) strand; PAM type: NRG; PAM sequence: GGG
gtgccactgcactccagcct

SEQ ID NO: 11670 - DNA, 20 bp, Artificial Sequence
  Description of Artificial Sequence: Synthetic oligonucleotide
  Target: FXN; (-) strand; PAM type: NRG; PAM sequence: TGG
tgtgccactgcactccagcc

SEQ ID NO: 11671 - DNA, 20 bp, Artificial Sequence
  Description of Artificial Sequence: Synthetic oligonucleotide
  Target: FXN; (-) strand; PAM type: NRG; PAM sequence: CAG
gacattgtgccactgcactc

SEQ ID NO: 11672 - DNA, 20 bp, Artificial Sequence
  Description of Artificial Sequence: Synthetic oligonucleotide
  Target: FXN; (-) strand; PAM type: NRG; PAM sequence: GAG
ccggaggtggaggttgcaat

SEQ ID NO: 11673 - DNA, 20 bp, Artificial Sequence
  Description of Artificial Sequence: Synthetic oligonucleotide
  Target: FXN; (-) strand; PAM type: NRG; PAM sequence: AGG
cactgaaaccccggaggtgg

SEQ ID NO: 11674 - DNA, 20 bp, Artificial Sequence
  Description of Artificial Sequence: Synthetic oligonucleotide
  Target: FXN; (-) strand; PAM type: NRG; PAM sequence: GAG
tcactgaaaccccggaggtg

SEQ ID NO: 11675 - DNA, 20 bp, Artificial Sequence
  Description of Artificial Sequence: Synthetic oligonucleotide
  Target: FXN; (-) strand; PAM type: NRG; PAM sequence: TGG
aatcactgaaaccccggagg

SEQ ID NO: 11676 - DNA, 20 bp, Artificial Sequence
  Description of Artificial Sequence: Synthetic oligonucleotide
  Target: FXN; (-) strand; PAM type: NRG; PAM sequence: AGG
gagaatcactgaaaccccgg

SEQ ID NO: 11677 - DNA, 20 bp, Artificial Sequence
  Description of Artificial Sequence: Synthetic oligonucleotide
  Target: FXN; (-) strand; PAM type: NRG; PAM sequence: GAG
ggagaatcactgaaaccccg

SEQ ID NO: 11678 - DNA, 20 bp, Artificial Sequence
  Description of Artificial Sequence: Synthetic oligonucleotide
  Target: FXN; (-) strand; PAM type: NRG; PAM sequence: CGG
caggagaatcactgaaaccc

SEQ ID NO: 11679 - DNA, 20 bp, Artificial Sequence
  Description of Artificial Sequence: Synthetic oligonucleotide
  Target: FXN; (-) strand; PAM type: NRG; PAM sequence: GAG
tacttgggaggctgagacag

SEQ ID NO: 11680 - DNA, 20 bp, Artificial Sequence
  Description of Artificial Sequence: Synthetic oligonucleotide
  Target: FXN; (-) strand; PAM type: NRG; PAM sequence: AGG
gctacttgggaggctgagac

SEQ ID NO: 11681 - DNA, 20 bp, Artificial Sequence
  Description of Artificial Sequence: Synthetic oligonucleotide
  Target: FXN; (-) strand; PAM type: NRG; PAM sequence: CAG
agctacttgggaggctgaga

SEQ ID NO: 11682 - DNA, 20 bp, Artificial Sequence
  Description of Artificial Sequence: Synthetic oligonucleotide
  Target: FXN; (-) strand; PAM type: NRG; PAM sequence: GAG
tcccagctacttgggaggct

SEQ ID NO: 11683 - DNA, 20 bp, Artificial Sequence
  Description of Artificial Sequence: Synthetic oligonucleotide
  Target: FXN; (-) strand; PAM type: NRG; PAM sequence: AGG
gtagttcccagctacttggg

SEQ ID NO: 11684 - DNA, 20 bp, Artificial Sequence
  Description of Artificial Sequence: Synthetic oligonucleotide
  Target: FXN; (-) strand; PAM type: NRG; PAM sequence: GAG
tgtagttcccagctacttgg

SEQ ID NO: 11685 - DNA, 20 bp, Artificial Sequence
  Description of Artificial Sequence: Synthetic oligonucleotide
  Target: FXN; (-) strand; PAM type: NRG; PAM sequence: GGG
cctgtagttcccagctactt

SEQ ID NO: 11686 - DNA, 20 bp, Artificial Sequence
  Description of Artificial Sequence: Synthetic oligonucleotide
  Target: FXN; (-) strand; PAM type: NRG; PAM sequence: TGG
gcctgtagttcccagctact

SEQ ID NO: 11687 - DNA, 20 bp, Artificial Sequence
  Description of Artificial Sequence: Synthetic oligonucleotide
  Target: FXN; (-) strand; PAM type: NRG; PAM sequence: CAG
tggtgcacgcctgtagttcc

SEQ ID NO: 11688 - DNA, 20 bp, Artificial Sequence
  Description of Artificial Sequence: Synthetic oligonucleotide
  Target: FXN; (-) strand; PAM type: NRG; PAM sequence: TAG
gggcttgtggtgcacgcctg

SEQ ID NO: 11689 - DNA, 20 bp, Artificial Sequence
  Description of Artificial Sequence: Synthetic oligonucleotide
  Target: FXN; (-) strand; PAM type: NRG; PAM sequence: TGG
acaaaaattagctgggcttg

SEQ ID NO: 11690 - DNA, 20 bp, Artificial Sequence
  Description of Artificial Sequence: Synthetic oligonucleotide
  Target: FXN; (-) strand; PAM type: NRG; PAM sequence: GGG
taaaaatacaaaaattagct

SEQ ID NO: 11691 - DNA, 20 bp, Artificial Sequence
  Description of Artificial Sequence: Synthetic oligonucleotide
  Target: FXN; (-) strand; PAM type: NRG; PAM sequence: TGG
ctaaaaatacaaaaattagc

SEQ ID NO: 11692 - DNA, 20 bp, Artificial Sequence
  Description of Artificial Sequence: Synthetic oligonucleotide
  Target: FXN; (-) strand; PAM type: NRG; PAM sequence: TAG
tctactaaaaatacaaaaat

SEQ ID NO: 11693 - DNA, 20 bp, Artificial Sequence
  Description of Artificial Sequence: Synthetic oligonucleotide
  Target: FXN; (-) strand; PAM type: NRG; PAM sequence: TGG
tgaaactagccaggccaata

SEQ ID NO: 11694 - DNA, 20 bp, Artificial Sequence
  Description of Artificial Sequence: Synthetic oligonucleotide
  Target: FXN; (-) strand; PAM type: NRG; PAM sequence: AGG
tcaggagtttgaaactagcc

SEQ ID NO: 11695 - DNA, 20 bp, Artificial Sequence
  Description of Artificial Sequence: Synthetic oligonucleotide
  Target: FXN; (-) strand; PAM type: NRG; PAM sequence: CAG
gtcaggagtttgaaactagc

SEQ ID NO: 11696 - DNA, 20 bp, Artificial Sequence
  Description of Artificial Sequence: Synthetic oligonucleotide
  Target: FXN; (-) strand; PAM type: NRG; PAM sequence: TAG
tgaggtcaggagtttgaaac

SEQ ID NO: 11697 - DNA, 20 bp, Artificial Sequence
  Description of Artificial Sequence: Synthetic oligonucleotide
  Target: FXN; (-) strand; PAM type: NRG; PAM sequence: GAG
ggtggctcacctgaggtcag

SEQ ID NO: 11698 - DNA, 20 bp, Artificial Sequence
  Description of Artificial Sequence: Synthetic oligonucleotide
  Target: FXN; (-) strand; PAM type: NRG; PAM sequence: AGG
taggtggctcacctgaggtc

SEQ ID NO: 11699 - DNA, 20 bp, Artificial Sequence
  Description of Artificial Sequence: Synthetic oligonucleotide
  Target: FXN; (-) strand; PAM type: NRG; PAM sequence: CAG
gtaggtggctcacctgaggt

SEQ ID NO: 11700 - DNA, 20 bp, Artificial Sequence
  Description of Artificial Sequence: Synthetic oligonucleotide
  Target: FXN; (-) strand; PAM type: NRG; PAM sequence: AGG
cgaggtaggtggctcacctg

SEQ ID NO: 11701 - DNA, 20 bp, Artificial Sequence
  Description of Artificial Sequence: Synthetic oligonucleotide
  Target: FXN; (-) strand; PAM type: NRG; PAM sequence: GAG
ccgaggtaggtggctcacct

SEQ ID NO: 11702 - DNA, 20 bp, Artificial Sequence
  Description of Artificial Sequence: Synthetic oligonucleotide
  Target: FXN; (-) strand; PAM type: NRG; PAM sequence: TGG
ctttcggaggccgaggtagg

SEQ ID NO: 11703 - DNA, 20 bp, Artificial Sequence
  Description of Artificial Sequence: Synthetic oligonucleotide
  Target: FXN; (-) strand; PAM type: NRG; PAM sequence: AGG
ggactttcggaggccgaggt

SEQ ID NO: 11704 - DNA, 20 bp, Artificial Sequence
  Description of Artificial Sequence: Synthetic oligonucleotide
  Target: FXN; (-) strand; PAM type: NRG; PAM sequence: TAG
aggactttcggaggccgagg

SEQ ID NO: 11705 - DNA, 20 bp, Artificial Sequence
  Description of Artificial Sequence: Synthetic oligonucleotide
  Target: FXN; (-) strand; PAM type: NRG; PAM sequence: AGG
cccaggactttcggaggccg

SEQ ID NO: 11706 - DNA, 20 bp, Artificial Sequence
  Description of Artificial Sequence: Synthetic oligonucleotide
  Target: FXN; (-) strand; PAM type: NRG; PAM sequence: GAG
tcccaggactttcggaggcc

SEQ ID NO: 11707 - DNA, 20 bp, Artificial Sequence
  Description of Artificial Sequence: Synthetic oligonucleotide
  Target: FXN; (-) strand; PAM type: NRG; PAM sequence: AGG
tgtaatcccaggactttcgg

SEQ ID NO: 11708 - DNA, 20 bp, Artificial Sequence
  Description of Artificial Sequence: Synthetic oligonucleotide
  Target: FXN; (-) strand; PAM type: NRG; PAM sequence: GAG
ctgtaatcccaggactttcg

SEQ ID NO: 11709 - DNA, 20 bp, Artificial Sequence
  Description of Artificial Sequence: Synthetic oligonucleotide
  Target: FXN; (-) strand; PAM type: NRG; PAM sequence: CGG
gtctgtaatcccaggacttt

SEQ ID NO: 11710 - DNA, 20 bp, Artificial Sequence
  Description of Artificial Sequence: Synthetic oligonucleotide
  Target: FXN; (-) strand; PAM type: NRG; PAM sequence: AGG
tggctcacgtctgtaatccc

SEQ ID NO: 11711 - DNA, 20 bp, Artificial Sequence
  Description of Artificial Sequence: Synthetic oligonucleotide
  Target: FXN; (-) strand; PAM type: NRG; PAM sequence: CAG
gtggctcacgtctgtaatcc

SEQ ID NO: 11712 - DNA, 20 bp, Artificial Sequence
  Description of Artificial Sequence: Synthetic oligonucleotide
  Target: FXN; (-) strand; PAM type: NRG; PAM sequence: TGG
ttctgggccaggcagtgcag

SEQ ID NO: 11713 - DNA, 20 bp, Artificial Sequence
  Description of Artificial Sequence: Synthetic oligonucleotide
  Target: FXN; (-) strand; PAM type: NRG; PAM sequence: CAG
cctttctgggccaggcagtg

SEQ ID NO: 11714 - DNA, 20 bp, Artificial Sequence
  Description of Artificial Sequence: Synthetic oligonucleotide
  Target: FXN; (-) strand; PAM type: NRG; PAM sequence: CAG
atagtcctttctgggccagg

SEQ ID NO: 11715 - DNA, 20 bp, Artificial Sequence
  Description of Artificial Sequence: Synthetic oligonucleotide
  Target: FXN; (-) strand; PAM type: NRG; PAM sequence: AGG
ttaatagtcctttctgggcc

SEQ ID NO: 11716 - DNA, 20 bp, Artificial Sequence
  Description of Artificial Sequence: Synthetic oligonucleotide
  Target: FXN; (-) strand; PAM type: NRG; PAM sequence: CAG
attaatagtcctttctgggc

SEQ ID NO: 11717 - DNA, 20 bp, Artificial Sequence
  Description of Artificial Sequence: Synthetic oligonucleotide
  Target: FXN; (-) strand; PAM type: NRG; PAM sequence: GGG
tacaattaatagtcctttct

SEQ ID NO: 11718 - DNA, 20 bp, Artificial Sequence
  Description of Artificial Sequence: Synthetic oligonucleotide
  Target: FXN; (-) strand; PAM type: NRG; PAM sequence: TGG
ctacaattaatagtcctttc

SEQ ID NO: 11719 - DNA, 20 bp, Artificial Sequence
  Description of Artificial Sequence: Synthetic oligonucleotide
  Target: FXN; (-) strand; PAM type: NRG; PAM sequence: TAG
ccagaggcaactacaattaa

SEQ ID NO: 11720 - DNA, 20 bp, Artificial Sequence
  Description of Artificial Sequence: Synthetic oligonucleotide
  Target: FXN; (-) strand; PAM type: NRG; PAM sequence: AGG
caggcagcccccattcccag

SEQ ID NO: 11721 - DNA, 20 bp, Artificial Sequence
  Description of Artificial Sequence: Synthetic oligonucleotide
  Target: FXN; (-) strand; PAM type: NRG; PAM sequence: GAG
gcaggcagcccccattccca

SEQ ID NO: 11722 - DNA, 20 bp, Artificial Sequence
  Description of Artificial Sequence: Synthetic oligonucleotide
  Target: FXN; (-) strand; PAM type: NRG; PAM sequence: CAG
aagcaggcagcccccattcc

SEQ ID NO: 11723 - DNA, 20 bp, Artificial Sequence
  Description of Artificial Sequence: Synthetic oligonucleotide
  Target: FXN; (-) strand; PAM type: NRG; PAM sequence: CAG
gggttacagaaagaagcagg

SEQ ID NO: 11724 - DNA, 20 bp, Artificial Sequence
  Description of Artificial Sequence: Synthetic oligonucleotide
  Target: FXN; (-) strand; PAM type: NRG; PAM sequence: AGG
aaggggttacagaaagaagc

SEQ ID NO: 11725 - DNA, 20 bp, Artificial Sequence
  Description of Artificial Sequence: Synthetic oligonucleotide
  Target: FXN; (-) strand; PAM type: NRG; PAM sequence: CAG
gaaggggttacagaaagaag

SEQ ID NO: 11726 - DNA, 20 bp, Artificial Sequence
  Description of Artificial Sequence: Synthetic oligonucleotide
  Target: FXN; (-) strand; PAM type: NRG; PAM sequence: AAG
acagaaggggttacagaaag

SEQ ID NO: 11727 - DNA, 20 bp, Artificial Sequence
  Description of Artificial Sequence: Synthetic oligonucleotide
  Target: FXN; (-) strand; PAM type: NRG; PAM sequence: AAG
agcacagaaggggttacaga

SEQ ID NO: 11728 - DNA, 20 bp, Artificial Sequence
  Description of Artificial Sequence: Synthetic oligonucleotide
  Target: FXN; (-) strand; PAM type: NRG; PAM sequence: CAG
aaacagcacagaaggggtta

SEQ ID NO: 11729 - DNA, 20 bp, Artificial Sequence
  Description of Artificial Sequence: Synthetic oligonucleotide
  Target: FXN; (-) strand; PAM type: NRG; PAM sequence: GGG
aaatttaaacagcacagaag

SEQ ID NO: 11730 - DNA, 20 bp, Artificial Sequence
  Description of Artificial Sequence: Synthetic oligonucleotide
  Target: FXN; (-) strand; PAM type: NRG; PAM sequence: GGG
aaaatttaaacagcacagaa

SEQ ID NO: 11731 - DNA, 20 bp, Artificial Sequence
  Description of Artificial Sequence: Synthetic oligonucleotide
  Target: FXN; (-) strand; PAM type: NRG; PAM sequence: AGG
aaaaatttaaacagcacaga

SEQ ID NO: 11732 - DNA, 20 bp, Artificial Sequence
  Description of Artificial Sequence: Synthetic oligonucleotide
  Target: FXN; (-) strand; PAM type: NRG; PAM sequence: AAG
aaaaaatttaaacagcacag

SEQ ID NO: 11733 - DNA, 20 bp, Artificial Sequence
  Description of Artificial Sequence: Synthetic oligonucleotide
  Target: FXN; (-) strand; PAM type: NRG; PAM sequence: CAG
aaaaaaaaatttaaacagca

SEQ ID NO: 11734 - DNA, 20 bp, Artificial Sequence
  Description of Artificial Sequence: Synthetic oligonucleotide
  Target: FXN; (-) strand; PAM type: NRG; PAM sequence: CAG
aaaaaaaaaaaaaatttaaa

SEQ ID NO: 11735 - DNA, 20 bp, Artificial Sequence
  Description of Artificial Sequence: Synthetic oligonucleotide
  Target: FXN; (-) strand; PAM type: NRG; PAM sequence: GAG
tccagcctgggcgacagagc

SEQ ID NO: 11736 - DNA, 20 bp, Artificial Sequence
  Description of Artificial Sequence: Synthetic oligonucleotide
  Target: FXN; (-) strand; PAM type: NRG; PAM sequence: GAG
gcactccagcctgggcgaca

SEQ ID NO: 11737 - DNA, 20 bp, Artificial Sequence
  Description of Artificial Sequence: Synthetic oligonucleotide
  Target: FXN; (-) strand; PAM type: NRG; PAM sequence: CAG
ctgcactccagcctgggcga

SEQ ID NO: 11738 - DNA, 20 bp, Artificial Sequence
  Description of Artificial Sequence: Synthetic oligonucleotide
  Target: FXN; (-) strand; PAM type: NRG; PAM sequence: GGG
gcgccactgcactccagcct

SEQ ID NO: 11739 - DNA, 20 bp, Artificial Sequence
  Description of Artificial Sequence: Synthetic oligonucleotide
  Target: FXN; (-) strand; PAM type: NRG; PAM sequence: TGG
tgcgccactgcactccagcc

SEQ ID NO: 11740 - DNA, 20 bp, Artificial Sequence
  Description of Artificial Sequence: Synthetic oligonucleotide
  Target: FXN; (-) strand; PAM type: NRG; PAM sequence: CAG
gagattgcgccactgcactc

SEQ ID NO: 11741 - DNA, 20 bp, Artificial Sequence
  Description of Artificial Sequence: Synthetic oligonucleotide
  Target: FXN; (-) strand; PAM type: NRG; PAM sequence: GAG
ggcggagcttgcagtgagcc

SEQ ID NO: 11742 - DNA, 20 bp, Artificial Sequence
  Description of Artificial Sequence: Synthetic oligonucleotide
  Target: FXN; (-) strand; PAM type: NRG; PAM sequence: GAG
tgggaggcggagcttgcagt

SEQ ID NO: 11743 - DNA, 20 bp, Artificial Sequence
  Description of Artificial Sequence: Synthetic oligonucleotide
  Target: FXN; (-) strand; PAM type: NRG; PAM sequence: CAG
aacctgggaggcggagcttg

SEQ ID NO: 11744 - DNA, 20 bp, Artificial Sequence
  Description of Artificial Sequence: Synthetic oligonucleotide
  Target: FXN; (-) strand; PAM type: NRG; PAM sequence: GAG
tggcgtgaacctgggaggcg

SEQ ID NO: 11745 - DNA, 20 bp, Artificial Sequence
  Description of Artificial Sequence: Synthetic oligonucleotide
  Target: FXN; (-) strand; PAM type: NRG; PAM sequence: CGG
aatggcgtgaacctgggagg

SEQ ID NO: 11746 - DNA, 20 bp, Artificial Sequence
  Description of Artificial Sequence: Synthetic oligonucleotide
  Target: FXN; (-) strand; PAM type: NRG; PAM sequence: AGG
gagaatggcgtgaacctggg

SEQ ID NO: 11747 - DNA, 20 bp, Artificial Sequence
  Description of Artificial Sequence: Synthetic oligonucleotide
  Target: FXN; (-) strand; PAM type: NRG; PAM sequence: GAG
ggagaatggcgtgaacctgg

SEQ ID NO: 11748 - DNA, 20 bp, Artificial Sequence
  Description of Artificial Sequence: Synthetic oligonucleotide
  Target: FXN; (-) strand; PAM type: NRG; PAM sequence: GGG
caggagaatggcgtgaacct

SEQ ID NO: 11749 - DNA, 20 bp, Artificial Sequence
  Description of Artificial Sequence: Synthetic oligonucleotide
  Target: FXN; (-) strand; PAM type: NRG; PAM sequence: TGG
gcaggagaatggcgtgaacc

SEQ ID NO: 11750 - DNA, 20 bp, Artificial Sequence
  Description of Artificial Sequence: Synthetic oligonucleotide
  Target: FXN; (-) strand; PAM type: NRG; PAM sequence: TGG
aggaggctgaggcaggagaa

SEQ ID NO: 11751 - DNA, 20 bp, Artificial Sequence
  Description of Artificial Sequence: Synthetic oligonucleotide
  Target: FXN; (-) strand; PAM type: NRG; PAM sequence: GAG
tactcaggaggctgaggcag

SEQ ID NO: 11752 - DNA, 20 bp, Artificial Sequence
  Description of Artificial Sequence: Synthetic oligonucleotide
  Target: FXN; (-) strand; PAM type: NRG; PAM sequence: AGG
gctactcaggaggctgaggc

SEQ ID NO: 11753 - DNA, 20 bp, Artificial Sequence
  Description of Artificial Sequence: Synthetic oligonucleotide
  Target: FXN; (-) strand; PAM type: NRG; PAM sequence: CAG
agctactcaggaggctgagg

SEQ ID NO: 11754 - DNA, 20 bp, Artificial Sequence
  Description of Artificial Sequence: Synthetic oligonucleotide
  Target: FXN; (-) strand; PAM type: NRG; PAM sequence: AGG
cccagctactcaggaggctg

SEQ ID NO: 11755 - DNA, 20 bp, Artificial Sequence
  Description of Artificial Sequence: Synthetic oligonucleotide
  Target: FXN; (-) strand; PAM type: NRG; PAM sequence: GAG
tcccagctactcaggaggct

SEQ ID NO: 11756 - DNA, 20 bp, Artificial Sequence
  Description of Artificial Sequence: Synthetic oligonucleotide
  Target: FXN; (-) strand; PAM type: NRG; PAM sequence: AGG
tgtagtcccagctactcagg

SEQ ID NO: 11757 - DNA, 20 bp, Artificial Sequence
  Description of Artificial Sequence: Synthetic oligonucleotide
  Target: FXN; (-) strand; PAM type: NRG; PAM sequence: GAG
ctgtagtcccagctactcag

SEQ ID NO: 11758 - DNA, 20 bp, Artificial Sequence
  Description of Artificial Sequence: Synthetic oligonucleotide
  Target: FXN; (-) strand; PAM type: NRG; PAM sequence: AGG
gcctgtagtcccagctactc

SEQ ID NO: 11759 - DNA, 20 bp, Artificial Sequence
  Description of Artificial Sequence: Synthetic oligonucleotide
  Target: FXN; (-) strand; PAM type: NRG; PAM sequence: CAG
tgcctgtagtcccagctact

SEQ ID NO: 11760 - DNA, 20 bp, Artificial Sequence
  Description of Artificial Sequence: Synthetic oligonucleotide
  Target: FXN; (-) strand; PAM type: NRG; PAM sequence: CAG
gtgacgggtgcctgtagtcc

SEQ ID NO: 11761 - DNA, 20 bp, Artificial Sequence
  Description of Artificial Sequence: Synthetic oligonucleotide
  Target: FXN; (-) strand; PAM type: NRG; PAM sequence: TAG
ggcgtggtgacgggtgcctg

SEQ ID NO: 11762 - DNA, 20 bp, Artificial Sequence
  Description of Artificial Sequence: Synthetic oligonucleotide
  Target: FXN; (-) strand; PAM type: NRG; PAM sequence: GGG
aattagccgggcgtggtgac

SEQ ID NO: 11763 - DNA, 20 bp, Artificial Sequence
  Description of Artificial Sequence: Synthetic oligonucleotide
  Target: FXN; (-) strand; PAM type: NRG; PAM sequence: CGG
aaattagccgggcgtggtga

SEQ ID NO: 11764 - DNA, 20 bp, Artificial Sequence
  Description of Artificial Sequence: Synthetic oligonucleotide
  Target: FXN; (-) strand; PAM type: NRG; PAM sequence: TGG
tacaaaaaattagccgggcg

SEQ ID NO: 11765 - DNA, 20 bp, Artificial Sequence
  Description of Artificial Sequence: Synthetic oligonucleotide
  Target: FXN; (-) strand; PAM type: NRG; PAM sequence: GGG
gaaaatacaaaaaattagcc

SEQ ID NO: 11766 - DNA, 20 bp, Artificial Sequence
  Description of Artificial Sequence: Synthetic oligonucleotide
  Target: FXN; (-) strand; PAM type: NRG; PAM sequence: CGG
tgaaaatacaaaaaattagc

SEQ ID NO: 11767 - DNA, 20 bp, Artificial Sequence
  Description of Artificial Sequence: Synthetic oligonucleotide
  Target: FXN; (-) strand; PAM type: NRG; PAM sequence: TAG
ctactgaaaatacaaaaaat

SEQ ID NO: 11768 - DNA, 20 bp, Artificial Sequence
  Description of Artificial Sequence: Synthetic oligonucleotide
  Target: FXN; (-) strand; PAM type: NRG; PAM sequence: TGG
cgagaccatcctggctaaca

SEQ ID NO: 11769 - DNA, 20 bp, Artificial Sequence
  Description of Artificial Sequence: Synthetic oligonucleotide
  Target: FXN; (-) strand; PAM type: NRG; PAM sequence: TGG
tcaggagatcgagaccatcc

SEQ ID NO: 11770 - DNA, 20 bp, Artificial Sequence
  Description of Artificial Sequence: Synthetic oligonucleotide
  Target: FXN; (-) strand; PAM type: NRG; PAM sequence: GAG
gataacacggtcaggagatc

SEQ ID NO: 11771 - DNA, 20 bp, Artificial Sequence
  Description of Artificial Sequence: Synthetic oligonucleotide
  Target: FXN; (-) strand; PAM type: NRG; PAM sequence: GAG
caggcagataacacggtcag

SEQ ID NO: 11772 - DNA, 20 bp, Artificial Sequence
  Description of Artificial Sequence: Synthetic oligonucleotide
  Target: FXN; (-) strand; PAM type: NRG; PAM sequence: AGG
ggcaggcagataacacggtc

SEQ ID NO: 11773 - DNA, 20 bp, Artificial Sequence
  Description of Artificial Sequence: Synthetic oligonucleotide
  Target: FXN; (-) strand; PAM type: NRG; PAM sequence: CAG
aggcaggcagataacacggt

SEQ ID NO: 11774 - DNA, 20 bp, Artificial Sequence
  Description of Artificial Sequence: Synthetic oligonucleotide
  Target: FXN; (-) strand; PAM type: NRG; PAM sequence: CGG
gccgaggcaggcagataaca

SEQ ID NO: 11775 - DNA, 20 bp, Artificial Sequence
  Description of Artificial Sequence: Synthetic oligonucleotide
  Target: FXN; (-) strand; PAM type: NRG; PAM sequence: CAG
ctctgggaggccgaggcagg

SEQ ID NO: 11776 - DNA, 20 bp, Artificial Sequence
  Description of Artificial Sequence: Synthetic oligonucleotide
  Target: FXN; (-) strand; PAM type: NRG; PAM sequence: AGG
gcactctgggaggccgaggc

SEQ ID NO: 11777 - DNA, 20 bp, Artificial Sequence
  Description of Artificial Sequence: Synthetic oligonucleotide
  Target: FXN; (-) strand; PAM type: NRG; PAM sequence: CAG
agcactctgggaggccgagg

SEQ ID NO: 11778 - DNA, 20 bp, Artificial Sequence
  Description of Artificial Sequence: Synthetic oligonucleotide
  Target: FXN; (-) strand; PAM type: NRG; PAM sequence: AGG
cccagcactctgggaggccg

SEQ ID NO: 11779 - DNA, 20 bp, Artificial Sequence
  Description of Artificial Sequence: Synthetic oligonucleotide
  Target: FXN; (-) strand; PAM type: NRG; PAM sequence: GAG
tcccagcactctgggaggcc

SEQ ID NO: 11780 - DNA, 20 bp, Artificial Sequence
  Description of Artificial Sequence: Synthetic oligonucleotide
  Target: FXN; (-) strand; PAM type: NRG; PAM sequence: AGG
tgtaatcccagcactctggg

SEQ ID NO: 11781 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagcactctgg

SEQ ID NO: 11782 - DNA, 20 bp, Artificial Sequence
  Description of Artificial Sequence: Synthetic oligonucleotide
  Target: FXN; (-) strand; PAM type: NRG; PAM sequence: GGG
gcctgtaatcccagcactct

SEQ ID NO: 11783 - DNA, 20 bp, Artificial Sequence
  Description of Artificial Sequence: Synthetic oligonucleotide
  Target: FXN; (-) strand; PAM type: NRG; PAM sequence: TGG
tgcctgtaatcccagcactc

SEQ ID NO: 11784 - DNA, 20 bp, Artificial Sequence
  Description of Artificial Sequence: Synthetic oligonucleotide
  Target: FXN; (-) strand; PAM type: NRG; PAM sequence: CAG
gtagctcatgcctgtaatcc

SEQ ID NO: 11785 - DNA, 20 bp, Artificial Sequence
  Description of Artificial Sequence: Synthetic oligonucleotide
  Target: FXN; (-) strand; PAM type: NRG; PAM sequence: TAG
aatttaaaggccgggcgtgg

SEQ ID NO: 11786 - DNA, 20 bp, Artificial Sequence
  Description of Artificial Sequence: Synthetic oligonucleotide
  Target: FXN; (-) strand; PAM type: NRG; PAM sequence: TGG
aaaaatttaaaggccgggcg

SEQ ID NO: 11787 - DNA, 20 bp, Artificial Sequence
  Description of Artificial Sequence: Synthetic oligonucleotide
  Target: FXN; (-) strand; PAM type: NRG; PAM sequence: GGG
aaagtaaaaatttaaaggcc

SEQ ID NO: 11788 - DNA, 20 bp, Artificial Sequence
  Description of Artificial Sequence: Synthetic oligonucleotide
  Target: FXN; (-) strand; PAM type: NRG; PAM sequence: CGG
caaagtaaaaatttaaaggc

SEQ ID NO: 11789 - DNA, 20 bp, Artificial Sequence
  Description of Artificial Sequence: Synthetic oligonucleotide
  Target: FXN; (-) strand; PAM type: NRG; PAM sequence: AGG
ggcccaaagtaaaaatttaa

SEQ ID NO: 11790 - DNA, 20 bp, Artificial Sequence
  Description of Artificial Sequence: Synthetic oligonucleotide
  Target: FXN; (-) strand; PAM type: NRG; PAM sequence: AAG
cggcccaaagtaaaaattta

SEQ ID NO: 11791 - DNA, 20 bp, Artificial Sequence
  Description of Artificial Sequence: Synthetic oligonucleotide
  Target: FXN; (-) strand; PAM type: NRG; PAM sequence: AAG
aaggcaccgtgcccggccca

SEQ ID NO: 11792 - DNA, 20 bp, Artificial Sequence
  Description of Artificial Sequence: Synthetic oligonucleotide
  Target: FXN; (-) strand; PAM type: NRG; PAM sequence: CGG
caggcgtaaggcaccgtgcc

SEQ ID NO: 11793 - DNA, 20 bp, Artificial Sequence
  Description of Artificial Sequence: Synthetic oligonucleotide
  Target: FXN; (-) strand; PAM type: NRG; PAM sequence: AGG
atgttaggattacaggcgta

SEQ ID NO: 11794 - DNA, 20 bp, Artificial Sequence
  Description of Artificial Sequence: Synthetic oligonucleotide
  Target: FXN; (-) strand; PAM type: NRG; PAM sequence: AAG
aatgttaggattacaggcgt

SEQ ID NO: 11795 - DNA, 20 bp, Artificial Sequence
  Description of Artificial Sequence: Synthetic oligonucleotide
  Target: FXN; (-) strand; PAM type: NRG; PAM sequence: AGG
tctcgaaatgttaggattac

SEQ ID NO: 11796 - DNA, 20 bp, Artificial Sequence
  Description of Artificial Sequence: Synthetic oligonucleotide
  Target: FXN; (-) strand; PAM type: NRG; PAM sequence: CAG
ttctcgaaatgttaggatta

SEQ ID NO: 11797 - DNA, 20 bp, Artificial Sequence
  Description of Artificial Sequence: Synthetic oligonucleotide
  Target: FXN; (-) strand; PAM type: NRG; PAM sequence: AGG
cctcagcttctcgaaatgtt

SEQ ID NO: 11798 - DNA, 20 bp, Artificial Sequence
  Description of Artificial Sequence: Synthetic oligonucleotide
  Target: FXN; (-) strand; PAM type: NRG; PAM sequence: TAG
gcctcagcttctcgaaatgt

SEQ ID NO: 11799 - DNA, 20 bp, Artificial Sequence
  Description of Artificial Sequence: Synthetic oligonucleotide
  Target: FXN; (-) strand; PAM type: NRG; PAM sequence: CAG
aagtgatccaccacgtgcct

SEQ ID NO: 11800 - DNA, 20 bp, Artificial Sequence
  Description of Artificial Sequence: Synthetic oligonucleotide
  Target: FXN; (-) strand; PAM type: NRG; PAM sequence: AAG
tggtctgaactcgtgacatc

SEQ ID NO: 11801 - DNA, 20 bp, Artificial Sequence
  Description of Artificial Sequence: Synthetic oligonucleotide
  Target: FXN; (-) strand; PAM type: NRG; PAM sequence: TGG
ccaggctggagtgcagtggc

SEQ ID NO: 11802 - DNA, 20 bp, Artificial Sequence
  Description of Artificial Sequence: Synthetic oligonucleotide
  Target: FXN; (-) strand; PAM type: NRG; PAM sequence: TGG
tcacccaggctggagtgcag

SEQ ID NO: 11803 - DNA, 20 bp, Artificial Sequence
  Description of Artificial Sequence: Synthetic oligonucleotide
  Target: FXN; (-) strand; PAM type: NRG; PAM sequence: CAG
ctgtcacccaggctggagtg

SEQ ID NO: 11804 - DNA, 20 bp, Artificial Sequence
  Description of Artificial Sequence: Synthetic oligonucleotide
  Target: FXN; (-) strand; PAM type: NRG; PAM sequence: GAG
tcactctgtcacccaggctg

SEQ ID NO: 11805 - DNA, 20 bp, Artificial Sequence
  Description of Artificial Sequence: Synthetic oligonucleotide
  Target: FXN; (-) strand; PAM type: NRG; PAM sequence: TGG
tctcactctgtcacccaggc

SEQ ID NO: 11806 - DNA, 20 bp, Artificial Sequence
  Description of Artificial Sequence: Synthetic oligonucleotide
  Target: FXN; (-) strand; PAM type: NRG; PAM sequence: AGG
agagtctcactctgtcaccc

SEQ ID NO: 11807 - DNA, 20 bp, Artificial Sequence
  Description of Artificial Sequence: Synthetic oligonucleotide
  Target: FXN; (-) strand; PAM type: NRG; PAM sequence: CAG
cagagtctcactctgtcacc

SEQ ID NO: 11808 - DNA, 20 bp, Artificial Sequence
  Description of Artificial Sequence: Synthetic oligonucleotide
  Target: FXN; (-) strand; PAM type: NRG; PAM sequence: GAG
ttttttttttttttgagaca

SEQ ID NO: 11809 - DNA, 20 bp, Artificial Sequence
  Description of Artificial Sequence: Synthetic oligonucleotide
  Target: FXN; (-) strand; PAM type: NRG; PAM sequence: CAG
ttttttttttttttttgaga

SEQ ID NO: 11810 - DNA, 20 bp, Artificial Sequence
  Description of Artificial Sequence: Synthetic oligonucleotide
  Target: FXN; (-) strand; PAM type: NRG; PAM sequence: GAG
tttctttttttttttttttt

SEQ ID NO: 11811 - DNA, 20 bp, Artificial Sequence
  Description of Artificial Sequence: Synthetic oligonucleotide
  Target: FXN; (-) strand; PAM type: NRG; PAM sequence: AAG
aaataacatgtaaaaagtaa

SEQ ID NO: 11812 - DNA, 20 bp, Artificial Sequence
  Description of Artificial Sequence: Synthetic oligonucleotide
  Target: FXN; (-) strand; PAM type: NRG; PAM sequence: AAG
tgatgaaaataacatgtaaa

SEQ ID NO: 11813 - DNA, 20 bp, Artificial Sequence
  Description of Artificial Sequence: Synthetic oligonucleotide
  Target: FXN; (-) strand; PAM type: NRG; PAM sequence: AAG
catctagagagctgcagagg

SEQ ID NO: 11814 - DNA, 20 bp, Artificial Sequence
  Description of Artificial Sequence: Synthetic oligonucleotide
  Target: FXN; (-) strand; PAM type: NRG; PAM sequence: AGG
tctcatctagagagctgcag

SEQ ID NO: 11815 - DNA, 20 bp, Artificial Sequence
  Description of Artificial Sequence: Synthetic oligonucleotide
  Target: FXN; (-) strand; PAM type: NRG; PAM sequence: GAG
gtctcatctagagagctgca

SEQ ID NO: 11816 - DNA, 20 bp, Artificial Sequence
  Description of Artificial Sequence: Synthetic oligonucleotide
  Target: FXN; (-) strand; PAM type: NRG; PAM sequence: CAG
tggtctcatctagagagctg

SEQ ID NO: 11817 - DNA, 20 bp, Artificial Sequence
  Description of Artificial Sequence: Synthetic oligonucleotide
  Target: FXN; (-) strand; PAM type: NRG; PAM sequence: GAG
cataggtggtctcatctaga

SEQ ID NO: 11818 - DNA, 20 bp, Artificial Sequence
  Description of Artificial Sequence: Synthetic oligonucleotide
  Target: FXN; (-) strand; PAM type: NRG; PAM sequence: GAG
ttcataggtggtctcatcta

SEQ ID NO: 11819 - DNA, 20 bp, Artificial Sequence
  Description of Artificial Sequence: Synthetic oligonucleotide
  Target: FXN; (-) strand; PAM type: NRG; PAM sequence: TAG
ctttcataggtggtctcatc

SEQ ID NO: 11820 - DNA, 20 bp, Artificial Sequence
  Description of Artificial Sequence: Synthetic oligonucleotide
  Target: FXN; (-) strand; PAM type: NRG; PAM sequence: TGG
ctctgctagtctttcatagg

SEQ ID NO: 11821 - DNA, 20 bp, Artificial Sequence
  Description of Artificial Sequence: Synthetic oligonucleotide
  Target: FXN; (-) strand; PAM type: NRG; PAM sequence: AGG
ttcctctgctagtctttcat

SEQ ID NO: 11822 - DNA, 20 bp, Artificial Sequence
  Description of Artificial Sequence: Synthetic oligonucleotide
  Target: FXN; (-) strand; PAM type: NRG; PAM sequence: TAG
tttcctctgctagtctttca

SEQ ID NO: 11823 - DNA, 20 bp, Artificial Sequence
  Description of Artificial Sequence: Synthetic oligonucleotide
  Target: FXN; (-) strand; PAM type: NRG; PAM sequence: TAG
gagtccagcgtttcctctgc

SEQ ID NO: 11824 - DNA, 20 bp, Artificial Sequence
  Description of Artificial Sequence: Synthetic oligonucleotide
  Target: FXN; (-) strand; PAM type: NRG; PAM sequence: CAG
aaaaactctgctaaagagtc

SEQ ID NO: 11825 - DNA, 20 bp, Artificial Sequence
  Description of Artificial Sequence: Synthetic oligonucleotide
  Target: FXN; (-) strand; PAM type: NRG; PAM sequence: GAG
cttcaaaaaactctgctaaa

SEQ ID NO: 11826 - DNA, 20 bp, Artificial Sequence
  Description of Artificial Sequence: Synthetic oligonucleotide
  Target: FXN; (-) strand; PAM type: NRG; PAM sequence: AAG
gtcttcaaaaaactctgcta

SEQ ID NO: 11827 - DNA, 20 bp, Artificial Sequence
  Description of Artificial Sequence: Synthetic oligonucleotide
  Target: FXN; (-) strand; PAM type: NRG; PAM sequence: AGG
acgtgtatggcttgtctgca

SEQ ID NO: 11828 - DNA, 20 bp, Artificial Sequence
  Description of Artificial Sequence: Synthetic oligonucleotide
  Target: FXN; (-) strand; PAM type: NRG; PAM sequence: AAG
aacgtgtatggcttgtctgc

SEQ ID NO: 11829 - DNA, 20 bp, Artificial Sequence
  Description of Artificial Sequence: Synthetic oligonucleotide
  Target: FXN; (-) strand; PAM type: NRG; PAM sequence: TGG
tcatagtcctcaaacgtgta

SEQ ID NO: 11830 - DNA, 20 bp, Artificial Sequence
  Description of Artificial Sequence: Synthetic oligonucleotide
  Target: FXN; (-) strand; PAM type: NRG; PAM sequence: TAG
gtaccccaaaggagacatca

SEQ ID NO: 11831 - DNA, 20 bp, Artificial Sequence
  Description of Artificial Sequence: Synthetic oligonucleotide
  Target: FXN; (-) strand; PAM type: NRG; PAM sequence: GAG
agtcaagaggtaccccaaag

SEQ ID NO: 11832 - DNA, 20 bp, Artificial Sequence
  Description of Artificial Sequence: Synthetic oligonucleotide
  Target: FXN; (-) strand; PAM type: NRG; PAM sequence: AGG
gaagtcaagaggtaccccaa

SEQ ID NO: 11833 - DNA, 20 bp, Artificial Sequence
  Description of Artificial Sequence: Synthetic oligonucleotide
  Target: FXN; (-) strand; PAM type: NRG; PAM sequence: AAG
agaagtcaagaggtacccca

SEQ ID NO: 11834 - DNA, 20 bp, Artificial Sequence
  Description of Artificial Sequence: Synthetic oligonucleotide
  Target: FXN; (-) strand; PAM type: NRG; PAM sequence: AGG
gaaaaataaaagaagtcaag

SEQ ID NO: 11835 - DNA, 20 bp, Artificial Sequence
  Description of Artificial Sequence: Synthetic oligonucleotide
  Target: FXN; (-) strand; PAM type: NRG; PAM sequence: GAG
agaaaaataaaagaagtcaa

SEQ ID NO: 11836 - DNA, 20 bp, Artificial Sequence
  Description of Artificial Sequence: Synthetic oligonucleotide
  Target: FXN; (-) strand; PAM type: NRG; PAM sequence: AAG
acagaaaaataaaagaagtc

SEQ ID NO: 11837 - DNA, 20 bp, Artificial Sequence
  Description of Artificial Sequence: Synthetic oligonucleotide
  Target: FXN; (-) strand; PAM type: NRG; PAM sequence: AAG
gggaaacagaaaaataaaag

SEQ ID NO: 11838 - DNA, 20 bp, Artificial Sequence
  Description of Artificial Sequence: Synthetic oligonucleotide
  Target: FXN; (-) strand; PAM type: NRG; PAM sequence: AAG
agggggaaacagaaaaataa

SEQ ID NO: 11839 - DNA, 20 bp, Artificial Sequence
  Description of Artificial Sequence: Synthetic oligonucleotide
  Target: FXN; (-) strand; PAM type: NRG; PAM sequence: CAG
aaaattcttagagggggaaa

SEQ ID NO: 11840 - DNA, 20 bp, Artificial Sequence
  Description of Artificial Sequence: Synthetic oligonucleotide
  Target: FXN; (-) strand; PAM type: NRG; PAM sequence: GGG
tgaactaaaattcttagagg

SEQ ID NO: 11841 - DNA, 20 bp, Artificial Sequence
  Description of Artificial Sequence: Synthetic oligonucleotide
  Target: FXN; (-) strand; PAM type: NRG; PAM sequence: GGG
gtgaactaaaattcttagag

SEQ ID NO: 11842 - DNA, 20 bp, Artificial Sequence
  Description of Artificial Sequence: Synthetic oligonucleotide
  Target: FXN; (-) strand; PAM type: NRG; PAM sequence: GGG
agtgaactaaaattcttaga

SEQ ID NO: 11843 - DNA, 20 bp, Artificial Sequence
  Description of Artificial Sequence: Synthetic oligonucleotide
  Target: FXN; (-) strand; PAM type: NRG; PAM sequence: AGG
tagtgaactaaaattcttag

SEQ ID NO: 11844 - DNA, 20 bp, Artificial Sequence
  Description of Artificial Sequence: Synthetic oligonucleotide
  Target: FXN; (-) strand; PAM type: NRG; PAM sequence: GAG
ttagtgaactaaaattctta

SEQ ID NO: 11845 - DNA, 20 bp, Artificial Sequence
  Description of Artificial Sequence: Synthetic oligonucleotide
  Target: FXN; (-) strand; PAM type: NRG; PAM sequence: TAG
ttttagtgaactaaaattct

SEQ ID NO: 11846 - DNA, 20 bp, Artificial Sequence
  Description of Artificial Sequence: Synthetic oligonucleotide
  Target: FXN; (-) strand; PAM type: NRG; PAM sequence: TAG
tggagggaaattcttcattt

SEQ ID NO: 11847 - DNA, 20 bp, Artificial Sequence
  Description of Artificial Sequence: Synthetic oligonucleotide
  Target: FXN; (-) strand; PAM type: NRG; PAM sequence: GGG
tgatgcttagctctgctgga

SEQ ID NO: 11848 - DNA, 20 bp, Artificial Sequence
  Description of Artificial Sequence: Synthetic oligonucleotide
  Target: FXN; (-) strand; PAM type: NRG; PAM sequence: AGG
ttgatgcttagctctgctgg

SEQ ID NO: 11849 - DNA, 20 bp, Artificial Sequence
  Description of Artificial Sequence: Synthetic oligonucleotide
  Target: FXN; (-) strand; PAM type: NRG; PAM sequence: GAG
cttgatgcttagctctgctg

SEQ ID NO: 11850 - DNA, 20 bp, Artificial Sequence
  Description of Artificial Sequence: Synthetic oligonucleotide
  Target: FXN; (-) strand; PAM type: NRG; PAM sequence: TGG
tacttgatgcttagctctgc

SEQ ID NO: 11851 - DNA, 20 bp, Artificial Sequence
  Description of Artificial Sequence: Synthetic oligonucleotide
  Target: FXN; (-) strand; PAM type: NRG; PAM sequence: TAG
actacatgctacttgatgct

SEQ ID NO: 11852 - DNA, 20 bp, Artificial Sequence
  Description of Artificial Sequence: Synthetic oligonucleotide
  Target: FXN; (-) strand; PAM type: NRG; PAM sequence: TAG
accttcacctcccggaaccc

SEQ ID NO: 11853 - DNA, 20 bp, Artificial Sequence
  Description of Artificial Sequence: Synthetic oligonucleotide
  Target: FXN; (-) strand; PAM type: NRG; PAM sequence: CGG
tcactgcaaccttcacctcc

SEQ ID NO: 11854 - DNA, 20 bp, Artificial Sequence
  Description of Artificial Sequence: Synthetic oligonucleotide
  Target: FXN; (-) strand; PAM type: NRG; PAM sequence: TGG
ggagtgcagtggcgtgattt

SEQ ID NO: 11855 - DNA, 20 bp, Artificial Sequence
  Description of Artificial Sequence: Synthetic oligonucleotide
  Target: FXN; (-) strand; PAM type: NRG; PAM sequence: TGG
tcacccaggctggagtgcag

SEQ ID NO: 11856 - DNA, 20 bp, Artificial Sequence
  Description of Artificial Sequence: Synthetic oligonucleotide
  Target: FXN; (-) strand; PAM type: NRG; PAM sequence: CAG
ctgtcacccaggctggagtg

SEQ ID NO: 11857 - DNA, 20 bp, Artificial Sequence
  Description of Artificial Sequence: Synthetic oligonucleotide
  Target: FXN; (-) strand; PAM type: NRG; PAM sequence: GAG
tcgctctgtcacccaggctg

SEQ ID NO: 11858 - DNA, 20 bp, Artificial Sequence
  Description of Artificial Sequence: Synthetic oligonucleotide
  Target: FXN; (-) strand; PAM type: NRG; PAM sequence: TGG
tctcgctctgtcacccaggc

SEQ ID NO: 11859 - DNA, 20 bp, Artificial Sequence
  Description of Artificial Sequence: Synthetic oligonucleotide
  Target: FXN; (-) strand; PAM type: NRG; PAM sequence: AGG
agagtctcgctctgtcaccc

SEQ ID NO: 11860 - DNA, 20 bp, Artificial Sequence
  Description of Artificial Sequence: Synthetic oligonucleotide
  Target: FXN; (-) strand; PAM type: NRG; PAM sequence: CAG
cagagtctcgctctgtcacc

SEQ ID NO: 11861 - DNA, 20 bp, Artificial Sequence
  Description of Artificial Sequence: Synthetic oligonucleotide
  Target: FXN; (-) strand; PAM type: NRG; PAM sequence: GAG
ccatccatccatctatgaca

SEQ ID NO: 11862 - DNA, 20 bp, Artificial Sequence
  Description of Artificial Sequence: Synthetic oligonucleotide
  Target: FXN; (-) strand; PAM type: NRG; PAM sequence: CAG
atccatccatccatctatga

SEQ ID NO: 11863 - DNA, 20 bp, Artificial Sequence
  Description of Artificial Sequence: Synthetic oligonucleotide
  Target: FXN; (-) strand; PAM type: NRG; PAM sequence: CAG
atctatcttatctatctatc

SEQ ID NO: 11864 - DNA, 20 bp, Artificial Sequence
  Description of Artificial Sequence: Synthetic oligonucleotide
  Target: FXN; (-) strand; PAM type: NRG; PAM sequence: TAG
ctggactgcagcttgaagcc

SEQ ID NO: 11865 - DNA, 20 bp, Artificial Sequence
  Description of Artificial Sequence: Synthetic oligonucleotide
  Target: FXN; (-) strand; PAM type: NRG; PAM sequence: AAG
tagagctggactgcagcttg

SEQ ID NO: 11866 - DNA, 20 bp, Artificial Sequence
  Description of Artificial Sequence: Synthetic oligonucleotide
  Target: FXN; (-) strand; PAM type: NRG; PAM sequence: CAG
agcctggtagagctggactg

SEQ ID NO: 11867 - DNA, 20 bp, Artificial Sequence
  Description of Artificial Sequence: Synthetic oligonucleotide
  Target: FXN; (-) strand; PAM type: NRG; PAM sequence: TGG
cacaacaagcctggtagagc

SEQ ID NO: 11868 - DNA, 20 bp, Artificial Sequence
  Description of Artificial Sequence: Synthetic oligonucleotide
  Target: FXN; (-) strand; PAM type: NRG; PAM sequence: GAG
gagtcacaacaagcctggta

SEQ ID NO: 11869 - DNA, 20 bp, Artificial Sequence
  Description of Artificial Sequence: Synthetic oligonucleotide
  Target: FXN; (-) strand; PAM type: NRG; PAM sequence: TAG
cagagtcacaacaagcctgg

SEQ ID NO: 11870 - DNA, 20 bp, Artificial Sequence
  Description of Artificial Sequence: Synthetic oligonucleotide
  Target: FXN; (-) strand; PAM type: NRG; PAM sequence: TGG
gcccagagtcacaacaagcc

SEQ ID NO: 11871 - DNA, 20 bp, Artificial Sequence
  Description of Artificial Sequence: Synthetic oligonucleotide
  Target: FXN; (-) strand; PAM type: NRG; PAM sequence: AAG
gacttgcccagagtcacaac

SEQ ID NO: 11872 - DNA, 20 bp, Artificial Sequence
  Description of Artificial Sequence: Synthetic oligonucleotide
  Target: FXN; (-) strand; PAM type: NRG; PAM sequence: GAG
gaggctgagtgacttgccca

SEQ ID NO: 11873 - DNA, 20 bp, Artificial Sequence
  Description of Artificial Sequence: Synthetic oligonucleotide
  Target: FXN; (-) strand; PAM type: NRG; PAM sequence: CAG
gagaggctgagtgacttgcc

SEQ ID NO: 11874 - DNA, 20 bp, Artificial Sequence
  Description of Artificial Sequence: Synthetic oligonucleotide
  Target: FXN; (-) strand; PAM type: NRG; PAM sequence: GAG
aaatgaggctcagagaggct

SEQ ID NO: 11875 - DNA, 20 bp, Artificial Sequence
  Description of Artificial Sequence: Synthetic oligonucleotide
  Target: FXN; (-) strand; PAM type: NRG; PAM sequence: AGG
ctggaaaatgaggctcagag

SEQ ID NO: 11876 - DNA, 20 bp, Artificial Sequence
  Description of Artificial Sequence: Synthetic oligonucleotide
  Target: FXN; (-) strand; PAM type: NRG; PAM sequence: GAG
gctggaaaatgaggctcaga

SEQ ID NO: 11877 - DNA, 20 bp, Artificial Sequence
  Description of Artificial Sequence: Synthetic oligonucleotide
  Target: FXN; (-) strand; PAM type: NRG; PAM sequence: GAG
aagctggaaaatgaggctca

SEQ ID NO: 11878 - DNA, 20 bp, Artificial Sequence
  Description of Artificial Sequence: Synthetic oligonucleotide
  Target: FXN; (-) strand; PAM type: NRG; PAM sequence: CAG
tgaagctggaaaatgaggct

SEQ ID NO: 11879 - DNA, 20 bp, Artificial Sequence
  Description of Artificial Sequence: Synthetic oligonucleotide
  Target: FXN; (-) strand; PAM type: NRG; PAM sequence: AGG
tccactgaagctggaaaatg

SEQ ID NO: 11880 - DNA, 20 bp, Artificial Sequence
  Description of Artificial Sequence: Synthetic oligonucleotide
  Target: FXN; (-) strand; PAM type: NRG; PAM sequence: GAG
atccactgaagctggaaaat

SEQ ID NO: 11881 - DNA, 20 bp, Artificial Sequence
  Description of Artificial Sequence: Synthetic oligonucleotide
  Target: FXN; (-) strand; PAM type: NRG; PAM sequence: TGG
tcatgggtatccactgaagc

SEQ ID NO: 11882 - DNA, 20 bp, Artificial Sequence
  Description of Artificial Sequence: Synthetic oligonucleotide
  Target: FXN; (-) strand; PAM type: NRG; PAM sequence: AAG
gccttcatgggtatccactg

SEQ ID NO: 11883 - DNA, 20 bp, Artificial Sequence
  Description of Artificial Sequence: Synthetic oligonucleotide
  Target: FXN; (-) strand; PAM type: NRG; PAM sequence: GGG
cctctctgatttgccttcat

SEQ ID NO: 11884 - DNA, 20 bp, Artificial Sequence
  Description of Artificial Sequence: Synthetic oligonucleotide
  Target: FXN; (-) strand; PAM type: NRG; PAM sequence: TGG
ccctctctgatttgccttca

SEQ ID NO: 11885 - DNA, 20 bp, Artificial Sequence
  Description of Artificial Sequence: Synthetic oligonucleotide
  Target: FXN; (-) strand; PAM type: NRG; PAM sequence: AGG
tgctggacaaatacacactc

SEQ ID NO: 11886 - DNA, 20 bp, Artificial Sequence
  Description of Artificial Sequence: Synthetic oligonucleotide
  Target: FXN; (-) strand; PAM type: NRG; PAM sequence: CAG
ctgctggacaaatacacact

SEQ ID NO: 11887 - DNA, 20 bp, Artificial Sequence
  Description of Artificial Sequence: Synthetic oligonucleotide
  Target: FXN; (-) strand; PAM type: NRG; PAM sequence: TGG
tgttccctccatctgcctgc

SEQ ID NO: 11888 - DNA, 20 bp, Artificial Sequence
  Description of Artificial Sequence: Synthetic oligonucleotide
  Target: FXN; (-) strand; PAM type: NRG; PAM sequence: TAG
ctactgaagaactacgggtc

SEQ ID NO: 11889 - DNA, 20 bp, Artificial Sequence
  Description of Artificial Sequence: Synthetic oligonucleotide
  Target: FXN; (-) strand; PAM type: NRG; PAM sequence: GGG
tatccctactgaagaactac

SEQ ID NO: 11890 - DNA, 20 bp, Artificial Sequence
  Description of Artificial Sequence: Synthetic oligonucleotide
  Target: FXN; (-) strand; PAM type: NRG; PAM sequence: CGG
ttatccctactgaagaacta

SEQ ID NO: 11891 - DNA, 20 bp, Artificial Sequence
  Description of Artificial Sequence: Synthetic oligonucleotide
  Target: FXN; (-) strand; PAM type: NRG; PAM sequence: AAG
cagttatcttatccctactg

SEQ ID NO: 11892 - DNA, 20 bp, Artificial Sequence
  Description of Artificial Sequence: Synthetic oligonucleotide
  Target: FXN; (-) strand; PAM type: NRG; PAM sequence: CAG
taatctaaataacttttggg

SEQ ID NO: 11893 - DNA, 20 bp, Artificial Sequence
  Description of Artificial Sequence: Synthetic oligonucleotide
  Target: FXN; (-) strand; PAM type: NRG; PAM sequence: GGG
ttgtaatctaaataactttt

SEQ ID NO: 11894 - DNA, 20 bp, Artificial Sequence
  Description of Artificial Sequence: Synthetic oligonucleotide
  Target: FXN; (-) strand; PAM type: NRG; PAM sequence: TGG
tttgtaatctaaataacttt

SEQ ID NO: 11895 - DNA, 20 bp, Artificial Sequence
  Description of Artificial Sequence: Synthetic oligonucleotide
  Target: FXN; (-) strand; PAM type: NRG; PAM sequence: AAG
gtctcacaggagcagggctc

SEQ ID NO: 11896 - DNA, 20 bp, Artificial Sequence
  Description of Artificial Sequence: Synthetic oligonucleotide
  Target: FXN; (-) strand; PAM type: NRG; PAM sequence: GGG
atcactgtctcacaggagca

SEQ ID NO: 11897 - DNA, 20 bp, Artificial Sequence
  Description of Artificial Sequence: Synthetic oligonucleotide
  Target: FXN; (-) strand; PAM type: NRG; PAM sequence: AGG
catcactgtctcacaggagc

SEQ ID NO: 11898 - DNA, 20 bp, Artificial Sequence
  Description of Artificial Sequence: Synthetic oligonucleotide
  Target: FXN; (-) strand; PAM type: NRG; PAM sequence: CAG
ccatcactgtctcacaggag

SEQ ID NO: 11899 - DNA, 20 bp, Artificial Sequence
  Description of Artificial Sequence: Synthetic oligonucleotide
  Target: FXN; (-) strand; PAM type: NRG; PAM sequence: GAG
accccatcactgtctcacag

SEQ ID NO: 11900 - DNA, 20 bp, Artificial Sequence
  Description of Artificial Sequence: Synthetic oligonucleotide
  Target: FXN; (-) strand; PAM type: NRG; PAM sequence: AGG
ctaccccatcactgtctcac

SEQ ID NO: 11901 - DNA, 20 bp, Artificial Sequence
  Description of Artificial Sequence: Synthetic oligonucleotide
  Target: FXN; (-) strand; PAM type: NRG; PAM sequence: CAG
cctaccccatcactgtctca

SEQ ID NO: 11902 - DNA, 20 bp, Artificial Sequence
  Description of Artificial Sequence: Synthetic oligonucleotide
  Target: FXN; (-) strand; PAM type: NRG; PAM sequence: AGG
ttttcaaaaatatgcttccc

SEQ ID NO: 11903 - DNA, 20 bp, Artificial Sequence
  Description of Artificial Sequence: Synthetic oligonucleotide
  Target: FXN; (-) strand; PAM type: NRG; PAM sequence: CAG
cttttcaaaaatatgcttcc

SEQ ID NO: 11904 - DNA, 20 bp, Artificial Sequence
  Description of Artificial Sequence: Synthetic oligonucleotide
  Target: FXN; (-) strand; PAM type: NRG; PAM sequence: GAG
tacacattagaatcccaggt

SEQ ID NO: 11905 - DNA, 20 bp, Artificial Sequence
  Description of Artificial Sequence: Synthetic oligonucleotide
  Target: FXN; (-) strand; PAM type: NRG; PAM sequence: AGG
gggatacacattagaatccc

SEQ ID NO: 11906 - DNA, 20 bp, Artificial Sequence
  Description of Artificial Sequence: Synthetic oligonucleotide
  Target: FXN; (-) strand; PAM type: NRG; PAM sequence: CAG
agggatacacattagaatcc

SEQ ID NO: 11907 - DNA, 20 bp, Artificial Sequence
  Description of Artificial Sequence: Synthetic oligonucleotide
  Target: FXN; (-) strand; PAM type: NRG; PAM sequence: TAG
taagacctagggatacacat

SEQ ID NO: 11908 - DNA, 20 bp, Artificial Sequence
  Description of Artificial Sequence: Synthetic oligonucleotide
  Target: FXN; (-) strand; PAM type: NRG; PAM sequence: GGG
atctctaggaataagaccta

SEQ ID NO: 11909 - DNA, 20 bp, Artificial Sequence
  Description of Artificial Sequence: Synthetic oligonucleotide
  Target: FXN; (-) strand; PAM type: NRG; PAM sequence: AGG
aatctctaggaataagacct

SEQ ID NO: 11910 - DNA, 20 bp, Artificial Sequence
  Description of Artificial Sequence: Synthetic oligonucleotide
  Target: FXN; (-) strand; PAM type: NRG; PAM sequence: TAG
aaatctctaggaataagacc

SEQ ID NO: 11911 - DNA, 20 bp, Artificial Sequence
  Description of Artificial Sequence: Synthetic oligonucleotide
  Target: FXN; (-) strand; PAM type: NRG; PAM sequence: AAG
taatcaaaatctctaggaat

SEQ ID NO: 11912 - DNA, 20 bp, Artificial Sequence
  Description of Artificial Sequence: Synthetic oligonucleotide
  Target: FXN; (-) strand; PAM type: NRG; PAM sequence: AGG
accaagtaatcaaaatctct

SEQ ID NO: 11913 - DNA, 20 bp, Artificial Sequence
  Description of Artificial Sequence: Synthetic oligonucleotide
  Target: FXN; (-) strand; PAM type: NRG; PAM sequence: TAG
gaccaagtaatcaaaatctc

SEQ ID NO: 11914 - DNA, 20 bp, Artificial Sequence
  Description of Artificial Sequence: Synthetic oligonucleotide
  Target: FXN; (-) strand; PAM type: NRG; PAM sequence: AAG
gtcatgccacaccccagacc

SEQ ID NO: 11915 - DNA, 20 bp, Artificial Sequence
  Description of Artificial Sequence: Synthetic oligonucleotide
  Target: FXN; (-) strand; PAM type: NRG; PAM sequence: CAG
gcccaggtcatgccacaccc

SEQ ID NO: 11916 - DNA, 20 bp, Artificial Sequence
  Description of Artificial Sequence: Synthetic oligonucleotide
  Target: FXN; (-) strand; PAM type: NRG; PAM sequence: AGG
aaaatcccagtgccctgccc

SEQ ID NO: 11917 - DNA, 20 bp, Artificial Sequence
  Description of Artificial Sequence: Synthetic oligonucleotide
  Target: FXN; (-) strand; PAM type: NRG; PAM sequence: CAG
aaaaatcccagtgccctgcc

SEQ ID NO: 11918 - DNA, 20 bp, Artificial Sequence
  Description of Artificial Sequence: Synthetic oligonucleotide
  Target: FXN; (-) strand; PAM type: NRG; PAM sequence: CAG
tctgtggagcttaaaaatcc

SEQ ID NO: 11919 - DNA, 20 bp, Artificial Sequence
  Description of Artificial Sequence: Synthetic oligonucleotide
  Target: FXN; (-) strand; PAM type: NRG; PAM sequence: GAG
gcatattggaatcatctgtg

SEQ ID NO: 11920 - DNA, 20 bp, Artificial Sequence
  Description of Artificial Sequence: Synthetic oligonucleotide
  Target: FXN; (-) strand; PAM type: NRG; PAM sequence: TGG
ctgcatattggaatcatctg

SEQ ID NO: 11921 - DNA, 20 bp, Artificial Sequence
  Description of Artificial Sequence: Synthetic oligonucleotide
  Target: FXN; (-) strand; PAM type: NRG; PAM sequence: TGG
ttctcatactagctgcatat

SEQ ID NO: 11922 - DNA, 20 bp, Artificial Sequence
  Description of Artificial Sequence: Synthetic oligonucleotide
  Target: FXN; (-) strand; PAM type: NRG; PAM sequence: TAG
aaaaaaacaagttctcatac

SEQ ID NO: 11923 - DNA, 20 bp, Artificial Sequence
  Description of Artificial Sequence: Synthetic oligonucleotide
  Target: FXN; (-) strand; PAM type: NRG; PAM sequence: AAG
agactccttcaaaaaaaaac

SEQ ID NO: 11924 - DNA, 20 bp, Artificial Sequence
  Description of Artificial Sequence: Synthetic oligonucleotide
  Target: FXN; (-) strand; PAM type: NRG; PAM sequence: GAG
tccagcctgggtgacagagt

SEQ ID NO: 11925 - DNA, 20 bp, Artificial Sequence
  Description of Artificial Sequence: Synthetic oligonucleotide
  Target: FXN; (-) strand; PAM type: NRG; PAM sequence: GAG
gcactccagcctgggtgaca

SEQ ID NO: 11926 - DNA, 20 bp, Artificial Sequence
  Description of Artificial Sequence: Synthetic oligonucleotide
  Target: FXN; (-) strand; PAM type: NRG; PAM sequence: CAG
ctgcactccagcctgggtga

SEQ ID NO: 11927 - DNA, 20 bp, Artificial Sequence
  Description of Artificial Sequence: Synthetic oligonucleotide
  Target: FXN; (-) strand; PAM type: NRG; PAM sequence: GGG
gcgccactgcactccagcct

SEQ ID NO: 11928 - DNA, 20 bp, Artificial Sequence
  Description of Artificial Sequence: Synthetic oligonucleotide
  Target: FXN; (-) strand; PAM type: NRG; PAM sequence: TGG
tgcgccactgcactccagcc

SEQ ID NO: 11929 - DNA, 20 bp, Artificial Sequence
  Description of Artificial Sequence: Synthetic oligonucleotide
  Target: FXN; (-) strand; PAM type: NRG; PAM sequence: CAG
gagattgcgccactgcactc

SEQ ID NO: 11930 - DNA, 20 bp, Artificial Sequence
  Description of Artificial Sequence: Synthetic oligonucleotide
  Target: FXN; (-) strand; PAM type: NRG; PAM sequence: GAG
aggaagcggagcagtgagcc

SEQ ID NO: 11931 - DNA, 20 bp, Artificial Sequence
  Description of Artificial Sequence: Synthetic oligonucleotide
  Target: FXN; (-) strand; PAM type: NRG; PAM sequence: GAG
aacccaggaagcggagcagt

SEQ ID NO: 11932 - DNA, 20 bp, Artificial Sequence
  Description of Artificial Sequence: Synthetic oligonucleotide
  Target: FXN; (-) strand; PAM type: NRG; PAM sequence: CAG
cttgaacccaggaagcggag

SEQ ID NO: 11933 - DNA, 20 bp, Artificial Sequence
  Description of Artificial Sequence: Synthetic oligonucleotide
  Target: FXN; (-) strand; PAM type: NRG; PAM sequence: GAG
ctgcttgaacccaggaagcg

SEQ ID NO: 11934 - DNA, 20 bp, Artificial Sequence
  Description of Artificial Sequence: Synthetic oligonucleotide
  Target: FXN; (-) strand; PAM type: NRG; PAM sequence: CGG
aactgcttgaacccaggaag

SEQ ID NO: 11935 - DNA, 20 bp, Artificial Sequence
  Description of Artificial Sequence: Synthetic oligonucleotide
  Target: FXN; (-) strand; PAM type: NRG; PAM sequence: AAG
gagaactgcttgaacccagg

SEQ ID NO: 11936 - DNA, 20 bp, Artificial Sequence
  Description of Artificial Sequence: Synthetic oligonucleotide
  Target: FXN; (-) strand; PAM type: NRG; PAM sequence: AGG
caggagaactgcttgaaccc

SEQ ID NO: 11937 - DNA, 20 bp, Artificial Sequence
  Description of Artificial Sequence: Synthetic oligonucleotide
  Target: FXN; (-) strand; PAM type: NRG; PAM sequence: CAG
gcaggagaactgcttgaacc

SEQ ID NO: 11938 - DNA, 20 bp, Artificial Sequence
  Description of Artificial Sequence: Synthetic oligonucleotide
  Target: FXN; (-) strand; PAM type: NRG; PAM sequence: GAG
tactcgggaggctgaggcag

SEQ ID NO: 11939 - DNA, 20 bp, Artificial Sequence
  Description of Artificial Sequence: Synthetic oligonucleotide
  Target: FXN; (-) strand; PAM type: NRG; PAM sequence: AGG
gctactcgggaggctgaggc

SEQ ID NO: 11940 - DNA, 20 bp, Artificial Sequence
  Description of Artificial Sequence: Synthetic oligonucleotide
  Target: FXN; (-) strand; PAM type: NRG; PAM sequence: CAG
agctactcgggaggctgagg

SEQ ID NO: 11941 - DNA, 20 bp, Artificial Sequence
  Description of Artificial Sequence: Synthetic oligonucleotide
  Target: FXN; (-) strand; PAM type: NRG; PAM sequence: AGG
cccagctactcgggaggctg

SEQ ID NO: 11942 - DNA, 20 bp, Artificial Sequence
  Description of Artificial Sequence: Synthetic oligonucleotide
  Target: FXN; (-) strand; PAM type: NRG; PAM sequence: GAG
tcccagctactcgggaggct

SEQ ID NO: 11943 - DNA, 20 bp, Artificial Sequence
  Description of Artificial Sequence: Synthetic oligonucleotide
  Target: FXN; (-) strand; PAM type: NRG; PAM sequence: AGG
tataatcccagctactcggg

SEQ ID NO: 11944 - DNA, 20 bp, Artificial Sequence
  Description of Artificial Sequence: Synthetic oligonucleotide
  Target: FXN; (-) strand; PAM type: NRG; PAM sequence: GAG
ctataatcccagctactcgg

SEQ ID NO: 11945 - DNA, 20 bp, Artificial Sequence
  Description of Artificial Sequence: Synthetic oligonucleotide
  Target: FXN; (-) strand; PAM type: NRG; PAM sequence: GGG
gcctataatcccagctactc

SEQ ID NO: 11946 - DNA, 20 bp, Artificial Sequence
  Description of Artificial Sequence: Synthetic oligonucleotide
  Target: FXN; (-) strand; PAM type: NRG; PAM sequence: CGG
tgcctataatcccagctact

SEQ ID NO: 11947 - DNA, 20 bp, Artificial Sequence
  Description of Artificial Sequence: Synthetic oligonucleotide
  Target: FXN; (-) strand; PAM type: NRG; PAM sequence: CAG
gtggcagatgcctataatcc

SEQ ID NO: 11948 - DNA, 20 bp, Artificial Sequence
  Description of Artificial Sequence: Synthetic oligonucleotide
  Target: FXN; (-) strand; PAM type: NRG; PAM sequence: CAG
aaattagctgggcatggtgg

SEQ ID NO: 11949 - DNA, 20 bp, Artificial Sequence
  Description of Artificial Sequence: Synthetic oligonucleotide
  Target: FXN; (-) strand; PAM type: NRG; PAM sequence: TGG
caaaaattagctgggcatgg

SEQ ID NO: 11950 - DNA, 20 bp, Artificial Sequence
  Description of Artificial Sequence: Synthetic oligonucleotide
  Target: FXN; (-) strand; PAM type: NRG; PAM sequence: TGG
atgcaaaaattagctgggca

SEQ ID NO: 11951 - DNA, 20 bp, Artificial Sequence
  Description of Artificial Sequence: Synthetic oligonucleotide
  Target: FXN; (-) strand; PAM type: NRG; PAM sequence: GGG
ctaaaatgcaaaaattagct

SEQ ID NO: 11952 - DNA, 20 bp, Artificial Sequence
  Description of Artificial Sequence: Synthetic oligonucleotide
  Target: FXN; (-) strand; PAM type: NRG; PAM sequence: TGG
actaaaatgcaaaaattagc

SEQ ID NO: 11953 - DNA, 20 bp, Artificial Sequence
  Description of Artificial Sequence: Synthetic oligonucleotide
  Target: FXN; (-) strand; PAM type: NRG; PAM sequence: TAG
ctttactaaaatgcaaaaat

SEQ ID NO: 11954 - DNA, 20 bp, Artificial Sequence
  Description of Artificial Sequence: Synthetic oligonucleotide
  Target: FXN; (-) strand; PAM type: NRG; PAM sequence: TGG
cgagaccagcctaaccaaca

SEQ ID NO: 11955 - DNA, 20 bp, Artificial Sequence
  Description of Artificial Sequence: Synthetic oligonucleotide
  Target: FXN; (-) strand; PAM type: NRG; PAM sequence: CAG
tgaggtcaggagatcgagac

SEQ ID NO: 11956 - DNA, 20 bp, Artificial Sequence
  Description of Artificial Sequence: Synthetic oligonucleotide
  Target: FXN; (-) strand; PAM type: NRG; PAM sequence: GAG
ccatttgaggtcaggagatc

SEQ ID NO: 11957 - DNA, 20 bp, Artificial Sequence
  Description of Artificial Sequence: Synthetic oligonucleotide
  Target: FXN; (-) strand; PAM type: NRG; PAM sequence: GAG
ggtggaccatttgaggtcag

SEQ ID NO: 11958 - DNA, 20 bp, Artificial Sequence
  Description of Artificial Sequence: Synthetic oligonucleotide
  Target: FXN; (-) strand; PAM type: NRG; PAM sequence: AGG
ggggtggaccatttgaggtc

SEQ ID NO: 11959 - DNA, 20 bp, Artificial Sequence
  Description of Artificial Sequence: Synthetic oligonucleotide
  Target: FXN; (-) strand; PAM type: NRG; PAM sequence: CAG
gggggtggaccatttgaggt

SEQ ID NO: 11960 - DNA, 20 bp, Artificial Sequence
  Description of Artificial Sequence: Synthetic oligonucleotide
  Target: FXN; (-) strand; PAM type: NRG; PAM sequence: AGG
tgatgggggtggaccatttg

SEQ ID NO: 11961 - DNA, 20 bp, Artificial Sequence
  Description of Artificial Sequence: Synthetic oligonucleotide
  Target: FXN; (-) strand; PAM type: NRG; PAM sequence: GAG
ctgatgggggtggaccattt

SEQ ID NO: 11962 - DNA, 20 bp, Artificial Sequence
  Description of Artificial Sequence: Synthetic oligonucleotide
  Target: FXN; (-) strand; PAM type: NRG; PAM sequence: TGG
ctttggaaggctgatggggg

SEQ ID NO: 11963 - DNA, 20 bp, Artificial Sequence
  Description of Artificial Sequence: Synthetic oligonucleotide
  Target: FXN; (-) strand; PAM type: NRG; PAM sequence: GGG
aaactttggaaggctgatgg

SEQ ID NO: 11964 - DNA, 20 bp, Artificial Sequence
  Description of Artificial Sequence: Synthetic oligonucleotide
  Target: FXN; (-) strand; PAM type: NRG; PAM sequence: GGG
aaaactttggaaggctgatg

SEQ ID NO: 11965 - DNA, 20 bp, Artificial Sequence
  Description of Artificial Sequence: Synthetic oligonucleotide
  Target: FXN; (-) strand; PAM type: NRG; PAM sequence: GGG
caaaactttggaaggctgat

SEQ ID NO: 11966 - DNA, 20 bp, Artificial Sequence
  Description of Artificial Sequence: Synthetic oligonucleotide
  Target: FXN; (-) strand; PAM type: NRG; PAM sequence: TGG
ccaaaactttggaaggctga

SEQ ID NO: 11967 - DNA, 20 bp, Artificial Sequence
  Description of Artificial Sequence: Synthetic oligonucleotide
  Target: FXN; (-) strand; PAM type: NRG; PAM sequence: AGG
tgttatcccaaaactttgga

SEQ ID NO: 11968 - DNA, 20 bp, Artificial Sequence
  Description of Artificial Sequence: Synthetic oligonucleotide
  Target: FXN; (-) strand; PAM type: NRG; PAM sequence: AAG
ctgttatcccaaaactttgg

SEQ ID NO: 11969 - DNA, 20 bp, Artificial Sequence
  Description of Artificial Sequence: Synthetic oligonucleotide
  Target: FXN; (-) strand; PAM type: NRG; PAM sequence: TGG
cgcctgttatcccaaaactt

SEQ ID NO: 11970 - DNA, 20 bp, Artificial Sequence
  Description of Artificial Sequence: Synthetic oligonucleotide
  Target: FXN; (-) strand; PAM type: NRG; PAM sequence: TGG
tcacaccaggccggacctgg

SEQ ID NO: 11971 - DNA, 20 bp, Artificial Sequence
  Description of Artificial Sequence: Synthetic oligonucleotide
  Target: FXN; (-) strand; PAM type: NRG; PAM sequence: TGG
ttctcacaccaggccggacc

SEQ ID NO: 11972 - DNA, 20 bp, Artificial Sequence
  Description of Artificial Sequence: Synthetic oligonucleotide
  Target: FXN; (-) strand; PAM type: NRG; PAM sequence: CGG
cagaagttctcacaccaggc

SEQ ID NO: 11973 - DNA, 20 bp, Artificial Sequence
  Description of Artificial Sequence: Synthetic oligonucleotide
  Target: FXN; (-) strand; PAM type: NRG; PAM sequence: AGG
aactcagaagttctcacacc

SEQ ID NO: 11974 - DNA, 20 bp, Artificial Sequence
  Description of Artificial Sequence: Synthetic oligonucleotide
  Target: FXN; (-) strand; PAM type: NRG; PAM sequence: CAG
caactcagaagttctcacac

SEQ ID NO: 11975 - DNA, 20 bp, Artificial Sequence
  Description of Artificial Sequence: Synthetic oligonucleotide
  Target: FXN; (-) strand; PAM type: NRG; PAM sequence: AAG
taatgtttcatccaactcag

SEQ ID NO: 11976 - DNA, 20 bp, Artificial Sequence
  Description of Artificial Sequence: Synthetic oligonucleotide
  Target: FXN; (-) strand; PAM type: NRG; PAM sequence: CAG
ggctaatgtttcatccaact

SEQ ID NO: 11977 - DNA, 20 bp, Artificial Sequence
  Description of Artificial Sequence: Synthetic oligonucleotide
  Target: FXN; (-) strand; PAM type: NRG; PAM sequence: GGG
tccctggcttctaggatctg

SEQ ID NO: 11978 - DNA, 20 bp, Artificial Sequence
  Description of Artificial Sequence: Synthetic oligonucleotide
  Target: FXN; (-) strand; PAM type: NRG; PAM sequence: GGG
ttccctggcttctaggatct

SEQ ID NO: 11979 - DNA, 20 bp, Artificial Sequence
  Description of Artificial Sequence: Synthetic oligonucleotide
  Target: FXN; (-) strand; PAM type: NRG; PAM sequence: TGG
cttccctggcttctaggatc

SEQ ID NO: 11980 - DNA, 20 bp, Artificial Sequence
  Description of Artificial Sequence: Synthetic oligonucleotide
  Target: FXN; (-) strand; PAM type: NRG; PAM sequence: AGG
ccagcacttccctggcttct

SEQ ID NO: 11981 - DNA, 20 bp, Artificial Sequence
  Description of Artificial Sequence: Synthetic oligonucleotide
  Target: FXN; (-) strand; PAM type: NRG; PAM sequence: TAG
accagcacttccctggcttc

SEQ ID NO: 11982 - DNA, 20 bp, Artificial Sequence
  Description of Artificial Sequence: Synthetic oligonucleotide
  Target: FXN; (-) strand; PAM type: NRG; PAM sequence: TGG
gataaagaccagcacttccc

SEQ ID NO: 11983 - DNA, 20 bp, Artificial Sequence
  Description of Artificial Sequence: Synthetic oligonucleotide
  Target: FXN; (-) strand; PAM type: NRG; PAM sequence: CAG
ggtggccagtcgataaagac

SEQ ID NO: 11984 - DNA, 20 bp, Artificial Sequence
  Description of Artificial Sequence: Synthetic oligonucleotide
  Target: FXN; (-) strand; PAM type: NRG; PAM sequence: AAG
cacctggtggccagtcgata

SEQ ID NO: 11985 - DNA, 20 bp, Artificial Sequence
  Description of Artificial Sequence: Synthetic oligonucleotide
  Target: FXN; (-) strand; PAM type: NRG; PAM sequence: CAG
caaatctgccacctggtggc

SEQ ID NO: 11986 - DNA, 20 bp, Artificial Sequence
  Description of Artificial Sequence: Synthetic oligonucleotide
  Target: FXN; (-) strand; PAM type: NRG; PAM sequence: TGG
tgcccaaatctgccacctgg

SEQ ID NO: 11987 - DNA, 20 bp, Artificial Sequence
  Description of Artificial Sequence: Synthetic oligonucleotide
  Target: FXN; (-) strand; PAM type: NRG; PAM sequence: TGG
ccttgcccaaatctgccacc

SEQ ID NO: 11988 - DNA, 20 bp, Artificial Sequence
  Description of Artificial Sequence: Synthetic oligonucleotide
  Target: FXN; (-) strand; PAM type: NRG; PAM sequence: CAG
aataattctaaacccaaagg

SEQ ID NO: 11989 - DNA, 20 bp, Artificial Sequence
  Description of Artificial Sequence: Synthetic oligonucleotide
  Target: FXN; (-) strand; PAM type: NRG; PAM sequence: AGG
agcaataattctaaacccaa

SEQ ID NO: 11990 - DNA, 20 bp, Artificial Sequence
  Description of Artificial Sequence: Synthetic oligonucleotide
  Target: FXN; (-) strand; PAM type: NRG; PAM sequence: AAG
aagcaataattctaaaccca

SEQ ID NO: 11991 - DNA, 20 bp, Artificial Sequence
  Description of Artificial Sequence: Synthetic oligonucleotide
  Target: FXN; (-) strand; PAM type: NRG; PAM sequence: AAG
aaagaactactttaaggcct

SEQ ID NO: 11992 - DNA, 20 bp, Artificial Sequence
  Description of Artificial Sequence: Synthetic oligonucleotide
  Target: FXN; (-) strand; PAM type: NRG; PAM sequence: AGG
ggcaaaaaagaactacttta

SEQ ID NO: 11993 - DNA, 20 bp, Artificial Sequence
  Description of Artificial Sequence: Synthetic oligonucleotide
  Target: FXN; (-) strand; PAM type: NRG; PAM sequence: AAG
tggcaaaaaagaactacttt

SEQ ID NO: 11994 - DNA, 20 bp, Artificial Sequence
  Description of Artificial Sequence: Synthetic oligonucleotide
  Target: FXN; (-) strand; PAM type: NRG; PAM sequence: AAG
attttctcccactggcaaaa

SEQ ID NO: 11995 - DNA, 20 bp, Artificial Sequence
  Description of Artificial Sequence: Synthetic oligonucleotide
  Target: FXN; (-) strand; PAM type: NRG; PAM sequence: TGG
tttgagggattttctcccac

SEQ ID NO: 11996 - DNA, 20 bp, Artificial Sequence
  Description of Artificial Sequence: Synthetic oligonucleotide
  Target: FXN; (-) strand; PAM type: NRG; PAM sequence: GGG
acccagaaaaccatctttga

SEQ ID NO: 11997 - DNA, 20 bp, Artificial Sequence
  Description of Artificial Sequence: Synthetic oligonucleotide
  Target: FXN; (-) strand; PAM type: NRG; PAM sequence: AGG
aacccagaaaaccatctttg

SEQ ID NO: 11998 - DNA, 20 bp, Artificial Sequence
  Description of Artificial Sequence: Synthetic oligonucleotide
  Target: FXN; (-) strand; PAM type: NRG; PAM sequence: GAG
caacccagaaaaccatcttt

SEQ ID NO: 11999 - DNA, 20 bp, Artificial Sequence
  Description of Artificial Sequence: Synthetic oligonucleotide
  Target: FXN; (-) strand; PAM type: NRG; PAM sequence: CAG
gacaaacaaaccaaccaacc

SEQ ID NO: 12000 - DNA, 20 bp, Artificial Sequence
  Description of Artificial Sequence: Synthetic oligonucleotide
  Target: FXN; (-) strand; PAM type: NRG; PAM sequence: CAG
tgtctcaaaaaacaaacaaa

SEQ ID NO: 12001 - DNA, 20 bp, Artificial Sequence
  Description of Artificial Sequence: Synthetic oligonucleotide
  Target: FXN; (-) strand; PAM type: NRG; PAM sequence: GAG
tccaggctgaataacagagg

SEQ ID NO: 12002 - DNA, 20 bp, Artificial Sequence
  Description of Artificial Sequence: Synthetic oligonucleotide
  Target: FXN; (-) strand; PAM type: NRG; PAM sequence: GGG
actccaggctgaataacaga

SEQ ID NO: 12003 - DNA, 20 bp, Artificial Sequence
  Description of Artificial Sequence: Synthetic oligonucleotide
  Target: FXN; (-) strand; PAM type: NRG; PAM sequence: AGG
cactccaggctgaataacag

SEQ ID NO: 12004 - DNA, 20 bp, Artificial Sequence
  Description of Artificial Sequence: Synthetic oligonucleotide
  Target: FXN; (-) strand; PAM type: NRG; PAM sequence: GAG
gcactccaggctgaataaca

SEQ ID NO: 12005 - DNA, 20 bp, Artificial Sequence
  Description of Artificial Sequence: Synthetic oligonucleotide
  Target: FXN; (-) strand; PAM type: NRG; PAM sequence: CAG
ctgcactccaggctgaataa

SEQ ID NO: 12006 - DNA, 20 bp, Artificial Sequence
  Description of Artificial Sequence: Synthetic oligonucleotide
  Target: FXN; (-) strand; PAM type: NRG; PAM sequence: AGG
agatcatgccactgcactcc

SEQ ID NO: 12007 - DNA, 20 bp, Artificial Sequence
  Description of Artificial Sequence: Synthetic oligonucleotide
  Target: FXN; (-) strand; PAM type: NRG; PAM sequence: CAG
gagatcatgccactgcactc

SEQ ID NO: 12008 - DNA, 20 bp, Artificial Sequence
  Description of Artificial Sequence: Synthetic oligonucleotide
  Target: FXN; (-) strand; PAM type: NRG; PAM sequence: GAG
cgagaggcagaggttgcagt

SEQ ID NO: 12009 - DNA, 20 bp, Artificial Sequence
  Description of Artificial Sequence: Synthetic oligonucleotide
  Target: FXN; (-) strand; PAM type: NRG; PAM sequence: CAG
aacccgagaggcagaggttg

SEQ ID NO: 12010 - DNA, 20 bp, Artificial Sequence
  Description of Artificial Sequence: Synthetic oligonucleotide
  Target: FXN; (-) strand; PAM type: NRG; PAM sequence: AGG
tgcttgaacccgagaggcag

SEQ ID NO: 12011 - DNA, 20 bp, Artificial Sequence
  Description of Artificial Sequence: Synthetic oligonucleotide
  Target: FXN; (-) strand; PAM type: NRG; PAM sequence: GAG
ctgcttgaacccgagaggca

SEQ ID NO: 12012 - DNA, 20 bp, Artificial Sequence
  Description of Artificial Sequence: Synthetic oligonucleotide
  Target: FXN; (-) strand; PAM type: NRG; PAM sequence: CAG
aactgcttgaacccgagagg

SEQ ID NO: 12013 - DNA, 20 bp, Artificial Sequence
  Description of Artificial Sequence: Synthetic oligonucleotide
  Target: FXN; (-) strand; PAM type: NRG; PAM sequence: AGG
gagaactgcttgaacccgag

SEQ ID NO: 12014 - DNA, 20 bp, Artificial Sequence
  Description of Artificial Sequence: Synthetic oligonucleotide
  Target: FXN; (-) strand; PAM type: NRG; PAM sequence: GAG
ggagaactgcttgaacccga

SEQ ID NO: 12015 - DNA, 20 bp, Artificial Sequence
  Description of Artificial Sequence: Synthetic oligonucleotide
  Target: FXN; (-) strand; PAM type: NRG; PAM sequence: GAG
caggagaactgcttgaaccc

SEQ ID NO: 12016 - DNA, 20 bp, Artificial Sequence
  Description of Artificial Sequence: Synthetic oligonucleotide
  Target: FXN; (-) strand; PAM type: NRG; PAM sequence: GAG
tacttgggaggttgaggcag

SEQ ID NO: 12017 - DNA, 20 bp, Artificial Sequence
  Description of Artificial Sequence: Synthetic oligonucleotide
  Target: FXN; (-) strand; PAM type: NRG; PAM sequence: AGG
gctacttgggaggttgaggc

SEQ ID NO: 12018 - DNA, 20 bp, Artificial Sequence
  Description of Artificial Sequence: Synthetic oligonucleotide
  Target: FXN; (-) strand; PAM type: NRG; PAM sequence: CAG
agctacttgggaggttgagg

SEQ ID NO: 12019 - DNA, 20 bp, Artificial Sequence
  Description of Artificial Sequence: Synthetic oligonucleotide
  Target: FXN; (-) strand; PAM type: NRG; PAM sequence: AGG
tccagctacttgggaggttg

SEQ ID NO: 12020 - DNA, 20 bp, Artificial Sequence
  Description of Artificial Sequence: Synthetic oligonucleotide
  Target: FXN; (-) strand; PAM type: NRG; PAM sequence: GAG
ttccagctacttgggaggtt

SEQ ID NO: 12021 - DNA, 20 bp, Artificial Sequence
  Description of Artificial Sequence: Synthetic oligonucleotide
  Target: FXN; (-) strand; PAM type: NRG; PAM sequence: AGG
tataattccagctacttggg

SEQ ID NO: 12022 - DNA, 20 bp, Artificial Sequence
  Description of Artificial Sequence: Synthetic oligonucleotide
  Target: FXN; (-) strand; PAM type: NRG; PAM sequence: GAG
ctataattccagctacttgg

SEQ ID NO: 12023 - DNA, 20 bp, Artificial Sequence
  Description of Artificial Sequence: Synthetic oligonucleotide
  Target: FXN; (-) strand; PAM type: NRG; PAM sequence: GGG
gcctataattccagctactt

SEQ ID NO: 12024 - DNA, 20 bp, Artificial Sequence
  Description of Artificial Sequence: Synthetic oligonucleotide
  Target: FXN; (-) strand; PAM type: NRG; PAM sequence: TGG
tgcctataattccagctact

SEQ ID NO: 12025 - DNA, 20 bp, Artificial Sequence
  Description of Artificial Sequence: Synthetic oligonucleotide
  Target: FXN; (-) strand; PAM type: NRG; PAM sequence: CAG
ggggcgtgtgcctataattc

SEQ ID NO: 12026 - DNA, 20 bp, Artificial Sequence
  Description of Artificial Sequence: Synthetic oligonucleotide
  Target: FXN; (-) strand; PAM type: NRG; PAM sequence: GGG
caaaaattagctgggtgtgg

SEQ ID NO: 12027 - DNA, 20 bp, Artificial Sequence
  Description of Artificial Sequence: Synthetic oligonucleotide
  Target: FXN; (-) strand; PAM type: NRG; PAM sequence: GGG
acaaaaattagctgggtgtg

SEQ ID NO: 12028 - DNA, 20 bp, Artificial Sequence
  Description of Artificial Sequence: Synthetic oligonucleotide
  Target: FXN; (-) strand; PAM type: NRG; PAM sequence: GGG
tacaaaaattagctgggtgt

SEQ ID NO: 12029 - DNA, 20 bp, Artificial Sequence
  Description of Artificial Sequence: Synthetic oligonucleotide
  Target: FXN; (-) strand; PAM type: NRG; PAM sequence: TGG
atacaaaaattagctgggtg

SEQ ID NO: 12030 - DNA, 20 bp, Artificial Sequence
  Description of Artificial Sequence: Synthetic oligonucleotide
  Target: FXN; (-) strand; PAM type: NRG; PAM sequence: GGG
taaaaatacaaaaattagct

SEQ ID NO: 12031 - DNA, 20 bp, Artificial Sequence
  Description of Artificial Sequence: Synthetic oligonucleotide
  Target: FXN; (-) strand; PAM type: NRG; PAM sequence: TGG
ctaaaaatacaaaaattagc

SEQ ID NO: 12032 - DNA, 20 bp, Artificial Sequence
  Description of Artificial Sequence: Synthetic oligonucleotide
  Target: FXN; (-) strand; PAM type: NRG; PAM sequence: TAG
tctactaaaaatacaaaaat

SEQ ID NO: 12033 - DNA, 20 bp, Artificial Sequence
  Description of Artificial Sequence: Synthetic oligonucleotide
  Target: FXN; (-) strand; PAM type: NRG; PAM sequence: TGG
caaaaccagcctggccaacg

SEQ ID NO: 12034 - DNA, 20 bp, Artificial Sequence
  Description of Artificial Sequence: Synthetic oligonucleotide
  Target: FXN; (-) strand; PAM type: NRG; PAM sequence: TGG
tcaggagttcaaaaccagcc

SEQ ID NO: 12035 - DNA, 20 bp, Artificial Sequence
  Description of Artificial Sequence: Synthetic oligonucleotide
  Target: FXN; (-) strand; PAM type: NRG; PAM sequence: CAG
tgagttcaggagttcaaaac

SEQ ID NO: 12036 - DNA, 20 bp, Artificial Sequence
  Description of Artificial Sequence: Synthetic oligonucleotide
  Target: FXN; (-) strand; PAM type: NRG; PAM sequence: GAG
ggaggattacttgagttcag

SEQ ID NO: 12037 - DNA, 20 bp, Artificial Sequence
  Description of Artificial Sequence: Synthetic oligonucleotide
  Target: FXN; (-) strand; PAM type: NRG; PAM sequence: AGG
tgggaggattacttgagttc

SEQ ID NO: 12038 - DNA, 20 bp, Artificial Sequence
  Description of Artificial Sequence: Synthetic oligonucleotide
  Target: FXN; (-) strand; PAM type: NRG; PAM sequence: CAG
gtgggaggattacttgagtt

SEQ ID NO: 12039 - DNA, 20 bp, Artificial Sequence
  Description of Artificial Sequence: Synthetic oligonucleotide
  Target: FXN; (-) strand; PAM type: NRG; PAM sequence: GAG
ctgaggtgggaggattactt

SEQ ID NO: 12040 - DNA, 20 bp, Artificial Sequence
  Description of Artificial Sequence: Synthetic oligonucleotide
  Target: FXN; (-) strand; PAM type: NRG; PAM sequence: AGG
ctttgggaggctgaggtggg

SEQ ID NO: 12041 - DNA, 20 bp, Artificial Sequence
  Description of Artificial Sequence: Synthetic oligonucleotide
  Target: FXN; (-) strand; PAM type: NRG; PAM sequence: GAG
actttgggaggctgaggtgg

SEQ ID NO: 12042 - DNA, 20 bp, Artificial Sequence
  Description of Artificial Sequence: Synthetic oligonucleotide
  Target: FXN; (-) strand; PAM type: NRG; PAM sequence: GGG
gcactttgggaggctgaggt

SEQ ID NO: 12043 - DNA, 20 bp, Artificial Sequence
  Description of Artificial Sequence: Synthetic oligonucleotide
  Target: FXN; (-) strand; PAM type: NRG; PAM sequence: TGG
agcactttgggaggctgagg

SEQ ID NO: 12044 - DNA, 20 bp, Artificial Sequence
  Description of Artificial Sequence: Synthetic oligonucleotide
  Target: FXN; (-) strand; PAM type: NRG; PAM sequence: AGG
cctagcactttgggaggctg

SEQ ID NO: 12045 - DNA, 20 bp, Artificial Sequence
  Description of Artificial Sequence: Synthetic oligonucleotide
  Target: FXN; (-) strand; PAM type: NRG; PAM sequence: GAG
tcctagcactttgggaggct

SEQ ID NO: 12046 - DNA, 20 bp, Artificial Sequence
  Description of Artificial Sequence: Synthetic oligonucleotide
  Target: FXN; (-) strand; PAM type: NRG; PAM sequence: AGG
tgtaatcctagcactttggg

SEQ ID NO: 12047 - DNA, 20 bp, Artificial Sequence
  Description of Artificial Sequence: Synthetic oligonucleotide
  Target: FXN; (-) strand; PAM type: NRG; PAM sequence: GAG
ctgtaatcctagcactttgg

SEQ ID NO: 12048 - DNA, 20 bp, Artificial Sequence
  Description of Artificial Sequence: Synthetic oligonucleotide
  Target: FXN; (-) strand; PAM type: NRG; PAM sequence: GGG
acctgtaatcctagcacttt

SEQ ID NO: 12049 - DNA, 20 bp, Artificial Sequence
  Description of Artificial Sequence: Synthetic oligonucleotide
  Target: FXN; (-) strand; PAM type: NRG; PAM sequence: TGG
cacctgtaatcctagcactt

SEQ ID NO: 12050 - DNA, 20 bp, Artificial Sequence
  Description of Artificial Sequence: Synthetic oligonucleotide
  Target: FXN; (-) strand; PAM type: NRG; PAM sequence: TAG
gtggctcacacctgtaatcc

SEQ ID NO: 12051 - DNA, 20 bp, Artificial Sequence
  Description of Artificial Sequence: Synthetic oligonucleotide
  Target: FXN; (-) strand; PAM type: NRG; PAM sequence: TGG
ctttgaggagccaggcgcgg

SEQ ID NO: 12052 - DNA, 20 bp, Artificial Sequence
  Description of Artificial Sequence: Synthetic oligonucleotide
  Target: FXN; (-) strand; PAM type: NRG; PAM sequence: CGG
catctttgaggagccaggcg

SEQ ID NO: 12053 - DNA, 20 bp, Artificial Sequence
  Description of Artificial Sequence: Synthetic oligonucleotide
  Target: FXN; (-) strand; PAM type: NRG; PAM sequence: AGG
attaacatctttgaggagcc

SEQ ID NO: 12054 - DNA, 20 bp, Artificial Sequence
  Description of Artificial Sequence: Synthetic oligonucleotide
  Target: FXN; (-) strand; PAM type: NRG; PAM sequence: CAG
gattaacatctttgaggagc

SEQ ID NO: 12055 - DNA, 20 bp, Artificial Sequence
  Description of Artificial Sequence: Synthetic oligonucleotide
  Target: FXN; (-) strand; PAM type: NRG; PAM sequence: GAG
agaggattaacatctttgag

SEQ ID NO: 12056 - DNA, 20 bp, Artificial Sequence
  Description of Artificial Sequence: Synthetic oligonucleotide
  Target: FXN; (-) strand; PAM type: NRG; PAM sequence: AGG
caagaggattaacatctttg

SEQ ID NO: 12057 - DNA, 20 bp, Artificial Sequence
  Description of Artificial Sequence: Synthetic oligonucleotide
  Target: FXN; (-) strand; PAM type: NRG; PAM sequence: GAG
tcaagaggattaacatcttt

SEQ ID NO: 12058 - DNA, 20 bp, Artificial Sequence
  Description of Artificial Sequence: Synthetic oligonucleotide
  Target: FXN; (-) strand; PAM type: NRG; PAM sequence: AGG
attagtcaattgccatcaag

SEQ ID NO: 12059 - DNA, 20 bp, Artificial Sequence
  Description of Artificial Sequence: Synthetic oligonucleotide
  Target: FXN; (-) strand; PAM type: NRG; PAM sequence: GAG
tattagtcaattgccatcaa

SEQ ID NO: 12060 - DNA, 20 bp, Artificial Sequence
  Description of Artificial Sequence: Synthetic oligonucleotide
  Target: FXN; (-) strand; PAM type: NRG; PAM sequence: AAG
ggtattagtcaattgccatc

SEQ ID NO: 12061 - DNA, 20 bp, Artificial Sequence
  Description of Artificial Sequence: Synthetic oligonucleotide
  Target: FXN; (-) strand; PAM type: NRG; PAM sequence: TAG
ttcgtgacattttctggtat

SEQ ID NO: 12062 - DNA, 20 bp, Artificial Sequence
  Description of Artificial Sequence: Synthetic oligonucleotide
  Target: FXN; (-) strand; PAM type: NRG; PAM sequence: TGG
gcacgcttcgtgacattttc

SEQ ID NO: 12063 - DNA, 20 bp, Artificial Sequence
  Description of Artificial Sequence: Synthetic oligonucleotide
  Target: FXN; (-) strand; PAM type: NRG; PAM sequence: TGG
tttctatcgctttagtctga

SEQ ID NO: 12064 - DNA, 20 bp, Artificial Sequence
  Description of Artificial Sequence: Synthetic oligonucleotide
  Target: FXN; (-) strand; PAM type: NRG; PAM sequence: TAG
caatactatttctatcgctt

SEQ ID NO: 12065 - DNA, 20 bp, Artificial Sequence
  Description of Artificial Sequence: Synthetic oligonucleotide
  Target: FXN; (-) strand; PAM type: NRG; PAM sequence: CAG
tgtggagtgccttctccatt

SEQ ID NO: 12066 - DNA, 20 bp, Artificial Sequence
  Description of Artificial Sequence: Synthetic oligonucleotide
  Target: FXN; (-) strand; PAM type: NRG; PAM sequence: GAG
gttgcctcctccattatgtg

SEQ ID NO: 12067 - DNA, 20 bp, Artificial Sequence
  Description of Artificial Sequence: Synthetic oligonucleotide
  Target: FXN; (-) strand; PAM type: NRG; PAM sequence: TGG
tggttgcctcctccattatg

SEQ ID NO: 12068 - DNA, 20 bp, Artificial Sequence
  Description of Artificial Sequence: Synthetic oligonucleotide
  Target: FXN; (-) strand; PAM type: NRG; PAM sequence: TGG
ttgataccttctctaagact

SEQ ID NO: 12069 - DNA, 20 bp, Artificial Sequence
  Description of Artificial Sequence: Synthetic oligonucleotide
  Target: FXN; (-) strand; PAM type: NRG; PAM sequence: AAG
tcaggcttgataccttctct

SEQ ID NO: 12070 - DNA, 20 bp, Artificial Sequence
  Description of Artificial Sequence: Synthetic oligonucleotide
  Target: FXN; (-) strand; PAM type: NRG; PAM sequence: AGG
ccctcactgtccttatagtc

SEQ ID NO: 12071 - DNA, 20 bp, Artificial Sequence
  Description of Artificial Sequence: Synthetic oligonucleotide
  Target: FXN; (-) strand; PAM type: NRG; PAM sequence: CAG
tccctcactgtccttatagt

SEQ ID NO: 12072 - DNA, 20 bp, Artificial Sequence
  Description of Artificial Sequence: Synthetic oligonucleotide
  Target: FXN; (-) strand; PAM type: NRG; PAM sequence: TAG
caattccctcactgtcctta

SEQ ID NO: 12073 - DNA, 20 bp, Artificial Sequence
  Description of Artificial Sequence: Synthetic oligonucleotide
  Target: FXN; (-) strand; PAM type: NRG; PAM sequence: AGG
aattactgaatctacttgaa

SEQ ID NO: 12074 - DNA, 20 bp, Artificial Sequence
  Description of Artificial Sequence: Synthetic oligonucleotide
  Target: FXN; (-) strand; PAM type: NRG; PAM sequence: AAG
caattactgaatctacttga

SEQ ID NO: 12075 - DNA, 20 bp, Artificial Sequence
  Description of Artificial Sequence: Synthetic oligonucleotide
  Target: FXN; (-) strand; PAM type: NRG; PAM sequence: CAG
actgcattttttgctgctaa

SEQ ID NO: 12076 - DNA, 20 bp, Artificial Sequence
  Description of Artificial Sequence: Synthetic oligonucleotide
  Target: FXN; (-) strand; PAM type: NRG; PAM sequence: AGG
agcactttaaagccctgccc

SEQ ID NO: 12077 - DNA, 20 bp, Artificial Sequence
  Description of Artificial Sequence: Synthetic oligonucleotide
  Target: FXN; (-) strand; PAM type: NRG; PAM sequence: CAG
aagcactttaaagccctgcc

SEQ ID NO: 12078 - DNA, 20 bp, Artificial Sequence
  Description of Artificial Sequence: Synthetic oligonucleotide
  Target: FXN; (-) strand; PAM type: NRG; PAM sequence: AAG
ctgcctgtgcaagcacttta

SEQ ID NO: 12079 - DNA, 20 bp, Artificial Sequence
  Description of Artificial Sequence: Synthetic oligonucleotide
  Target: FXN; (-) strand; PAM type: NRG; PAM sequence: AAG
ccctctagggctgcctgtgc

SEQ ID NO: 12080 - DNA, 20 bp, Artificial Sequence
  Description of Artificial Sequence: Synthetic oligonucleotide
  Target: FXN; (-) strand; PAM type: NRG; PAM sequence: GGG
ccaagcagcccggccctcta

SEQ ID NO: 12081 - DNA, 20 bp, Artificial Sequence
  Description of Artificial Sequence: Synthetic oligonucleotide
  Target: FXN; (-) strand; PAM type: NRG; PAM sequence: AGG
cccaagcagcccggccctct

SEQ ID NO: 12082 - DNA, 20 bp, Artificial Sequence
  Description of Artificial Sequence: Synthetic oligonucleotide
  Target: FXN; (-) strand; PAM type: NRG; PAM sequence: TAG
tcccaagcagcccggccctc

SEQ ID NO: 12083 - DNA, 20 bp, Artificial Sequence
  Description of Artificial Sequence: Synthetic oligonucleotide
  Target: FXN; (-) strand; PAM type: NRG; PAM sequence: CGG
gtaagagttcccaagcagcc

SEQ ID NO: 12084 - DNA, 20 bp, Artificial Sequence
  Description of Artificial Sequence: Synthetic oligonucleotide
  Target: FXN; (-) strand; PAM type: NRG; PAM sequence: CAG
agtttgtaagagttcccaag

SEQ ID NO: 12085 - DNA, 20 bp, Artificial Sequence
  Description of Artificial Sequence: Synthetic oligonucleotide
  Target: FXN; (-) strand; PAM type: NRG; PAM sequence: AAG
gtcagtttgtaagagttccc

SEQ ID NO: 12086 - DNA, 20 bp, Artificial Sequence
  Description of Artificial Sequence: Synthetic oligonucleotide
  Target: FXN; (-) strand; PAM type: NRG; PAM sequence: GAG
gttggtaggtcagtttgtaa

SEQ ID NO: 12087 - DNA, 20 bp, Artificial Sequence
  Description of Artificial Sequence: Synthetic oligonucleotide
  Target: FXN; (-) strand; PAM type: NRG; PAM sequence: AAG
aagttggtaggtcagtttgt

SEQ ID NO: 12088 - DNA, 20 bp, Artificial Sequence
  Description of Artificial Sequence: Synthetic oligonucleotide
  Target: FXN; (-) strand; PAM type: NRG; PAM sequence: CAG
ggatgctcaagttggtaggt

SEQ ID NO: 12089 - DNA, 20 bp, Artificial Sequence
  Description of Artificial Sequence: Synthetic oligonucleotide
  Target: FXN; (-) strand; PAM type: NRG; PAM sequence: AGG
ctgtggatgctcaagttggt

SEQ ID NO: 12090 - DNA, 20 bp, Artificial Sequence
  Description of Artificial Sequence: Synthetic oligonucleotide
  Target: FXN; (-) strand; PAM type: NRG; PAM sequence: TAG
gctgtggatgctcaagttgg

SEQ ID NO: 12091 - DNA, 20 bp, Artificial Sequence
  Description of Artificial Sequence: Synthetic oligonucleotide
  Target: FXN; (-) strand; PAM type: NRG; PAM sequence: TGG
caggctgtggatgctcaagt

SEQ ID NO: 12092 - DNA, 20 bp, Artificial Sequence
  Description of Artificial Sequence: Synthetic oligonucleotide
  Target: FXN; (-) strand; PAM type: NRG; PAM sequence: AAG
tgatcaggctgtggatgctc

SEQ ID NO: 12093 - DNA, 20 bp, Artificial Sequence
  Description of Artificial Sequence: Synthetic oligonucleotide
  Target: FXN; (-) strand; PAM type: NRG; PAM sequence: TGG
ccccacctctgatcaggctg

SEQ ID NO: 12094 - DNA, 20 bp, Artificial Sequence
  Description of Artificial Sequence: Synthetic oligonucleotide
  Target: FXN; (-) strand; PAM type: NRG; PAM sequence: AGG
taactcccccacctctgatc

SEQ ID NO: 12095 - DNA, 20 bp, Artificial Sequence
  Description of Artificial Sequence: Synthetic oligonucleotide
  Target: FXN; (-) strand; PAM type: NRG; PAM sequence: CAG
ttaactcccccacctctgat

SEQ ID NO: 12096 - DNA, 20 bp, Artificial Sequence
  Description of Artificial Sequence: Synthetic oligonucleotide
  Target: FXN; (-) strand; PAM type: NRG; PAM sequence: AGG
agtagaggctaggggagaga

SEQ ID NO: 12097 - DNA, 20 bp, Artificial Sequence
  Description of Artificial Sequence: Synthetic oligonucleotide
  Target: FXN; (-) strand; PAM type: NRG; PAM sequence: AAG
tagtagaggctaggggagag

SEQ ID NO: 12098 - DNA, 20 bp, Artificial Sequence
  Description of Artificial Sequence: Synthetic oligonucleotide
  Target: FXN; (-) strand; PAM type: NRG; PAM sequence: GAG
ctctagtagaggctagggga

SEQ ID NO: 12099 - DNA, 20 bp, Artificial Sequence
  Description of Artificial Sequence: Synthetic oligonucleotide
  Target: FXN; (-) strand; PAM type: NRG; PAM sequence: GAG
ggctctagtagaggctaggg

SEQ ID NO: 12100 - DNA, 20 bp, Artificial Sequence
  Description of Artificial Sequence: Synthetic oligonucleotide
  Target: FXN; (-) strand; PAM type: NRG; PAM sequence: GGG
caggctctagtagaggctag

SEQ ID NO: 12101 - DNA, 20 bp, Artificial Sequence
  Description of Artificial Sequence: Synthetic oligonucleotide
  Target: FXN; (-) strand; PAM type: NRG; PAM sequence: GGG
acaggctctagtagaggcta

SEQ ID NO: 12102 - DNA, 20 bp, Artificial Sequence
  Description of Artificial Sequence: Synthetic oligonucleotide
  Target: FXN; (-) strand; PAM type: NRG; PAM sequence: AGG
tacaggctctagtagaggct

SEQ ID NO: 12103 - DNA, 20 bp, Artificial Sequence
  Description of Artificial Sequence: Synthetic oligonucleotide
  Target: FXN; (-) strand; PAM type: NRG; PAM sequence: TAG
ttacaggctctagtagaggc

SEQ ID NO: 12104 - DNA, 20 bp, Artificial Sequence
  Description of Artificial Sequence: Synthetic oligonucleotide
  Target: FXN; (-) strand; PAM type: NRG; PAM sequence: AGG
gcagttacaggctctagtag

SEQ ID NO: 12105 - DNA, 20 bp, Artificial Sequence
  Description of Artificial Sequence: Synthetic oligonucleotide
  Target: FXN; (-) strand; PAM type: NRG; PAM sequence: GAG
tgcagttacaggctctagta

SEQ ID NO: 12106 - DNA, 20 bp, Artificial Sequence
  Description of Artificial Sequence: Synthetic oligonucleotide
  Target: FXN; (-) strand; PAM type: NRG; PAM sequence: TAG
cctgcagttacaggctctag

SEQ ID NO: 12107 - DNA, 20 bp, Artificial Sequence
  Description of Artificial Sequence: Synthetic oligonucleotide
  Target: FXN; (-) strand; PAM type: NRG; PAM sequence: TAG
ttccctgcagttacaggctc

SEQ ID NO: 12108 - DNA, 20 bp, Artificial Sequence
  Description of Artificial Sequence: Synthetic oligonucleotide
  Target: FXN; (-) strand; PAM type: NRG; PAM sequence: AGG
cttggtttccctgcagttac

SEQ ID NO: 12109 - DNA, 20 bp, Artificial Sequence
  Description of Artificial Sequence: Synthetic oligonucleotide
  Target: FXN; (-) strand; PAM type: NRG; PAM sequence: CAG
acttggtttccctgcagtta

SEQ ID NO: 12110 - DNA, 20 bp, Artificial Sequence
  Description of Artificial Sequence: Synthetic oligonucleotide
  Target: FXN; (-) strand; PAM type: NRG; PAM sequence: CAG
cctgcaacttggtttccctg

SEQ ID NO: 12111 - DNA, 20 bp, Artificial Sequence
  Description of Artificial Sequence: Synthetic oligonucleotide
  Target: FXN; (-) strand; PAM type: NRG; PAM sequence: TGG
gcagagtttagcctgcaact

SEQ ID NO: 12112 - DNA, 20 bp, Artificial Sequence
  Description of Artificial Sequence: Synthetic oligonucleotide
  Target: FXN; (-) strand; PAM type: NRG; PAM sequence: TAG
ctgcatgtgtgggcagagtt

SEQ ID NO: 12113 - DNA, 20 bp, Artificial Sequence
  Description of Artificial Sequence: Synthetic oligonucleotide
  Target: FXN; (-) strand; PAM type: NRG; PAM sequence: GAG
aatgtctgcatgtgtgggca

SEQ ID NO: 12114 - DNA, 20 bp, Artificial Sequence
  Description of Artificial Sequence: Synthetic oligonucleotide
  Target: FXN; (-) strand; PAM type: NRG; PAM sequence: CAG
tcaatgtctgcatgtgtggg

SEQ ID NO: 12115 - DNA, 20 bp, Artificial Sequence
  Description of Artificial Sequence: Synthetic oligonucleotide
  Target: FXN; (-) strand; PAM type: NRG; PAM sequence: GGG
taatcaatgtctgcatgtgt

SEQ ID NO: 12116 - DNA, 20 bp, Artificial Sequence
  Description of Artificial Sequence: Synthetic oligonucleotide
  Target: FXN; (-) strand; PAM type: NRG; PAM sequence: TGG
ctaatcaatgtctgcatgtg

SEQ ID NO: 12117 - DNA, 20 bp, Artificial Sequence
  Description of Artificial Sequence: Synthetic oligonucleotide
  Target: FXN; (-) strand; PAM type: NRG; PAM sequence: TAG
aggtttcatgactgtttttg

SEQ ID NO: 12118 - DNA, 20 bp, Artificial Sequence
  Description of Artificial Sequence: Synthetic oligonucleotide
  Target: FXN; (-) strand; PAM type: NRG; PAM sequence: AGG
ttcactaatcctataaaaac

SEQ ID NO: 12119 - DNA, 20 bp, Artificial Sequence
  Description of Artificial Sequence: Synthetic oligonucleotide
  Target: FXN; (-) strand; PAM type: NRG; PAM sequence: CAG
cttcactaatcctataaaaa

SEQ ID NO: 12120 - DNA, 20 bp, Artificial Sequence
  Description of Artificial Sequence: Synthetic oligonucleotide
  Target: FXN; (-) strand; PAM type: NRG; PAM sequence: GGG
aaagtactctggtcaaactg

SEQ ID NO: 12121 - DNA, 20 bp, Artificial Sequence
  Description of Artificial Sequence: Synthetic oligonucleotide
  Target: FXN; (-) strand; PAM type: NRG; PAM sequence: GGG
caaagtactctggtcaaact

SEQ ID NO: 12122 - DNA, 20 bp, Artificial Sequence
  Description of Artificial Sequence: Synthetic oligonucleotide
  Target: FXN; (-) strand; PAM type: NRG; PAM sequence: TGG
gcaaagtactctggtcaaac

SEQ ID NO: 12123 - DNA, 20 bp, Artificial Sequence
  Description of Artificial Sequence: Synthetic oligonucleotide
  Target: FXN; (-) strand; PAM type: NRG; PAM sequence: TGG
aacattcatgcaaagtactc

SEQ ID NO: 12124 - DNA, 20 bp, Artificial Sequence
  Description of Artificial Sequence: Synthetic oligonucleotide
  Target: FXN; (-) strand; PAM type: NRG; PAM sequence: AAG
tctaacaaaacattcatgca

SEQ ID NO: 12125 - DNA, 20 bp, Artificial Sequence
  Description of Artificial Sequence: Synthetic oligonucleotide
  Target: FXN; (-) strand; PAM type: NRG; PAM sequence: TGG
aaacgcagctgctagaatat

SEQ ID NO: 12126 - DNA, 20 bp, Artificial Sequence
  Description of Artificial Sequence: Synthetic oligonucleotide
  Target: FXN; (-) strand; PAM type: NRG; PAM sequence: TAG
agtaaaccaaacgcagctgc

SEQ ID NO: 12127 - DNA, 20 bp, Artificial Sequence
  Description of Artificial Sequence: Synthetic oligonucleotide
  Target: FXN; (-) strand; PAM type: NRG; PAM sequence: CAG
aagaagaagtaaaccaaacg

SEQ ID NO: 12128 - DNA, 20 bp, Artificial Sequence
  Description of Artificial Sequence: Synthetic oligonucleotide
  Target: FXN; (-) strand; PAM type: NRG; PAM sequence: AAG
aaaaaaaaaagaagaagaag

SEQ ID NO: 12129 - DNA, 20 bp, Artificial Sequence
  Description of Artificial Sequence: Synthetic oligonucleotide
  Target: FXN; (-) strand; PAM type: NRG; PAM sequence: AAG
aaaaaaaaaaaaagaagaag

SEQ ID NO: 12130 - DNA, 20 bp, Artificial Sequence
  Description of Artificial Sequence: Synthetic oligonucleotide
  Target: FXN; (-) strand; PAM type: NRG; PAM sequence: AAG
caaaaaaaaaaaaaaagaag

SEQ ID NO: 12131 - DNA, 20 bp, Artificial Sequence
  Description of Artificial Sequence: Synthetic oligonucleotide
  Target: FXN; (-) strand; PAM type: NRG; PAM sequence: AAG
actcaaaaaaaaaaaaaaag

SEQ ID NO: 12132 - DNA, 20 bp, Artificial Sequence
  Description of Artificial Sequence: Synthetic oligonucleotide
  Target: FXN; (-) strand; PAM type: NRG; PAM sequence: AAG
tcaactcaaaaaaaaaaaaa

SEQ ID NO: 12133 - DNA, 20 bp, Artificial Sequence
  Description of Artificial Sequence: Synthetic oligonucleotide
  Target: FXN; (-) strand; PAM type: NRG; PAM sequence: AGG
ccagcctgggtgacagagct

SEQ ID NO: 12134 - DNA, 20 bp, Artificial Sequence
  Description of Artificial Sequence: Synthetic oligonucleotide
  Target: FXN; (-) strand; PAM type: NRG; PAM sequence: TAG
tccagcctgggtgacagagc

SEQ ID NO: 12135 - DNA, 20 bp, Artificial Sequence
  Description of Artificial Sequence: Synthetic oligonucleotide
  Target: FXN; (-) strand; PAM type: NRG; PAM sequence: GAG
gcactccagcctgggtgaca

SEQ ID NO: 12136 - DNA, 20 bp, Artificial Sequence
  Description of Artificial Sequence: Synthetic oligonucleotide
  Target: FXN; (-) strand; PAM type: NRG; PAM sequence: CAG
ctgcactccagcctgggtga

SEQ ID NO: 12137 - DNA, 20 bp, Artificial Sequence
  Description of Artificial Sequence: Synthetic oligonucleotide
  Target: FXN; (-) strand; PAM type: NRG; PAM sequence: GGG
acacaactgcactccagcct

SEQ ID NO: 12138 - DNA, 20 bp, Artificial Sequence
  Description of Artificial Sequence: Synthetic oligonucleotide
  Target: FXN; (-) strand; PAM type: NRG; PAM sequence: TGG
cacacaactgcactccagcc

SEQ ID NO: 12139 - DNA, 20 bp, Artificial Sequence
  Description of Artificial Sequence: Synthetic oligonucleotide
  Target: FXN; (-) strand; PAM type: NRG; PAM sequence: CAG
gagatcacacaactgcactc

SEQ ID NO: 12140 - DNA, 20 bp, Artificial Sequence
  Description of Artificial Sequence: Synthetic oligonucleotide
  Target: FXN; (-) strand; PAM type: NRG; PAM sequence: GAG
ggcagaggttgcagtgagct

SEQ ID NO: 12141 - DNA, 20 bp, Artificial Sequence
  Description of Artificial Sequence: Synthetic oligonucleotide
  Target: FXN; (-) strand; PAM type: NRG; PAM sequence: GAG
tgggaggcagaggttgcagt

SEQ ID NO: 12142 - DNA, 20 bp, Artificial Sequence
  Description of Artificial Sequence: Synthetic oligonucleotide
  Target: FXN; (-) strand; PAM type: NRG; PAM sequence: CAG
aacctgggaggcagaggttg

SEQ ID NO: 12143 - DNA, 20 bp, Artificial Sequence
  Description of Artificial Sequence: Synthetic oligonucleotide
  Target: FXN; (-) strand; PAM type: NRG; PAM sequence: AGG
cgcttgaacctgggaggcag

SEQ ID NO: 12144 - DNA, 20 bp, Artificial Sequence
  Description of Artificial Sequence: Synthetic oligonucleotide
  Target: FXN; (-) strand; PAM type: NRG; PAM sequence: GAG
tcgcttgaacctgggaggca

SEQ ID NO: 12145 - DNA, 20 bp, Artificial Sequence
  Description of Artificial Sequence: Synthetic oligonucleotide
  Target: FXN; (-) strand; PAM type: NRG; PAM sequence: CAG
aatcgcttgaacctgggagg

SEQ ID NO: 12146 - DNA, 20 bp, Artificial Sequence
  Description of Artificial Sequence: Synthetic oligonucleotide
  Target: FXN; (-) strand; PAM type: NRG; PAM sequence: AGG
gagaatcgcttgaacctggg

SEQ ID NO: 12147 - DNA, 20 bp, Artificial Sequence
  Description of Artificial Sequence: Synthetic oligonucleotide
  Target: FXN; (-) strand; PAM type: NRG; PAM sequence: GAG
ggagaatcgcttgaacctgg

SEQ ID NO: 12148 - DNA, 20 bp, Artificial Sequence
  Description of Artificial Sequence: Synthetic oligonucleotide
  Target: FXN; (-) strand; PAM type: NRG; PAM sequence: GGG
cgggagaatcgcttgaacct

SEQ ID NO: 12149 - DNA, 20 bp, Artificial Sequence
  Description of Artificial Sequence: Synthetic oligonucleotide
  Target: FXN; (-) strand; PAM type: NRG; PAM sequence: TGG
gcgggagaatcgcttgaacc

SEQ ID NO: 12150 - DNA, 20 bp, Artificial Sequence
  Description of Artificial Sequence: Synthetic oligonucleotide
  Target: FXN; (-) strand; PAM type: NRG; PAM sequence: GAG
tactcaggaggttgaggcgg

SEQ ID NO: 12151 - DNA, 20 bp, Artificial Sequence
  Description of Artificial Sequence: Synthetic oligonucleotide
  Target: FXN; (-) strand; PAM type: NRG; PAM sequence: GGG
gctactcaggaggttgaggc

SEQ ID NO: 12152 - DNA, 20 bp, Artificial Sequence
  Description of Artificial Sequence: Synthetic oligonucleotide
  Target: FXN; (-) strand; PAM type: NRG; PAM sequence: CGG
agctactcaggaggttgagg

SEQ ID NO: 12153 - DNA, 20 bp, Artificial Sequence
  Description of Artificial Sequence: Synthetic oligonucleotide
  Target: FXN; (-) strand; PAM type: NRG; PAM sequence: AGG
cccagctactcaggaggttg

SEQ ID NO: 12154 - DNA, 20 bp, Artificial Sequence
  Description of Artificial Sequence: Synthetic oligonucleotide
  Target: FXN; (-) strand; PAM type: NRG; PAM sequence: GAG
tcccagctactcaggaggtt

SEQ ID NO: 12155 - DNA, 20 bp, Artificial Sequence
  Description of Artificial Sequence: Synthetic oligonucleotide
  Target: FXN; (-) strand; PAM type: NRG; PAM sequence: AGG
tgtaatcccagctactcagg

SEQ ID NO: 12156 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagctactcag

SEQ ID NO: 12157 - DNA, 20 bp, Artificial Sequence
  Description of Artificial Sequence: Synthetic oligonucleotide
  Target: FXN; (-) strand; PAM type: NRG; PAM sequence: AGG
gtctgtaatcccagctactc

SEQ ID NO: 12158 - DNA, 20 bp, Artificial Sequence
  Description of Artificial Sequence: Synthetic oligonucleotide
  Target: FXN; (-) strand; PAM type: NRG; PAM sequence: CAG
tgtctgtaatcccagctact

SEQ ID NO: 12159 - DNA, 20 bp, Artificial Sequence
  Description of Artificial Sequence: Synthetic oligonucleotide
  Target: FXN; (-) strand; PAM type: NRG; PAM sequence: CAG
gtggtacatgtctgtaatcc

SEQ ID NO: 12160 - DNA, 20 bp, Artificial Sequence
  Description of Artificial Sequence: Synthetic oligonucleotide
  Target: FXN; (-) strand; PAM type: NRG; PAM sequence: TGG
caaaacttagccctgtattg

SEQ ID NO: 12161 - DNA, 20 bp, Artificial Sequence
  Description of Artificial Sequence: Synthetic oligonucleotide
  Target: FXN; (-) strand; PAM type: NRG; PAM sequence: TAG
tctactaaaaatacaaaact

SEQ ID NO: 12162 - DNA, 20 bp, Artificial Sequence
  Description of Artificial Sequence: Synthetic oligonucleotide
  Target: FXN; (-) strand; PAM type: NRG; PAM sequence: TGG
tgagaccagcctggccaaca

SEQ ID NO: 12163 - DNA, 20 bp, Artificial Sequence
  Description of Artificial Sequence: Synthetic oligonucleotide
  Target: FXN; (-) strand; PAM type: NRG; PAM sequence: TGG
tcaggagtttgagaccagcc

SEQ ID NO: 12164 - DNA, 20 bp, Artificial Sequence
  Description of Artificial Sequence: Synthetic oligonucleotide
  Target: FXN; (-) strand; PAM type: NRG; PAM sequence: CAG
tgagatcaggagtttgagac

SEQ ID NO: 12165 - DNA, 20 bp, Artificial Sequence
  Description of Artificial Sequence: Synthetic oligonucleotide
  Target: FXN; (-) strand; PAM type: NRG; PAM sequence: GAG
tcacttgagatcaggagttt

SEQ ID NO: 12166 - DNA, 20 bp, Artificial Sequence
  Description of Artificial Sequence: Synthetic oligonucleotide
  Target: FXN; (-) strand; PAM type: NRG; PAM sequence: GAG
ggtggatcacttgagatcag

SEQ ID NO: 12167 - DNA, 20 bp, Artificial Sequence
  Description of Artificial Sequence: Synthetic oligonucleotide
  Target: FXN; (-) strand; PAM type: NRG; PAM sequence: AGG
cgggtggatcacttgagatc

SEQ ID NO: 12168 - DNA, 20 bp, Artificial Sequence
  Description of Artificial Sequence: Synthetic oligonucleotide
  Target: FXN; (-) strand; PAM type: NRG; PAM sequence: CAG
gcgggtggatcacttgagat

SEQ ID NO: 12169 - DNA, 20 bp, Artificial Sequence
  Description of Artificial Sequence: Synthetic oligonucleotide
  Target: FXN; (-) strand; PAM type: NRG; PAM sequence: GAG
ctgaggcgggtggatcactt

SEQ ID NO: 12170 - DNA, 20 bp, Artificial Sequence
  Description of Artificial Sequence: Synthetic oligonucleotide
  Target: FXN; (-) strand; PAM type: NRG; PAM sequence: TGG
ctttaggaggctgaggcggg

SEQ ID NO: 12171 - DNA, 20 bp, Artificial Sequence
  Description of Artificial Sequence: Synthetic oligonucleotide
  Target: FXN; (-) strand; PAM type: NRG; PAM sequence: GGG
gcactttaggaggctgaggc

SEQ ID NO: 12172 - DNA, 20 bp, Artificial Sequence
  Description of Artificial Sequence: Synthetic oligonucleotide
  Target: FXN; (-) strand; PAM type: NRG; PAM sequence: CGG
agcactttaggaggctgagg

SEQ ID NO: 12173 - DNA, 20 bp, Artificial Sequence
  Description of Artificial Sequence: Synthetic oligonucleotide
  Target: FXN; (-) strand; PAM type: NRG; PAM sequence: AGG
cccagcactttaggaggctg

SEQ ID NO: 12174 - DNA, 20 bp, Artificial Sequence
  Description of Artificial Sequence: Synthetic oligonucleotide
  Target: FXN; (-) strand; PAM type: NRG; PAM sequence: GAG
acccagcactttaggaggct

SEQ ID NO: 12175 - DNA, 20 bp, Artificial Sequence
  Description of Artificial Sequence: Synthetic oligonucleotide
  Target: FXN; (-) strand; PAM type: NRG; PAM sequence: AGG
tgttaacccagcactttagg

SEQ ID NO: 12176 - DNA, 20 bp, Artificial Sequence
  Description of Artificial Sequence: Synthetic oligonucleotide
  Target: FXN; (-) strand; PAM type: NRG; PAM sequence: GAG
ctgttaacccagcactttag

SEQ ID NO: 12177 - DNA, 20 bp, Artificial Sequence
  Description of Artificial Sequence: Synthetic oligonucleotide
  Target: FXN; (-) strand; PAM type: NRG; PAM sequence: AGG
gcctgttaacccagcacttt

SEQ ID NO: 12178 - DNA, 20 bp, Artificial Sequence
  Description of Artificial Sequence: Synthetic oligonucleotide
  Target: FXN; (-) strand; PAM type: NRG; PAM sequence: TAG
tgcctgttaacccagcactt

SEQ ID NO: 12179 - DNA, 20 bp, Artificial Sequence
  Description of Artificial Sequence: Synthetic oligonucleotide
  Target: FXN; (-) strand; PAM type: NRG; PAM sequence: CAG
gtggctcatgcctgttaacc

SEQ ID NO: 12180 - DNA, 20 bp, Artificial Sequence
  Description of Artificial Sequence: Synthetic oligonucleotide
  Target: FXN; (-) strand; PAM type: NRG; PAM sequence: TGG
atgacttttgccaggtgccg

SEQ ID NO: 12181 - DNA, 20 bp, Artificial Sequence
  Description of Artificial Sequence: Synthetic oligonucleotide
  Target: FXN; (-) strand; PAM type: NRG; PAM sequence: AGG
accaaaagatgacttttgcc

SEQ ID NO: 12182 - DNA, 20 bp, Artificial Sequence
  Description of Artificial Sequence: Synthetic oligonucleotide
  Target: FXN; (-) strand; PAM type: NRG; PAM sequence: CAG
aaccaaaagatgacttttgc

SEQ ID NO: 12183 - DNA, 20 bp, Artificial Sequence
  Description of Artificial Sequence: Synthetic oligonucleotide
  Target: FXN; (-) strand; PAM type: NRG; PAM sequence: AAG
gttcaatagaagtaaaccaa

SEQ ID NO: 12184 - DNA, 20 bp, Artificial Sequence
  Description of Artificial Sequence: Synthetic oligonucleotide
  Target: FXN; (-) strand; PAM type: NRG; PAM sequence: AAG
tgactttttcagttcaatag

SEQ ID NO: 12185 - DNA, 20 bp, Artificial Sequence
  Description of Artificial Sequence: Synthetic oligonucleotide
  Target: FXN; (-) strand; PAM type: NRG; PAM sequence: TAG
ttgtgactttttcagttcaa

SEQ ID NO: 12186 - DNA, 20 bp, Artificial Sequence
  Description of Artificial Sequence: Synthetic oligonucleotide
  Target: FXN; (-) strand; PAM type: NRG; PAM sequence: CAG
aaatatatttgtgacttttt

SEQ ID NO: 12187 - DNA, 20 bp, Artificial Sequence
  Description of Artificial Sequence: Synthetic oligonucleotide
  Target: FXN; (-) strand; PAM type: NRG; PAM sequence: AGG
ccagcctgggtgacagagcg

SEQ ID NO: 12188 - DNA, 20 bp, Artificial Sequence
  Description of Artificial Sequence: Synthetic oligonucleotide
  Target: FXN; (-) strand; PAM type: NRG; PAM sequence: GAG
tccagcctgggtgacagagc

SEQ ID NO: 12189 - DNA, 20 bp, Artificial Sequence
  Description of Artificial Sequence: Synthetic oligonucleotide
  Target: FXN; (-) strand; PAM type: NRG; PAM sequence: GAG
gcactccagcctgggtgaca

SEQ ID NO: 12190 - DNA, 20 bp, Artificial Sequence
  Description of Artificial Sequence: Synthetic oligonucleotide
  Target: FXN; (-) strand; PAM type: NRG; PAM sequence: CAG
ctgcactccagcctgggtga

SEQ ID NO: 12191 - DNA, 20 bp, Artificial Sequence
  Description of Artificial Sequence: Synthetic oligonucleotide
  Target: FXN; (-) strand; PAM type: NRG; PAM sequence: GGG
gtgccactgcactccagcct

SEQ ID NO: 12192 - DNA, 20 bp, Artificial Sequence
  Description of Artificial Sequence: Synthetic oligonucleotide
  Target: FXN; (-) strand; PAM type: NRG; PAM sequence: TGG
tgtgccactgcactccagcc

SEQ ID NO: 12193 - DNA, 20 bp, Artificial Sequence
  Description of Artificial Sequence: Synthetic oligonucleotide
  Target: FXN; (-) strand; PAM type: NRG; PAM sequence: CAG
atgattgtgccactgcactc

SEQ ID NO: 12194 - DNA, 20 bp, Artificial Sequence
  Description of Artificial Sequence: Synthetic oligonucleotide
  Target: FXN; (-) strand; PAM type: NRG; PAM sequence: GAG
cagaagcttgaggctgcagt

SEQ ID NO: 12195 - DNA, 20 bp, Artificial Sequence
  Description of Artificial Sequence: Synthetic oligonucleotide
  Target: FXN; (-) strand; PAM type: NRG; PAM sequence: CAG
agcccagaagcttgaggctg

SEQ ID NO: 12196 - DNA, 20 bp, Artificial Sequence
  Description of Artificial Sequence: Synthetic oligonucleotide
  Target: FXN; (-) strand; PAM type: NRG; PAM sequence: AGG
cacttgagcccagaagcttg

SEQ ID NO: 12197 - DNA, 20 bp, Artificial Sequence
  Description of Artificial Sequence: Synthetic oligonucleotide
  Target: FXN; (-) strand; PAM type: NRG; PAM sequence: GAG
tcacttgagcccagaagctt

SEQ ID NO: 12198 - DNA, 20 bp, Artificial Sequence
  Description of Artificial Sequence: Synthetic oligonucleotide
  Target: FXN; (-) strand; PAM type: NRG; PAM sequence: AAG
gaacgatcacttgagcccag

SEQ ID NO: 12199 - DNA, 20 bp, Artificial Sequence
  Description of Artificial Sequence: Synthetic oligonucleotide
  Target: FXN; (-) strand; PAM type: NRG; PAM sequence: CAG
gtggaacgatcacttgagcc

SEQ ID NO: 12200 - DNA, 20 bp, Artificial Sequence
  Description of Artificial Sequence: Synthetic oligonucleotide
  Target: FXN; (-) strand; PAM type: NRG; PAM sequence: GAG
ctgaggtggaacgatcactt

SEQ ID NO: 12201 - DNA, 20 bp, Artificial Sequence
  Description of Artificial Sequence: Synthetic oligonucleotide
  Target: FXN; (-) strand; PAM type: NRG; PAM sequence: TGG
agctactagggaggctgagg

SEQ ID NO: 12202 - DNA, 20 bp, Artificial Sequence
  Description of Artificial Sequence: Synthetic oligonucleotide
  Target: FXN; (-) strand; PAM type: NRG; PAM sequence: AGG
cccagctactagggaggctg

SEQ ID NO: 12203 - DNA, 20 bp, Artificial Sequence
  Description of Artificial Sequence: Synthetic oligonucleotide
  Target: FXN; (-) strand; PAM type: NRG; PAM sequence: GAG
tcccagctactagggaggct

SEQ ID NO: 12204 - DNA, 20 bp, Artificial Sequence
  Description of Artificial Sequence: Synthetic oligonucleotide
  Target: FXN; (-) strand; PAM type: NRG; PAM sequence: AGG
tgtagtcccagctactaggg

SEQ ID NO: 12205 - DNA, 20 bp, Artificial Sequence
  Description of Artificial Sequence: Synthetic oligonucleotide
  Target: FXN; (-) strand; PAM type: NRG; PAM sequence: GAG
ctgtagtcccagctactagg

SEQ ID NO: 12206 - DNA, 20 bp, Artificial Sequence
  Description of Artificial Sequence: Synthetic oligonucleotide
  Target: FXN; (-) strand; PAM type: NRG; PAM sequence: GGG
gcctgtagtcccagctacta

SEQ ID NO: 12207 - DNA, 20 bp, Artificial Sequence
  Description of Artificial Sequence: Synthetic oligonucleotide
  Target: FXN; (-) strand; PAM type: NRG; PAM sequence: AGG
tgcctgtagtcccagctact

SEQ ID NO: 12208 - DNA, 20 bp, Artificial Sequence
  Description of Artificial Sequence: Synthetic oligonucleotide
  Target: FXN; (-) strand; PAM type: NRG; PAM sequence: TAG
gtgcctgtagtcccagctac

SEQ ID NO: 12209 - DNA, 20 bp, Artificial Sequence
  Description of Artificial Sequence: Synthetic oligonucleotide
  Target: FXN; (-) strand; PAM type: NRG; PAM sequence: CAG
gtggcatgtgcctgtagtcc

SEQ ID NO: 12210 - DNA, 20 bp, Artificial Sequence
  Description of Artificial Sequence: Synthetic oligonucleotide
  Target: FXN; (-) strand; PAM type: NRG; PAM sequence: TAG
agtatggtggcatgtgcctg

SEQ ID NO: 12211 - DNA, 20 bp, Artificial Sequence
  Description of Artificial Sequence: Synthetic oligonucleotide
  Target: FXN; (-) strand; PAM type: NRG; PAM sequence: TGG
aaataattagccgagtatgg

SEQ ID NO: 12212 - DNA, 20 bp, Artificial Sequence
  Description of Artificial Sequence: Synthetic oligonucleotide
  Target: FXN; (-) strand; PAM type: NRG; PAM sequence: TGG
ataaaataattagccgagta

SEQ ID NO: 12213 - DNA, 20 bp, Artificial Sequence
  Description of Artificial Sequence: Synthetic oligonucleotide
  Target: FXN; (-) strand; PAM type: NRG; PAM sequence: GAG
ataaaataaaataattagcc

SEQ ID NO: 12214 - DNA, 20 bp, Artificial Sequence
  Description of Artificial Sequence: Synthetic oligonucleotide
  Target: FXN; (-) strand; PAM type: NRG; PAM sequence: TAG
cataaataaaataaaataat

SEQ ID NO: 12215 - DNA, 20 bp, Artificial Sequence
  Description of Artificial Sequence: Synthetic oligonucleotide
  Target: FXN; (-) strand; PAM type: NRG; PAM sequence: GAG
accagcctgggaaacatagc

SEQ ID NO: 12216 - DNA, 20 bp, Artificial Sequence
  Description of Artificial Sequence: Synthetic oligonucleotide
  Target: FXN; (-) strand; PAM type: NRG; PAM sequence: TAG
tgagaccagcctgggaaaca

SEQ ID NO: 12217 - DNA, 20 bp, Artificial Sequence
  Description of Artificial Sequence: Synthetic oligonucleotide
  Target: FXN; (-) strand; PAM type: NRG; PAM sequence: GGG
caggagtttgagaccagcct

SEQ ID NO: 12218 - DNA, 20 bp, Artificial Sequence
  Description of Artificial Sequence: Synthetic oligonucleotide
  Target: FXN; (-) strand; PAM type: NRG; PAM sequence: TGG
ccaggagtttgagaccagcc

SEQ ID NO: 12219 - DNA, 20 bp, Artificial Sequence
  Description of Artificial Sequence: Synthetic oligonucleotide
  Target: FXN; (-) strand; PAM type: NRG; PAM sequence: CAG
tgaggccaggagtttgagac

SEQ ID NO: 12220 - DNA, 20 bp, Artificial Sequence
  Description of Artificial Sequence: Synthetic oligonucleotide
  Target: FXN; (-) strand; PAM type: NRG; PAM sequence: GAG
tcgcttgaggccaggagttt

SEQ ID NO: 12221 - DNA, 20 bp, Artificial Sequence
  Description of Artificial Sequence: Synthetic oligonucleotide
  Target: FXN; (-) strand; PAM type: NRG; PAM sequence: GAG
agagaatcgcttgaggccag

SEQ ID NO: 12222 - DNA, 20 bp, Artificial Sequence
  Description of Artificial Sequence: Synthetic oligonucleotide
  Target: FXN; (-) strand; PAM type: NRG; PAM sequence: AGG
tgagagaatcgcttgaggcc

SEQ ID NO: 12223 - DNA, 20 bp, Artificial Sequence
  Description of Artificial Sequence: Synthetic oligonucleotide
  Target: FXN; (-) strand; PAM type: NRG; PAM sequence: CAG
gtgagagaatcgcttgaggc

SEQ ID NO: 12224 - DNA, 20 bp, Artificial Sequence
  Description of Artificial Sequence: Synthetic oligonucleotide
  Target: FXN; (-) strand; PAM type: NRG; PAM sequence: AGG
cgaggtgagagaatcgcttg

SEQ ID NO: 12225 - DNA, 20 bp, Artificial Sequence
  Description of Artificial Sequence: Synthetic oligonucleotide
  Target: FXN; (-) strand; PAM type: NRG; PAM sequence: GAG
ccgaggtgagagaatcgctt

SEQ ID NO: 12226 - DNA, 20 bp, Artificial Sequence
  Description of Artificial Sequence: Synthetic oligonucleotide
  Target: FXN; (-) strand; PAM type: NRG; PAM sequence: GAG
gctttgggaggccgaggtga

SEQ ID NO: 12227 - DNA, 20 bp, Artificial Sequence
  Description of Artificial Sequence: Synthetic oligonucleotide
  Target: FXN; (-) strand; PAM type: NRG; PAM sequence: GAG
gtgctttgggaggccgaggt

SEQ ID NO: 12228 - DNA, 20 bp, Artificial Sequence
  Description of Artificial Sequence: Synthetic oligonucleotide
  Target: FXN; (-) strand; PAM type: NRG; PAM sequence: AGG
cccggtgctttgggaggccg

SEQ ID NO: 12229 - DNA, 20 bp, Artificial Sequence
  Description of Artificial Sequence: Synthetic oligonucleotide
  Target: FXN; (-) strand; PAM type: NRG; PAM sequence: GAG
tcccggtgctttgggaggcc

SEQ ID NO: 12230 - DNA, 20 bp, Artificial Sequence
  Description of Artificial Sequence: Synthetic oligonucleotide
  Target: FXN; (-) strand; PAM type: NRG; PAM sequence: AGG
tgtaatcccggtgctttggg

SEQ ID NO: 12231 - DNA, 20 bp, Artificial Sequence
  Description of Artificial Sequence: Synthetic oligonucleotide
  Target: FXN; (-) strand; PAM type: NRG; PAM sequence: GAG
ctgtaatcccggtgctttgg

SEQ ID NO: 12232 - DNA, 20 bp, Artificial Sequence
  Description of Artificial Sequence: Synthetic oligonucleotide
  Target: FXN; (-) strand; PAM type: NRG; PAM sequence: GGG
acctgtaatcccggtgcttt

SEQ ID NO: 12233 - DNA, 20 bp, Artificial Sequence
  Description of Artificial Sequence: Synthetic oligonucleotide
  Target: FXN; (-) strand; PAM type: NRG; PAM sequence: TGG
cacctgtaatcccggtgctt

SEQ ID NO: 12234 - DNA, 20 bp, Artificial Sequence
  Description of Artificial Sequence: Synthetic oligonucleotide
  Target: FXN; (-) strand; PAM type: NRG; PAM sequence: CGG
ctggcacacacctgtaatcc

SEQ ID NO: 12235 - DNA, 20 bp, Artificial Sequence
  Description of Artificial Sequence: Synthetic oligonucleotide
  Target: FXN; (-) strand; PAM type: NRG; PAM sequence: TGG
agatttgtggctgggtgtgc

SEQ ID NO: 12236 - DNA, 20 bp, Artificial Sequence
  Description of Artificial Sequence: Synthetic oligonucleotide
  Target: FXN; (-) strand; PAM type: NRG; PAM sequence: GGG
aaatttatagatttgtggct

SEQ ID NO: 12237 - DNA, 20 bp, Artificial Sequence
  Description of Artificial Sequence: Synthetic oligonucleotide
  Target: FXN; (-) strand; PAM type: NRG; PAM sequence: TGG
taaatttatagatttgtggc

SEQ ID NO: 12238 - DNA, 20 bp, Artificial Sequence
  Description of Artificial Sequence: Synthetic oligonucleotide
  Target: FXN; (-) strand; PAM type: NRG; PAM sequence: TGG
tttctaaatttatagatttg

SEQ ID NO: 12239 - DNA, 20 bp, Artificial Sequence
  Description of Artificial Sequence: Synthetic oligonucleotide
  Target: FXN; (-) strand; PAM type: NRG; PAM sequence: TAG
agtcctcctttctaaattta

SEQ ID NO: 12240 - DNA, 20 bp, Artificial Sequence
  Description of Artificial Sequence: Synthetic oligonucleotide
  Target: FXN; (-) strand; PAM type: NRG; PAM sequence: TAG
agtgggaccctctttagaaa

SEQ ID NO: 12241 - DNA, 20 bp, Artificial Sequence
  Description of Artificial Sequence: Synthetic oligonucleotide
  Target: FXN; (-) strand; PAM type: NRG; PAM sequence: TAG
acaggtagtgggaccctctt

SEQ ID NO: 12242 - DNA, 20 bp, Artificial Sequence
  Description of Artificial Sequence: Synthetic oligonucleotide
  Target: FXN; (-) strand; PAM type: NRG; PAM sequence: GGG
gcttcctgcctacaggtagt

SEQ ID NO: 12243 - DNA, 20 bp, Artificial Sequence
  Description of Artificial Sequence: Synthetic oligonucleotide
  Target: FXN; (-) strand; PAM type: NRG; PAM sequence: TGG
tgcttcctgcctacaggtag

SEQ ID NO: 12244 - DNA, 20 bp, Artificial Sequence
  Description of Artificial Sequence: Synthetic oligonucleotide
  Target: FXN; (-) strand; PAM type: NRG; PAM sequence: TAG
ctctgcttcctgcctacagg

SEQ ID NO: 12245 - DNA, 20 bp, Artificial Sequence
  Description of Artificial Sequence: Synthetic oligonucleotide
  Target: FXN; (-) strand; PAM type: NRG; PAM sequence: AGG
aggctctgcttcctgcctac

SEQ ID NO: 12246 - DNA, 20 bp, Artificial Sequence
  Description of Artificial Sequence: Synthetic oligonucleotide
  Target: FXN; (-) strand; PAM type: NRG; PAM sequence: CAG
gaggctctgcttcctgccta

SEQ ID NO: 12247 - DNA, 20 bp, Artificial Sequence
  Description of Artificial Sequence: Synthetic oligonucleotide
  Target: FXN; (-) strand; PAM type: NRG; PAM sequence: AGG
tgtttttcagttatggccag

SEQ ID NO: 12248 - DNA, 20 bp, Artificial Sequence
  Description of Artificial Sequence: Synthetic oligonucleotide
  Target: FXN; (-) strand; PAM type: NRG; PAM sequence: GAG
ttgtttttcagttatggcca

SEQ ID NO: 12249 - DNA, 20 bp, Artificial Sequence
  Description of Artificial Sequence: Synthetic oligonucleotide
  Target: FXN; (-) strand; PAM type: NRG; PAM sequence: CAG
gcttgtttttcagttatggc

SEQ ID NO: 12250 - DNA, 20 bp, Artificial Sequence
  Description of Artificial Sequence: Synthetic oligonucleotide
  Target: FXN; (-) strand; PAM type: NRG; PAM sequence: TGG
aagtgcttgtttttcagtta

SEQ ID NO: 12251 - DNA, 20 bp, Artificial Sequence
  Description of Artificial Sequence: Synthetic oligonucleotide
  Target: FXN; (-) strand; PAM type: NRG; PAM sequence: CAG
tcttggaagtgcttgttttt

SEQ ID NO: 12252 - DNA, 20 bp, Artificial Sequence
  Description of Artificial Sequence: Synthetic oligonucleotide
  Target: FXN; (-) strand; PAM type: NRG; PAM sequence: AAG
ttccctttgccccttcttgg

SEQ ID NO: 12253 - DNA, 20 bp, Artificial Sequence
  Description of Artificial Sequence: Synthetic oligonucleotide
  Target: FXN; (-) strand; PAM type: NRG; PAM sequence: TGG
atgttccctttgccccttct

SEQ ID NO: 12254 - DNA, 20 bp, Artificial Sequence
  Description of Artificial Sequence: Synthetic oligonucleotide
  Target: FXN; (-) strand; PAM type: NRG; PAM sequence: CAG
gtatgcttagctacgcctct

SEQ ID NO: 12255 - DNA, 20 bp, Artificial Sequence
  Description of Artificial Sequence: Synthetic oligonucleotide
  Target: FXN; (-) strand; PAM type: NRG; PAM sequence: TAG
atctgttgaatatgtatgct

SEQ ID NO: 12256 - DNA, 20 bp, Artificial Sequence
  Description of Artificial Sequence: Synthetic oligonucleotide
  Target: FXN; (-) strand; PAM type: NRG; PAM sequence: TAG
cctccctttgtgaatattca

SEQ ID NO: 12257 - DNA, 20 bp, Artificial Sequence
  Description of Artificial Sequence: Synthetic oligonucleotide
  Target: FXN; (-) strand; PAM type: NRG; PAM sequence: TAG
tccacatgtgtgcatattca

SEQ ID NO: 12258 - DNA, 20 bp, Artificial Sequence
  Description of Artificial Sequence: Synthetic oligonucleotide
  Target: FXN; (-) strand; PAM type: NRG; PAM sequence: TAG
gggagacatgctgcacacgt

SEQ ID NO: 12259 - DNA, 20 bp, Artificial Sequence
  Description of Artificial Sequence: Synthetic oligonucleotide
  Target: FXN; (-) strand; PAM type: NRG; PAM sequence: GAG
tctgcctaaggtgaacatgg

SEQ ID NO: 12260 - DNA, 20 bp, Artificial Sequence
  Description of Artificial Sequence: Synthetic oligonucleotide
  Target: FXN; (-) strand; PAM type: NRG; PAM sequence: GGG
tttctgcctaaggtgaacat

SEQ ID NO: 12261 - DNA, 20 bp, Artificial Sequence
  Description of Artificial Sequence: Synthetic oligonucleotide
  Target: FXN; (-) strand; PAM type: NRG; PAM sequence: TGG
gtttctgcctaaggtgaaca

SEQ ID NO: 12262 - DNA, 20 bp, Artificial Sequence
  Description of Artificial Sequence: Synthetic oligonucleotide
  Target: FXN; (-) strand; PAM type: NRG; PAM sequence: AGG
tagtgttaagtttctgccta

SEQ ID NO: 12263 - DNA, 20 bp, Artificial Sequence
  Description of Artificial Sequence: Synthetic oligonucleotide
  Target: FXN; (-) strand; PAM type: NRG; PAM sequence: AAG
ttagtgttaagtttctgcct

SEQ ID NO: 12264 - DNA, 20 bp, Artificial Sequence
  Description of Artificial Sequence: Synthetic oligonucleotide
  Target: FXN; (-) strand; PAM type: NRG; PAM sequence: AAG
ctgtaatacatgttagtgtt

SEQ ID NO: 12265 - DNA, 20 bp, Artificial Sequence
  Description of Artificial Sequence: Synthetic oligonucleotide
  Target: FXN; (-) strand; PAM type: NRG; PAM sequence: TAG
tgttgccctgtaatacatgt

SEQ ID NO: 12266 - DNA, 20 bp, Artificial Sequence
  Description of Artificial Sequence: Synthetic oligonucleotide
  Target: FXN; (-) strand; PAM type: NRG; PAM sequence: CAG
agctaggttatgtagatatg

SEQ ID NO: 12267 - DNA, 20 bp, Artificial Sequence
  Description of Artificial Sequence: Synthetic oligonucleotide
  Target: FXN; (-) strand; PAM type: NRG; PAM sequence: TAG
taccaaatagctaggttatg

SEQ ID NO: 12268 - DNA, 20 bp, Artificial Sequence
  Description of Artificial Sequence: Synthetic oligonucleotide
  Target: FXN; (-) strand; PAM type: NRG; PAM sequence: AGG
cttcagcctaccaaatagct

SEQ ID NO: 12269 - DNA, 20 bp, Artificial Sequence
  Description of Artificial Sequence: Synthetic oligonucleotide
  Target: FXN; (-) strand; PAM type: NRG; PAM sequence: TAG
gcttcagcctaccaaatagc

SEQ ID NO: 12270 - DNA, 20 bp, Artificial Sequence
  Description of Artificial Sequence: Synthetic oligonucleotide
  Target: FXN; (-) strand; PAM type: NRG; PAM sequence: TAG
tcctgcttcagcctaccaaa

SEQ ID NO: 12271 - DNA, 20 bp, Artificial Sequence
  Description of Artificial Sequence: Synthetic oligonucleotide
  Target: FXN; (-) strand; PAM type: NRG; PAM sequence: CAG
cttaagtgatgctcctgctt

SEQ ID NO: 12272 - DNA, 20 bp, Artificial Sequence
  Description of Artificial Sequence: Synthetic oligonucleotide
  Target: FXN; (-) strand; PAM type: NRG; PAM sequence: AAG
tgcctcgaactcccagtctt

SEQ ID NO: 12273 - DNA, 20 bp, Artificial Sequence
  Description of Artificial Sequence: Synthetic oligonucleotide
  Target: FXN; (-) strand; PAM type: NRG; PAM sequence: CAG
tcacagctgcctcgaactcc

SEQ ID NO: 12274 - DNA, 20 bp, Artificial Sequence
  Description of Artificial Sequence: Synthetic oligonucleotide
  Target: FXN; (-) strand; PAM type: NRG; PAM sequence: CAG
agtggtgcgatcatggctca

SEQ ID NO: 12275 - DNA, 20 bp, Artificial Sequence
  Description of Artificial Sequence: Synthetic oligonucleotide
  Target: FXN; (-) strand; PAM type: NRG; PAM sequence: TGG
ggagaacagtggtgcgatca

SEQ ID NO: 12276 - DNA, 20 bp, Artificial Sequence
  Description of Artificial Sequence: Synthetic oligonucleotide
  Target: FXN; (-) strand; PAM type: NRG; PAM sequence: TGG
tcatcctggctggagaacag

SEQ ID NO: 12277 - DNA, 20 bp, Artificial Sequence
  Description of Artificial Sequence: Synthetic oligonucleotide
  Target: FXN; (-) strand; PAM type: NRG; PAM sequence: CAG
ctgtcatcctggctggagaa

SEQ ID NO: 12278 - DNA, 20 bp, Artificial Sequence
  Description of Artificial Sequence: Synthetic oligonucleotide
  Target: FXN; (-) strand; PAM type: NRG; PAM sequence: GAG
ttgccctgtcatcctggctg

SEQ ID NO: 12279 - DNA, 20 bp, Artificial Sequence
  Description of Artificial Sequence: Synthetic oligonucleotide
  Target: FXN; (-) strand; PAM type: NRG; PAM sequence: TGG
tcttgccctgtcatcctggc

SEQ ID NO: 12280 - DNA, 20 bp, Artificial Sequence
  Description of Artificial Sequence: Synthetic oligonucleotide
  Target: FXN; (-) strand; PAM type: NRG; PAM sequence: TGG
agggtcttgccctgtcatcc

SEQ ID NO: 12281 - DNA, 20 bp, Artificial Sequence
  Description of Artificial Sequence: Synthetic oligonucleotide
  Target: FXN; (-) strand; PAM type: NRG; PAM sequence: GGG
ccacagagtggtctaagaca

SEQ ID NO: 12282 - DNA, 20 bp, Artificial Sequence
  Description of Artificial Sequence: Synthetic oligonucleotide
  Target: FXN; (-) strand; PAM type: NRG; PAM sequence: AGG
accacagagtggtctaagac

SEQ ID NO: 12283 - DNA, 20 bp, Artificial Sequence
  Description of Artificial Sequence: Synthetic oligonucleotide
  Target: FXN; (-) strand; PAM type: NRG; PAM sequence: CAG
gaccacagagtggtctaaga

SEQ ID NO: 12284 - DNA, 20 bp, Artificial Sequence
  Description of Artificial Sequence: Synthetic oligonucleotide
  Target: FXN; (-) strand; PAM type: NRG; PAM sequence: AAG
cactgaccacagagtggtct

SEQ ID NO: 12285 - DNA, 20 bp, Artificial Sequence
  Description of Artificial Sequence: Synthetic oligonucleotide
  Target: FXN; (-) strand; PAM type: NRG; PAM sequence: TGG
gataaccactgaccacagag

SEQ ID NO: 12286 - DNA, 20 bp, Artificial Sequence
  Description of Artificial Sequence: Synthetic oligonucleotide
  Target: FXN; (-) strand; PAM type: NRG; PAM sequence: GAG
cctgataaccactgaccaca

SEQ ID NO: 12287 - DNA, 20 bp, Artificial Sequence
  Description of Artificial Sequence: Synthetic oligonucleotide
  Target: FXN; (-) strand; PAM type: NRG; PAM sequence: CAG
ttcctgataaccactgacca

SEQ ID NO: 12288 - DNA, 20 bp, Artificial Sequence
  Description of Artificial Sequence: Synthetic oligonucleotide
  Target: FXN; (-) strand; PAM type: NRG; PAM sequence: TAG
gtggtttcagcacaactgac

SEQ ID NO: 12289 - DNA, 20 bp, Artificial Sequence
  Description of Artificial Sequence: Synthetic oligonucleotide
  Target: FXN; (-) strand; PAM type: NRG; PAM sequence: CAG
cccttcctttttagtggttt

SEQ ID NO: 12290 - DNA, 20 bp, Artificial Sequence
  Description of Artificial Sequence: Synthetic oligonucleotide
  Target: FXN; (-) strand; PAM type: NRG; PAM sequence: TGG
attctgcccttcctttttag

SEQ ID NO: 12291 - DNA, 20 bp, Artificial Sequence
  Description of Artificial Sequence: Synthetic oligonucleotide
  Target: FXN; (-) strand; PAM type: NRG; PAM sequence: TAG
ctaattctgcccttcctttt

SEQ ID NO: 12292 - DNA, 20 bp, Artificial Sequence
  Description of Artificial Sequence: Synthetic oligonucleotide
  Target: FXN; (-) strand; PAM type: NRG; PAM sequence: TGG
aaaaagactcacttcaccac

SEQ ID NO: 12293 - DNA, 20 bp, Artificial Sequence
  Description of Artificial Sequence: Synthetic oligonucleotide
  Target: FXN; (-) strand; PAM type: NRG; PAM sequence: AAG
tcaaaaagaaaaaaaaaaaa

SEQ ID NO: 12294 - DNA, 20 bp, Artificial Sequence
  Description of Artificial Sequence: Synthetic oligonucleotide
  Target: FXN; (-) strand; PAM type: NRG; PAM sequence: AAG
gagcaagactccatctcaaa

SEQ ID NO: 12295 - DNA, 20 bp, Artificial Sequence
  Description of Artificial Sequence: Synthetic oligonucleotide
  Target: FXN; (-) strand; PAM type: NRG; PAM sequence: AAG
tccagcctgggcaacagagc

SEQ ID NO: 12296 - DNA, 20 bp, Artificial Sequence
  Description of Artificial Sequence: Synthetic oligonucleotide
  Target: FXN; (-) strand; PAM type: NRG; PAM sequence: GAG
acactccagcctgggcaaca

SEQ ID NO: 12297 - DNA, 20 bp, Artificial Sequence
  Description of Artificial Sequence: Synthetic oligonucleotide
  Target: FXN; (-) strand; PAM type: NRG; PAM sequence: CAG
ctacactccagcctgggcaa

SEQ ID NO: 12298 - DNA, 20 bp, Artificial Sequence
  Description of Artificial Sequence: Synthetic oligonucleotide
  Target: FXN; (-) strand; PAM type: NRG; PAM sequence: GGG
acaccactacactccagcct

SEQ ID NO: 12299 - DNA, 20 bp, Artificial Sequence
  Description of Artificial Sequence: Synthetic oligonucleotide
  Target: FXN; (-) strand; PAM type: NRG; PAM sequence: TGG
cacaccactacactccagcc

SEQ ID NO: 12300 - DNA, 20 bp, Artificial Sequence
  Description of Artificial Sequence: Synthetic oligonucleotide
  Target: FXN; (-) strand; PAM type: NRG; PAM sequence: CAG
gagatcacaccactacactc

SEQ ID NO: 12301 - DNA, 20 bp, Artificial Sequence
  Description of Artificial Sequence: Synthetic oligonucleotide
  Target: FXN; (-) strand; PAM type: NRG; PAM sequence: GAG
ggtggaggttgcgatgagct

SEQ ID NO: 12302 - DNA, 20 bp, Artificial Sequence
  Description of Artificial Sequence: Synthetic oligonucleotide
  Target: FXN; (-) strand; PAM type: NRG; PAM sequence: GAG
caggaggtggaggttgcgat

SEQ ID NO: 12303 - DNA, 20 bp, Artificial Sequence
  Description of Artificial Sequence: Synthetic oligonucleotide
  Target: FXN; (-) strand; PAM type: NRG; PAM sequence: AGG
cacttgaacccaggaggtgg

SEQ ID NO: 12304 - DNA, 20 bp, Artificial Sequence
  Description of Artificial Sequence: Synthetic oligonucleotide
  Target: FXN; (-) strand; PAM type: NRG; PAM sequence: GAG
tcacttgaacccaggaggtg

SEQ ID NO: 12305 - DNA, 20 bp, Artificial Sequence
  Description of Artificial Sequence: Synthetic oligonucleotide
  Target: FXN; (-) strand; PAM type: NRG; PAM sequence: TGG
aatcacttgaacccaggagg

SEQ ID NO: 12306 - DNA, 20 bp, Artificial Sequence
  Description of Artificial Sequence: Synthetic oligonucleotide
  Target: FXN; (-) strand; PAM type: NRG; PAM sequence: AGG
gagaatcacttgaacccagg

SEQ ID NO: 12307 - DNA, 20 bp, Artificial Sequence
  Description of Artificial Sequence: Synthetic oligonucleotide
  Target: FXN; (-) strand; PAM type: NRG; PAM sequence: GAG
agagaatcacttgaacccag

SEQ ID NO: 12308 - DNA, 20 bp, Artificial Sequence
  Description of Artificial Sequence: Synthetic oligonucleotide
  Target: FXN; (-) strand; PAM type: NRG; PAM sequence: AGG
caagagaatcacttgaaccc

SEQ ID NO: 12309 - DNA, 20 bp, Artificial Sequence
  Description of Artificial Sequence: Synthetic oligonucleotide
  Target: FXN; (-) strand; PAM type: NRG; PAM sequence: CAG
gcaagagaatcacttgaacc

SEQ ID NO: 12310 - DNA, 20 bp, Artificial Sequence
  Description of Artificial Sequence: Synthetic oligonucleotide
  Target: FXN; (-) strand; PAM type: NRG; PAM sequence: GAG
tactcgggaggctgaggcaa

SEQ ID NO: 12311 - DNA, 20 bp, Artificial Sequence
  Description of Artificial Sequence: Synthetic oligonucleotide
  Target: FXN; (-) strand; PAM type: NRG; PAM sequence: AAG
gctactcgggaggctgaggc

SEQ ID NO: 12312 - DNA, 20 bp, Artificial Sequence
  Description of Artificial Sequence: Synthetic oligonucleotide
  Target: FXN; (-) strand; PAM type: NRG; PAM sequence: AGG
cccagctactcgggaggctg

SEQ ID NO: 12313 - DNA, 20 bp, Artificial Sequence
  Description of Artificial Sequence: Synthetic oligonucleotide
  Target: FXN; (-) strand; PAM type: NRG; PAM sequence: GAG
tcccagctactcgggaggct

SEQ ID NO: 12314 - DNA, 20 bp, Artificial Sequence
  Description of Artificial Sequence: Synthetic oligonucleotide
  Target: FXN; (-) strand; PAM type: NRG; PAM sequence: AGG
tgtaatcccagctactcggg

SEQ ID NO: 12315 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagctactcgg

SEQ ID NO: 12316 - DNA, 20 bp, Artificial Sequence
  Description of Artificial Sequence: Synthetic oligonucleotide
  Target: FXN; (-) strand; PAM type: NRG; PAM sequence: GGG
gcctgtaatcccagctactc

SEQ ID NO: 12317 - DNA, 20 bp, Artificial Sequence
  Description of Artificial Sequence: Synthetic oligonucleotide
  Target: FXN; (-) strand; PAM type: NRG; PAM sequence: CGG
cgcctgtaatcccagctact

SEQ ID NO: 12318 - DNA, 20 bp, Artificial Sequence
  Description of Artificial Sequence: Synthetic oligonucleotide
  Target: FXN; (-) strand; PAM type: NRG; PAM sequence: CAG
gtggcaggcgcctgtaatcc

SEQ ID NO: 12319 - DNA, 20 bp, Artificial Sequence
  Description of Artificial Sequence: Synthetic oligonucleotide
  Target: FXN; (-) strand; PAM type: NRG; PAM sequence: AGG
aattagccaggcgtggtggc

SEQ ID NO: 12320 - DNA, 20 bp, Artificial Sequence
  Description of Artificial Sequence: Synthetic oligonucleotide
  Target: FXN; (-) strand; PAM type: NRG; PAM sequence: CAG
aaattagccaggcgtggtgg

SEQ ID NO: 12321 - DNA, 20 bp, Artificial Sequence
  Description of Artificial Sequence: Synthetic oligonucleotide
  Target: FXN; (-) strand; PAM type: NRG; PAM sequence: TGG
aaaaaattagccaggcgtgg

SEQ ID NO: 12322 - DNA, 20 bp, Artificial Sequence
  Description of Artificial Sequence: Synthetic oligonucleotide
  Target: FXN; (-) strand; PAM type: NRG; PAM sequence: TGG
ataaaaaaattagccaggcg

SEQ ID NO: 12323 - DNA, 20 bp, Artificial Sequence
  Description of Artificial Sequence: Synthetic oligonucleotide
  Target: FXN; (-) strand; PAM type: NRG; PAM sequence: AGG
aaaatataaaaaaattagcc

SEQ ID NO: 12324 - DNA, 20 bp, Artificial Sequence
  Description of Artificial Sequence: Synthetic oligonucleotide
  Target: FXN; (-) strand; PAM type: NRG; PAM sequence: CAG
aaaaatataaaaaaattagc

SEQ ID NO: 12325 - DNA, 20 bp, Artificial Sequence
  Description of Artificial Sequence: Synthetic oligonucleotide
  Target: FXN; (-) strand; PAM type: NRG; PAM sequence: TAG
tactaaaaatataaaaaaat

SEQ ID NO: 12326 - DNA, 20 bp, Artificial Sequence
  Description of Artificial Sequence: Synthetic oligonucleotide
  Target: FXN; (-) strand; PAM type: NRG; PAM sequence: CAG
cctgacaacatggcaaaacc

SEQ ID NO: 12327 - DNA, 20 bp, Artificial Sequence
  Description of Artificial Sequence: Synthetic oligonucleotide
  Target: FXN; (-) strand; PAM type: NRG; PAM sequence: TGG
tcaagactagcctgacaaca

SEQ ID NO: 12328 - DNA, 20 bp, Artificial Sequence
  Description of Artificial Sequence: Synthetic oligonucleotide
  Target: FXN; (-) strand; PAM type: NRG; PAM sequence: TAG
tgaggtcaggagttcaagac

SEQ ID NO: 12329 - DNA, 20 bp, Artificial Sequence
  Description of Artificial Sequence: Synthetic oligonucleotide
  Target: FXN; (-) strand; PAM type: NRG; PAM sequence: AAG
ttacctgaggtcaggagttc

SEQ ID NO: 12330 - DNA, 20 bp, Artificial Sequence
  Description of Artificial Sequence: Synthetic oligonucleotide
  Target: FXN; (-) strand; PAM type: NRG; PAM sequence: GAG
gttggattacctgaggtcag

SEQ ID NO: 12331 - DNA, 20 bp, Artificial Sequence
  Description of Artificial Sequence: Synthetic oligonucleotide
  Target: FXN; (-) strand; PAM type: NRG; PAM sequence: AGG
cagttggattacctgaggtc

SEQ ID NO: 12332 - DNA, 20 bp, Artificial Sequence
  Description of Artificial Sequence: Synthetic oligonucleotide
  Target: FXN; (-) strand; PAM type: NRG; PAM sequence: CAG
gcagttggattacctgaggt

SEQ ID NO: 12333 - DNA, 20 bp, Artificial Sequence
  Description of Artificial Sequence: Synthetic oligonucleotide
  Target: FXN; (-) strand; PAM type: NRG; PAM sequence: AGG
caaagcagttggattacctg

SEQ ID NO: 12334 - DNA, 20 bp, Artificial Sequence
  Description of Artificial Sequence: Synthetic oligonucleotide
  Target: FXN; (-) strand; PAM type: NRG; PAM sequence: GAG
ccaaagcagttggattacct

SEQ ID NO: 12335 - DNA, 20 bp, Artificial Sequence
  Description of Artificial Sequence: Synthetic oligonucleotide
  Target: FXN; (-) strand; PAM type: NRG; PAM sequence: TGG
ctttgggaggccaaagcagt

SEQ ID NO: 12336 - DNA, 20 bp, Artificial Sequence
  Description of Artificial Sequence: Synthetic oligonucleotide
  Target: FXN; (-) strand; PAM type: NRG; PAM sequence: CAG
agcactttgggaggccaaag

SEQ ID NO: 12337 - DNA, 20 bp, Artificial Sequence
  Description of Artificial Sequence: Synthetic oligonucleotide
  Target: FXN; (-) strand; PAM type: NRG; PAM sequence: AAG
cccagcactttgggaggcca

SEQ ID NO: 12338 - DNA, 20 bp, Artificial Sequence
  Description of Artificial Sequence: Synthetic oligonucleotide
  Target: FXN; (-) strand; PAM type: NRG; PAM sequence: AGG
tgtaatcccagcactttggg

SEQ ID NO: 12339 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagcactttgg

SEQ ID NO: 12340 - DNA, 20 bp, Artificial Sequence
  Description of Artificial Sequence: Synthetic oligonucleotide
  Target: FXN; (-) strand; PAM type: NRG; PAM sequence: GGG
gcctgtaatcccagcacttt

SEQ ID NO: 12341 - DNA, 20 bp, Artificial Sequence
  Description of Artificial Sequence: Synthetic oligonucleotide
  Target: FXN; (-) strand; PAM type: NRG; PAM sequence: TGG
tgcctgtaatcccagcactt

SEQ ID NO: 12342 - DNA, 20 bp, Artificial Sequence
  Description of Artificial Sequence: Synthetic oligonucleotide
  Target: FXN; (-) strand; PAM type: NRG; PAM sequence: CAG
tttggagctgcctgtaatcc

SEQ ID NO: 12343 - DNA, 20 bp, Artificial Sequence
  Description of Artificial Sequence: Synthetic oligonucleotide
  Target: FXN; (-) strand; PAM type: NRG; PAM sequence: GAG
cctgtaatcccagcactttg

SEQ ID NO: 12344 - DNA, 20 bp, Artificial Sequence
  Description of Artificial Sequence: Synthetic oligonucleotide
  Target: FXN; (-) strand; PAM type: NRG; PAM sequence: TGG
tgcctgtaatcccagcactt

SEQ ID NO: 12345 - DNA, 20 bp, Artificial Sequence
  Description of Artificial Sequence: Synthetic oligonucleotide
  Target: FXN; (-) strand; PAM type: NRG; PAM sequence: CAG
gtggctcatgcctgtaatcc

SEQ ID NO: 12346 - DNA, 20 bp, Artificial Sequence
  Description of Artificial Sequence: Synthetic oligonucleotide
  Target: FXN; (-) strand; PAM type: NRG; PAM sequence: TGG
ttatttcaggccatgcatgg

SEQ ID NO: 12347 - DNA, 20 bp, Artificial Sequence
  Description of Artificial Sequence: Synthetic oligonucleotide
  Target: FXN; (-) strand; PAM type: NRG; PAM sequence: TGG
aaattatttcaggccatgca

SEQ ID NO: 12348 - DNA, 20 bp, Artificial Sequence
  Description of Artificial Sequence: Synthetic oligonucleotide
  Target: FXN; (-) strand; PAM type: NRG; PAM sequence: AGG
cctttcaaaaaaattatttc

SEQ ID NO: 12349 - DNA, 20 bp, Artificial Sequence
  Description of Artificial Sequence: Synthetic oligonucleotide
  Target: FXN; (-) strand; PAM type: NRG; PAM sequence: CAG
ccctttcaaaaaaattattt

SEQ ID NO: 12350 - DNA, 20 bp, Artificial Sequence
  Description of Artificial Sequence: Synthetic oligonucleotide
  Target: FXN; (-) strand; PAM type: NRG; PAM sequence: TAG
cctaagggctaaatagaaac

SEQ ID NO: 12351 - DNA, 20 bp, Artificial Sequence
  Description of Artificial Sequence: Synthetic oligonucleotide
  Target: FXN; (-) strand; PAM type: NRG; PAM sequence: TAG
tttttcccctaagggctaaa

SEQ ID NO: 12352 - DNA, 20 bp, Artificial Sequence
  Description of Artificial Sequence: Synthetic oligonucleotide
  Target: FXN; (-) strand; PAM type: NRG; PAM sequence: GGG
attagttttttttcccctaa

SEQ ID NO: 12353 - DNA, 20 bp, Artificial Sequence
  Description of Artificial Sequence: Synthetic oligonucleotide
  Target: FXN; (-) strand; PAM type: NRG; PAM sequence: AGG
cattagttttttttccccta

SEQ ID NO: 12354 - DNA, 20 bp, Artificial Sequence
  Description of Artificial Sequence: Synthetic oligonucleotide
  Target: FXN; (-) strand; PAM type: NRG; PAM sequence: AAG
ccattagttttttttcccct

SEQ ID NO: 12355 - DNA, 20 bp, Artificial Sequence
  Description of Artificial Sequence: Synthetic oligonucleotide
  Target: FXN; (-) strand; PAM type: NRG; PAM sequence: TAG
attccctccctaactgccat

SEQ ID NO: 12356 - DNA, 20 bp, Artificial Sequence
  Description of Artificial Sequence: Synthetic oligonucleotide
  Target: FXN; (-) strand; PAM type: NRG; PAM sequence: AGG
gatgggaaaggagttcaaac

SEQ ID NO: 12357 - DNA, 20 bp, Artificial Sequence
  Description of Artificial Sequence: Synthetic oligonucleotide
  Target: FXN; (-) strand; PAM type: NRG; PAM sequence: CAG
tgatgggaaaggagttcaaa

SEQ ID NO: 12358 - DNA, 20 bp, Artificial Sequence
  Description of Artificial Sequence: Synthetic oligonucleotide
  Target: FXN; (-) strand; PAM type: NRG; PAM sequence: GAG
ttttggccatgatgggaaag

SEQ ID NO: 12359 - DNA, 20 bp, Artificial Sequence
  Description of Artificial Sequence: Synthetic oligonucleotide
  Target: FXN; (-) strand; PAM type: NRG; PAM sequence: AGG
agttttggccatgatgggaa

SEQ ID NO: 12360 - DNA, 20 bp, Artificial Sequence
  Description of Artificial Sequence: Synthetic oligonucleotide
  Target: FXN; (-) strand; PAM type: NRG; PAM sequence: AAG
aagttttggccatgatggga

SEQ ID NO: 12361 - DNA, 20 bp, Artificial Sequence
  Description of Artificial Sequence: Synthetic oligonucleotide
  Target: FXN; (-) strand; PAM type: NRG; PAM sequence: GGG
ttttaagttttggccatgat

SEQ ID NO: 12362 - DNA, 20 bp, Artificial Sequence
  Description of Artificial Sequence: Synthetic oligonucleotide
  Target: FXN; (-) strand; PAM type: NRG; PAM sequence: TGG
attttaagttttggccatga

SEQ ID NO: 12363 - DNA, 20 bp, Artificial Sequence
  Description of Artificial Sequence: Synthetic oligonucleotide
  Target: FXN; (-) strand; PAM type: NRG; PAM sequence: TGG
ctaaaaaaaattttaagttt

SEQ ID NO: 12364 - DNA, 20 bp, Artificial Sequence
  Description of Artificial Sequence: Synthetic oligonucleotide
  Target: FXN; (-) strand; PAM type: NRG; PAM sequence: AAG
agatatctaaaaaaaatttt

SEQ ID NO: 12365 - DNA, 20 bp, Artificial Sequence
  Description of Artificial Sequence: Synthetic oligonucleotide
  Target: FXN; (-) strand; PAM type: NRG; PAM sequence: GAG
ttttggccaaggggagccca

SEQ ID NO: 12366 - DNA, 20 bp, Artificial Sequence
  Description of Artificial Sequence: Synthetic oligonucleotide
  Target: FXN; (-) strand; PAM type: NRG; PAM sequence: CAG
tcttttggccaaggggagcc

SEQ ID NO: 12367 - DNA, 20 bp, Artificial Sequence
  Description of Artificial Sequence: Synthetic oligonucleotide
  Target: FXN; (-) strand; PAM type: NRG; PAM sequence: GAG
aactatcttttggccaaggg

SEQ ID NO: 12368 - DNA, 20 bp, Artificial Sequence
  Description of Artificial Sequence: Synthetic oligonucleotide
  Target: FXN; (-) strand; PAM type: NRG; PAM sequence: GGG
caaactatcttttggccaag

SEQ ID NO: 12369 - DNA, 20 bp, Artificial Sequence
  Description of Artificial Sequence: Synthetic oligonucleotide
  Target: FXN; (-) strand; PAM type: NRG; PAM sequence: GGG
acaaactatcttttggccaa

SEQ ID NO: 12370 - DNA, 20 bp, Artificial Sequence
  Description of Artificial Sequence: Synthetic oligonucleotide
  Target: FXN; (-) strand; PAM type: NRG; PAM sequence: AGG
aacaaactatcttttggcca

SEQ ID NO: 12371 - DNA, 20 bp, Artificial Sequence
  Description of Artificial Sequence: Synthetic oligonucleotide
  Target: FXN; (-) strand; PAM type: NRG; PAM sequence: AAG
caacaaactatcttttggcc

SEQ ID NO: 12372 - DNA, 20 bp, Artificial Sequence
  Description of Artificial Sequence: Synthetic oligonucleotide
  Target: FXN; (-) strand; PAM type: NRG; PAM sequence: TGG
tgactcaacaaactatcttt

SEQ ID NO: 12373 - DNA, 20 bp, Artificial Sequence
  Description of Artificial Sequence: Synthetic oligonucleotide
  Target: FXN; (-) strand; PAM type: NRG; PAM sequence: AAG
agaaataaaaacaaaattct

SEQ ID NO: 12374 - DNA, 20 bp, Artificial Sequence
  Description of Artificial Sequence: Synthetic oligonucleotide
  Target: FXN; (-) strand; PAM type: NRG; PAM sequence: GAG
tcaaattgattcaatgatgt

SEQ ID NO: 12375 - DNA, 20 bp, Artificial Sequence
  Description of Artificial Sequence: Synthetic oligonucleotide
  Target: FXN; (-) strand; PAM type: NRG; PAM sequence: TGG
gagcagaaggttttgtcgcc

SEQ ID NO: 12376 - DNA, 20 bp, Artificial Sequence
  Description of Artificial Sequence: Synthetic oligonucleotide
  Target: FXN; (-) strand; PAM type: NRG; PAM sequence: AGG
gacccactactgggagcaga

SEQ ID NO: 12377 - DNA, 20 bp, Artificial Sequence
  Description of Artificial Sequence: Synthetic oligonucleotide
  Target: FXN; (-) strand; PAM type: NRG; PAM sequence: AAG
tgacccactactgggagcag

SEQ ID NO: 12378 - DNA, 20 bp, Artificial Sequence
  Description of Artificial Sequence: Synthetic oligonucleotide
  Target: FXN; (-) strand; PAM type: NRG; PAM sequence: CAG
ctctgacccactactgggag

SEQ ID NO: 12379 - DNA, 20 bp, Artificial Sequence
  Description of Artificial Sequence: Synthetic oligonucleotide
  Target: FXN; (-) strand; PAM type: NRG; PAM sequence: GAG
gttctctgacccactactgg

SEQ ID NO: 12380 - DNA, 20 bp, Artificial Sequence
  Description of Artificial Sequence: Synthetic oligonucleotide
  Target: FXN; (-) strand; PAM type: NRG; PAM sequence: GGG
aggttctctgacccactact

SEQ ID NO: 12381 - DNA, 20 bp, Artificial Sequence
  Description of Artificial Sequence: Synthetic oligonucleotide
  Target: FXN; (-) strand; PAM type: NRG; PAM sequence: TGG
aaggttctctgacccactac

SEQ ID NO: 12382 - DNA, 20 bp, Artificial Sequence
  Description of Artificial Sequence: Synthetic oligonucleotide
  Target: FXN; (-) strand; PAM type: NRG; PAM sequence: AGG
tctcagggcaggaatcagga

SEQ ID NO: 12383 - DNA, 20 bp, Artificial Sequence
  Description of Artificial Sequence: Synthetic oligonucleotide
  Target: FXN; (-) strand; PAM type: NRG; PAM sequence: AAG
atctcagggcaggaatcagg

SEQ ID NO: 12384 - DNA, 20 bp, Artificial Sequence
  Description of Artificial Sequence: Synthetic oligonucleotide
  Target: FXN; (-) strand; PAM type: NRG; PAM sequence: AGG
acaatctcagggcaggaatc

SEQ ID NO: 12385 - DNA, 20 bp, Artificial Sequence
  Description of Artificial Sequence: Synthetic oligonucleotide
  Target: FXN; (-) strand; PAM type: NRG; PAM sequence: CAG
gacaatctcagggcaggaat

SEQ ID NO: 12386 - DNA, 20 bp, Artificial Sequence
  Description of Artificial Sequence: Synthetic oligonucleotide
  Target: FXN; (-) strand; PAM type: NRG; PAM sequence: AGG
cagagagacaatctcagggc

SEQ ID NO: 12387 - DNA, 20 bp, Artificial Sequence
  Description of Artificial Sequence: Synthetic oligonucleotide
  Target: FXN; (-) strand; PAM type: NRG; PAM sequence: CAG
tcagagagacaatctcaggg

SEQ ID NO: 12388 - DNA, 20 bp, Artificial Sequence
  Description of Artificial Sequence: Synthetic oligonucleotide
  Target: FXN; (-) strand; PAM type: NRG; PAM sequence: GGG
tcttcagagagacaatctca

SEQ ID NO: 12389 - DNA, 20 bp, Artificial Sequence
  Description of Artificial Sequence: Synthetic oligonucleotide
  Target: FXN; (-) strand; PAM type: NRG; PAM sequence: AGG
gtcttcagagagacaatctc

SEQ ID NO: 12390 - DNA, 20 bp, Artificial Sequence
  Description of Artificial Sequence: Synthetic oligonucleotide
  Target: FXN; (-) strand; PAM type: NRG; PAM sequence: CAG
tgtcttcagagagacaatct

SEQ ID NO: 12391 - DNA, 20 bp, Artificial Sequence
  Description of Artificial Sequence: Synthetic oligonucleotide
  Target: FXN; (-) strand; PAM type: NRG; PAM sequence: GAG
agcctaatgttgtcttcaga

SEQ ID NO: 12392 - DNA, 20 bp, Artificial Sequence
  Description of Artificial Sequence: Synthetic oligonucleotide
  Target: FXN; (-) strand; PAM type: NRG; PAM sequence: GAG
ctagcctaatgttgtcttca

SEQ ID NO: 12393 - DNA, 20 bp, Artificial Sequence
  Description of Artificial Sequence: Synthetic oligonucleotide
  Target: FXN; (-) strand; PAM type: NRG; PAM sequence: CAG
tactagcctaatgttgtctt

SEQ ID NO: 12394 - DNA, 20 bp, Artificial Sequence
  Description of Artificial Sequence: Synthetic oligonucleotide
  Target: FXN; (-) strand; PAM type: NRG; PAM sequence: TAG
acagaatctggaaagcctac

SEQ ID NO: 12395 - DNA, 20 bp, Artificial Sequence
  Description of Artificial Sequence: Synthetic oligonucleotide
  Target: FXN; (-) strand; PAM type: NRG; PAM sequence: AAG
aatgggttacagaatctgga

SEQ ID NO: 12396 - DNA, 20 bp, Artificial Sequence
  Description of Artificial Sequence: Synthetic oligonucleotide
  Target: FXN; (-) strand; PAM type: NRG; PAM sequence: TGG
aaagaatgggttacagaatc

SEQ ID NO: 12397 - DNA, 20 bp, Artificial Sequence
  Description of Artificial Sequence: Synthetic oligonucleotide
  Target: FXN; (-) strand; PAM type: NRG; PAM sequence: CAG
tcctttgaaagaatgggtta

SEQ ID NO: 12398 - DNA, 20 bp, Artificial Sequence
  Description of Artificial Sequence: Synthetic oligonucleotide
  Target: FXN; (-) strand; PAM type: NRG; PAM sequence: GGG
atctcttcctttgaaagaat

SEQ ID NO: 12399 - DNA, 20 bp, Artificial Sequence
  Description of Artificial Sequence: Synthetic oligonucleotide
  Target: FXN; (-) strand; PAM type: NRG; PAM sequence: TGG
catctcttcctttgaaagaa

SEQ ID NO: 12400 - DNA, 20 bp, Artificial Sequence
  Description of Artificial Sequence: Synthetic oligonucleotide
  Target: FXN; (-) strand; PAM type: NRG; PAM sequence: AAG
ataggcatctcttcctttga

SEQ ID NO: 12401 - DNA, 20 bp, Artificial Sequence
  Description of Artificial Sequence: Synthetic oligonucleotide
  Target: FXN; (-) strand; PAM type: NRG; PAM sequence: AGG
tgaattggctagaaaaatat

SEQ ID NO: 12402 - DNA, 20 bp, Artificial Sequence
  Description of Artificial Sequence: Synthetic oligonucleotide
  Target: FXN; (-) strand; PAM type: NRG; PAM sequence: TAG
atgaattggctagaaaaata

SEQ ID NO: 12403 - DNA, 20 bp, Artificial Sequence
  Description of Artificial Sequence: Synthetic oligonucleotide
  Target: FXN; (-) strand; PAM type: NRG; PAM sequence: TAG
ctcaaggtatatgaattggc

SEQ ID NO: 12404 - DNA, 20 bp, Artificial Sequence
  Description of Artificial Sequence: Synthetic oligonucleotide
  Target: FXN; (-) strand; PAM type: NRG; PAM sequence: TGG
gatactcaaggtatatgaat

SEQ ID NO: 12405 - DNA, 20 bp, Artificial Sequence
  Description of Artificial Sequence: Synthetic oligonucleotide
  Target: FXN; (-) strand; PAM type: NRG; PAM sequence: AGG
ttgcccttgagtgatactca

SEQ ID NO: 12406 - DNA, 20 bp, Artificial Sequence
  Description of Artificial Sequence: Synthetic oligonucleotide
  Target: FXN; (-) strand; PAM type: NRG; PAM sequence: AAG
tttgcccttgagtgatactc

SEQ ID NO: 12407 - DNA, 20 bp, Artificial Sequence
  Description of Artificial Sequence: Synthetic oligonucleotide
  Target: FXN; (-) strand; PAM type: NRG; PAM sequence: GAG
ttagaaataattttgccctt

SEQ ID NO: 12408 - DNA, 20 bp, Artificial Sequence
  Description of Artificial Sequence: Synthetic oligonucleotide
  Target: FXN; (-) strand; PAM type: NRG; PAM sequence: TAG
ctaattagtaaatgatttgt

SEQ ID NO: 12409 - DNA, 20 bp, Artificial Sequence
  Description of Artificial Sequence: Synthetic oligonucleotide
  Target: FXN; (-) strand; PAM type: NRG; PAM sequence: TAG
acacttaagcatttgctaat

SEQ ID NO: 12410 - DNA, 20 bp, Artificial Sequence
  Description of Artificial Sequence: Synthetic oligonucleotide
  Target: FXN; (-) strand; PAM type: NRG; PAM sequence: AAG
agctttctaaatctacactt

SEQ ID NO: 12411 - DNA, 20 bp, Artificial Sequence
  Description of Artificial Sequence: Synthetic oligonucleotide
  Target: FXN; (-) strand; PAM type: NRG; PAM sequence: TAG
tggcagccactgtatagctt

SEQ ID NO: 12412 - DNA, 20 bp, Artificial Sequence
  Description of Artificial Sequence: Synthetic oligonucleotide
  Target: FXN; (-) strand; PAM type: NRG; PAM sequence: TAG
tatagatggcagccactgta

SEQ ID NO: 12413 - DNA, 20 bp, Artificial Sequence
  Description of Artificial Sequence: Synthetic oligonucleotide
  Target: FXN; (-) strand; PAM type: NRG; PAM sequence: CAG
caagtccaaactatagatgg

SEQ ID NO: 12414 - DNA, 20 bp, Artificial Sequence
  Description of Artificial Sequence: Synthetic oligonucleotide
  Target: FXN; (-) strand; PAM type: NRG; PAM sequence: TGG
tcacaagtccaaactataga

SEQ ID NO: 12415 - DNA, 20 bp, Artificial Sequence
  Description of Artificial Sequence: Synthetic oligonucleotide
  Target: FXN; (-) strand; PAM type: NRG; PAM sequence: TAG
ttaatcacaagtccaaacta

SEQ ID NO: 12416 - DNA, 20 bp, Artificial Sequence
  Description of Artificial Sequence: Synthetic oligonucleotide
  Target: FXN; (-) strand; PAM type: NRG; PAM sequence: AAG
atttcaatgtagttaatcac

SEQ ID NO: 12417 - DNA, 20 bp, Artificial Sequence
  Description of Artificial Sequence: Synthetic oligonucleotide
  Target: FXN; (-) strand; PAM type: NRG; PAM sequence: TAG
acagagttagcatttcaatg

SEQ ID NO: 12418 - DNA, 20 bp, Artificial Sequence
  Description of Artificial Sequence: Synthetic oligonucleotide
  Target: FXN; (-) strand; PAM type: NRG; PAM sequence: TAG
catactctagggtacagagt

SEQ ID NO: 12419 - DNA, 20 bp, Artificial Sequence
  Description of Artificial Sequence: Synthetic oligonucleotide
  Target: FXN; (-) strand; PAM type: NRG; PAM sequence: GAG
aattcatactctagggtaca

SEQ ID NO: 12420 - DNA, 20 bp, Artificial Sequence
  Description of Artificial Sequence: Synthetic oligonucleotide
  Target: FXN; (-) strand; PAM type: NRG; PAM sequence: CAG
ggaattcatactctagggta

SEQ ID NO: 12421 - DNA, 20 bp, Artificial Sequence
  Description of Artificial Sequence: Synthetic oligonucleotide
  Target: FXN; (-) strand; PAM type: NRG; PAM sequence: GGG
aatcaggaattcatactcta

SEQ ID NO: 12422 - DNA, 20 bp, Artificial Sequence
  Description of Artificial Sequence: Synthetic oligonucleotide
  Target: FXN; (-) strand; PAM type: NRG; PAM sequence: AGG
taatcaggaattcatactct

SEQ ID NO: 12423 - DNA, 20 bp, Artificial Sequence
  Description of Artificial Sequence: Synthetic oligonucleotide
  Target: FXN; (-) strand; PAM type: NRG; PAM sequence: TAG
ctaatcaggaattcatactc

SEQ ID NO: 12424 - DNA, 20 bp, Artificial Sequence
  Description of Artificial Sequence: Synthetic oligonucleotide
  Target: FXN; (-) strand; PAM type: NRG; PAM sequence: AGG
gcacctgaaggactctaatc

SEQ ID NO: 12425 - DNA, 20 bp, Artificial Sequence
  Description of Artificial Sequence: Synthetic oligonucleotide
  Target: FXN; (-) strand; PAM type: NRG; PAM sequence: CAG
agcacctgaaggactctaat

SEQ ID NO: 12426 - DNA, 20 bp, Artificial Sequence
  Description of Artificial Sequence: Synthetic oligonucleotide
  Target: FXN; (-) strand; PAM type: NRG; PAM sequence: AGG
ataaattagttagcacctga

SEQ ID NO: 12427 - DNA, 20 bp, Artificial Sequence
  Description of Artificial Sequence: Synthetic oligonucleotide
  Target: FXN; (-) strand; PAM type: NRG; PAM sequence: AAG
cataaattagttagcacctg

SEQ ID NO: 12428 - DNA, 20 bp, Artificial Sequence
  Description of Artificial Sequence: Synthetic oligonucleotide
  Target: FXN; (-) strand; PAM type: NRG; PAM sequence: TAG
catgaaatacataaattagt

SEQ ID NO: 12429 - DNA, 20 bp, Artificial Sequence
  Description of Artificial Sequence: Synthetic oligonucleotide
  Target: FXN; (-) strand; PAM type: NRG; PAM sequence: TAG
caaacatgaaatacataaat

SEQ ID NO: 12430 - DNA, 20 bp, Artificial Sequence
  Description of Artificial Sequence: Synthetic oligonucleotide
  Target: FXN; (-) strand; PAM type: NRG; PAM sequence: AAG
actgctctcccacaaagctc

SEQ ID NO: 12431 - DNA, 20 bp, Artificial Sequence
  Description of Artificial Sequence: Synthetic oligonucleotide
  Target: FXN; (-) strand; PAM type: NRG; PAM sequence: AAG
gaaaagactgctctcccaca

SEQ ID NO: 12432 - DNA, 20 bp, Artificial Sequence
  Description of Artificial Sequence: Synthetic oligonucleotide
  Target: FXN; (-) strand; PAM type: NRG; PAM sequence: AAG
gctatatctcaggggaggaa

SEQ ID NO: 12433 - DNA, 20 bp, Artificial Sequence
  Description of Artificial Sequence: Synthetic oligonucleotide
  Target: FXN; (-) strand; PAM type: NRG; PAM sequence: AGG
ttctagctatatctcagggg

SEQ ID NO: 12434 - DNA, 20 bp, Artificial Sequence
  Description of Artificial Sequence: Synthetic oligonucleotide
  Target: FXN; (-) strand; PAM type: NRG; PAM sequence: GAG
cttctagctatatctcaggg

SEQ ID NO: 12435 - DNA, 20 bp, Artificial Sequence
  Description of Artificial Sequence: Synthetic oligonucleotide
  Target: FXN; (-) strand; PAM type: NRG; PAM sequence: GGG
aacttctagctatatctcag

SEQ ID NO: 12436 - DNA, 20 bp, Artificial Sequence
  Description of Artificial Sequence: Synthetic oligonucleotide
  Target: FXN; (-) strand; PAM type: NRG; PAM sequence: GGG
taacttctagctatatctca

SEQ ID NO: 12437 - DNA, 20 bp, Artificial Sequence
  Description of Artificial Sequence: Synthetic oligonucleotide
  Target: FXN; (-) strand; PAM type: NRG; PAM sequence: AGG
gtaacttctagctatatctc

SEQ ID NO: 12438 - DNA, 20 bp, Artificial Sequence
  Description of Artificial Sequence: Synthetic oligonucleotide
  Target: FXN; (-) strand; PAM type: NRG; PAM sequence: CAG
ggtaacttctagctatatct

SEQ ID NO: 12439 - DNA, 20 bp, Artificial Sequence
  Description of Artificial Sequence: Synthetic oligonucleotide
  Target: FXN; (-) strand; PAM type: NRG; PAM sequence: TAG
ttcacaaaggaggtaacttc

SEQ ID NO: 12440 - DNA, 20 bp, Artificial Sequence
  Description of Artificial Sequence: Synthetic oligonucleotide
  Target: FXN; (-) strand; PAM type: NRG; PAM sequence: AGG
ctaggaaggcttcacaaagg

SEQ ID NO: 12441 - DNA, 20 bp, Artificial Sequence
  Description of Artificial Sequence: Synthetic oligonucleotide
  Target: FXN; (-) strand; PAM type: NRG; PAM sequence: GAG
tctaggaaggcttcacaaag

SEQ ID NO: 12442 - DNA, 20 bp, Artificial Sequence
  Description of Artificial Sequence: Synthetic oligonucleotide
  Target: FXN; (-) strand; PAM type: NRG; PAM sequence: AGG
tatctaggaaggcttcacaa

SEQ ID NO: 12443 - DNA, 20 bp, Artificial Sequence
  Description of Artificial Sequence: Synthetic oligonucleotide
  Target: FXN; (-) strand; PAM type: NRG; PAM sequence: AAG
gtatctaggaaggcttcaca

SEQ ID NO: 12444 - DNA, 20 bp, Artificial Sequence
  Description of Artificial Sequence: Synthetic oligonucleotide
  Target: FXN; (-) strand; PAM type: NRG; PAM sequence: AGG
tctgcttggagtatctagga

SEQ ID NO: 12445 - DNA, 20 bp, Artificial Sequence
  Description of Artificial Sequence: Synthetic oligonucleotide
  Target: FXN; (-) strand; PAM type: NRG; PAM sequence: AAG
gtctgcttggagtatctagg

SEQ ID NO: 12446 - DNA, 20 bp, Artificial Sequence
  Description of Artificial Sequence: Synthetic oligonucleotide
  Target: FXN; (-) strand; PAM type: NRG; PAM sequence: AGG
cgtgtctgcttggagtatct

SEQ ID NO: 12447 - DNA, 20 bp, Artificial Sequence
  Description of Artificial Sequence: Synthetic oligonucleotide
  Target: FXN; (-) strand; PAM type: NRG; PAM sequence: TAG
ccgtgtctgcttggagtatc

SEQ ID NO: 12448 - DNA, 20 bp, Artificial Sequence
  Description of Artificial Sequence: Synthetic oligonucleotide
  Target: FXN; (-) strand; PAM type: NRG; PAM sequence: GAG
ggaaggaccgtgtctgcttg

SEQ ID NO: 12449 - DNA, 20 bp, Artificial Sequence
  Description of Artificial Sequence: Synthetic oligonucleotide
  Target: FXN; (-) strand; PAM type: NRG; PAM sequence: TGG
aaggaaggaccgtgtctgct

SEQ ID NO: 12450 - DNA, 20 bp, Artificial Sequence
  Description of Artificial Sequence: Synthetic oligonucleotide
  Target: FXN; (-) strand; PAM type: NRG; PAM sequence: AGG
gctgggcaagggagaaagga

SEQ ID NO: 12451 - DNA, 20 bp, Artificial Sequence
  Description of Artificial Sequence: Synthetic oligonucleotide
  Target: FXN; (-) strand; PAM type: NRG; PAM sequence: AAG
tgctgggcaagggagaaagg

SEQ ID NO: 12452 - DNA, 20 bp, Artificial Sequence
  Description of Artificial Sequence: Synthetic oligonucleotide
  Target: FXN; (-) strand; PAM type: NRG; PAM sequence: AGG
gagtgctgggcaagggagaa

SEQ ID NO: 12453 - DNA, 20 bp, Artificial Sequence
  Description of Artificial Sequence: Synthetic oligonucleotide
  Target: FXN; (-) strand; PAM type: NRG; PAM sequence: AAG
agagtgctgggcaagggaga

SEQ ID NO: 12454 - DNA, 20 bp, Artificial Sequence
  Description of Artificial Sequence: Synthetic oligonucleotide
  Target: FXN; (-) strand; PAM type: NRG; PAM sequence: GAG
cctcagagtgctgggcaagg

SEQ ID NO: 12455 - DNA, 20 bp, Artificial Sequence
  Description of Artificial Sequence: Synthetic oligonucleotide
  Target: FXN; (-) strand; PAM type: NRG; PAM sequence: GGG
aacctcagagtgctgggcaa

SEQ ID NO: 12456 - DNA, 20 bp, Artificial Sequence
  Description of Artificial Sequence: Synthetic oligonucleotide
  Target: FXN; (-) strand; PAM type: NRG; PAM sequence: AGG
caacctcagagtgctgggca

SEQ ID NO: 12457 - DNA, 20 bp, Artificial Sequence
  Description of Artificial Sequence: Synthetic oligonucleotide
  Target: FXN; (-) strand; PAM type: NRG; PAM sequence: AAG
tcaacctcagagtgctgggc

SEQ ID NO: 12458 - DNA, 20 bp, Artificial Sequence
  Description of Artificial Sequence: Synthetic oligonucleotide
  Target: FXN; (-) strand; PAM type: NRG; PAM sequence: GGG
agagtcaacctcagagtgct

SEQ ID NO: 12459 - DNA, 20 bp, Artificial Sequence
  Description of Artificial Sequence: Synthetic oligonucleotide
  Target: FXN; (-) strand; PAM type: NRG; PAM sequence: TGG
cagagtcaacctcagagtgc

SEQ ID NO: 12460 - DNA, 20 bp, Artificial Sequence
  Description of Artificial Sequence: Synthetic oligonucleotide
  Target: FXN; (-) strand; PAM type: NRG; PAM sequence: GAG
gctccacagagtcaacctca

SEQ ID NO: 12461 - DNA, 20 bp, Artificial Sequence
  Description of Artificial Sequence: Synthetic oligonucleotide
  Target: FXN; (-) strand; PAM type: NRG; PAM sequence: CAG
gtgctccacagagtcaacct

SEQ ID NO: 12462 - DNA, 20 bp, Artificial Sequence
  Description of Artificial Sequence: Synthetic oligonucleotide
  Target: FXN; (-) strand; PAM type: NRG; PAM sequence: GAG
agagggatcagtgctccaca

SEQ ID NO: 12463 - DNA, 20 bp, Artificial Sequence
  Description of Artificial Sequence: Synthetic oligonucleotide
  Target: FXN; (-) strand; PAM type: NRG; PAM sequence: CAG
acagagggatcagtgctcca

SEQ ID NO: 12464 - DNA, 20 bp, Artificial Sequence
  Description of Artificial Sequence: Synthetic oligonucleotide
  Target: FXN; (-) strand; PAM type: NRG; PAM sequence: CAG
caattataacacagagggat

SEQ ID NO: 12465 - DNA, 20 bp, Artificial Sequence
  Description of Artificial Sequence: Synthetic oligonucleotide
  Target: FXN; (-) strand; PAM type: NRG; PAM sequence: GGG
atagacaattataacacaga

SEQ ID NO: 12466 - DNA, 20 bp, Artificial Sequence
  Description of Artificial Sequence: Synthetic oligonucleotide
  Target: FXN; (-) strand; PAM type: NRG; PAM sequence: AGG
aatagacaattataacacag

SEQ ID NO: 12467 - DNA, 20 bp, Artificial Sequence
  Description of Artificial Sequence: Synthetic oligonucleotide
  Target: FXN; (-) strand; PAM type: NRG; PAM sequence: GAG
aaatagacaattataacaca

SEQ ID NO: 12468 - DNA, 20 bp, Artificial Sequence
  Description of Artificial Sequence: Synthetic oligonucleotide
  Target: FXN; (-) strand; PAM type: NRG; PAM sequence: CAG
gtaaatagacaattataaca

SEQ ID NO: 12469 - DNA, 20 bp, Artificial Sequence
  Description of Artificial Sequence: Synthetic oligonucleotide
  Target: FXN; (-) strand; PAM type: NRG; PAM sequence: TAG
ggtggtagctgacgtgtaaa

SEQ ID NO: 12470 - DNA, 20 bp, Artificial Sequence
  Description of Artificial Sequence: Synthetic oligonucleotide
  Target: FXN; (-) strand; PAM type: NRG; PAM sequence: TAG
actcagtgtgttataggtgg

SEQ ID NO: 12471 - DNA, 20 bp, Artificial Sequence
  Description of Artificial Sequence: Synthetic oligonucleotide
  Target: FXN; (-) strand; PAM type: NRG; PAM sequence: TGG
ggaactcagtgtgttatagg

SEQ ID NO: 12472 - DNA, 20 bp, Artificial Sequence
  Description of Artificial Sequence: Synthetic oligonucleotide
  Target: FXN; (-) strand; PAM type: NRG; PAM sequence: AGG
tgaggaactcagtgtgttat

SEQ ID NO: 12473 - DNA, 20 bp, Artificial Sequence
  Description of Artificial Sequence: Synthetic oligonucleotide
  Target: FXN; (-) strand; PAM type: NRG; PAM sequence: TAG
ttgaggaactcagtgtgtta

SEQ ID NO: 12474 - DNA, 20 bp, Artificial Sequence
  Description of Artificial Sequence: Synthetic oligonucleotide
  Target: FXN; (-) strand; PAM type: NRG; PAM sequence: CAG
gtccctgctgttgaggaact

SEQ ID NO: 12475 - DNA, 20 bp, Artificial Sequence
  Description of Artificial Sequence: Synthetic oligonucleotide
  Target: FXN; (-) strand; PAM type: NRG; PAM sequence: AGG
ggacagtgtccctgctgttg

SEQ ID NO: 12476 - DNA, 20 bp, Artificial Sequence
  Description of Artificial Sequence: Synthetic oligonucleotide
  Target: FXN; (-) strand; PAM type: NRG; PAM sequence: GAG
tggacagtgtccctgctgtt

SEQ ID NO: 12477 - DNA, 20 bp, Artificial Sequence
  Description of Artificial Sequence: Synthetic oligonucleotide
  Target: FXN; (-) strand; PAM type: NRG; PAM sequence: CAG
cactgggatcaaagaatgga

SEQ ID NO: 12478 - DNA, 20 bp, Artificial Sequence
  Description of Artificial Sequence: Synthetic oligonucleotide
  Target: FXN; (-) strand; PAM type: NRG; PAM sequence: TGG
cagacactgggatcaaagaa

SEQ ID NO: 12479 - DNA, 20 bp, Artificial Sequence
  Description of Artificial Sequence: Synthetic oligonucleotide
  Target: FXN; (-) strand; PAM type: NRG; PAM sequence: AAG
tgttccagacactgggatca

SEQ ID NO: 12480 - DNA, 20 bp, Artificial Sequence
  Description of Artificial Sequence: Synthetic oligonucleotide
  Target: FXN; (-) strand; PAM type: NRG; PAM sequence: GGG
ttggcactgttccagacact

SEQ ID NO: 12481 - DNA, 20 bp, Artificial Sequence
  Description of Artificial Sequence: Synthetic oligonucleotide
  Target: FXN; (-) strand; PAM type: NRG; PAM sequence: TGG
cttggcactgttccagacac

SEQ ID NO: 12482 - DNA, 20 bp, Artificial Sequence
  Description of Artificial Sequence: Synthetic oligonucleotide
  Target: FXN; (-) strand; PAM type: NRG; PAM sequence: CAG
ctatgtacttggcactgttc

SEQ ID NO: 12483 - DNA, 20 bp, Artificial Sequence
  Description of Artificial Sequence: Synthetic oligonucleotide
  Target: FXN; (-) strand; PAM type: NRG; PAM sequence: TGG
ttaagtccctactatgtact

SEQ ID NO: 12484 - DNA, 20 bp, Artificial Sequence
  Description of Artificial Sequence: Synthetic oligonucleotide
  Target: FXN; (-) strand; PAM type: NRG; PAM sequence: AAG
catatgaatcaatatttatt

SEQ ID NO: 12485 - DNA, 20 bp, Artificial Sequence
  Description of Artificial Sequence: Synthetic oligonucleotide
  Target: FXN; (-) strand; PAM type: NRG; PAM sequence: AAG
aacgaaagcatgttttggaa

SEQ ID NO: 12486 - DNA, 20 bp, Artificial Sequence
  Description of Artificial Sequence: Synthetic oligonucleotide
  Target: FXN; (-) strand; PAM type: NRG; PAM sequence: TGG
gcatcaacgaaagcatgttt

SEQ ID NO: 12487 - DNA, 20 bp, Artificial Sequence
  Description of Artificial Sequence: Synthetic oligonucleotide
  Target: FXN; (-) strand; PAM type: NRG; PAM sequence: AAG
atgctgagaggcatcaacga

SEQ ID NO: 12488 - DNA, 20 bp, Artificial Sequence
  Description of Artificial Sequence: Synthetic oligonucleotide
  Target: FXN; (-) strand; PAM type: NRG; PAM sequence: AGG
aaaggtgtataaatgctgag

SEQ ID NO: 12489 - DNA, 20 bp, Artificial Sequence
  Description of Artificial Sequence: Synthetic oligonucleotide
  Target: FXN; (-) strand; PAM type: NRG; PAM sequence: GAG
aaaaggtgtataaatgctga

SEQ ID NO: 12490 - DNA, 20 bp, Artificial Sequence
  Description of Artificial Sequence: Synthetic oligonucleotide
  Target: FXN; (-) strand; PAM type: NRG; PAM sequence: GAG
gtaaaaggtgtataaatgct

SEQ ID NO: 12491 - DNA, 20 bp, Artificial Sequence
  Description of Artificial Sequence: Synthetic oligonucleotide
  Target: FXN; (-) strand; PAM type: NRG; PAM sequence: AGG
gccagtagcgagttggtaaa

SEQ ID NO: 12492 - DNA, 20 bp, Artificial Sequence
  Description of Artificial Sequence: Synthetic oligonucleotide
  Target: FXN; (-) strand; PAM type: NRG; PAM sequence: AAG
ggccagtagcgagttggtaa

SEQ ID NO: 12493 - DNA, 20 bp, Artificial Sequence
  Description of Artificial Sequence: Synthetic oligonucleotide
  Target: FXN; (-) strand; PAM type: NRG; PAM sequence: TGG
ctatgtggccagtagcgagt

SEQ ID NO: 12494 - DNA, 20 bp, Artificial Sequence
  Description of Artificial Sequence: Synthetic oligonucleotide
  Target: FXN; (-) strand; PAM type: NRG; PAM sequence: GAG
ttgtctatgtggccagtagc

SEQ ID NO: 12495 - DNA, 20 bp, Artificial Sequence
  Description of Artificial Sequence: Synthetic oligonucleotide
  Target: FXN; (-) strand; PAM type: NRG; PAM sequence: TAG
tcatttgtctatgtggccag

SEQ ID NO: 12496 - DNA, 20 bp, Artificial Sequence
  Description of Artificial Sequence: Synthetic oligonucleotide
  Target: FXN; (-) strand; PAM type: NRG; PAM sequence: CAG
ctttcatttgtctatgtggc

SEQ ID NO: 12497 - DNA, 20 bp, Artificial Sequence
  Description of Artificial Sequence: Synthetic oligonucleotide
  Target: FXN; (-) strand; PAM type: NRG; PAM sequence: TGG
actgctttcatttgtctatg

SEQ ID NO: 12498 - DNA, 20 bp, Artificial Sequence
  Description of Artificial Sequence: Synthetic oligonucleotide
  Target: FXN; (-) strand; PAM type: NRG; PAM sequence: TGG
gatgtcctcttgggtgtatc

SEQ ID NO: 12499 - DNA, 20 bp, Artificial Sequence
  Description of Artificial Sequence: Synthetic oligonucleotide
  Target: FXN; (-) strand; PAM type: NRG; PAM sequence: GGG
aaaagaacagatgtcctctt

SEQ ID NO: 12500 - DNA, 20 bp, Artificial Sequence
  Description of Artificial Sequence: Synthetic oligonucleotide
  Target: FXN; (-) strand; PAM type: NRG; PAM sequence: TGG
aaaaagaacagatgtcctct

SEQ ID NO: 12501 - DNA, 20 bp, Artificial Sequence
  Description of Artificial Sequence: Synthetic oligonucleotide
  Target: FXN; (-) strand; PAM type: NRG; PAM sequence: CAG
tccacagagagaaaaaagaa

SEQ ID NO: 12502 - DNA, 20 bp, Artificial Sequence
  Description of Artificial Sequence: Synthetic oligonucleotide
  Target: FXN; (-) strand; PAM type: NRG; PAM sequence: AAG
cccactccacagagagaaaa

SEQ ID NO: 12503 - DNA, 20 bp, Artificial Sequence
  Description of Artificial Sequence: Synthetic oligonucleotide
  Target: FXN; (-) strand; PAM type: NRG; PAM sequence: GAG
taagtctcccactccacaga

SEQ ID NO: 12504 - DNA, 20 bp, Artificial Sequence
  Description of Artificial Sequence: Synthetic oligonucleotide
  Target: FXN; (-) strand; PAM type: NRG; PAM sequence: GAG
cttaagtctcccactccaca

SEQ ID NO: 12505 - DNA, 20 bp, Artificial Sequence
  Description of Artificial Sequence: Synthetic oligonucleotide
  Target: FXN; (-) strand; PAM type: NRG; PAM sequence: CAG
cacttaagtctcccactcca

SEQ ID NO: 12506 - DNA, 20 bp, Artificial Sequence
  Description of Artificial Sequence: Synthetic oligonucleotide
  Target: FXN; (-) strand; PAM type: NRG; PAM sequence: AAG
caccagttaagaagccactt

SEQ ID NO: 12507 - DNA, 20 bp, Artificial Sequence
  Description of Artificial Sequence: Synthetic oligonucleotide
  Target: FXN; (-) strand; PAM type: NRG; PAM sequence: AAG
cagacgacacaccagttaag

SEQ ID NO: 12508 - DNA, 20 bp, Artificial Sequence
  Description of Artificial Sequence: Synthetic oligonucleotide
  Target: FXN; (-) strand; PAM type: NRG; PAM sequence: AAG
gatcagacgacacaccagtt

SEQ ID NO: 12509 - DNA, 20 bp, Artificial Sequence
  Description of Artificial Sequence: Synthetic oligonucleotide
  Target: FXN; (-) strand; PAM type: NRG; PAM sequence: CAG
cacttgatcagacgacacac

SEQ ID NO: 12510 - DNA, 20 bp, Artificial Sequence
  Description of Artificial Sequence: Synthetic oligonucleotide
  Target: FXN; (-) strand; PAM type: NRG; PAM sequence: CAG
tgttacctggaccacttgat

SEQ ID NO: 12511 - DNA, 20 bp, Artificial Sequence
  Description of Artificial Sequence: Synthetic oligonucleotide
  Target: FXN; (-) strand; PAM type: NRG; PAM sequence: TGG
attggcatccacctgttacc

SEQ ID NO: 12512 - DNA, 20 bp, Artificial Sequence
  Description of Artificial Sequence: Synthetic oligonucleotide
  Target: FXN; (-) strand; PAM type: NRG; PAM sequence: TGG
gtgatgcctgggccagacat

SEQ ID NO: 12513 - DNA, 20 bp, Artificial Sequence
  Description of Artificial Sequence: Synthetic oligonucleotide
  Target: FXN; (-) strand; PAM type: NRG; PAM sequence: CAG
gtaaggggtgatgcctgggc

SEQ ID NO: 12514 - DNA, 20 bp, Artificial Sequence
  Description of Artificial Sequence: Synthetic oligonucleotide
  Target: FXN; (-) strand; PAM type: NRG; PAM sequence: GGG
gccagtaaggggtgatgcct

SEQ ID NO: 12515 - DNA, 20 bp, Artificial Sequence
  Description of Artificial Sequence: Synthetic oligonucleotide
  Target: FXN; (-) strand; PAM type: NRG; PAM sequence: TGG
tgccagtaaggggtgatgcc

SEQ ID NO: 12516 - DNA, 20 bp, Artificial Sequence
  Description of Artificial Sequence: Synthetic oligonucleotide
  Target: FXN; (-) strand; PAM type: NRG; PAM sequence: GGG
taatgaccagtgccagtaag

SEQ ID NO: 12517 - DNA, 20 bp, Artificial Sequence
  Description of Artificial Sequence: Synthetic oligonucleotide
  Target: FXN; (-) strand; PAM type: NRG; PAM sequence: GGG
gtaatgaccagtgccagtaa

SEQ ID NO: 12518 - DNA, 20 bp, Artificial Sequence
  Description of Artificial Sequence: Synthetic oligonucleotide
  Target: FXN; (-) strand; PAM type: NRG; PAM sequence: AGG
tgtaatgaccagtgccagta

SEQ ID NO: 12519 - DNA, 20 bp, Artificial Sequence
  Description of Artificial Sequence: Synthetic oligonucleotide
  Target: FXN; (-) strand; PAM type: NRG; PAM sequence: AAG
ctgtaatgaccagtgccagt

SEQ ID NO: 12520 - DNA, 20 bp, Artificial Sequence
  Description of Artificial Sequence: Synthetic oligonucleotide
  Target: FXN; (-) strand; PAM type: NRG; PAM sequence: CAG
tcttctgtaatgaccagtgc

SEQ ID NO: 12521 - DNA, 20 bp, Artificial Sequence
  Description of Artificial Sequence: Synthetic oligonucleotide
  Target: FXN; (-) strand; PAM type: NRG; PAM sequence: CAG
agagtgtcttctgtaatgac

SEQ ID NO: 12522 - DNA, 20 bp, Artificial Sequence
  Description of Artificial Sequence: Synthetic oligonucleotide
  Target: FXN; (-) strand; PAM type: NRG; PAM sequence: GAG
aggtcctttcagctctggta

SEQ ID NO: 12523 - DNA, 20 bp, Artificial Sequence
  Description of Artificial Sequence: Synthetic oligonucleotide
  Target: FXN; (-) strand; PAM type: NRG; PAM sequence: TAG
agaggtcctttcagctctgg

SEQ ID NO: 12524 - DNA, 20 bp, Artificial Sequence
  Description of Artificial Sequence: Synthetic oligonucleotide
  Target: FXN; (-) strand; PAM type: NRG; PAM sequence: TGG
acaagaggtcctttcagctc

SEQ ID NO: 12525 - DNA, 20 bp, Artificial Sequence
  Description of Artificial Sequence: Synthetic oligonucleotide
  Target: FXN; (-) strand; PAM type: NRG; PAM sequence: CAG
ctagtgacaagaggtccttt

SEQ ID NO: 12526 - DNA, 20 bp, Artificial Sequence
  Description of Artificial Sequence: Synthetic oligonucleotide
  Target: FXN; (-) strand; PAM type: NRG; PAM sequence: AGG
cacagctgcctagtgacaag

SEQ ID NO: 12527 - DNA, 20 bp, Artificial Sequence
  Description of Artificial Sequence: Synthetic oligonucleotide
  Target: FXN; (-) strand; PAM type: NRG; PAM sequence: GAG
ccacagctgcctagtgacaa

SEQ ID NO: 12528 - DNA, 20 bp, Artificial Sequence
  Description of Artificial Sequence: Synthetic oligonucleotide
  Target: FXN; (-) strand; PAM type: NRG; PAM sequence: AAG
ctccacagctgcctagtgac

SEQ ID NO: 12529 - DNA, 20 bp, Artificial Sequence
  Description of Artificial Sequence: Synthetic oligonucleotide
  Target: FXN; (-) strand; PAM type: NRG; PAM sequence: TAG
gagcggactccacagctgcc

SEQ ID NO: 12530 - DNA, 20 bp, Artificial Sequence
  Description of Artificial Sequence: Synthetic oligonucleotide
  Target: FXN; (-) strand; PAM type: NRG; PAM sequence: CAG
gtcaagtagagcggactcca

SEQ ID NO: 12531 - DNA, 20 bp, Artificial Sequence
  Description of Artificial Sequence: Synthetic oligonucleotide
  Target: FXN; (-) strand; PAM type: NRG; PAM sequence: CGG
ttttactaggtcaagtagag

SEQ ID NO: 12532 - DNA, 20 bp, Artificial Sequence
  Description of Artificial Sequence: Synthetic oligonucleotide
  Target: FXN; (-) strand; PAM type: NRG; PAM sequence: GAG
agattttactaggtcaagta

SEQ ID NO: 12533 - DNA, 20 bp, Artificial Sequence
  Description of Artificial Sequence: Synthetic oligonucleotide
  Target: FXN; (-) strand; PAM type: NRG; PAM sequence: TAG
gcagattttactaggtcaag

SEQ ID NO: 12534 - DNA, 20 bp, Artificial Sequence
  Description of Artificial Sequence: Synthetic oligonucleotide
  Target: FXN; (-) strand; PAM type: NRG; PAM sequence: AAG
caggcagattttactaggtc

SEQ ID NO: 12535 - DNA, 20 bp, Artificial Sequence
  Description of Artificial Sequence: Synthetic oligonucleotide
  Target: FXN; (-) strand; PAM type: NRG; PAM sequence: AGG
gtctccaggcagattttact

SEQ ID NO: 12536 - DNA, 20 bp, Artificial Sequence
  Description of Artificial Sequence: Synthetic oligonucleotide
  Target: FXN; (-) strand; PAM type: NRG; PAM sequence: TAG
agtctccaggcagattttac

SEQ ID NO: 12537 - DNA, 20 bp, Artificial Sequence
  Description of Artificial Sequence: Synthetic oligonucleotide
  Target: FXN; (-) strand; PAM type: NRG; PAM sequence: CAG
tgactctaacagtctccagg

SEQ ID NO: 12538 - DNA, 20 bp, Artificial Sequence
  Description of Artificial Sequence: Synthetic oligonucleotide
  Target: FXN; (-) strand; PAM type: NRG; PAM sequence: AGG
gggtgactctaacagtctcc

SEQ ID NO: 12539 - DNA, 20 bp, Artificial Sequence
  Description of Artificial Sequence: Synthetic oligonucleotide
  Target: FXN; (-) strand; PAM type: NRG; PAM sequence: CAG
ggggtgactctaacagtctc

SEQ ID NO: 12540 - DNA, 20 bp, Artificial Sequence
  Description of Artificial Sequence: Synthetic oligonucleotide
  Target: FXN; (-) strand; PAM type: NRG; PAM sequence: CAG
aggtagtggggtgactctaa

SEQ ID NO: 12541 - DNA, 20 bp, Artificial Sequence
  Description of Artificial Sequence: Synthetic oligonucleotide
  Target: FXN; (-) strand; PAM type: NRG; PAM sequence: GGG
ggaggtaacttcaggtagtg

SEQ ID NO: 12542 - DNA, 20 bp, Artificial Sequence
  Description of Artificial Sequence: Synthetic oligonucleotide
  Target: FXN; (-) strand; PAM type: NRG; PAM sequence: GGG
tggaggtaacttcaggtagt

SEQ ID NO: 12543 - DNA, 20 bp, Artificial Sequence
  Description of Artificial Sequence: Synthetic oligonucleotide
  Target: FXN; (-) strand; PAM type: NRG; PAM sequence: TGG
ctggaggtaacttcaggtag

SEQ ID NO: 12544 - DNA, 20 bp, Artificial Sequence
  Description of Artificial Sequence: Synthetic oligonucleotide
  Target: FXN; (-) strand; PAM type: NRG; PAM sequence: TAG
agcctggaggtaacttcagg

SEQ ID NO: 12545 - DNA, 20 bp, Artificial Sequence
  Description of Artificial Sequence: Synthetic oligonucleotide
  Target: FXN; (-) strand; PAM type: NRG; PAM sequence: AGG
gtcagcctggaggtaacttc

SEQ ID NO: 12546 - DNA, 20 bp, Artificial Sequence
  Description of Artificial Sequence: Synthetic oligonucleotide
  Target: FXN; (-) strand; PAM type: NRG; PAM sequence: CAG
ggtcagcctggaggtaactt

SEQ ID NO: 12547 - DNA, 20 bp, Artificial Sequence
  Description of Artificial Sequence: Synthetic oligonucleotide
  Target: FXN; (-) strand; PAM type: NRG; PAM sequence: AGG
aaaaaaagaggtcagcctgg

SEQ ID NO: 12548 - DNA, 20 bp, Artificial Sequence
  Description of Artificial Sequence: Synthetic oligonucleotide
  Target: FXN; (-) strand; PAM type: NRG; PAM sequence: GAG
aaaaaaaagaggtcagcctg

SEQ ID NO: 12549 - DNA, 20 bp, Artificial Sequence
  Description of Artificial Sequence: Synthetic oligonucleotide
  Target: FXN; (-) strand; PAM type: NRG; PAM sequence: TGG
ggaaaaaaaagaggtcagcc

SEQ ID NO: 12550 - DNA, 20 bp, Artificial Sequence
  Description of Artificial Sequence: Synthetic oligonucleotide
  Target: FXN; (-) strand; PAM type: NRG; PAM sequence: CAG
acctgggaaaaaaaagaggt

SEQ ID NO: 12551 - DNA, 20 bp, Artificial Sequence
  Description of Artificial Sequence: Synthetic oligonucleotide
  Target: FXN; (-) strand; PAM type: NRG; PAM sequence: AGG
ctccacctgggaaaaaaaag

SEQ ID NO: 12552 - DNA, 20 bp, Artificial Sequence
  Description of Artificial Sequence: Synthetic oligonucleotide
  Target: FXN; (-) strand; PAM type: NRG; PAM sequence: GAG
actccacctgggaaaaaaaa

SEQ ID NO: 12553 - DNA, 20 bp, Artificial Sequence
  Description of Artificial Sequence: Synthetic oligonucleotide
  Target: FXN; (-) strand; PAM type: NRG; PAM sequence: AAG
ggactccacctgggaaaaaa

SEQ ID NO: 12554 - DNA, 20 bp, Artificial Sequence
  Description of Artificial Sequence: Synthetic oligonucleotide
  Target: FXN; (-) strand; PAM type: NRG; PAM sequence: GGG
aagatgccaggactccacct

SEQ ID NO: 12555 - DNA, 20 bp, Artificial Sequence
  Description of Artificial Sequence: Synthetic oligonucleotide
  Target: FXN; (-) strand; PAM type: NRG; PAM sequence: TGG
taagatgccaggactccacc

SEQ ID NO: 12556 - DNA, 20 bp, Artificial Sequence
  Description of Artificial Sequence: Synthetic oligonucleotide
  Target: FXN; (-) strand; PAM type: NRG; PAM sequence: AGG
attaaaatatctaagatgcc

SEQ ID NO: 12557 - DNA, 20 bp, Artificial Sequence
  Description of Artificial Sequence: Synthetic oligonucleotide
  Target: FXN; (-) strand; PAM type: NRG; PAM sequence: CAG
tattaaaatatctaagatgc

SEQ ID NO: 12558 - DNA, 20 bp, Artificial Sequence
  Description of Artificial Sequence: Synthetic oligonucleotide
  Target: FXN; (-) strand; PAM type: NRG; PAM sequence: AAG
aaatccttattaaaatatct

SEQ ID NO: 12559 - DNA, 20 bp, Artificial Sequence
  Description of Artificial Sequence: Synthetic oligonucleotide
  Target: FXN; (-) strand; PAM type: NRG; PAM sequence: AAG
tgaataaagaacatgtcaac

SEQ ID NO: 12560 - DNA, 20 bp, Artificial Sequence
  Description of Artificial Sequence: Synthetic oligonucleotide
  Target: FXN; (-) strand; PAM type: NRG; PAM sequence: AAG
tgctgacaccttagtgaata

SEQ ID NO: 12561 - DNA, 20 bp, Artificial Sequence
  Description of Artificial Sequence: Synthetic oligonucleotide
  Target: FXN; (-) strand; PAM type: NRG; PAM sequence: TAG
acagtaatatgctgacacct

SEQ ID NO: 12562 - DNA, 20 bp, Artificial Sequence
  Description of Artificial Sequence: Synthetic oligonucleotide
  Target: FXN; (-) strand; PAM type: NRG; PAM sequence: CAG
aagaaccctcagttctaaga

SEQ ID NO: 12563 - DNA, 20 bp, Artificial Sequence
  Description of Artificial Sequence: Synthetic oligonucleotide
  Target: FXN; (-) strand; PAM type: NRG; PAM sequence: AAG
gatgaagaaccctcagttct

SEQ ID NO: 12564 - DNA, 20 bp, Artificial Sequence
  Description of Artificial Sequence: Synthetic oligonucleotide
  Target: FXN; (-) strand; PAM type: NRG; PAM sequence: CAG
caaaaaagatgaagaaccct

SEQ ID NO: 12565 - DNA, 20 bp, Artificial Sequence
  Description of Artificial Sequence: Synthetic oligonucleotide
  Target: FXN; (-) strand; PAM type: NRG; PAM sequence: AAG
gtcctgatccaaaaaagatg

SEQ ID NO: 12566 - DNA, 20 bp, Artificial Sequence
  Description of Artificial Sequence: Synthetic oligonucleotide
  Target: FXN; (-) strand; PAM type: NRG; PAM sequence: AAG
agggaggtcctgatccaaaa

SEQ ID NO: 12567 - DNA, 20 bp, Artificial Sequence
  Description of Artificial Sequence: Synthetic oligonucleotide
  Target: FXN; (-) strand; PAM type: NRG; PAM sequence: AGG
gtcatcagattcttagaggg

SEQ ID NO: 12568 - DNA, 20 bp, Artificial Sequence
  Description of Artificial Sequence: Synthetic oligonucleotide
  Target: FXN; (-) strand; PAM type: NRG; PAM sequence: GAG
agtcatcagattcttagagg

SEQ ID NO: 12569 - DNA, 20 bp, Artificial Sequence
  Description of Artificial Sequence: Synthetic oligonucleotide
  Target: FXN; (-) strand; PAM type: NRG; PAM sequence: GGG
gcagtcatcagattcttaga

SEQ ID NO: 12570 - DNA, 20 bp, Artificial Sequence
  Description of Artificial Sequence: Synthetic oligonucleotide
  Target: FXN; (-) strand; PAM type: NRG; PAM sequence: AGG
agcagtcatcagattcttag

SEQ ID NO: 12571 - DNA, 20 bp, Artificial Sequence
  Description of Artificial Sequence: Synthetic oligonucleotide
  Target: FXN; (-) strand; PAM type: NRG; PAM sequence: GAG
gagcagtcatcagattctta

SEQ ID NO: 12572 - DNA, 20 bp, Artificial Sequence
  Description of Artificial Sequence: Synthetic oligonucleotide
  Target: FXN; (-) strand; PAM type: NRG; PAM sequence: TAG
cagagcagtcatcagattct

SEQ ID NO: 12573 - DNA, 20 bp, Artificial Sequence
  Description of Artificial Sequence: Synthetic oligonucleotide
  Target: FXN; (-) strand; PAM type: NRG; PAM sequence: CAG
agagggaccagagcagtcat

SEQ ID NO: 12574 - DNA, 20 bp, Artificial Sequence
  Description of Artificial Sequence: Synthetic oligonucleotide
  Target: FXN; (-) strand; PAM type: NRG; PAM sequence: CAG
tattgggagagggaccagag

SEQ ID NO: 12575 - DNA, 20 bp, Artificial Sequence
  Description of Artificial Sequence: Synthetic oligonucleotide
  Target: FXN; (-) strand; PAM type: NRG; PAM sequence: GAG
ttttattgggagagggacca

SEQ ID NO: 12576 - DNA, 20 bp, Artificial Sequence
  Description of Artificial Sequence: Synthetic oligonucleotide
  Target: FXN; (-) strand; PAM type: NRG; PAM sequence: CAG
gtttttattgggagagggac

SEQ ID NO: 12577 - DNA, 20 bp, Artificial Sequence
  Description of Artificial Sequence: Synthetic oligonucleotide
  Target: FXN; (-) strand; PAM type: NRG; PAM sequence: GGG
tggaagtttttattgggaga

SEQ ID NO: 12578 - DNA, 20 bp, Artificial Sequence
  Description of Artificial Sequence: Synthetic oligonucleotide
  Target: FXN; (-) strand; PAM type: NRG; PAM sequence: AGG
atggaagtttttattgggag

SEQ ID NO: 12579 - DNA, 20 bp, Artificial Sequence
  Description of Artificial Sequence: Synthetic oligonucleotide
  Target: FXN; (-) strand; PAM type: NRG; PAM sequence: GAG
tatggaagtttttattggga

SEQ ID NO: 12580 - DNA, 20 bp, Artificial Sequence
  Description of Artificial Sequence: Synthetic oligonucleotide
  Target: FXN; (-) strand; PAM type: NRG; PAM sequence: GAG
agtatggaagtttttattgg

SEQ ID NO: 12581 - DNA, 20 bp, Artificial Sequence
  Description of Artificial Sequence: Synthetic oligonucleotide
  Target: FXN; (-) strand; PAM type: NRG; PAM sequence: GGG
tgagtatggaagtttttatt

SEQ ID NO: 12582 - DNA, 20 bp, Artificial Sequence
  Description of Artificial Sequence: Synthetic oligonucleotide
  Target: FXN; (-) strand; PAM type: NRG; PAM sequence: TGG
gtgagtatggaagtttttat

SEQ ID NO: 12583 - DNA, 20 bp, Artificial Sequence
  Description of Artificial Sequence: Synthetic oligonucleotide
  Target: FXN; (-) strand; PAM type: NRG; PAM sequence: AAG
tttttaacaggtgagtatgg

SEQ ID NO: 12584 - DNA, 20 bp, Artificial Sequence
  Description of Artificial Sequence: Synthetic oligonucleotide
  Target: FXN; (-) strand; PAM type: NRG; PAM sequence: TGG
ttttttttaacaggtgagta

SEQ ID NO: 12585 - DNA, 20 bp, Artificial Sequence
  Description of Artificial Sequence: Synthetic oligonucleotide
  Target: FXN; (-) strand; PAM type: NRG; PAM sequence: GAG
tttttttttttttaacaggt

SEQ ID NO: 12586 - DNA, 20 bp, Artificial Sequence
  Description of Artificial Sequence: Synthetic oligonucleotide
  Target: FXN; (-) strand; PAM type: NRG; PAM sequence: AGG
aagttttttttttttttaac

SEQ ID NO: 12587 - DNA, 20 bp, Artificial Sequence
  Description of Artificial Sequence: Synthetic oligonucleotide
  Target: FXN; (-) strand; PAM type: NRG; PAM sequence: CAG
aaagttttttttttttttaa

SEQ ID NO: 12588 - DNA, 20 bp, Artificial Sequence
  Description of Artificial Sequence: Synthetic oligonucleotide
  Target: FXN; (-) strand; PAM type: NRG; PAM sequence: AAG
aaactctgttaatttgttta

SEQ ID NO: 12589 - DNA, 20 bp, Artificial Sequence
  Description of Artificial Sequence: Synthetic oligonucleotide
  Target: FXN; (-) strand; PAM type: NRG; PAM sequence: CAG
ctctgaacctattctggttg

SEQ ID NO: 12590 - DNA, 20 bp, Artificial Sequence
  Description of Artificial Sequence: Synthetic oligonucleotide
  Target: FXN; (-) strand; PAM type: NRG; PAM sequence: TGG
gagtctctctgaacctattc

SEQ ID NO: 12591 - DNA, 20 bp, Artificial Sequence
  Description of Artificial Sequence: Synthetic oligonucleotide
  Target: FXN; (-) strand; PAM type: NRG; PAM sequence: GAG
caaccacgtggcacaccgtg

SEQ ID NO: 12592 - DNA, 20 bp, Artificial Sequence
  Description of Artificial Sequence: Synthetic oligonucleotide
  Target: FXN; (-) strand; PAM type: NRG; PAM sequence: TGG
tccaaccacgtggcacaccg

SEQ ID NO: 12593 - DNA, 20 bp, Artificial Sequence
  Description of Artificial Sequence: Synthetic oligonucleotide
  Target: FXN; (-) strand; PAM type: NRG; PAM sequence: TGG
ctaaatcctctccaaccacg

SEQ ID NO: 12594 - DNA, 20 bp, Artificial Sequence
  Description of Artificial Sequence: Synthetic oligonucleotide
  Target: FXN; (-) strand; PAM type: NRG; PAM sequence: AGG
tgaggcaccgcaccagcacc

SEQ ID NO: 12595 - DNA, 20 bp, Artificial Sequence
  Description of Artificial Sequence: Synthetic oligonucleotide
  Target: FXN; (-) strand; PAM type: NRG; PAM sequence: CAG
gtgaggcaccgcaccagcac

SEQ ID NO: 12596 - DNA, 20 bp, Artificial Sequence
  Description of Artificial Sequence: Synthetic oligonucleotide
  Target: FXN; (-) strand; PAM type: NRG; PAM sequence: CAG
acaggcgtgaggcaccgcac

SEQ ID NO: 12597 - DNA, 20 bp, Artificial Sequence
  Description of Artificial Sequence: Synthetic oligonucleotide
  Target: FXN; (-) strand; PAM type: NRG; PAM sequence: AGG
gtgctgggattacaggcgtg

SEQ ID NO: 12598 - DNA, 20 bp, Artificial Sequence
  Description of Artificial Sequence: Synthetic oligonucleotide
  Target: FXN; (-) strand; PAM type: NRG; PAM sequence: GAG
agtgctgggattacaggcgt

SEQ ID NO: 12599 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctgggattac

SEQ ID NO: 12600 - DNA, 20 bp, Artificial Sequence
  Description of Artificial Sequence: Synthetic oligonucleotide
  Target: FXN; (-) strand; PAM type: NRG; PAM sequence: CAG
ctcccaaagtgctgggatta

SEQ ID NO: 12601 - DNA, 20 bp, Artificial Sequence
  Description of Artificial Sequence: Synthetic oligonucleotide
  Target: FXN; (-) strand; PAM type: NRG; PAM sequence: GGG
cctcggcctcccaaagtgct

SEQ ID NO: 12602 - DNA, 20 bp, Artificial Sequence
  Description of Artificial Sequence: Synthetic oligonucleotide
  Target: FXN; (-) strand; PAM type: NRG; PAM sequence: TGG
gcctcggcctcccaaagtgc

SEQ ID NO: 12603 - DNA, 20 bp, Artificial Sequence
  Description of Artificial Sequence: Synthetic oligonucleotide
  Target: FXN; (-) strand; PAM type: NRG; PAM sequence: AAG
ctgcccgcctcggcctccca

SEQ ID NO: 12604 - DNA, 20 bp, Artificial Sequence
  Description of Artificial Sequence: Synthetic oligonucleotide
  Target: FXN; (-) strand; PAM type: NRG; PAM sequence: CGG
acctcatgatctgcccgcct

SEQ ID NO: 12605 - DNA, 20 bp, Artificial Sequence
  Description of Artificial Sequence: Synthetic oligonucleotide
  Target: FXN; (-) strand; PAM type: NRG; PAM sequence: TGG
tttcaccgtgttagccagga

SEQ ID NO: 12606 - DNA, 20 bp, Artificial Sequence
  Description of Artificial Sequence: Synthetic oligonucleotide
  Target: FXN; (-) strand; PAM type: NRG; PAM sequence: AGG
agggtttcaccgtgttagcc

SEQ ID NO: 12607 - DNA, 20 bp, Artificial Sequence
  Description of Artificial Sequence: Synthetic oligonucleotide
  Target: FXN; (-) strand; PAM type: NRG; PAM sequence: CAG
cagggtttcaccgtgttagc

SEQ ID NO: 12608 - DNA, 20 bp, Artificial Sequence
  Description of Artificial Sequence: Synthetic oligonucleotide
  Target: FXN; (-) strand; PAM type: NRG; PAM sequence: TAG
gagacagggtttcaccgtgt

SEQ ID NO: 12609 - DNA, 20 bp, Artificial Sequence
  Description of Artificial Sequence: Synthetic oligonucleotide
  Target: FXN; (-) strand; PAM type: NRG; PAM sequence: GGG
ttgcatttttagtagagaca

SEQ ID NO: 12610 - DNA, 20 bp, Artificial Sequence
  Description of Artificial Sequence: Synthetic oligonucleotide
  Target: FXN; (-) strand; PAM type: NRG; PAM sequence: AGG
tttgcatttttagtagagac

SEQ ID NO: 12611 - DNA, 20 bp, Artificial Sequence
  Description of Artificial Sequence: Synthetic oligonucleotide
  Target: FXN; (-) strand; PAM type: NRG; PAM sequence: CAG
ttttgcatttttagtagaga

SEQ ID NO: 12612 - DNA, 20 bp, Artificial Sequence
  Description of Artificial Sequence: Synthetic oligonucleotide
  Target: FXN; (-) strand; PAM type: NRG; PAM sequence: GAG
aagtttttgcatttttagta

SEQ ID NO: 12613 - DNA, 20 bp, Artificial Sequence
  Description of Artificial Sequence: Synthetic oligonucleotide
  Target: FXN; (-) strand; PAM type: NRG; PAM sequence: TAG
ctaagtttttgcatttttag

SEQ ID NO: 12614 - DNA, 20 bp, Artificial Sequence
  Description of Artificial Sequence: Synthetic oligonucleotide
  Target: FXN; (-) strand; PAM type: NRG; PAM sequence: TAG
cggctaagtttttgcatttt

SEQ ID NO: 12615 - DNA, 20 bp, Artificial Sequence
  Description of Artificial Sequence: Synthetic oligonucleotide
  Target: FXN; (-) strand; PAM type: NRG; PAM sequence: AAG
gcctgccaccacgcccggct

SEQ ID NO: 12616 - DNA, 20 bp, Artificial Sequence
  Description of Artificial Sequence: Synthetic oligonucleotide
  Target: FXN; (-) strand; PAM type: NRG; PAM sequence: CGG
caggtgcctgccaccacgcc

SEQ ID NO: 12617 - DNA, 20 bp, Artificial Sequence
  Description of Artificial Sequence: Synthetic oligonucleotide
  Target: FXN; (-) strand; PAM type: NRG; PAM sequence: AGG
tcccaagtagctgggactac

SEQ ID NO: 12618 - DNA, 20 bp, Artificial Sequence
  Description of Artificial Sequence: Synthetic oligonucleotide
  Target: FXN; (-) strand; PAM type: NRG; PAM sequence: CAG
ctcccaagtagctgggacta

SEQ ID NO: 12619 - DNA, 20 bp, Artificial Sequence
  Description of Artificial Sequence: Synthetic oligonucleotide
  Target: FXN; (-) strand; PAM type: NRG; PAM sequence: GGG
cctcagcctcccaagtagct

SEQ ID NO: 12620 - DNA, 20 bp, Artificial Sequence
  Description of Artificial Sequence: Synthetic oligonucleotide
  Target: FXN; (-) strand; PAM type: NRG; PAM sequence: TGG
gcctcagcctcccaagtagc

SEQ ID NO: 12621 - DNA, 20 bp, Artificial Sequence
  Description of Artificial Sequence: Synthetic oligonucleotide
  Target: FXN; (-) strand; PAM type: NRG; PAM sequence: TAG
tcctgcctcagcctcccaag

SEQ ID NO: 12622 - DNA, 20 bp, Artificial Sequence
  Description of Artificial Sequence: Synthetic oligonucleotide
  Target: FXN; (-) strand; PAM type: NRG; PAM sequence: AAG
ttctcctgcctcagcctccc

SEQ ID NO: 12623 - DNA, 20 bp, Artificial Sequence
  Description of Artificial Sequence: Synthetic oligonucleotide
  Target: FXN; (-) strand; PAM type: NRG; PAM sequence: CAG
ttcacaccattctcctgcct

SEQ ID NO: 12624 - DNA, 20 bp, Artificial Sequence
  Description of Artificial Sequence: Synthetic oligonucleotide
  Target: FXN; (-) strand; PAM type: NRG; PAM sequence: AGG
cactgcaagctccgcctccc

SEQ ID NO: 12625 - DNA, 20 bp, Artificial Sequence
  Description of Artificial Sequence: Synthetic oligonucleotide
  Target: FXN; (-) strand; PAM type: NRG; PAM sequence: CAG
tcactgcaagctccgcctcc

SEQ ID NO: 12626 - DNA, 20 bp, Artificial Sequence
  Description of Artificial Sequence: Synthetic oligonucleotide
  Target: FXN; (-) strand; PAM type: NRG; PAM sequence: AAG
gcgggatcctggctcactgc

SEQ ID NO: 12627 - DNA, 20 bp, Artificial Sequence
  Description of Artificial Sequence: Synthetic oligonucleotide
  Target: FXN; (-) strand; PAM type: NRG; PAM sequence: TGG
ggagtgcagtggcgggatcc

SEQ ID NO: 12628 - DNA, 20 bp, Artificial Sequence
  Description of Artificial Sequence: Synthetic oligonucleotide
  Target: FXN; (-) strand; PAM type: NRG; PAM sequence: GGG
ccaggctggagtgcagtggc

SEQ ID NO: 12629 - DNA, 20 bp, Artificial Sequence
  Description of Artificial Sequence: Synthetic oligonucleotide
  Target: FXN; (-) strand; PAM type: NRG; PAM sequence: CGG
cccaggctggagtgcagtgg

SEQ ID NO: 12630 - DNA, 20 bp, Artificial Sequence
  Description of Artificial Sequence: Synthetic oligonucleotide
  Target: FXN; (-) strand; PAM type: NRG; PAM sequence: TGG
tcgcccaggctggagtgcag

SEQ ID NO: 12631 - DNA, 20 bp, Artificial Sequence
  Description of Artificial Sequence: Synthetic oligonucleotide
  Target: FXN; (-) strand; PAM type: NRG; PAM sequence: CAG
ctgtcgcccaggctggagtg

SEQ ID NO: 12632 - DNA, 20 bp, Artificial Sequence
  Description of Artificial Sequence: Synthetic oligonucleotide
  Target: FXN; (-) strand; PAM type: NRG; PAM sequence: GAG
tcgctctgtcgcccaggctg

SEQ ID NO: 12633 - DNA, 20 bp, Artificial Sequence
  Description of Artificial Sequence: Synthetic oligonucleotide
  Target: FXN; (-) strand; PAM type: NRG; PAM sequence: TGG
tctcgctctgtcgcccaggc

SEQ ID NO: 12634 - DNA, 20 bp, Artificial Sequence
  Description of Artificial Sequence: Synthetic oligonucleotide
  Target: FXN; (-) strand; PAM type: NRG; PAM sequence: AGG
gaagtctcgctctgtcgccc

SEQ ID NO: 12635 - DNA, 20 bp, Artificial Sequence
  Description of Artificial Sequence: Synthetic oligonucleotide
  Target: FXN; (-) strand; PAM type: NRG; PAM sequence: CAG
tgaagtctcgctctgtcgcc

SEQ ID NO: 12636 - DNA, 20 bp, Artificial Sequence
  Description of Artificial Sequence: Synthetic oligonucleotide
  Target: FXN; (-) strand; PAM type: NRG; PAM sequence: AAG
ttttctttttttttaagatg

SEQ ID NO: 12637 - DNA, 20 bp, Artificial Sequence
  Description of Artificial Sequence: Synthetic oligonucleotide
  Target: FXN; (-) strand; PAM type: NRG; PAM sequence: AAG
tttttcttttcttttttttt

SEQ ID NO: 12638 - DNA, 20 bp, Artificial Sequence
  Description of Artificial Sequence: Synthetic oligonucleotide
  Target: FXN; (-) strand; PAM type: NRG; PAM sequence: TGG
acaccaagctgtaaccaacc

SEQ ID NO: 12639 - DNA, 20 bp, Artificial Sequence
  Description of Artificial Sequence: Synthetic oligonucleotide
  Target: FXN; (-) strand; PAM type: NRG; PAM sequence: AAG
ccaagtttaaggcaaacacc

SEQ ID NO: 12640 - DNA, 20 bp, Artificial Sequence
  Description of Artificial Sequence: Synthetic oligonucleotide
  Target: FXN; (-) strand; PAM type: NRG; PAM sequence: AGG
aactgttcaaaccaagttta

SEQ ID NO: 12641 - DNA, 20 bp, Artificial Sequence
  Description of Artificial Sequence: Synthetic oligonucleotide
  Target: FXN; (-) strand; PAM type: NRG; PAM sequence: AAG
caactgttcaaaccaagttt

SEQ ID NO: 12642 - DNA, 20 bp, Artificial Sequence
  Description of Artificial Sequence: Synthetic oligonucleotide
  Target: FXN; (-) strand; PAM type: NRG; PAM sequence: AAG
ggcggccaactgttcaaacc

SEQ ID NO: 12643 - DNA, 20 bp, Artificial Sequence
  Description of Artificial Sequence: Synthetic oligonucleotide
  Target: FXN; (-) strand; PAM type: NRG; PAM sequence: CGG
gagttttggctaatcaaagg

SEQ ID NO: 12644 - DNA, 20 bp, Artificial Sequence
  Description of Artificial Sequence: Synthetic oligonucleotide
  Target: FXN; (-) strand; PAM type: NRG; PAM sequence: AGG
accgagttttggctaatcaa

SEQ ID NO: 12645 - DNA, 20 bp, Artificial Sequence
  Description of Artificial Sequence: Synthetic oligonucleotide
  Target: FXN; (-) strand; PAM type: NRG; PAM sequence: AAG
caccgagttttggctaatca

SEQ ID NO: 12646 - DNA, 20 bp, Artificial Sequence
  Description of Artificial Sequence: Synthetic oligonucleotide
  Target: FXN; (-) strand; PAM type: NRG; PAM sequence: TGG
ttgtaccaatcaccgagttt

SEQ ID NO: 12647 - DNA, 20 bp, Artificial Sequence
  Description of Artificial Sequence: Synthetic oligonucleotide
  Target: FXN; (-) strand; PAM type: NRG; PAM sequence: GAG
ctactcttgtaccaatcacc

SEQ ID NO: 12648 - DNA, 20 bp, Artificial Sequence
  Description of Artificial Sequence: Synthetic oligonucleotide
  Target: FXN; (-) strand; PAM type: NRG; PAM sequence: TAG
tctaagggcttctctgtaca

SEQ ID NO: 12649 - DNA, 20 bp, Artificial Sequence
  Description of Artificial Sequence: Synthetic oligonucleotide
  Target: FXN; (-) strand; PAM type: NRG; PAM sequence: GGG
tattttgagttcggatctaa

SEQ ID NO: 12650 - DNA, 20 bp, Artificial Sequence
  Description of Artificial Sequence: Synthetic oligonucleotide
  Target: FXN; (-) strand; PAM type: NRG; PAM sequence: AGG
ctattttgagttcggatcta

SEQ ID NO: 12651 - DNA, 20 bp, Artificial Sequence
  Description of Artificial Sequence: Synthetic oligonucleotide
  Target: FXN; (-) strand; PAM type: NRG; PAM sequence: AAG
cctattttgagttcggatct

SEQ ID NO: 12652 - DNA, 20 bp, Artificial Sequence
  Description of Artificial Sequence: Synthetic oligonucleotide
  Target: FXN; (-) strand; PAM type: NRG; PAM sequence: CGG
ctccttacctattttgagtt

SEQ ID NO: 12653 - DNA, 20 bp, Artificial Sequence
  Description of Artificial Sequence: Synthetic oligonucleotide
  Target: FXN; (-) strand; PAM type: NRG; PAM sequence: GAG
actgcctccttacctatttt

SEQ ID NO: 12654 - DNA, 20 bp, Artificial Sequence
  Description of Artificial Sequence: Synthetic oligonucleotide
  Target: FXN; (-) strand; PAM type: NRG; PAM sequence: TAG
tgagtatgttaacttaagtg

SEQ ID NO: 12655 - DNA, 20 bp, Artificial Sequence
  Description of Artificial Sequence: Synthetic oligonucleotide
  Target: FXN; (-) strand; PAM type: NRG; PAM sequence: AAG
actcctgagtatgttaactt

SEQ ID NO: 12656 - DNA, 20 bp, Artificial Sequence
  Description of Artificial Sequence: Synthetic oligonucleotide
  Target: FXN; (-) strand; PAM type: NRG; PAM sequence: GAG
gaagctggaatggtactcct

SEQ ID NO: 12657 - DNA, 20 bp, Artificial Sequence
  Description of Artificial Sequence: Synthetic oligonucleotide
  Target: FXN; (-) strand; PAM type: NRG; PAM sequence: TGG
cttccagcttgaagctggaa

SEQ ID NO: 12658 - DNA, 20 bp, Artificial Sequence
  Description of Artificial Sequence: Synthetic oligonucleotide
  Target: FXN; (-) strand; PAM type: NRG; PAM sequence: TGG
agacacttccagcttgaagc

SEQ ID NO: 12659 - DNA, 20 bp, Artificial Sequence
  Description of Artificial Sequence: Synthetic oligonucleotide
  Target: FXN; (-) strand; PAM type: NRG; PAM sequence: AAG
ctgcagacacttccagcttg

SEQ ID NO: 12660 - DNA, 20 bp, Artificial Sequence
  Description of Artificial Sequence: Synthetic oligonucleotide
  Target: FXN; (-) strand; PAM type: NRG; PAM sequence: CAG
cagggggctgcagacacttc

SEQ ID NO: 12661 - DNA, 20 bp, Artificial Sequence
  Description of Artificial Sequence: Synthetic oligonucleotide
  Target: FXN; (-) strand; PAM type: NRG; PAM sequence: CAG
taagtggtctcagggggctg

SEQ ID NO: 12662 - DNA, 20 bp, Artificial Sequence
  Description of Artificial Sequence: Synthetic oligonucleotide
  Target: FXN; (-) strand; PAM type: NRG; PAM sequence: GGG
tgggattaagtggtctcagg

SEQ ID NO: 12663 - DNA, 20 bp, Artificial Sequence
  Description of Artificial Sequence: Synthetic oligonucleotide
  Target: FXN; (-) strand; PAM type: NRG; PAM sequence: GGG
ttgggattaagtggtctcag

SEQ ID NO: 12664 - DNA, 20 bp, Artificial Sequence
  Description of Artificial Sequence: Synthetic oligonucleotide
  Target: FXN; (-) strand; PAM type: NRG; PAM sequence: GGG
cttgggattaagtggtctca

SEQ ID NO: 12665 - DNA, 20 bp, Artificial Sequence
  Description of Artificial Sequence: Synthetic oligonucleotide
  Target: FXN; (-) strand; PAM type: NRG; PAM sequence: AGG
acttgggattaagtggtctc

SEQ ID NO: 12666 - DNA, 20 bp, Artificial Sequence
  Description of Artificial Sequence: Synthetic oligonucleotide
  Target: FXN; (-) strand; PAM type: NRG; PAM sequence: CAG
aacttgggattaagtggtct

SEQ ID NO: 12667 - DNA, 20 bp, Artificial Sequence
  Description of Artificial Sequence: Synthetic oligonucleotide
  Target: FXN; (-) strand; PAM type: NRG; PAM sequence: TGG
gtttttaacttgggattaag

SEQ ID NO: 12668 - DNA, 20 bp, Artificial Sequence
  Description of Artificial Sequence: Synthetic oligonucleotide
  Target: FXN; (-) strand; PAM type: NRG; PAM sequence: AAG
ggggtttttaacttgggatt

SEQ ID NO: 12669 - DNA, 20 bp, Artificial Sequence
  Description of Artificial Sequence: Synthetic oligonucleotide
  Target: FXN; (-) strand; PAM type: NRG; PAM sequence: GGG
tgagcaggggtttttaactt

SEQ ID NO: 12670 - DNA, 20 bp, Artificial Sequence
  Description of Artificial Sequence: Synthetic oligonucleotide
  Target: FXN; (-) strand; PAM type: NRG; PAM sequence: TGG
ctgagcaggggtttttaact

SEQ ID NO: 12671 - DNA, 20 bp, Artificial Sequence
  Description of Artificial Sequence: Synthetic oligonucleotide
  Target: FXN; (-) strand; PAM type: NRG; PAM sequence: GGG
aagatgctgcctctgagcag

SEQ ID NO: 12672 - DNA, 20 bp, Artificial Sequence
  Description of Artificial Sequence: Synthetic oligonucleotide
  Target: FXN; (-) strand; PAM type: NRG; PAM sequence: GGG
aaagatgctgcctctgagca

SEQ ID NO: 12673 - DNA, 20 bp, Artificial Sequence
  Description of Artificial Sequence: Synthetic oligonucleotide
  Target: FXN; (-) strand; PAM type: NRG; PAM sequence: AGG
aaaagatgctgcctctgagc

SEQ ID NO: 12674 - DNA, 20 bp, Artificial Sequence
  Description of Artificial Sequence: Synthetic oligonucleotide
  Target: FXN; (-) strand; PAM type: NRG; PAM sequence: CAG
aaaaagatgctgcctctgag

SEQ ID NO: 12675 - DNA, 20 bp, Artificial Sequence
  Description of Artificial Sequence: Synthetic oligonucleotide
  Target: FXN; (-) strand; PAM type: NRG; PAM sequence: GAG
aaaaaaaagatgctgcctct

SEQ ID NO: 12676 - DNA, 20 bp, Artificial Sequence
  Description of Artificial Sequence: Synthetic oligonucleotide
  Target: FXN; (-) strand; PAM type: NRG; PAM sequence: AAG
aaaaaaaaaaaaaaaaaaaa

SEQ ID NO: 12677 - DNA, 20 bp, Artificial Sequence
  Description of Artificial Sequence: Synthetic oligonucleotide
  Target: FXN; (-) strand; PAM type: NRG; PAM sequence: GAG
tccagcctgggtgacagagt

SEQ ID NO: 12678 - DNA, 20 bp, Artificial Sequence
  Description of Artificial Sequence: Synthetic oligonucleotide
  Target: FXN; (-) strand; PAM type: NRG; PAM sequence: GAG
gcactccagcctgggtgaca

SEQ ID NO: 12679 - DNA, 20 bp, Artificial Sequence
  Description of Artificial Sequence: Synthetic oligonucleotide
  Target: FXN; (-) strand; PAM type: NRG; PAM sequence: CAG
ctgcactccagcctgggtga

SEQ ID NO: 12680 - DNA, 20 bp, Artificial Sequence
  Description of Artificial Sequence: Synthetic oligonucleotide
  Target: FXN; (-) strand; PAM type: NRG; PAM sequence: GGG
gtgccactgcactccagcct

SEQ ID NO: 12681 - DNA, 20 bp, Artificial Sequence
  Description of Artificial Sequence: Synthetic oligonucleotide
  Target: FXN; (-) strand; PAM type: NRG; PAM sequence: TGG
cgtgccactgcactccagcc

SEQ ID NO: 12682 - DNA, 20 bp, Artificial Sequence
  Description of Artificial Sequence: Synthetic oligonucleotide
  Target: FXN; (-) strand; PAM type: NRG; PAM sequence: CAG
gagatcgtgccactgcactc

SEQ ID NO: 12683 - DNA, 20 bp, Artificial Sequence
  Description of Artificial Sequence: Synthetic oligonucleotide
  Target: FXN; (-) strand; PAM type: NRG; PAM sequence: GAG
ggtggtggttgcagtgagct

SEQ ID NO: 12684 - DNA, 20 bp, Artificial Sequence
  Description of Artificial Sequence: Synthetic oligonucleotide
  Target: FXN; (-) strand; PAM type: NRG; PAM sequence: GAG
caggaggtggtggttgcagt

SEQ ID NO: 12685 - DNA, 20 bp, Artificial Sequence
  Description of Artificial Sequence: Synthetic oligonucleotide
  Target: FXN; (-) strand; PAM type: NRG; PAM sequence: CAG
agcccaggaggtggtggttg

SEQ ID NO: 12686 - DNA, 20 bp, Artificial Sequence
  Description of Artificial Sequence: Synthetic oligonucleotide
  Target: FXN; (-) strand; PAM type: NRG; PAM sequence: TGG
cccttgagcccaggaggtgg

SEQ ID NO: 12687 - DNA, 20 bp, Artificial Sequence
  Description of Artificial Sequence: Synthetic oligonucleotide
  Target: FXN; (-) strand; PAM type: NRG; PAM sequence: TGG
aatcccttgagcccaggagg

SEQ ID NO: 12688 - DNA, 20 bp, Artificial Sequence
  Description of Artificial Sequence: Synthetic oligonucleotide
  Target: FXN; (-) strand; PAM type: NRG; PAM sequence: AGG
gagaatcccttgagcccagg

SEQ ID NO: 12689 - DNA, 20 bp, Artificial Sequence
  Description of Artificial Sequence: Synthetic oligonucleotide
  Target: FXN; (-) strand; PAM type: NRG; PAM sequence: GAG
agagaatcccttgagcccag

SEQ ID NO: 12690 - DNA, 20 bp, Artificial Sequence
  Description of Artificial Sequence: Synthetic oligonucleotide
  Target: FXN; (-) strand; PAM type: NRG; PAM sequence: AGG
caagagaatcccttgagccc

SEQ ID NO: 12691 - DNA, 20 bp, Artificial Sequence
  Description of Artificial Sequence: Synthetic oligonucleotide
  Target: FXN; (-) strand; PAM type: NRG; PAM sequence: CAG
gcaagagaatcccttgagcc

SEQ ID NO: 12692 - DNA, 20 bp, Artificial Sequence
  Description of Artificial Sequence: Synthetic oligonucleotide
  Target: FXN; (-) strand; PAM type: NRG; PAM sequence: GAG
ctgaggcaagagaatccctt

SEQ ID NO: 12693 - DNA, 20 bp, Artificial Sequence
  Description of Artificial Sequence: Synthetic oligonucleotide
  Target: FXN; (-) strand; PAM type: NRG; PAM sequence: GAG
tactcgggagactgaggcaa

SEQ ID NO: 12694 - DNA, 20 bp, Artificial Sequence
  Description of Artificial Sequence: Synthetic oligonucleotide
  Target: FXN; (-) strand; PAM type: NRG; PAM sequence: AAG
gttactcgggagactgaggc

SEQ ID NO: 12695 - DNA, 20 bp, Artificial Sequence
  Description of Artificial Sequence: Synthetic oligonucleotide
  Target: FXN; (-) strand; PAM type: NRG; PAM sequence: AGG
cccagttactcgggagactg

SEQ ID NO: 12696 - DNA, 20 bp, Artificial Sequence
  Description of Artificial Sequence: Synthetic oligonucleotide
  Target: FXN; (-) strand; PAM type: NRG; PAM sequence: GAG
tcccagttactcgggagact

SEQ ID NO: 12697 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagttactcgg

SEQ ID NO: 12698 - DNA, 20 bp, Artificial Sequence
  Description of Artificial Sequence: Synthetic oligonucleotide
  Target: FXN; (-) strand; PAM type: NRG; PAM sequence: GGG
gcctgtaatcccagttactc

SEQ ID NO: 12699 - DNA, 20 bp, Artificial Sequence
  Description of Artificial Sequence: Synthetic oligonucleotide
  Target: FXN; (-) strand; PAM type: NRG; PAM sequence: CGG
cgcctgtaatcccagttact

SEQ ID NO: 12700 - DNA, 20 bp, Artificial Sequence
  Description of Artificial Sequence: Synthetic oligonucleotide
  Target: FXN; (-) strand; PAM type: NRG; PAM sequence: CAG
gtggcacgcgcctgtaatcc

SEQ ID NO: 12701 - DNA, 20 bp, Artificial Sequence
  Description of Artificial Sequence: Synthetic oligonucleotide
  Target: FXN; (-) strand; PAM type: NRG; PAM sequence: TGG
aaaaaattagctggacatag

SEQ ID NO: 12702 - DNA, 20 bp, Artificial Sequence
  Description of Artificial Sequence: Synthetic oligonucleotide
  Target: FXN; (-) strand; PAM type: NRG; PAM sequence: TAG
aaaaaaaaattagctggaca

SEQ ID NO: 12703 - DNA, 20 bp, Artificial Sequence
  Description of Artificial Sequence: Synthetic oligonucleotide
  Target: FXN; (-) strand; PAM type: NRG; PAM sequence: TGG
atacaaaaaaaaaaattagc

SEQ ID NO: 12704 - DNA, 20 bp, Artificial Sequence
  Description of Artificial Sequence: Synthetic oligonucleotide
  Target: FXN; (-) strand; PAM type: NRG; PAM sequence: TAG
aaaaatacaaaaaaaaaaat

SEQ ID NO: 12705 - DNA, 20 bp, Artificial Sequence
  Description of Artificial Sequence: Synthetic oligonucleotide
  Target: FXN; (-) strand; PAM type: NRG; PAM sequence: TGG
caagaccagccaggccaaca

SEQ ID NO: 12706 - DNA, 20 bp, Artificial Sequence
  Description of Artificial Sequence: Synthetic oligonucleotide
  Target: FXN; (-) strand; PAM type: NRG; PAM sequence: AGG
tcaagagttcaagaccagcc

SEQ ID NO: 12707 - DNA, 20 bp, Artificial Sequence
  Description of Artificial Sequence: Synthetic oligonucleotide
  Target: FXN; (-) strand; PAM type: NRG; PAM sequence: CAG
gtcaagagttcaagaccagc

SEQ ID NO: 12708 - DNA, 20 bp, Artificial Sequence
  Description of Artificial Sequence: Synthetic oligonucleotide
  Target: FXN; (-) strand; PAM type: NRG; PAM sequence: CAG
tgaggtcaagagttcaagac

SEQ ID NO: 12709 - DNA, 20 bp, Artificial Sequence
  Description of Artificial Sequence: Synthetic oligonucleotide
  Target: FXN; (-) strand; PAM type: NRG; PAM sequence: AAG
tcacttgaggtcaagagttc

SEQ ID NO: 12710 - DNA, 20 bp, Artificial Sequence
  Description of Artificial Sequence: Synthetic oligonucleotide
  Target: FXN; (-) strand; PAM type: NRG; PAM sequence: GAG
agtggatcacttgaggtcaa

SEQ ID NO: 12711 - DNA, 20 bp, Artificial Sequence
  Description of Artificial Sequence: Synthetic oligonucleotide
  Target: FXN; (-) strand; PAM type: NRG; PAM sequence: AAG
ccagtggatcacttgaggtc

SEQ ID NO: 12712 - DNA, 20 bp, Artificial Sequence
  Description of Artificial Sequence: Synthetic oligonucleotide
  Target: FXN; (-) strand; PAM type: NRG; PAM sequence: AGG
tgaggccagtggatcacttg

SEQ ID NO: 12713 - DNA, 20 bp, Artificial Sequence
  Description of Artificial Sequence: Synthetic oligonucleotide
  Target: FXN; (-) strand; PAM type: NRG; PAM sequence: GAG
ctgaggccagtggatcactt

SEQ ID NO: 12714 - DNA, 20 bp, Artificial Sequence
  Description of Artificial Sequence: Synthetic oligonucleotide
  Target: FXN; (-) strand; PAM type: NRG; PAM sequence: TGG
ctttgggaggctgaggccag

SEQ ID NO: 12715 - DNA, 20 bp, Artificial Sequence
  Description of Artificial Sequence: Synthetic oligonucleotide
  Target: FXN; (-) strand; PAM type: NRG; PAM sequence: CAG
gcactttgggaggctgaggc

SEQ ID NO: 12716 - DNA, 20 bp, Artificial Sequence
  Description of Artificial Sequence: Synthetic oligonucleotide
  Target: FXN; (-) strand; PAM type: NRG; PAM sequence: AGG
gccagcactttgggaggctg

SEQ ID NO: 12717 - DNA, 20 bp, Artificial Sequence
  Description of Artificial Sequence: Synthetic oligonucleotide
  Target: FXN; (-) strand; PAM type: NRG; PAM sequence: GAG
tgccagcactttgggaggct

SEQ ID NO: 12718 - DNA, 20 bp, Artificial Sequence
  Description of Artificial Sequence: Synthetic oligonucleotide
  Target: FXN; (-) strand; PAM type: NRG; PAM sequence: AGG
tctaatgccagcactttggg

SEQ ID NO: 12719 - DNA, 20 bp, Artificial Sequence
  Description of Artificial Sequence: Synthetic oligonucleotide
  Target: FXN; (-) strand; PAM type: NRG; PAM sequence: GAG
ctctaatgccagcactttgg

SEQ ID NO: 12720 - DNA, 20 bp, Artificial Sequence
  Description of Artificial Sequence: Synthetic oligonucleotide
  Target: FXN; (-) strand; PAM type: NRG; PAM sequence: GGG
acctctaatgccagcacttt

SEQ ID NO: 12721 - DNA, 20 bp, Artificial Sequence
  Description of Artificial Sequence: Synthetic oligonucleotide
  Target: FXN; (-) strand; PAM type: NRG; PAM sequence: TGG
cacctctaatgccagcactt

SEQ ID NO: 12722 - DNA, 20 bp, Artificial Sequence
  Description of Artificial Sequence: Synthetic oligonucleotide
  Target: FXN; (-) strand; PAM type: NRG; PAM sequence: CAG
gtgactcacacctctaatgc

SEQ ID NO: 12723 - DNA, 20 bp, Artificial Sequence
  Description of Artificial Sequence: Synthetic oligonucleotide
  Target: FXN; (-) strand; PAM type: NRG; PAM sequence: CAG
gtgcctcactgggccaggaa

SEQ ID NO: 12724 - DNA, 20 bp, Artificial Sequence
  Description of Artificial Sequence: Synthetic oligonucleotide
  Target: FXN; (-) strand; PAM type: NRG; PAM sequence: AGG
agatggtgcctcactgggcc

SEQ ID NO: 12725 - DNA, 20 bp, Artificial Sequence
  Description of Artificial Sequence: Synthetic oligonucleotide
  Target: FXN; (-) strand; PAM type: NRG; PAM sequence: CAG
gagatggtgcctcactgggc

SEQ ID NO: 12726 - DNA, 20 bp, Artificial Sequence
  Description of Artificial Sequence: Synthetic oligonucleotide
  Target: FXN; (-) strand; PAM type: NRG; PAM sequence: GGG
caatgagatggtgcctcact

SEQ ID NO: 12727 - DNA, 20 bp, Artificial Sequence
  Description of Artificial Sequence: Synthetic oligonucleotide
  Target: FXN; (-) strand; PAM type: NRG; PAM sequence: TGG
ccaatgagatggtgcctcac

SEQ ID NO: 12728 - DNA, 20 bp, Artificial Sequence
  Description of Artificial Sequence: Synthetic oligonucleotide
  Target: FXN; (-) strand; PAM type: NRG; PAM sequence: TGG
tgtctccatatccaatgaga

SEQ ID NO: 12729 - DNA, 20 bp, Artificial Sequence
  Description of Artificial Sequence: Synthetic oligonucleotide
  Target: FXN; (-) strand; PAM type: NRG; PAM sequence: GAG
cctttgtctccatatccaat

SEQ ID NO: 12730 - DNA, 20 bp, Artificial Sequence
  Description of Artificial Sequence: Synthetic oligonucleotide
  Target: FXN; (-) strand; PAM type: NRG; PAM sequence: CAG
acaaatccaggatgctaagc

SEQ ID NO: 12731 - DNA, 20 bp, Artificial Sequence
  Description of Artificial Sequence: Synthetic oligonucleotide
  Target: FXN; (-) strand; PAM type: NRG; PAM sequence: AAG
aaatacaaatccaggatgct

SEQ ID NO: 12732 - DNA, 20 bp, Artificial Sequence
  Description of Artificial Sequence: Synthetic oligonucleotide
  Target: FXN; (-) strand; PAM type: NRG; PAM sequence: AGG
tggaaagaaaatacaaatcc

SEQ ID NO: 12733 - DNA, 20 bp, Artificial Sequence
  Description of Artificial Sequence: Synthetic oligonucleotide
  Target: FXN; (-) strand; PAM type: NRG; PAM sequence: CAG
ttggaaagaaaatacaaatc

SEQ ID NO: 12734 - DNA, 20 bp, Artificial Sequence
  Description of Artificial Sequence: Synthetic oligonucleotide
  Target: FXN; (-) strand; PAM type: NRG; PAM sequence: AAG
atcacttaaggactcttgga

SEQ ID NO: 12735 - DNA, 20 bp, Artificial Sequence
  Description of Artificial Sequence: Synthetic oligonucleotide
  Target: FXN; (-) strand; PAM type: NRG; PAM sequence: TGG
agatatcacttaaggactct

SEQ ID NO: 12736 - DNA, 20 bp, Artificial Sequence
  Description of Artificial Sequence: Synthetic oligonucleotide
  Target: FXN; (-) strand; PAM type: NRG; PAM sequence: AGG
caaaagttagatatcactta

SEQ ID NO: 12737 - DNA, 20 bp, Artificial Sequence
  Description of Artificial Sequence: Synthetic oligonucleotide
  Target: FXN; (-) strand; PAM type: NRG; PAM sequence: AAG
gcaaaagttagatatcactt

SEQ ID NO: 12738 - DNA, 20 bp, Artificial Sequence
  Description of Artificial Sequence: Synthetic oligonucleotide
  Target: FXN; (-) strand; PAM type: NRG; PAM sequence: TAG
aaactgcagctcgcaaaagt

SEQ ID NO: 12739 - DNA, 20 bp, Artificial Sequence
  Description of Artificial Sequence: Synthetic oligonucleotide
  Target: FXN; (-) strand; PAM type: NRG; PAM sequence: AAG
gaggaaactgcagctcgcaa

SEQ ID NO: 12740 - DNA, 20 bp, Artificial Sequence
  Description of Artificial Sequence: Synthetic oligonucleotide
  Target: FXN; (-) strand; PAM type: NRG; PAM sequence: CAG
tctcatagctgaggaaactg

SEQ ID NO: 12741 - DNA, 20 bp, Artificial Sequence
  Description of Artificial Sequence: Synthetic oligonucleotide
  Target: FXN; (-) strand; PAM type: NRG; PAM sequence: AGG
tgtcactcatctcatagctg

SEQ ID NO: 12742 - DNA, 20 bp, Artificial Sequence
  Description of Artificial Sequence: Synthetic oligonucleotide
  Target: FXN; (-) strand; PAM type: NRG; PAM sequence: GAG
atgtcactcatctcatagct

SEQ ID NO: 12743 - DNA, 20 bp, Artificial Sequence
  Description of Artificial Sequence: Synthetic oligonucleotide
  Target: FXN; (-) strand; PAM type: NRG; PAM sequence: TAG
ggttaatgtcactcatctca

SEQ ID NO: 12744 - DNA, 20 bp, Artificial Sequence
  Description of Artificial Sequence: Synthetic oligonucleotide
  Target: FXN; (-) strand; PAM type: NRG; PAM sequence: AGG
cttataaatctgaagagagg

SEQ ID NO: 12745 - DNA, 20 bp, Artificial Sequence
  Description of Artificial Sequence: Synthetic oligonucleotide
  Target: FXN; (-) strand; PAM type: NRG; PAM sequence: GAG
tcttataaatctgaagagag

SEQ ID NO: 12746 - DNA, 20 bp, Artificial Sequence
  Description of Artificial Sequence: Synthetic oligonucleotide
  Target: FXN; (-) strand; PAM type: NRG; PAM sequence: AGG
cctcttataaatctgaagag

SEQ ID NO: 12747 - DNA, 20 bp, Artificial Sequence
  Description of Artificial Sequence: Synthetic oligonucleotide
  Target: FXN; (-) strand; PAM type: NRG; PAM sequence: GAG
tcctcttataaatctgaaga

SEQ ID NO: 12748 - DNA, 20 bp, Artificial Sequence
  Description of Artificial Sequence: Synthetic oligonucleotide
  Target: FXN; (-) strand; PAM type: NRG; PAM sequence: GAG
gatcctcttataaatctgaa

SEQ ID NO: 12749 - DNA, 20 bp, Artificial Sequence
  Description of Artificial Sequence: Synthetic oligonucleotide
  Target: FXN; (-) strand; PAM type: NRG; PAM sequence: AAG
ttgatcctcttataaatctg

SEQ ID NO: 12750 - DNA, 20 bp, Artificial Sequence
  Description of Artificial Sequence: Synthetic oligonucleotide
  Target: FXN; (-) strand; PAM type: NRG; PAM sequence: AGG
aaagtagataccaacttgct

SEQ ID NO: 12751 - DNA, 20 bp, Artificial Sequence
  Description of Artificial Sequence: Synthetic oligonucleotide
  Target: FXN; (-) strand; PAM type: NRG; PAM sequence: TAG
taaagtagataccaacttgc

SEQ ID NO: 12752 - DNA, 20 bp, Artificial Sequence
  Description of Artificial Sequence: Synthetic oligonucleotide
  Target: FXN; (-) strand; PAM type: NRG; PAM sequence: TAG
gacctccttcatttctaaag

SEQ ID NO: 12753 - DNA, 20 bp, Artificial Sequence
  Description of Artificial Sequence: Synthetic oligonucleotide
  Target: FXN; (-) strand; PAM type: NRG; PAM sequence: AAG
tatgacctccttcatttcta

SEQ ID NO: 12754 - DNA, 20 bp, Artificial Sequence
  Description of Artificial Sequence: Synthetic oligonucleotide
  Target: FXN; (-) strand; PAM type: NRG; PAM sequence: GAG
aagatggcatgttgggtctg

SEQ ID NO: 12755 - DNA, 20 bp, Artificial Sequence
  Description of Artificial Sequence: Synthetic oligonucleotide
  Target: FXN; (-) strand; PAM type: NRG; PAM sequence: TGG
ataagatggcatgttgggtc

SEQ ID NO: 12756 - DNA, 20 bp, Artificial Sequence
  Description of Artificial Sequence: Synthetic oligonucleotide
  Target: FXN; (-) strand; PAM type: NRG; PAM sequence: GGG
cacatataagatggcatgtt

SEQ ID NO: 12757 - DNA, 20 bp, Artificial Sequence
  Description of Artificial Sequence: Synthetic oligonucleotide
  Target: FXN; (-) strand; PAM type: NRG; PAM sequence: TGG
acacatataagatggcatgt

SEQ ID NO: 12758 - DNA, 20 bp, Artificial Sequence
  Description of Artificial Sequence: Synthetic oligonucleotide
  Target: FXN; (-) strand; PAM type: NRG; PAM sequence: TGG
agaaatagacacatataaga

SEQ ID NO: 12759 - DNA, 20 bp, Artificial Sequence
  Description of Artificial Sequence: Synthetic oligonucleotide
  Target: FXN; (-) strand; PAM type: NRG; PAM sequence: AAG
ttgtagaaatagacacatat

SEQ ID NO: 12760 - DNA, 20 bp, Artificial Sequence
  Description of Artificial Sequence: Synthetic oligonucleotide
  Target: FXN; (-) strand; PAM type: NRG; PAM sequence: TAG
cactagctcacttgtagaaa

SEQ ID NO: 12761 - DNA, 20 bp, Artificial Sequence
  Description of Artificial Sequence: Synthetic oligonucleotide
  Target: FXN; (-) strand; PAM type: NRG; PAM sequence: TAG
tgttgtcactagctcacttg

SEQ ID NO: 12762 - DNA, 20 bp, Artificial Sequence
  Description of Artificial Sequence: Synthetic oligonucleotide
  Target: FXN; (-) strand; PAM type: NRG; PAM sequence: TAG
atagcaattactgttgtcac

SEQ ID NO: 12763 - DNA, 20 bp, Artificial Sequence
  Description of Artificial Sequence: Synthetic oligonucleotide
  Target: FXN; (-) strand; PAM type: NRG; PAM sequence: TAG
tacccatgtaggagcaaaaa

SEQ ID NO: 12764 - DNA, 20 bp, Artificial Sequence
  Description of Artificial Sequence: Synthetic oligonucleotide
  Target: FXN; (-) strand; PAM type: NRG; PAM sequence: GAG
gatcagccctacccatgtag

SEQ ID NO: 12765 - DNA, 20 bp, Artificial Sequence
  Description of Artificial Sequence: Synthetic oligonucleotide
  Target: FXN; (-) strand; PAM type: NRG; PAM sequence: AGG
aagatcagccctacccatgt

SEQ ID NO: 12766 - DNA, 20 bp, Artificial Sequence
  Description of Artificial Sequence: Synthetic oligonucleotide
  Target: FXN; (-) strand; PAM type: NRG; PAM sequence: TAG
caagatcagccctacccatg

SEQ ID NO: 12767 - DNA, 20 bp, Artificial Sequence
  Description of Artificial Sequence: Synthetic oligonucleotide
  Target: FXN; (-) strand; PAM type: NRG; PAM sequence: CAG
tgactcctcctagtcaagat

SEQ ID NO: 12768 - DNA, 20 bp, Artificial Sequence
  Description of Artificial Sequence: Synthetic oligonucleotide
  Target: FXN; (-) strand; PAM type: NRG; PAM sequence: AAG
cttattgactcctcctagtc

SEQ ID NO: 12769 - DNA, 20 bp, Artificial Sequence
  Description of Artificial Sequence: Synthetic oligonucleotide
  Target: FXN; (-) strand; PAM type: NRG; PAM sequence: TAG
tgagtcttattgactcctcc

SEQ ID NO: 12770 - DNA, 20 bp, Artificial Sequence
  Description of Artificial Sequence: Synthetic oligonucleotide
  Target: FXN; (-) strand; PAM type: NRG; PAM sequence: GAG
agccaccacgcccggctggt

SEQ ID NO: 12771 - DNA, 20 bp, Artificial Sequence
  Description of Artificial Sequence: Synthetic oligonucleotide
  Target: FXN; (-) strand; PAM type: NRG; PAM sequence: TGG
cgtgagccaccacgcccggc

SEQ ID NO: 12772 - DNA, 20 bp, Artificial Sequence
  Description of Artificial Sequence: Synthetic oligonucleotide
  Target: FXN; (-) strand; PAM type: NRG; PAM sequence: CGG
caggcgtgagccaccacgcc

SEQ ID NO: 12773 - DNA, 20 bp, Artificial Sequence
  Description of Artificial Sequence: Synthetic oligonucleotide
  Target: FXN; (-) strand; PAM type: NRG; PAM sequence: GAG
agtgctgggattacaggcgt

SEQ ID NO: 12774 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctgggattac

SEQ ID NO: 12775 - DNA, 20 bp, Artificial Sequence
  Description of Artificial Sequence: Synthetic oligonucleotide
  Target: FXN; (-) strand; PAM type: NRG; PAM sequence: CAG
ctcccaaagtgctgggatta

SEQ ID NO: 12776 - DNA, 20 bp, Artificial Sequence
  Description of Artificial Sequence: Synthetic oligonucleotide
  Target: FXN; (-) strand; PAM type: NRG; PAM sequence: GGG
ccttggcctcccaaagtgct

SEQ ID NO: 12777 - DNA, 20 bp, Artificial Sequence
  Description of Artificial Sequence: Synthetic oligonucleotide
  Target: FXN; (-) strand; PAM type: NRG; PAM sequence: TGG
gccttggcctcccaaagtgc

SEQ ID NO: 12778 - DNA, 20 bp, Artificial Sequence
  Description of Artificial Sequence: Synthetic oligonucleotide
  Target: FXN; (-) strand; PAM type: NRG; PAM sequence: AAG
ccgcccgccttggcctccca

SEQ ID NO: 12779 - DNA, 20 bp, Artificial Sequence
  Description of Artificial Sequence: Synthetic oligonucleotide
  Target: FXN; (-) strand; PAM type: NRG; PAM sequence: TGG
acctcgtgatccgcccgcct

SEQ ID NO: 12780 - DNA, 20 bp, Artificial Sequence
  Description of Artificial Sequence: Synthetic oligonucleotide
  Target: FXN; (-) strand; PAM type: NRG; PAM sequence: TGG
tttcaccgtgttagccagaa

SEQ ID NO: 12781 - DNA, 20 bp, Artificial Sequence
  Description of Artificial Sequence: Synthetic oligonucleotide
  Target: FXN; (-) strand; PAM type: NRG; PAM sequence: CAG
cggggtttcaccgtgttagc

SEQ ID NO: 12782 - DNA, 20 bp, Artificial Sequence
  Description of Artificial Sequence: Synthetic oligonucleotide
  Target: FXN; (-) strand; PAM type: NRG; PAM sequence: TAG
gagacggggtttcaccgtgt

SEQ ID NO: 12783 - DNA, 20 bp, Artificial Sequence
  Description of Artificial Sequence: Synthetic oligonucleotide
  Target: FXN; (-) strand; PAM type: NRG; PAM sequence: GGG
gtatttttttagtagagacg

SEQ ID NO: 12784 - DNA, 20 bp, Artificial Sequence
  Description of Artificial Sequence: Synthetic oligonucleotide
  Target: FXN; (-) strand; PAM type: NRG; PAM sequence: GGG
tgtatttttttagtagagac

SEQ ID NO: 12785 - DNA, 20 bp, Artificial Sequence
  Description of Artificial Sequence: Synthetic oligonucleotide
  Target: FXN; (-) strand; PAM type: NRG; PAM sequence: CGG
ttgtatttttttagtagaga

SEQ ID NO: 12786 - DNA, 20 bp, Artificial Sequence
  Description of Artificial Sequence: Synthetic oligonucleotide
  Target: FXN; (-) strand; PAM type: NRG; PAM sequence: GAG
ttttttgtatttttttagta

SEQ ID NO: 12787 - DNA, 20 bp, Artificial Sequence
  Description of Artificial Sequence: Synthetic oligonucleotide
  Target: FXN; (-) strand; PAM type: NRG; PAM sequence: TAG
atttttttgtatttttttag

SEQ ID NO: 12788 - DNA, 20 bp, Artificial Sequence
  Description of Artificial Sequence: Synthetic oligonucleotide
  Target: FXN; (-) strand; PAM type: NRG; PAM sequence: TAG
ctaatttttttgtatttttt

SEQ ID NO: 12789 - DNA, 20 bp, Artificial Sequence
  Description of Artificial Sequence: Synthetic oligonucleotide
  Target: FXN; (-) strand; PAM type: NRG; PAM sequence: CAG
caggcgcccaccaccacgcc

SEQ ID NO: 12790 - DNA, 20 bp, Artificial Sequence
  Description of Artificial Sequence: Synthetic oligonucleotide
  Target: FXN; (-) strand; PAM type: NRG; PAM sequence: AGG
tcccgagtagctgggactac

SEQ ID NO: 12791 - DNA, 20 bp, Artificial Sequence
  Description of Artificial Sequence: Synthetic oligonucleotide
  Target: FXN; (-) strand; PAM type: NRG; PAM sequence: CAG
ttcccgagtagctgggacta

SEQ ID NO: 12792 - DNA, 20 bp, Artificial Sequence
  Description of Artificial Sequence: Synthetic oligonucleotide
  Target: FXN; (-) strand; PAM type: NRG; PAM sequence: GGG
cctcagcttcccgagtagct

SEQ ID NO: 12793 - DNA, 20 bp, Artificial Sequence
  Description of Artificial Sequence: Synthetic oligonucleotide
  Target: FXN; (-) strand; PAM type: NRG; PAM sequence: TGG
gcctcagcttcccgagtagc

SEQ ID NO: 12794 - DNA, 20 bp, Artificial Sequence
  Description of Artificial Sequence: Synthetic oligonucleotide
  Target: FXN; (-) strand; PAM type: NRG; PAM sequence: TAG
tcctgcctcagcttcccgag

SEQ ID NO: 12795 - DNA, 20 bp, Artificial Sequence
  Description of Artificial Sequence: Synthetic oligonucleotide
  Target: FXN; (-) strand; PAM type: NRG; PAM sequence: GAG
ttctcctgcctcagcttccc

SEQ ID NO: 12796 - DNA, 20 bp, Artificial Sequence
  Description of Artificial Sequence: Synthetic oligonucleotide
  Target: FXN; (-) strand; PAM type: NRG; PAM sequence: CAG
ttcacgccattctcctgcct

SEQ ID NO: 12797 - DNA, 20 bp, Artificial Sequence
  Description of Artificial Sequence: Synthetic oligonucleotide
  Target: FXN; (-) strand; PAM type: NRG; PAM sequence: GGG
cactgcaagctctgcctccc

SEQ ID NO: 12798 - DNA, 20 bp, Artificial Sequence
  Description of Artificial Sequence: Synthetic oligonucleotide
  Target: FXN; (-) strand; PAM type: NRG; PAM sequence: CGG
tcactgcaagctctgcctcc

SEQ ID NO: 12799 - DNA, 20 bp, Artificial Sequence
  Description of Artificial Sequence: Synthetic oligonucleotide
  Target: FXN; (-) strand; PAM type: NRG; PAM sequence: AAG
gctcgatcttggttcactgc

SEQ ID NO: 12800 - DNA, 20 bp, Artificial Sequence
  Description of Artificial Sequence: Synthetic oligonucleotide
  Target: FXN; (-) strand; PAM type: NRG; PAM sequence: TGG
agagtgcagtggctcgatct

SEQ ID NO: 12801 - DNA, 20 bp, Artificial Sequence
  Description of Artificial Sequence: Synthetic oligonucleotide
  Target: FXN; (-) strand; PAM type: NRG; PAM sequence: TGG
tcacccaggctagagtgcag

SEQ ID NO: 12802 - DNA, 20 bp, Artificial Sequence
  Description of Artificial Sequence: Synthetic oligonucleotide
  Target: FXN; (-) strand; PAM type: NRG; PAM sequence: CAG
ctgtcacccaggctagagtg

SEQ ID NO: 12803 - DNA, 20 bp, Artificial Sequence
  Description of Artificial Sequence: Synthetic oligonucleotide
  Target: FXN; (-) strand; PAM type: NRG; PAM sequence: GAG
tcgctctgtcacccaggcta

SEQ ID NO: 12804 - DNA, 20 bp, Artificial Sequence
  Description of Artificial Sequence: Synthetic oligonucleotide
  Target: FXN; (-) strand; PAM type: NRG; PAM sequence: TAG
tctcgctctgtcacccaggc

SEQ ID NO: 12805 - DNA, 20 bp, Artificial Sequence
  Description of Artificial Sequence: Synthetic oligonucleotide
  Target: FXN; (-) strand; PAM type: NRG; PAM sequence: AGG
ggagtctcgctctgtcaccc

SEQ ID NO: 12806 - DNA, 20 bp, Artificial Sequence
  Description of Artificial Sequence: Synthetic oligonucleotide
  Target: FXN; (-) strand; PAM type: NRG; PAM sequence: CAG
tggagtctcgctctgtcacc

SEQ ID NO: 12807 - DNA, 20 bp, Artificial Sequence
  Description of Artificial Sequence: Synthetic oligonucleotide
  Target: FXN; (-) strand; PAM type: NRG; PAM sequence: GAG
ttttttttttttttgagatg

SEQ ID NO: 12808 - DNA, 20 bp, Artificial Sequence
  Description of Artificial Sequence: Synthetic oligonucleotide
  Target: FXN; (-) strand; PAM type: NRG; PAM sequence: TGG
tcttttttttttttttgaga

SEQ ID NO: 12809 - DNA, 20 bp, Artificial Sequence
  Description of Artificial Sequence: Synthetic oligonucleotide
  Target: FXN; (-) strand; PAM type: NRG; PAM sequence: GAG
tgagtctttttttttttttt

SEQ ID NO: 12810 - DNA, 20 bp, Artificial Sequence
  Description of Artificial Sequence: Synthetic oligonucleotide
  Target: FXN; (-) strand; PAM type: NRG; PAM sequence: GAG
agacagtggccacagctggt

SEQ ID NO: 12811 - DNA, 20 bp, Artificial Sequence
  Description of Artificial Sequence: Synthetic oligonucleotide
  Target: FXN; (-) strand; PAM type: NRG; PAM sequence: TGG
gcacagacagtggccacagc

SEQ ID NO: 12812 - DNA, 20 bp, Artificial Sequence
  Description of Artificial Sequence: Synthetic oligonucleotide
  Target: FXN; (-) strand; PAM type: NRG; PAM sequence: CAG
attagcacagacagtggcca

SEQ ID NO: 12813 - DNA, 20 bp, Artificial Sequence
  Description of Artificial Sequence: Synthetic oligonucleotide
  Target: FXN; (-) strand; PAM type: NRG; PAM sequence: TGG
tagccaattagcacagacag

SEQ ID NO: 12814 - DNA, 20 bp, Artificial Sequence
  Description of Artificial Sequence: Synthetic oligonucleotide
  Target: FXN; (-) strand; PAM type: NRG; PAM sequence: CAG
cactagccaattagcacaga

SEQ ID NO: 12815 - DNA, 20 bp, Artificial Sequence
  Description of Artificial Sequence: Synthetic oligonucleotide
  Target: FXN; (-) strand; PAM type: NRG; PAM sequence: CAG
caggcactagccaattagca

SEQ ID NO: 12816 - DNA, 20 bp, Artificial Sequence
  Description of Artificial Sequence: Synthetic oligonucleotide
  Target: FXN; (-) strand; PAM type: NRG; PAM sequence: TAG
agatgcaggcactagccaat

SEQ ID NO: 12817 - DNA, 20 bp, Artificial Sequence
  Description of Artificial Sequence: Synthetic oligonucleotide
  Target: FXN; (-) strand; PAM type: NRG; PAM sequence: TAG
agtttctgagatgcaggcac

SEQ ID NO: 12818 - DNA, 20 bp, Artificial Sequence
  Description of Artificial Sequence: Synthetic oligonucleotide
  Target: FXN; (-) strand; PAM type: NRG; PAM sequence: AGG
tgtagcagtttctgagatgc

SEQ ID NO: 12819 - DNA, 20 bp, Artificial Sequence
  Description of Artificial Sequence: Synthetic oligonucleotide
  Target: FXN; (-) strand; PAM type: NRG; PAM sequence: CAG
atgtagcagtttctgagatg

SEQ ID NO: 12820 - DNA, 20 bp, Artificial Sequence
  Description of Artificial Sequence: Synthetic oligonucleotide
  Target: FXN; (-) strand; PAM type: NRG; PAM sequence: GAG
caaaatatgtagcagtttct

SEQ ID NO: 12821 - DNA, 20 bp, Artificial Sequence
  Description of Artificial Sequence: Synthetic oligonucleotide
  Target: FXN; (-) strand; PAM type: NRG; PAM sequence: CAG
ggaatagtcaaaatatgtag

SEQ ID NO: 12822 - DNA, 20 bp, Artificial Sequence
  Description of Artificial Sequence: Synthetic oligonucleotide
  Target: FXN; (-) strand; PAM type: NRG; PAM sequence: TAG
gggggaatagtcaaaatatg

SEQ ID NO: 12823 - DNA, 20 bp, Artificial Sequence
  Description of Artificial Sequence: Synthetic oligonucleotide
  Target: FXN; (-) strand; PAM type: NRG; PAM sequence: TAG
gcccttaagtgcagggggaa

SEQ ID NO: 12824 - DNA, 20 bp, Artificial Sequence
  Description of Artificial Sequence: Synthetic oligonucleotide
  Target: FXN; (-) strand; PAM type: NRG; PAM sequence: GGG
tgcatgcccttaagtgcagg

SEQ ID NO: 12825 - DNA, 20 bp, Artificial Sequence
  Description of Artificial Sequence: Synthetic oligonucleotide
  Target: FXN; (-) strand; PAM type: NRG; PAM sequence: GGG
gtgcatgcccttaagtgcag

SEQ ID NO: 12826 - DNA, 20 bp, Artificial Sequence
  Description of Artificial Sequence: Synthetic oligonucleotide
  Target: FXN; (-) strand; PAM type: NRG; PAM sequence: GGG
tgtgcatgcccttaagtgca

SEQ ID NO: 12827 - DNA, 20 bp, Artificial Sequence
  Description of Artificial Sequence: Synthetic oligonucleotide
  Target: FXN; (-) strand; PAM type: NRG; PAM sequence: AGG
gtgtgcatgcccttaagtgc

SEQ ID NO: 12828 - DNA, 20 bp, Artificial Sequence
  Description of Artificial Sequence: Synthetic oligonucleotide
  Target: FXN; (-) strand; PAM type: NRG; PAM sequence: CAG
agtgtgcatgcccttaagtg

SEQ ID NO: 12829 - DNA, 20 bp, Artificial Sequence
  Description of Artificial Sequence: Synthetic oligonucleotide
  Target: FXN; (-) strand; PAM type: NRG; PAM sequence: AAG
ttgggagtgtgcatgccctt

SEQ ID NO: 12830 - DNA, 20 bp, Artificial Sequence
  Description of Artificial Sequence: Synthetic oligonucleotide
  Target: FXN; (-) strand; PAM type: NRG; PAM sequence: GAG
acaatctgagtctattttgg

SEQ ID NO: 12831 - DNA, 20 bp, Artificial Sequence
  Description of Artificial Sequence: Synthetic oligonucleotide
  Target: FXN; (-) strand; PAM type: NRG; PAM sequence: GGG
agacaatctgagtctatttt

SEQ ID NO: 12832 - DNA, 20 bp, Artificial Sequence
  Description of Artificial Sequence: Synthetic oligonucleotide
  Target: FXN; (-) strand; PAM type: NRG; PAM sequence: TGG
tagacaatctgagtctattt

SEQ ID NO: 12833 - DNA, 20 bp, Artificial Sequence
  Description of Artificial Sequence: Synthetic oligonucleotide
  Target: FXN; (-) strand; PAM type: NRG; PAM sequence: GAG
cattattccttagacaatct

SEQ ID NO: 12834 - DNA, 20 bp, Artificial Sequence
  Description of Artificial Sequence: Synthetic oligonucleotide
  Target: FXN; (-) strand; PAM type: NRG; PAM sequence: TAG
tcatcatcatcattattcct

SEQ ID NO: 12835 - DNA, 20 bp, Artificial Sequence
  Description of Artificial Sequence: Synthetic oligonucleotide
  Target: FXN; (-) strand; PAM type: NRG; PAM sequence: GGG
acaaatagaccagataaaga

SEQ ID NO: 12836 - DNA, 20 bp, Artificial Sequence
  Description of Artificial Sequence: Synthetic oligonucleotide
  Target: FXN; (-) strand; PAM type: NRG; PAM sequence: AGG
tacaaatagaccagataaag

SEQ ID NO: 12837 - DNA, 20 bp, Artificial Sequence
  Description of Artificial Sequence: Synthetic oligonucleotide
  Target: FXN; (-) strand; PAM type: NRG; PAM sequence: GAG
ctacaaatagaccagataaa

SEQ ID NO: 12838 - DNA, 20 bp, Artificial Sequence
  Description of Artificial Sequence: Synthetic oligonucleotide
  Target: FXN; (-) strand; PAM type: NRG; PAM sequence: AAG
gactacaaatagaccagata

SEQ ID NO: 12839 - DNA, 20 bp, Artificial Sequence
  Description of Artificial Sequence: Synthetic oligonucleotide
  Target: FXN; (-) strand; PAM type: NRG; PAM sequence: CAG
ggaactgactacaaatagac

SEQ ID NO: 12840 - DNA, 20 bp, Artificial Sequence
  Description of Artificial Sequence: Synthetic oligonucleotide
  Target: FXN; (-) strand; PAM type: NRG; PAM sequence: TAG
cttttggaactgactacaaa

SEQ ID NO: 12841 - DNA, 20 bp, Artificial Sequence
  Description of Artificial Sequence: Synthetic oligonucleotide
  Target: FXN; (-) strand; PAM type: NRG; PAM sequence: TGG
gcagaaattcttaatgcttt

SEQ ID NO: 12842 - DNA, 20 bp, Artificial Sequence
  Description of Artificial Sequence: Synthetic oligonucleotide
  Target: FXN; (-) strand; PAM type: NRG; PAM sequence: CAG
aactagctgcattagttcag

SEQ ID NO: 12843 - DNA, 20 bp, Artificial Sequence
  Description of Artificial Sequence: Synthetic oligonucleotide
  Target: FXN; (-) strand; PAM type: NRG; PAM sequence: CAG
agaaactagctgcattagtt

SEQ ID NO: 12844 - DNA, 20 bp, Artificial Sequence
  Description of Artificial Sequence: Synthetic oligonucleotide
  Target: FXN; (-) strand; PAM type: NRG; PAM sequence: TAG
aggaaagaaactagctgcat

SEQ ID NO: 12845 - DNA, 20 bp, Artificial Sequence
  Description of Artificial Sequence: Synthetic oligonucleotide
  Target: FXN; (-) strand; PAM type: NRG; PAM sequence: TAG
agtggtgacaggaaagaaac

SEQ ID NO: 12846 - DNA, 20 bp, Artificial Sequence
  Description of Artificial Sequence: Synthetic oligonucleotide
  Target: FXN; (-) strand; PAM type: NRG; PAM sequence: AAG
gaaggaaagtggtgacagga

SEQ ID NO: 12847 - DNA, 20 bp, Artificial Sequence
  Description of Artificial Sequence: Synthetic oligonucleotide
  Target: FXN; (-) strand; PAM type: NRG; PAM sequence: AGG
tttggaaggaaagtggtgac

SEQ ID NO: 12848 - DNA, 20 bp, Artificial Sequence
  Description of Artificial Sequence: Synthetic oligonucleotide
  Target: FXN; (-) strand; PAM type: NRG; PAM sequence: CAG
ttttggaaggaaagtggtga

SEQ ID NO: 12849 - DNA, 20 bp, Artificial Sequence
  Description of Artificial Sequence: Synthetic oligonucleotide
  Target: FXN; (-) strand; PAM type: NRG; PAM sequence: TGG
aaactattttggaaggaaag

SEQ ID NO: 12850 - DNA, 20 bp, Artificial Sequence
  Description of Artificial Sequence: Synthetic oligonucleotide
  Target: FXN; (-) strand; PAM type: NRG; PAM sequence: AAG
ttgaaactattttggaagga

SEQ ID NO: 12851 - DNA, 20 bp, Artificial Sequence
  Description of Artificial Sequence: Synthetic oligonucleotide
  Target: FXN; (-) strand; PAM type: NRG; PAM sequence: AGG
gatcttgaaactattttgga

SEQ ID NO: 12852 - DNA, 20 bp, Artificial Sequence
  Description of Artificial Sequence: Synthetic oligonucleotide
  Target: FXN; (-) strand; PAM type: NRG; PAM sequence: AAG
agatcttgaaactattttgg

SEQ ID NO: 12853 - DNA, 20 bp, Artificial Sequence
  Description of Artificial Sequence: Synthetic oligonucleotide
  Target: FXN; (-) strand; PAM type: NRG; PAM sequence: TGG
cacagatcttgaaactattt

SEQ ID NO: 12854 - DNA, 20 bp, Artificial Sequence
  Description of Artificial Sequence: Synthetic oligonucleotide
  Target: FXN; (-) strand; PAM type: NRG; PAM sequence: CAG
taaatagattttttccccca

SEQ ID NO: 12855 - DNA, 20 bp, Artificial Sequence
  Description of Artificial Sequence: Synthetic oligonucleotide
  Target: FXN; (-) strand; PAM type: NRG; PAM sequence: TAG
accagtctgttcactgtaaa

SEQ ID NO: 12856 - DNA, 20 bp, Artificial Sequence
  Description of Artificial Sequence: Synthetic oligonucleotide
  Target: FXN; (-) strand; PAM type: NRG; PAM sequence: CAG
aatgctcaacttcctcccac

SEQ ID NO: 12857 - DNA, 20 bp, Artificial Sequence
  Description of Artificial Sequence: Synthetic oligonucleotide
  Target: FXN; (-) strand; PAM type: NRG; PAM sequence: CAG
tagggcaaggttacacaggg

SEQ ID NO: 12858 - DNA, 20 bp, Artificial Sequence
  Description of Artificial Sequence: Synthetic oligonucleotide
  Target: FXN; (-) strand; PAM type: NRG; PAM sequence: GGG
acttagggcaaggttacaca

SEQ ID NO: 12859 - DNA, 20 bp, Artificial Sequence
  Description of Artificial Sequence: Synthetic oligonucleotide
  Target: FXN; (-) strand; PAM type: NRG; PAM sequence: AGG
aacttagggcaaggttacac

SEQ ID NO: 12860 - DNA, 20 bp, Artificial Sequence
  Description of Artificial Sequence: Synthetic oligonucleotide
  Target: FXN; (-) strand; PAM type: NRG; PAM sequence: CAG
caacttagggcaaggttaca

SEQ ID NO: 12861 - DNA, 20 bp, Artificial Sequence
  Description of Artificial Sequence: Synthetic oligonucleotide
  Target: FXN; (-) strand; PAM type: NRG; PAM sequence: AGG
catctgcccaacttagggca

SEQ ID NO: 12862 - DNA, 20 bp, Artificial Sequence
  Description of Artificial Sequence: Synthetic oligonucleotide
  Target: FXN; (-) strand; PAM type: NRG; PAM sequence: AAG
ccatctgcccaacttagggc

SEQ ID NO: 12863 - DNA, 20 bp, Artificial Sequence
  Description of Artificial Sequence: Synthetic oligonucleotide
  Target: FXN; (-) strand; PAM type: NRG; PAM sequence: GGG
gataccatctgcccaactta

SEQ ID NO: 12864 - DNA, 20 bp, Artificial Sequence
  Description of Artificial Sequence: Synthetic oligonucleotide
  Target: FXN; (-) strand; PAM type: NRG; PAM sequence: AGG
tgataccatctgcccaactt

SEQ ID NO: 12865 - DNA, 20 bp, Artificial Sequence
  Description of Artificial Sequence: Synthetic oligonucleotide
  Target: FXN; (-) strand; PAM type: NRG; PAM sequence: TAG
gtgataccatctgcccaact

SEQ ID NO: 12866 - DNA, 20 bp, Artificial Sequence
  Description of Artificial Sequence: Synthetic oligonucleotide
  Target: FXN; (-) strand; PAM type: NRG; PAM sequence: TAG
atgagcagatgatgtccagg

SEQ ID NO: 12867 - DNA, 20 bp, Artificial Sequence
  Description of Artificial Sequence: Synthetic oligonucleotide
  Target: FXN; (-) strand; PAM type: NRG; PAM sequence: AGG
tgaatgagcagatgatgtcc

SEQ ID NO: 12868 - DNA, 20 bp, Artificial Sequence
  Description of Artificial Sequence: Synthetic oligonucleotide
  Target: FXN; (-) strand; PAM type: NRG; PAM sequence: CAG
gtgaatgagcagatgatgtc

SEQ ID NO: 12869 - DNA, 20 bp, Artificial Sequence
  Description of Artificial Sequence: Synthetic oligonucleotide
  Target: FXN; (-) strand; PAM type: NRG; PAM sequence: CAG
ctggtcaaatagtgaatgag

SEQ ID NO: 12870 - DNA, 20 bp, Artificial Sequence
  Description of Artificial Sequence: Synthetic oligonucleotide
  Target: FXN; (-) strand; PAM type: NRG; PAM sequence: GAG
caactggtcaaatagtgaat

SEQ ID NO: 12871 - DNA, 20 bp, Artificial Sequence
  Description of Artificial Sequence: Synthetic oligonucleotide
  Target: FXN; (-) strand; PAM type: NRG; PAM sequence: TAG
tgaatgaccaactggtcaaa

SEQ ID NO: 12872 - DNA, 20 bp, Artificial Sequence
  Description of Artificial Sequence: Synthetic oligonucleotide
  Target: FXN; (-) strand; PAM type: NRG; PAM sequence: TGG
tttgtgaatgaatgaccaac

SEQ ID NO: 12873 - DNA, 20 bp, Artificial Sequence
  Description of Artificial Sequence: Synthetic oligonucleotide
  Target: FXN; (-) strand; PAM type: NRG; PAM sequence: AGG
cctccatccctcctgcaaaa

SEQ ID NO: 12874 - DNA, 20 bp, Artificial Sequence
  Description of Artificial Sequence: Synthetic oligonucleotide
  Target: FXN; (-) strand; PAM type: NRG; PAM sequence: AAG
acctccatccctcctgcaaa

SEQ ID NO: 12875 - DNA, 20 bp, Artificial Sequence
  Description of Artificial Sequence: Synthetic oligonucleotide
  Target: FXN; (-) strand; PAM type: NRG; PAM sequence: TAG
catgctagcatctgcaggtc

SEQ ID NO: 12876 - DNA, 20 bp, Artificial Sequence
  Description of Artificial Sequence: Synthetic oligonucleotide
  Target: FXN; (-) strand; PAM type: NRG; PAM sequence: AGG
cttttcatgctagcatctgc

SEQ ID NO: 12877 - DNA, 20 bp, Artificial Sequence
  Description of Artificial Sequence: Synthetic oligonucleotide
  Target: FXN; (-) strand; PAM type: NRG; PAM sequence: CAG
tcttttcatgctagcatctg

SEQ ID NO: 12878 - DNA, 20 bp, Artificial Sequence
  Description of Artificial Sequence: Synthetic oligonucleotide
  Target: FXN; (-) strand; PAM type: NRG; PAM sequence: TAG
ggagatctgtcttttcatgc

SEQ ID NO: 12879 - DNA, 20 bp, Artificial Sequence
  Description of Artificial Sequence: Synthetic oligonucleotide
  Target: FXN; (-) strand; PAM type: NRG; PAM sequence: GAG
tttaagcaccttagcagcag

SEQ ID NO: 12880 - DNA, 20 bp, Artificial Sequence
  Description of Artificial Sequence: Synthetic oligonucleotide
  Target: FXN; (-) strand; PAM type: NRG; PAM sequence: AGG
actttaagcaccttagcagc

SEQ ID NO: 12881 - DNA, 20 bp, Artificial Sequence
  Description of Artificial Sequence: Synthetic oligonucleotide
  Target: FXN; (-) strand; PAM type: NRG; PAM sequence: CAG
tactttaagcaccttagcag

SEQ ID NO: 12882 - DNA, 20 bp, Artificial Sequence
  Description of Artificial Sequence: Synthetic oligonucleotide
  Target: FXN; (-) strand; PAM type: NRG; PAM sequence: CAG
cactactttaagcaccttag

SEQ ID NO: 12883 - DNA, 20 bp, Artificial Sequence
  Description of Artificial Sequence: Synthetic oligonucleotide
  Target: FXN; (-) strand; PAM type: NRG; PAM sequence: TAG
ctccactactttaagcacct

SEQ ID NO: 12884 - DNA, 20 bp, Artificial Sequence
  Description of Artificial Sequence: Synthetic oligonucleotide
  Target: FXN; (-) strand; PAM type: NRG; PAM sequence: AAG
cccctgacctccactacttt

SEQ ID NO: 12885 - DNA, 20 bp, Artificial Sequence
  Description of Artificial Sequence: Synthetic oligonucleotide
  Target: FXN; (-) strand; PAM type: NRG; PAM sequence: GAG
gcttcctgcctctgcattca

SEQ ID NO: 12886 - DNA, 20 bp, Artificial Sequence
  Description of Artificial Sequence: Synthetic oligonucleotide
  Target: FXN; (-) strand; PAM type: NRG; PAM sequence: CAG
gtgcttcctgcctctgcatt

SEQ ID NO: 12887 - DNA, 20 bp, Artificial Sequence
  Description of Artificial Sequence: Synthetic oligonucleotide
  Target: FXN; (-) strand; PAM type: NRG; PAM sequence: TGG
ctgtgggtcccattgcctcg

SEQ ID NO: 12888 - DNA, 20 bp, Artificial Sequence
  Description of Artificial Sequence: Synthetic oligonucleotide
  Target: FXN; (-) strand; PAM type: NRG; PAM sequence: GGG
ctaccctgctacccctctgt

SEQ ID NO: 12889 - DNA, 20 bp, Artificial Sequence
  Description of Artificial Sequence: Synthetic oligonucleotide
  Target: FXN; (-) strand; PAM type: NRG; PAM sequence: TGG
tctaccctgctacccctctg

SEQ ID NO: 12890 - DNA, 20 bp, Artificial Sequence
  Description of Artificial Sequence: Synthetic oligonucleotide
  Target: FXN; (-) strand; PAM type: NRG; PAM sequence: GAG
aacttcctccctccccacat

SEQ ID NO: 12891 - DNA, 20 bp, Artificial Sequence
  Description of Artificial Sequence: Synthetic oligonucleotide
  Target: FXN; (-) strand; PAM type: NRG; PAM sequence: CAG
accccctggcaccttctctg

SEQ ID NO: 12892 - DNA, 20 bp, Artificial Sequence
  Description of Artificial Sequence: Synthetic oligonucleotide
  Target: FXN; (-) strand; PAM type: NRG; PAM sequence: TGG
ctcaagctattttcaccccc

SEQ ID NO: 12893 - DNA, 20 bp, Artificial Sequence
  Description of Artificial Sequence: Synthetic oligonucleotide
  Target: FXN; (-) strand; PAM type: NRG; PAM sequence: AAG
cttctagctccacagctctc

SEQ ID NO: 12894 - DNA, 20 bp, Artificial Sequence
  Description of Artificial Sequence: Synthetic oligonucleotide
  Target: FXN; (-) strand; PAM type: NRG; PAM sequence: CAG
tgagagcccttctagctcca

SEQ ID NO: 12895 - DNA, 20 bp, Artificial Sequence
  Description of Artificial Sequence: Synthetic oligonucleotide
  Target: FXN; (-) strand; PAM type: NRG; PAM sequence: TAG
agcaaatgtgagagcccttc

SEQ ID NO: 12896 - DNA, 20 bp, Artificial Sequence
  Description of Artificial Sequence: Synthetic oligonucleotide
  Target: FXN; (-) strand; PAM type: NRG; PAM sequence: GAG
atattaataagcaaatgtga

SEQ ID NO: 12897 - DNA, 20 bp, Artificial Sequence
  Description of Artificial Sequence: Synthetic oligonucleotide
  Target: FXN; (-) strand; PAM type: NRG; PAM sequence: GAG
gcatattaataagcaaatgt

SEQ ID NO: 12898 - DNA, 20 bp, Artificial Sequence
  Description of Artificial Sequence: Synthetic oligonucleotide
  Target: FXN; (-) strand; PAM type: NRG; PAM sequence: AAG
ttttcaaagggcatattaat

SEQ ID NO: 12899 - DNA, 20 bp, Artificial Sequence
  Description of Artificial Sequence: Synthetic oligonucleotide
  Target: FXN; (-) strand; PAM type: NRG; PAM sequence: GGG
tcaggccactctttttcaaa

SEQ ID NO: 12900 - DNA, 20 bp, Artificial Sequence
  Description of Artificial Sequence: Synthetic oligonucleotide
  Target: FXN; (-) strand; PAM type: NRG; PAM sequence: AGG
atcaggccactctttttcaa

SEQ ID NO: 12901 - DNA, 20 bp, Artificial Sequence
  Description of Artificial Sequence: Synthetic oligonucleotide
  Target: FXN; (-) strand; PAM type: NRG; PAM sequence: AAG
tatcaggccactctttttca

SEQ ID NO: 12902 - DNA, 20 bp, Artificial Sequence
  Description of Artificial Sequence: Synthetic oligonucleotide
  Target: FXN; (-) strand; PAM type: NRG; PAM sequence: AGG
tttgagtgactccaggtatc

SEQ ID NO: 12903 - DNA, 20 bp, Artificial Sequence
  Description of Artificial Sequence: Synthetic oligonucleotide
  Target: FXN; (-) strand; PAM type: NRG; PAM sequence: CAG
ttttgagtgactccaggtat

SEQ ID NO: 12904 - DNA, 20 bp, Artificial Sequence
  Description of Artificial Sequence: Synthetic oligonucleotide
  Target: FXN; (-) strand; PAM type: NRG; PAM sequence: AGG
gaaatcttttgagtgactcc

SEQ ID NO: 12905 - DNA, 20 bp, Artificial Sequence
  Description of Artificial Sequence: Synthetic oligonucleotide
  Target: FXN; (-) strand; PAM type: NRG; PAM sequence: CAG
ggaaatcttttgagtgactc

SEQ ID NO: 12906 - DNA, 20 bp, Artificial Sequence
  Description of Artificial Sequence: Synthetic oligonucleotide
  Target: FXN; (-) strand; PAM type: NRG; PAM sequence: GAG
atcggaattggaaatctttt

SEQ ID NO: 12907 - DNA, 20 bp, Artificial Sequence
  Description of Artificial Sequence: Synthetic oligonucleotide
  Target: FXN; (-) strand; PAM type: NRG; PAM sequence: TGG
tgactttttcctatcggaat

SEQ ID NO: 12908 - DNA, 20 bp, Artificial Sequence
  Description of Artificial Sequence: Synthetic oligonucleotide
  Target: FXN; (-) strand; PAM type: NRG; PAM sequence: CGG
caaaattgactttttcctat

SEQ ID NO: 12909 - DNA, 20 bp, Artificial Sequence
  Description of Artificial Sequence: Synthetic oligonucleotide
  Target: FXN; (-) strand; PAM type: NRG; PAM sequence: AAG
gggtgcacatgcaaccactg

SEQ ID NO: 12910 - DNA, 20 bp, Artificial Sequence
  Description of Artificial Sequence: Synthetic oligonucleotide
  Target: FXN; (-) strand; PAM type: NRG; PAM sequence: GGG
tcagcatacagcaaatcagg

SEQ ID NO: 12911 - DNA, 20 bp, Artificial Sequence
  Description of Artificial Sequence: Synthetic oligonucleotide
  Target: FXN; (-) strand; PAM type: NRG; PAM sequence: GGG
ctcagcatacagcaaatcag

SEQ ID NO: 12912 - DNA, 20 bp, Artificial Sequence
  Description of Artificial Sequence: Synthetic oligonucleotide
  Target: FXN; (-) strand; PAM type: NRG; PAM sequence: GGG
cctcagcatacagcaaatca

SEQ ID NO: 12913 - DNA, 20 bp, Artificial Sequence
  Description of Artificial Sequence: Synthetic oligonucleotide
  Target: FXN; (-) strand; PAM type: NRG; PAM sequence: AGG
gcctcagcatacagcaaatc

SEQ ID NO: 12914 - DNA, 20 bp, Artificial Sequence
  Description of Artificial Sequence: Synthetic oligonucleotide
  Target: FXN; (-) strand; PAM type: NRG; PAM sequence: CAG
tgcctcagcatacagcaaat

SEQ ID NO: 12915 - DNA, 20 bp, Artificial Sequence
  Description of Artificial Sequence: Synthetic oligonucleotide
  Target: FXN; (-) strand; PAM type: NRG; PAM sequence: CAG
caccacaatgcctcagcata

SEQ ID NO: 12916 - DNA, 20 bp, Artificial Sequence
  Description of Artificial Sequence: Synthetic oligonucleotide
  Target: FXN; (-) strand; PAM type: NRG; PAM sequence: CAG
cgtccatcaccacaatgcct

SEQ ID NO: 12917 - DNA, 20 bp, Artificial Sequence
  Description of Artificial Sequence: Synthetic oligonucleotide
  Target: FXN; (-) strand; PAM type: NRG; PAM sequence: AGG
taggggcagatgcgtgctca

SEQ ID NO: 12918 - DNA, 20 bp, Artificial Sequence
  Description of Artificial Sequence: Synthetic oligonucleotide
  Target: FXN; (-) strand; PAM type: NRG; PAM sequence: AAG
ctaggggcagatgcgtgctc

SEQ ID NO: 12919 - DNA, 20 bp, Artificial Sequence
  Description of Artificial Sequence: Synthetic oligonucleotide
  Target: FXN; (-) strand; PAM type: NRG; PAM sequence: CAG
ctcagggcaagaactagggg

SEQ ID NO: 12920 - DNA, 20 bp, Artificial Sequence
  Description of Artificial Sequence: Synthetic oligonucleotide
  Target: FXN; (-) strand; PAM type: NRG; PAM sequence: GGG
ggactcagggcaagaactag

SEQ ID NO: 12921 - DNA, 20 bp, Artificial Sequence
  Description of Artificial Sequence: Synthetic oligonucleotide
  Target: FXN; (-) strand; PAM type: NRG; PAM sequence: GGG
aggactcagggcaagaacta

SEQ ID NO: 12922 - DNA, 20 bp, Artificial Sequence
  Description of Artificial Sequence: Synthetic oligonucleotide
  Target: FXN; (-) strand; PAM type: NRG; PAM sequence: AGG
gaggactcagggcaagaact

SEQ ID NO: 12923 - DNA, 20 bp, Artificial Sequence
  Description of Artificial Sequence: Synthetic oligonucleotide
  Target: FXN; (-) strand; PAM type: NRG; PAM sequence: TAG
cgaggactcagggcaagaac

SEQ ID NO: 12924 - DNA, 20 bp, Artificial Sequence
  Description of Artificial Sequence: Synthetic oligonucleotide
  Target: FXN; (-) strand; PAM type: NRG; PAM sequence: AAG
ctccttcgaggactcagggc

SEQ ID NO: 12925 - DNA, 20 bp, Artificial Sequence
  Description of Artificial Sequence: Synthetic oligonucleotide
  Target: FXN; (-) strand; PAM type: NRG; PAM sequence: GGG
ctgcctccttcgaggactca

SEQ ID NO: 12926 - DNA, 20 bp, Artificial Sequence
  Description of Artificial Sequence: Synthetic oligonucleotide
  Target: FXN; (-) strand; PAM type: NRG; PAM sequence: AGG
cctgcctccttcgaggactc

SEQ ID NO: 12927 - DNA, 20 bp, Artificial Sequence
  Description of Artificial Sequence: Synthetic oligonucleotide
  Target: FXN; (-) strand; PAM type: NRG; PAM sequence: CAG
tcctgcctccttcgaggact

SEQ ID NO: 12928 - DNA, 20 bp, Artificial Sequence
  Description of Artificial Sequence: Synthetic oligonucleotide
  Target: FXN; (-) strand; PAM type: NRG; PAM sequence: AGG
tgtctctcctgcctccttcg

SEQ ID NO: 12929 - DNA, 20 bp, Artificial Sequence
  Description of Artificial Sequence: Synthetic oligonucleotide
  Target: FXN; (-) strand; PAM type: NRG; PAM sequence: GAG
atgtctctcctgcctccttc

SEQ ID NO: 12930 - DNA, 20 bp, Artificial Sequence
  Description of Artificial Sequence: Synthetic oligonucleotide
  Target: FXN; (-) strand; PAM type: NRG; PAM sequence: CGG
ctggtctcatcactgatgag

SEQ ID NO: 12931 - DNA, 20 bp, Artificial Sequence
  Description of Artificial Sequence: Synthetic oligonucleotide
  Target: FXN; (-) strand; PAM type: NRG; PAM sequence: GAG
ggtctggtctcatcactgat

SEQ ID NO: 12932 - DNA, 20 bp, Artificial Sequence
  Description of Artificial Sequence: Synthetic oligonucleotide
  Target: FXN; (-) strand; PAM type: NRG; PAM sequence: TGG
taagacgcgagttccaggtc

SEQ ID NO: 12933 - DNA, 20 bp, Artificial Sequence
  Description of Artificial Sequence: Synthetic oligonucleotide
  Target: FXN; (-) strand; PAM type: NRG; PAM sequence: AGG
gagtataagacgcgagttcc

SEQ ID NO: 12934 - DNA, 20 bp, Artificial Sequence
  Description of Artificial Sequence: Synthetic oligonucleotide
  Target: FXN; (-) strand; PAM type: NRG; PAM sequence: CAG
tgagtataagacgcgagttc

SEQ ID NO: 12935 - DNA, 20 bp, Artificial Sequence
  Description of Artificial Sequence: Synthetic oligonucleotide
  Target: FXN; (-) strand; PAM type: NRG; PAM sequence: GAG
gaggactgagtataagacgc

SEQ ID NO: 12936 - DNA, 20 bp, Artificial Sequence
  Description of Artificial Sequence: Synthetic oligonucleotide
  Target: FXN; (-) strand; PAM type: NRG; PAM sequence: AAG
aagggcagaggactgagtat

SEQ ID NO: 12937 - DNA, 20 bp, Artificial Sequence
  Description of Artificial Sequence: Synthetic oligonucleotide
  Target: FXN; (-) strand; PAM type: NRG; PAM sequence: GAG
agcagaaagggcagaggact

SEQ ID NO: 12938 - DNA, 20 bp, Artificial Sequence
  Description of Artificial Sequence: Synthetic oligonucleotide
  Target: FXN; (-) strand; PAM type: NRG; PAM sequence: AGG
caatccagcagaaagggcag

SEQ ID NO: 12939 - DNA, 20 bp, Artificial Sequence
  Description of Artificial Sequence: Synthetic oligonucleotide
  Target: FXN; (-) strand; PAM type: NRG; PAM sequence: GAG
acaatccagcagaaagggca

SEQ ID NO: 12940 - DNA, 20 bp, Artificial Sequence
  Description of Artificial Sequence: Synthetic oligonucleotide
  Target: FXN; (-) strand; PAM type: NRG; PAM sequence: CAG
ccacaatccagcagaaaggg

SEQ ID NO: 12941 - DNA, 20 bp, Artificial Sequence
  Description of Artificial Sequence: Synthetic oligonucleotide
  Target: FXN; (-) strand; PAM type: NRG; PAM sequence: GGG
gggccacaatccagcagaaa

SEQ ID NO: 12942 - DNA, 20 bp, Artificial Sequence
  Description of Artificial Sequence: Synthetic oligonucleotide
  Target: FXN; (-) strand; PAM type: NRG; PAM sequence: AGG
ggggccacaatccagcagaa

SEQ ID NO: 12943 - DNA, 20 bp, Artificial Sequence
  Description of Artificial Sequence: Synthetic oligonucleotide
  Target: FXN; (-) strand; PAM type: NRG; PAM sequence: AAG
gggggccacaatccagcaga

SEQ ID NO: 12944 - DNA, 20 bp, Artificial Sequence
  Description of Artificial Sequence: Synthetic oligonucleotide
  Target: FXN; (-) strand; PAM type: NRG; PAM sequence: CAG
actggggggccacaatccag

SEQ ID NO: 12945 - DNA, 20 bp, Artificial Sequence
  Description of Artificial Sequence: Synthetic oligonucleotide
  Target: FXN; (-) strand; PAM type: NRG; PAM sequence: CAG
tatactggggggccacaatc

SEQ ID NO: 12946 - DNA, 20 bp, Artificial Sequence
  Description of Artificial Sequence: Synthetic oligonucleotide
  Target: FXN; (-) strand; PAM type: NRG; PAM sequence: GGG
gtgttgcaccctatactggg

SEQ ID NO: 12947 - DNA, 20 bp, Artificial Sequence
  Description of Artificial Sequence: Synthetic oligonucleotide
  Target: FXN; (-) strand; PAM type: NRG; PAM sequence: GGG
tgtgttgcaccctatactgg

SEQ ID NO: 12948 - DNA, 20 bp, Artificial Sequence
  Description of Artificial Sequence: Synthetic oligonucleotide
  Target: FXN; (-) strand; PAM type: NRG; PAM sequence: GGG
gtgtgttgcaccctatactg

SEQ ID NO: 12949 - DNA, 20 bp, Artificial Sequence
  Description of Artificial Sequence: Synthetic oligonucleotide
  Target: FXN; (-) strand; PAM type: NRG; PAM sequence: GGG
tgtgtgttgcaccctatact

SEQ ID NO: 12950 - DNA, 20 bp, Artificial Sequence
  Description of Artificial Sequence: Synthetic oligonucleotide
  Target: FXN; (-) strand; PAM type: NRG; PAM sequence: TGG
ttgtgtgttgcaccctatac

SEQ ID NO: 12951 - DNA, 20 bp, Artificial Sequence
  Description of Artificial Sequence: Synthetic oligonucleotide
  Target: FXN; (-) strand; PAM type: NRG; PAM sequence: CAG
tttgtggcccttaaatgctc

SEQ ID NO: 12952 - DNA, 20 bp, Artificial Sequence
  Description of Artificial Sequence: Synthetic oligonucleotide
  Target: FXN; (-) strand; PAM type: NRG; PAM sequence: TGG
ttggtaatttgttctctttg

SEQ ID NO: 12953 - DNA, 20 bp, Artificial Sequence
  Description of Artificial Sequence: Synthetic oligonucleotide
  Target: FXN; (-) strand; PAM type: NRG; PAM sequence: TGG
aagaatcaacacacaatcat

SEQ ID NO: 12954 - DNA, 20 bp, Artificial Sequence
  Description of Artificial Sequence: Synthetic oligonucleotide
  Target: FXN; (-) strand; PAM type: NRG; PAM sequence: AAG
taataaaaaaaaagagctca

SEQ ID NO: 12955 - DNA, 20 bp, Artificial Sequence
  Description of Artificial Sequence: Synthetic oligonucleotide
  Target: FXN; (-) strand; PAM type: NRG; PAM sequence: GAG
agtataataataaaaaaaaa

SEQ ID NO: 12956 - DNA, 20 bp, Artificial Sequence
  Description of Artificial Sequence: Synthetic oligonucleotide
  Target: FXN; (-) strand; PAM type: NRG; PAM sequence: AAG
aaagtataataataaaaaaa

SEQ ID NO: 12957 - DNA, 20 bp, Artificial Sequence
  Description of Artificial Sequence: Synthetic oligonucleotide
  Target: FXN; (-) strand; PAM type: NRG; PAM sequence: AAG
cacatgtaccctaacactta

SEQ ID NO: 12958 - DNA, 20 bp, Artificial Sequence
  Description of Artificial Sequence: Synthetic oligonucleotide
  Target: FXN; (-) strand; PAM type: NRG; PAM sequence: TGG
atgggtgcagcacaccagca

SEQ ID NO: 12959 - DNA, 20 bp, Artificial Sequence
  Description of Artificial Sequence: Synthetic oligonucleotide
  Target: FXN; (-) strand; PAM type: NRG; PAM sequence: CAG
agttaatgggtgcagcacac

SEQ ID NO: 12960 - DNA, 20 bp, Artificial Sequence
  Description of Artificial Sequence: Synthetic oligonucleotide
  Target: FXN; (-) strand; PAM type: NRG; PAM sequence: CAG
aaatgacgagttaatgggtg

SEQ ID NO: 12961 - DNA, 20 bp, Artificial Sequence
  Description of Artificial Sequence: Synthetic oligonucleotide
  Target: FXN; (-) strand; PAM type: NRG; PAM sequence: GGG
atgctaaatgacgagttaat

SEQ ID NO: 12962 - DNA, 20 bp, Artificial Sequence
  Description of Artificial Sequence: Synthetic oligonucleotide
  Target: FXN; (-) strand; PAM type: NRG; PAM sequence: TGG
aatgctaaatgacgagttaa

SEQ ID NO: 12963 - DNA, 20 bp, Artificial Sequence
  Description of Artificial Sequence: Synthetic oligonucleotide
  Target: FXN; (-) strand; PAM type: NRG; PAM sequence: GAG
tatacctaatgctaaatgac

SEQ ID NO: 12964 - DNA, 20 bp, Artificial Sequence
  Description of Artificial Sequence: Synthetic oligonucleotide
  Target: FXN; (-) strand; PAM type: NRG; PAM sequence: GAG
ggggggagggatagctttag

SEQ ID NO: 12965 - DNA, 20 bp, Artificial Sequence
  Description of Artificial Sequence: Synthetic oligonucleotide
  Target: FXN; (-) strand; PAM type: NRG; PAM sequence: AGG
aaggggggagggatagcttt

SEQ ID NO: 12966 - DNA, 20 bp, Artificial Sequence
  Description of Artificial Sequence: Synthetic oligonucleotide
  Target: FXN; (-) strand; PAM type: NRG; PAM sequence: TAG
gaaggggggagggatagctt

SEQ ID NO: 12967 - DNA, 20 bp, Artificial Sequence
  Description of Artificial Sequence: Synthetic oligonucleotide
  Target: FXN; (-) strand; PAM type: NRG; PAM sequence: TAG
gagggggaaggggggaggga

SEQ ID NO: 12968 - DNA, 20 bp, Artificial Sequence
  Description of Artificial Sequence: Synthetic oligonucleotide
  Target: FXN; (-) strand; PAM type: NRG; PAM sequence: GGG
gagggagggggaagggggga

SEQ ID NO: 12969 - DNA, 20 bp, Artificial Sequence
  Description of Artificial Sequence: Synthetic oligonucleotide
  Target: FXN; (-) strand; PAM type: NRG; PAM sequence: AGG
ggagggagggggaagggggg

SEQ ID NO: 12970 - DNA, 20 bp, Artificial Sequence
  Description of Artificial Sequence: Synthetic oligonucleotide
  Target: FXN; (-) strand; PAM type: NRG; PAM sequence: GAG
tggagggagggggaaggggg

SEQ ID NO: 12971 - DNA, 20 bp, Artificial Sequence
  Description of Artificial Sequence: Synthetic oligonucleotide
  Target: FXN; (-) strand; PAM type: NRG; PAM sequence: GGG
ggtggagggagggggaaggg

SEQ ID NO: 12972 - DNA, 20 bp, Artificial Sequence
  Description of Artificial Sequence: Synthetic oligonucleotide
  Target: FXN; (-) strand; PAM type: NRG; PAM sequence: GGG
gggtggagggagggggaagg

SEQ ID NO: 12973 - DNA, 20 bp, Artificial Sequence
  Description of Artificial Sequence: Synthetic oligonucleotide
  Target: FXN; (-) strand; PAM type: NRG; PAM sequence: GGG
ggggtggagggagggggaag

SEQ ID NO: 12974 - DNA, 20 bp, Artificial Sequence
  Description of Artificial Sequence: Synthetic oligonucleotide
  Target: FXN; (-) strand; PAM type: NRG; PAM sequence: GGG
tggggtggagggagggggaa

SEQ ID NO: 12975 - DNA, 20 bp, Artificial Sequence
  Description of Artificial Sequence: Synthetic oligonucleotide
  Target: FXN; (-) strand; PAM type: NRG; PAM sequence: AGG
gtggggtggagggaggggga

SEQ ID NO: 12976 - DNA, 20 bp, Artificial Sequence
  Description of Artificial Sequence: Synthetic oligonucleotide
  Target: FXN; (-) strand; PAM type: NRG; PAM sequence: AAG
tgtggggtggagggaggggg

SEQ ID NO: 12977 - DNA, 20 bp, Artificial Sequence
  Description of Artificial Sequence: Synthetic oligonucleotide
  Target: FXN; (-) strand; PAM type: NRG; PAM sequence: GGG
tgttgtggggtggagggagg

SEQ ID NO: 12978 - DNA, 20 bp, Artificial Sequence
  Description of Artificial Sequence: Synthetic oligonucleotide
  Target: FXN; (-) strand; PAM type: NRG; PAM sequence: GGG
ctgttgtggggtggagggag

SEQ ID NO: 12979 - DNA, 20 bp, Artificial Sequence
  Description of Artificial Sequence: Synthetic oligonucleotide
  Target: FXN; (-) strand; PAM type: NRG; PAM sequence: GGG
actgttgtggggtggaggga

SEQ ID NO: 12980 - DNA, 20 bp, Artificial Sequence
  Description of Artificial Sequence: Synthetic oligonucleotide
  Target: FXN; (-) strand; PAM type: NRG; PAM sequence: AGG
gactgttgtggggtggaggg

SEQ ID NO: 12981 - DNA, 20 bp, Artificial Sequence
  Description of Artificial Sequence: Synthetic oligonucleotide
  Target: FXN; (-) strand; PAM type: NRG; PAM sequence: GAG
ggactgttgtggggtggagg

SEQ ID NO: 12982 - DNA, 20 bp, Artificial Sequence
  Description of Artificial Sequence: Synthetic oligonucleotide
  Target: FXN; (-) strand; PAM type: NRG; PAM sequence: GGG
ggggactgttgtggggtgga

SEQ ID NO: 12983 - DNA, 20 bp, Artificial Sequence
  Description of Artificial Sequence: Synthetic oligonucleotide
  Target: FXN; (-) strand; PAM type: NRG; PAM sequence: AGG
tggggactgttgtggggtgg

SEQ ID NO: 12984 - DNA, 20 bp, Artificial Sequence
  Description of Artificial Sequence: Synthetic oligonucleotide
  Target: FXN; (-) strand; PAM type: NRG; PAM sequence: GAG
ctggggactgttgtggggtg

SEQ ID NO: 12985 - DNA, 20 bp, Artificial Sequence
  Description of Artificial Sequence: Synthetic oligonucleotide
  Target: FXN; (-) strand; PAM type: NRG; PAM sequence: TGG
ctctggggactgttgtgggg

SEQ ID NO: 12986 - DNA, 20 bp, Artificial Sequence
  Description of Artificial Sequence: Synthetic oligonucleotide
  Target: FXN; (-) strand; PAM type: NRG; PAM sequence: GGG
acactctggggactgttgtg

SEQ ID NO: 12987 - DNA, 20 bp, Artificial Sequence
  Description of Artificial Sequence: Synthetic oligonucleotide
  Target: FXN; (-) strand; PAM type: NRG; PAM sequence: GGG
cacactctggggactgttgt

SEQ ID NO: 12988 - DNA, 20 bp, Artificial Sequence
  Description of Artificial Sequence: Synthetic oligonucleotide
  Target: FXN; (-) strand; PAM type: NRG; PAM sequence: TGG
tcacactctggggactgttg

SEQ ID NO: 12989 - DNA, 20 bp, Artificial Sequence
  Description of Artificial Sequence: Synthetic oligonucleotide
  Target: FXN; (-) strand; PAM type: NRG; PAM sequence: GGG
aaggggaacatcacactctg

SEQ ID NO: 12990 - DNA, 20 bp, Artificial Sequence
  Description of Artificial Sequence: Synthetic oligonucleotide
  Target: FXN; (-) strand; PAM type: NRG; PAM sequence: GGG
gaaggggaacatcacactct

SEQ ID NO: 12991 - DNA, 20 bp, Artificial Sequence
  Description of Artificial Sequence: Synthetic oligonucleotide
  Target: FXN; (-) strand; PAM type: NRG; PAM sequence: TGG
ggaaggggaacatcacactc

SEQ ID NO: 12992 - DNA, 20 bp, Artificial Sequence
  Description of Artificial Sequence: Synthetic oligonucleotide
  Target: FXN; (-) strand; PAM type: NRG; PAM sequence: GGG
gaacacatggtcacaggaag

SEQ ID NO: 12993 - DNA, 20 bp, Artificial Sequence
  Description of Artificial Sequence: Synthetic oligonucleotide
  Target: FXN; (-) strand; PAM type: NRG; PAM sequence: GGG
agaacacatggtcacaggaa

SEQ ID NO: 12994 - DNA, 20 bp, Artificial Sequence
  Description of Artificial Sequence: Synthetic oligonucleotide
  Target: FXN; (-) strand; PAM type: NRG; PAM sequence: AGG
gagaacacatggtcacagga

SEQ ID NO: 12995 - DNA, 20 bp, Artificial Sequence
  Description of Artificial Sequence: Synthetic oligonucleotide
  Target: FXN; (-) strand; PAM type: NRG; PAM sequence: AAG
tgagaacacatggtcacagg

SEQ ID NO: 12996 - DNA, 20 bp, Artificial Sequence
  Description of Artificial Sequence: Synthetic oligonucleotide
  Target: FXN; (-) strand; PAM type: NRG; PAM sequence: AGG
caatgagaacacatggtcac

SEQ ID NO: 12997 - DNA, 20 bp, Artificial Sequence
  Description of Artificial Sequence: Synthetic oligonucleotide
  Target: FXN; (-) strand; PAM type: NRG; PAM sequence: CAG
acaatgagaacacatggtca

SEQ ID NO: 12998 - DNA, 20 bp, Artificial Sequence
  Description of Artificial Sequence: Synthetic oligonucleotide
  Target: FXN; (-) strand; PAM type: NRG; PAM sequence: TGG
aactgaacaatgagaacaca

SEQ ID NO: 12999 - DNA, 20 bp, Artificial Sequence
  Description of Artificial Sequence: Synthetic oligonucleotide
  Target: FXN; (-) strand; PAM type: NRG; PAM sequence: GAG
ataggtgggaactgaacaat

SEQ ID NO: 13000 - DNA, 20 bp, Artificial Sequence
  Description of Artificial Sequence: Synthetic oligonucleotide
  Target: FXN; (-) strand; PAM type: NRG; PAM sequence: GGG
gcatattctcactcataggt

SEQ ID NO: 13001 - DNA, 20 bp, Artificial Sequence
  Description of Artificial Sequence: Synthetic oligonucleotide
  Target: FXN; (-) strand; PAM type: NRG; PAM sequence: TGG
tgcatattctcactcatagg

SEQ ID NO: 13002 - DNA, 20 bp, Artificial Sequence
  Description of Artificial Sequence: Synthetic oligonucleotide
  Target: FXN; (-) strand; PAM type: NRG; PAM sequence: AGG
cactgcatattctcactcat

SEQ ID NO: 13003 - DNA, 20 bp, Artificial Sequence
  Description of Artificial Sequence: Synthetic oligonucleotide
  Target: FXN; (-) strand; PAM type: NRG; PAM sequence: TAG
acactgcatattctcactca

SEQ ID NO: 13004 - DNA, 20 bp, Artificial Sequence
  Description of Artificial Sequence: Synthetic oligonucleotide
  Target: FXN; (-) strand; PAM type: NRG; PAM sequence: AAG
cattctcagtaaactatcgc

SEQ ID NO: 13005 - DNA, 20 bp, Artificial Sequence
  Description of Artificial Sequence: Synthetic oligonucleotide
  Target: FXN; (-) strand; PAM type: NRG; PAM sequence: CAG
aaactggaaatcatcattct

SEQ ID NO: 13006 - DNA, 20 bp, Artificial Sequence
  Description of Artificial Sequence: Synthetic oligonucleotide
  Target: FXN; (-) strand; PAM type: NRG; PAM sequence: TGG
tgtagggacatggatgaaac

SEQ ID NO: 13007 - DNA, 20 bp, Artificial Sequence
  Description of Artificial Sequence: Synthetic oligonucleotide
  Target: FXN; (-) strand; PAM type: NRG; PAM sequence: TGG
tcatgtcctttgtagggaca

SEQ ID NO: 13008 - DNA, 20 bp, Artificial Sequence
  Description of Artificial Sequence: Synthetic oligonucleotide
  Target: FXN; (-) strand; PAM type: NRG; PAM sequence: GGG
atgagttcatgtcctttgta

SEQ ID NO: 13009 - DNA, 20 bp, Artificial Sequence
  Description of Artificial Sequence: Synthetic oligonucleotide
  Target: FXN; (-) strand; PAM type: NRG; PAM sequence: AGG
gatgagttcatgtcctttgt

SEQ ID NO: 13010 - DNA, 20 bp, Artificial Sequence
  Description of Artificial Sequence: Synthetic oligonucleotide
  Target: FXN; (-) strand; PAM type: NRG; PAM sequence: TAG
tgatgagttcatgtcctttg

SEQ ID NO: 13011 - DNA, 20 bp, Artificial Sequence
  Description of Artificial Sequence: Synthetic oligonucleotide
  Target: FXN; (-) strand; PAM type: NRG; PAM sequence: GAG
atgcagcaataaaaaatgat

SEQ ID NO: 13012 - DNA, 20 bp, Artificial Sequence
  Description of Artificial Sequence: Synthetic oligonucleotide
  Target: FXN; (-) strand; PAM type: NRG; PAM sequence: CAG
atacaccatggaatactatg

SEQ ID NO: 13013 - DNA, 20 bp, Artificial Sequence
  Description of Artificial Sequence: Synthetic oligonucleotide
  Target: FXN; (-) strand; PAM type: NRG; PAM sequence: TGG
aatgtggcacatatacacca

SEQ ID NO: 13014 - DNA, 20 bp, Artificial Sequence
  Description of Artificial Sequence: Synthetic oligonucleotide
  Target: FXN; (-) strand; PAM type: NRG; PAM sequence: TGG
tagactggattaagaaaatg

SEQ ID NO: 13015 - DNA, 20 bp, Artificial Sequence
  Description of Artificial Sequence: Synthetic oligonucleotide
  Target: FXN; (-) strand; PAM type: NRG; PAM sequence: AAG
caacaatgatagactggatt

SEQ ID NO: 13016 - DNA, 20 bp, Artificial Sequence
  Description of Artificial Sequence: Synthetic oligonucleotide
  Target: FXN; (-) strand; PAM type: NRG; PAM sequence: TGG
ctcatccaacaatgatagac

SEQ ID NO: 13017 - DNA, 20 bp, Artificial Sequence
  Description of Artificial Sequence: Synthetic oligonucleotide
  Target: FXN; (-) strand; PAM type: NRG; PAM sequence: TAG
aagagctcatccaacaatga

SEQ ID NO: 13018 - DNA, 20 bp, Artificial Sequence
  Description of Artificial Sequence: Synthetic oligonucleotide
  Target: FXN; (-) strand; PAM type: NRG; PAM sequence: GAG
ttatttttccatgagataaa

SEQ ID NO: 13019 - DNA, 20 bp, Artificial Sequence
  Description of Artificial Sequence: Synthetic oligonucleotide
  Target: FXN; (-) strand; PAM type: NRG; PAM sequence: AAG
aattatttttccatgagata

SEQ ID NO: 13020 - DNA, 20 bp, Artificial Sequence
  Description of Artificial Sequence: Synthetic oligonucleotide
  Target: FXN; (-) strand; PAM type: NRG; PAM sequence: GAG
tttataaattatttttccat

SEQ ID NO: 13021 - DNA, 20 bp, Artificial Sequence
  Description of Artificial Sequence: Synthetic oligonucleotide
  Target: FXN; (-) strand; PAM type: NRG; PAM sequence: GAG
tttcccactcctctcataca

SEQ ID NO: 13022 - DNA, 20 bp, Artificial Sequence
  Description of Artificial Sequence: Synthetic oligonucleotide
  Target: FXN; (-) strand; PAM type: NRG; PAM sequence: CAG
tatttcccactcctctcata

SEQ ID NO: 13023 - DNA, 20 bp, Artificial Sequence
  Description of Artificial Sequence: Synthetic oligonucleotide
  Target: FXN; (-) strand; PAM type: NRG; PAM sequence: AAG
gctatttccattgtcccaaa

SEQ ID NO: 13024 - DNA, 20 bp, Artificial Sequence
  Description of Artificial Sequence: Synthetic oligonucleotide
  Target: FXN; (-) strand; PAM type: NRG; PAM sequence: CAG
acatcaccactatctaattc

SEQ ID NO: 13025 - DNA, 20 bp, Artificial Sequence
  Description of Artificial Sequence: Synthetic oligonucleotide
  Target: FXN; (-) strand; PAM type: NRG; PAM sequence: AAG
ggagtttttagtatttcaca

SEQ ID NO: 13026 - DNA, 20 bp, Artificial Sequence
  Description of Artificial Sequence: Synthetic oligonucleotide
  Target: FXN; (-) strand; PAM type: NRG; PAM sequence: TAG
ctgtataattcaggagtttt

SEQ ID NO: 13027 - DNA, 20 bp, Artificial Sequence
  Description of Artificial Sequence: Synthetic oligonucleotide
  Target: FXN; (-) strand; PAM type: NRG; PAM sequence: GAG
cttaaaactgtataattcag

SEQ ID NO: 13028 - DNA, 20 bp, Artificial Sequence
  Description of Artificial Sequence: Synthetic oligonucleotide
  Target: FXN; (-) strand; PAM type: NRG; PAM sequence: AGG
ttcttaaaactgtataattc

SEQ ID NO: 13029 - DNA, 20 bp, Artificial Sequence
  Description of Artificial Sequence: Synthetic oligonucleotide
  Target: FXN; (-) strand; PAM type: NRG; PAM sequence: CAG
tttcttaaaactgtataatt

SEQ ID NO: 13030 - DNA, 20 bp, Artificial Sequence
  Description of Artificial Sequence: Synthetic oligonucleotide
  Target: FXN; (-) strand; PAM type: NRG; PAM sequence: AAG
tctcaaaaacaaataaataa

SEQ ID NO: 13031 - DNA, 20 bp, Artificial Sequence
  Description of Artificial Sequence: Synthetic oligonucleotide
  Target: FXN; (-) strand; PAM type: NRG; PAM sequence: GAG
acttcagcctgggtgacaca

SEQ ID NO: 13032 - DNA, 20 bp, Artificial Sequence
  Description of Artificial Sequence: Synthetic oligonucleotide
  Target: FXN; (-) strand; PAM type: NRG; PAM sequence: CAG
acacttcagcctgggtgaca

SEQ ID NO: 13033 - DNA, 20 bp, Artificial Sequence
  Description of Artificial Sequence: Synthetic oligonucleotide
  Target: FXN; (-) strand; PAM type: NRG; PAM sequence: GGG
acgccaccacacttcagcct

SEQ ID NO: 13034 - DNA, 20 bp, Artificial Sequence
  Description of Artificial Sequence: Synthetic oligonucleotide
  Target: FXN; (-) strand; PAM type: NRG; PAM sequence: TGG
cacgccaccacacttcagcc

SEQ ID NO: 13035 - DNA, 20 bp, Artificial Sequence
  Description of Artificial Sequence: Synthetic oligonucleotide
  Target: FXN; (-) strand; PAM type: NRG; PAM sequence: CAG
gtgatcacgccaccacactt

SEQ ID NO: 13036 - DNA, 20 bp, Artificial Sequence
  Description of Artificial Sequence: Synthetic oligonucleotide
  Target: FXN; (-) strand; PAM type: NRG; PAM sequence: CGG
gagattgaggctgcaataac

SEQ ID NO: 13037 - DNA, 20 bp, Artificial Sequence
  Description of Artificial Sequence: Synthetic oligonucleotide
  Target: FXN; (-) strand; PAM type: NRG; PAM sequence: AGG
cgcttgagcctcagagattg

SEQ ID NO: 13038 - DNA, 20 bp, Artificial Sequence
  Description of Artificial Sequence: Synthetic oligonucleotide
  Target: FXN; (-) strand; PAM type: NRG; PAM sequence: GAG
tcgcttgagcctcagagatt

SEQ ID NO: 13039 - DNA, 20 bp, Artificial Sequence
  Description of Artificial Sequence: Synthetic oligonucleotide
  Target: FXN; (-) strand; PAM type: NRG; PAM sequence: GAG
ggagaatcgcttgagcctca

SEQ ID NO: 13040 - DNA, 20 bp, Artificial Sequence
  Description of Artificial Sequence: Synthetic oligonucleotide
  Target: FXN; (-) strand; PAM type: NRG; PAM sequence: CAG
tgggagaatcgcttgagcct

SEQ ID NO: 13041 - DNA, 20 bp, Artificial Sequence
  Description of Artificial Sequence: Synthetic oligonucleotide
  Target: FXN; (-) strand; PAM type: NRG; PAM sequence: GAG
ctgaggtgggagaatcgctt

SEQ ID NO: 13042 - DNA, 20 bp, Artificial Sequence
  Description of Artificial Sequence: Synthetic oligonucleotide
  Target: FXN; (-) strand; PAM type: NRG; PAM sequence: GAG
tacttggtaggctgaggtgg

SEQ ID NO: 13043 - DNA, 20 bp, Artificial Sequence
  Description of Artificial Sequence: Synthetic oligonucleotide
  Target: FXN; (-) strand; PAM type: NRG; PAM sequence: GGG
tctacttggtaggctgaggt

SEQ ID NO: 13044 - DNA, 20 bp, Artificial Sequence
  Description of Artificial Sequence: Synthetic oligonucleotide
  Target: FXN; (-) strand; PAM type: NRG; PAM sequence: TGG
atctacttggtaggctgagg

SEQ ID NO: 13045 - DNA, 20 bp, Artificial Sequence
  Description of Artificial Sequence: Synthetic oligonucleotide
  Target: FXN; (-) strand; PAM type: NRG; PAM sequence: AGG
cacatctacttggtaggctg

SEQ ID NO: 13046 - DNA, 20 bp, Artificial Sequence
  Description of Artificial Sequence: Synthetic oligonucleotide
  Target: FXN; (-) strand; PAM type: NRG; PAM sequence: GAG
tcacatctacttggtaggct

SEQ ID NO: 13047 - DNA, 20 bp, Artificial Sequence
  Description of Artificial Sequence: Synthetic oligonucleotide
  Target: FXN; (-) strand; PAM type: NRG; PAM sequence: AGG
tatagtcacatctacttggt

SEQ ID NO: 13048 - DNA, 20 bp, Artificial Sequence
  Description of Artificial Sequence: Synthetic oligonucleotide
  Target: FXN; (-) strand; PAM type: NRG; PAM sequence: TAG
ctatagtcacatctacttgg

SEQ ID NO: 13049 - DNA, 20 bp, Artificial Sequence
  Description of Artificial Sequence: Synthetic oligonucleotide
  Target: FXN; (-) strand; PAM type: NRG; PAM sequence: TGG
cacctatagtcacatctact

SEQ ID NO: 13050 - DNA, 20 bp, Artificial Sequence
  Description of Artificial Sequence: Synthetic oligonucleotide
  Target: FXN; (-) strand; PAM type: NRG; PAM sequence: TAG
ggtgtggtggtgcgcaccta

SEQ ID NO: 13051 - DNA, 20 bp, Artificial Sequence
  Description of Artificial Sequence: Synthetic oligonucleotide
  Target: FXN; (-) strand; PAM type: NRG; PAM sequence: TGG
tacaaattcactgggtgtgg

SEQ ID NO: 13052 - DNA, 20 bp, Artificial Sequence
  Description of Artificial Sequence: Synthetic oligonucleotide
  Target: FXN; (-) strand; PAM type: NRG; PAM sequence: TGG
aattacaaattcactgggtg

SEQ ID NO: 13053 - DNA, 20 bp, Artificial Sequence
  Description of Artificial Sequence: Synthetic oligonucleotide
  Target: FXN; (-) strand; PAM type: NRG; PAM sequence: GGG
caaaaaattacaaattcact

SEQ ID NO: 13054 - DNA, 20 bp, Artificial Sequence
  Description of Artificial Sequence: Synthetic oligonucleotide
  Target: FXN; (-) strand; PAM type: NRG; PAM sequence: TGG
acaaaaaattacaaattcac

SEQ ID NO: 13055 - DNA, 20 bp, Artificial Sequence
  Description of Artificial Sequence: Synthetic oligonucleotide
  Target: FXN; (-) strand; PAM type: NRG; PAM sequence: TGG
caagaccagactgggcaaca

SEQ ID NO: 13056 - DNA, 20 bp, Artificial Sequence
  Description of Artificial Sequence: Synthetic oligonucleotide
  Target: FXN; (-) strand; PAM type: NRG; PAM sequence: GGG
caggagttcaagaccagact

SEQ ID NO: 13057 - DNA, 20 bp, Artificial Sequence
  Description of Artificial Sequence: Synthetic oligonucleotide
  Target: FXN; (-) strand; PAM type: NRG; PAM sequence: TGG
ccaggagttcaagaccagac

SEQ ID NO: 13058 - DNA, 20 bp, Artificial Sequence
  Description of Artificial Sequence: Synthetic oligonucleotide
  Target: FXN; (-) strand; PAM type: NRG; PAM sequence: CAG
tgggcccaggagttcaagac

SEQ ID NO: 13059 - DNA, 20 bp, Artificial Sequence
  Description of Artificial Sequence: Synthetic oligonucleotide
  Target: FXN; (-) strand; PAM type: NRG; PAM sequence: AAG
tcgcttgggcccaggagttc

SEQ ID NO: 13060 - DNA, 20 bp, Artificial Sequence
  Description of Artificial Sequence: Synthetic oligonucleotide
  Target: FXN; (-) strand; PAM type: NRG; PAM sequence: GAG
ggaggatcgcttgggcccag

SEQ ID NO: 13061 - DNA, 20 bp, Artificial Sequence
  Description of Artificial Sequence: Synthetic oligonucleotide
  Target: FXN; (-) strand; PAM type: NRG; PAM sequence: AGG
agggaggatcgcttgggccc

SEQ ID NO: 13062 - DNA, 20 bp, Artificial Sequence
  Description of Artificial Sequence: Synthetic oligonucleotide
  Target: FXN; (-) strand; PAM type: NRG; PAM sequence: CAG
gagggaggatcgcttgggcc

SEQ ID NO: 13063 - DNA, 20 bp, Artificial Sequence
  Description of Artificial Sequence: Synthetic oligonucleotide
  Target: FXN; (-) strand; PAM type: NRG; PAM sequence: GGG
ccaaggagggaggatcgctt

SEQ ID NO: 13064 - DNA, 20 bp, Artificial Sequence
  Description of Artificial Sequence: Synthetic oligonucleotide
  Target: FXN; (-) strand; PAM type: NRG; PAM sequence: TGG
cccaaggagggaggatcgct

SEQ ID NO: 13065 - DNA, 20 bp, Artificial Sequence
  Description of Artificial Sequence: Synthetic oligonucleotide
  Target: FXN; (-) strand; PAM type: NRG; PAM sequence: AGG
cttcgggagcccaaggaggg

SEQ ID NO: 13066 - DNA, 20 bp, Artificial Sequence
  Description of Artificial Sequence: Synthetic oligonucleotide
  Target: FXN; (-) strand; PAM type: NRG; PAM sequence: GAG
acttcgggagcccaaggagg

SEQ ID NO: 13067 - DNA, 20 bp, Artificial Sequence
  Description of Artificial Sequence: Synthetic oligonucleotide
  Target: FXN; (-) strand; PAM type: NRG; PAM sequence: GGG
gcacttcgggagcccaagga

SEQ ID NO: 13068 - DNA, 20 bp, Artificial Sequence
  Description of Artificial Sequence: Synthetic oligonucleotide
  Target: FXN; (-) strand; PAM type: NRG; PAM sequence: AGG
ggcacttcgggagcccaagg

SEQ ID NO: 13069 - DNA, 20 bp, Artificial Sequence
  Description of Artificial Sequence: Synthetic oligonucleotide
  Target: FXN; (-) strand; PAM type: NRG; PAM sequence: GAG
tggcacttcgggagcccaag

SEQ ID NO: 13070 - DNA, 20 bp, Artificial Sequence
  Description of Artificial Sequence: Synthetic oligonucleotide
  Target: FXN; (-) strand; PAM type: NRG; PAM sequence: AGG
cctggcacttcgggagccca

SEQ ID NO: 13071 - DNA, 20 bp, Artificial Sequence
  Description of Artificial Sequence: Synthetic oligonucleotide
  Target: FXN; (-) strand; PAM type: NRG; PAM sequence: AAG
tcctggcacttcgggagccc

SEQ ID NO: 13072 - DNA, 20 bp, Artificial Sequence
  Description of Artificial Sequence: Synthetic oligonucleotide
  Target: FXN; (-) strand; PAM type: NRG; PAM sequence: GAG
cttgtatcctggcacttcgg

SEQ ID NO: 13073 - DNA, 20 bp, Artificial Sequence
  Description of Artificial Sequence: Synthetic oligonucleotide
  Target: FXN; (-) strand; PAM type: NRG; PAM sequence: GGG
tgcttgtatcctggcacttc

SEQ ID NO: 13074 - DNA, 20 bp, Artificial Sequence
  Description of Artificial Sequence: Synthetic oligonucleotide
  Target: FXN; (-) strand; PAM type: NRG; PAM sequence: CGG
atgcttgtatcctggcactt

SEQ ID NO: 13075 - DNA, 20 bp, Artificial Sequence
  Description of Artificial Sequence: Synthetic oligonucleotide
  Target: FXN; (-) strand; PAM type: NRG; PAM sequence: TGG
ggtgactcatgcttgtatcc

SEQ ID NO: 13076 - DNA, 20 bp, Artificial Sequence
  Description of Artificial Sequence: Synthetic oligonucleotide
  Target: FXN; (-) strand; PAM type: NRG; PAM sequence: TGG
cttaaaactgaggctgcatg

SEQ ID NO: 13077 - DNA, 20 bp, Artificial Sequence
  Description of Artificial Sequence: Synthetic oligonucleotide
  Target: FXN; (-) strand; PAM type: NRG; PAM sequence: AGG
ttaaaagtttcttaaaactg

SEQ ID NO: 13078 - DNA, 20 bp, Artificial Sequence
  Description of Artificial Sequence: Synthetic oligonucleotide
  Target: FXN; (-) strand; PAM type: NRG; PAM sequence: GAG
tttaaaagtttcttaaaact

SEQ ID NO: 13079 - DNA, 20 bp, Artificial Sequence
  Description of Artificial Sequence: Synthetic oligonucleotide
  Target: FXN; (-) strand; PAM type: NRG; PAM sequence: AAG
actatatttcatttatttaa

SEQ ID NO: 13080 - DNA, 20 bp, Artificial Sequence
  Description of Artificial Sequence: Synthetic oligonucleotide
  Target: FXN; (-) strand; PAM type: NRG; PAM sequence: TGG
gaaacccatttttactgttt

SEQ ID NO: 13081 - DNA, 20 bp, Artificial Sequence
  Description of Artificial Sequence: Synthetic oligonucleotide
  Target: FXN; (-) strand; PAM type: NRG; PAM sequence: AAG
gctgggattatacaatacgt

SEQ ID NO: 13082 - DNA, 20 bp, Artificial Sequence
  Description of Artificial Sequence: Synthetic oligonucleotide
  Target: FXN; (-) strand; PAM type: NRG; PAM sequence: GGG
aagcattttttaaaagggct

SEQ ID NO: 13083 - DNA, 20 bp, Artificial Sequence
  Description of Artificial Sequence: Synthetic oligonucleotide
  Target: FXN; (-) strand; PAM type: NRG; PAM sequence: TGG
aaagcattttttaaaagggc

SEQ ID NO: 13084 - DNA, 20 bp, Artificial Sequence
  Description of Artificial Sequence: Synthetic oligonucleotide
  Target: FXN; (-) strand; PAM type: NRG; PAM sequence: GGG
tttgaaagcattttttaaaa

SEQ ID NO: 13085 - DNA, 20 bp, Artificial Sequence
  Description of Artificial Sequence: Synthetic oligonucleotide
  Target: FXN; (-) strand; PAM type: NRG; PAM sequence: AGG
ttttgaaagcattttttaaa

SEQ ID NO: 13086 - DNA, 20 bp, Artificial Sequence
  Description of Artificial Sequence: Synthetic oligonucleotide
  Target: FXN; (-) strand; PAM type: NRG; PAM sequence: AAG
tttttgaaagcattttttaa

SEQ ID NO: 13087 - DNA, 20 bp, Artificial Sequence
  Description of Artificial Sequence: Synthetic oligonucleotide
  Target: FXN; (-) strand; PAM type: NRG; PAM sequence: AAG
agttgactgccagtttttga

SEQ ID NO: 13088 - DNA, 20 bp, Artificial Sequence
  Description of Artificial Sequence: Synthetic oligonucleotide
  Target: FXN; (-) strand; PAM type: NRG; PAM sequence: CAG
tccttttatgagttgactgc

SEQ ID NO: 13089 - DNA, 20 bp, Artificial Sequence
  Description of Artificial Sequence: Synthetic oligonucleotide
  Target: FXN; (-) strand; PAM type: NRG; PAM sequence: GAG
ataagtatttgtccttttat

SEQ ID NO: 13090 - DNA, 20 bp, Artificial Sequence
  Description of Artificial Sequence: Synthetic oligonucleotide
  Target: FXN; (-) strand; PAM type: NRG; PAM sequence: AAG
tacttcatcagtggaatcat

SEQ ID NO: 13091 - DNA, 20 bp, Artificial Sequence
  Description of Artificial Sequence: Synthetic oligonucleotide
  Target: FXN; (-) strand; PAM type: NRG; PAM sequence: TGG
acttttgactacttcatcag

SEQ ID NO: 13092 - DNA, 20 bp, Artificial Sequence
  Description of Artificial Sequence: Synthetic oligonucleotide
  Target: FXN; (-) strand; PAM type: NRG; PAM sequence: CAG
actacttttgactacttcat

SEQ ID NO: 13093 - DNA, 20 bp, Artificial Sequence
  Description of Artificial Sequence: Synthetic oligonucleotide
  Target: FXN; (-) strand; PAM type: NRG; PAM sequence: TGG
taaaaattatacatttatgg

SEQ ID NO: 13094 - DNA, 20 bp, Artificial Sequence
  Description of Artificial Sequence: Synthetic oligonucleotide
  Target: FXN; (-) strand; PAM type: NRG; PAM sequence: TGG
aaataaaaattatacattta

SEQ ID NO: 13095 - DNA, 20 bp, Artificial Sequence
  Description of Artificial Sequence: Synthetic oligonucleotide
  Target: FXN; (-) strand; PAM type: NRG; PAM sequence: AAG
ctatgattttgactaaaaaa

SEQ ID NO: 13096 - DNA, 20 bp, Artificial Sequence
  Description of Artificial Sequence: Synthetic oligonucleotide
  Target: FXN; (-) strand; PAM type: NRG; PAM sequence: TAG
tttccccatcccatagccct

SEQ ID NO: 13097 - DNA, 20 bp, Artificial Sequence
  Description of Artificial Sequence: Synthetic oligonucleotide
  Target: FXN; (-) strand; PAM type: NRG; PAM sequence: TAG
acactaatttccccatccca

SEQ ID NO: 13098 - DNA, 20 bp, Artificial Sequence
  Description of Artificial Sequence: Synthetic oligonucleotide
  Target: FXN; (-) strand; PAM type: NRG; PAM sequence: TAG
cactgaaactctatgcccat

SEQ ID NO: 13099 - DNA, 20 bp, Artificial Sequence
  Description of Artificial Sequence: Synthetic oligonucleotide
  Target: FXN; (-) strand; PAM type: NRG; PAM sequence: TAG
actgctgggcagcataactc

SEQ ID NO: 13100 - DNA, 20 bp, Artificial Sequence
  Description of Artificial Sequence: Synthetic oligonucleotide
  Target: FXN; (-) strand; PAM type: NRG; PAM sequence: CAG
agtatattcacactgctggg

SEQ ID NO: 13101 - DNA, 20 bp, Artificial Sequence
  Description of Artificial Sequence: Synthetic oligonucleotide
  Target: FXN; (-) strand; PAM type: NRG; PAM sequence: GGG
taaagtatattcacactgct

SEQ ID NO: 13102 - DNA, 20 bp, Artificial Sequence
  Description of Artificial Sequence: Synthetic oligonucleotide
  Target: FXN; (-) strand; PAM type: NRG; PAM sequence: TGG
ataaagtatattcacactgc

SEQ ID NO: 13103 - DNA, 20 bp, Artificial Sequence
  Description of Artificial Sequence: Synthetic oligonucleotide
  Target: FXN; (-) strand; PAM type: NRG; PAM sequence: AAG
gttaagtgtacagaacaata

SEQ ID NO: 13104 - DNA, 20 bp, Artificial Sequence
  Description of Artificial Sequence: Synthetic oligonucleotide
  Target: FXN; (-) strand; PAM type: NRG; PAM sequence: CAG
tattaaccatgttaagtgta

SEQ ID NO: 13105 - DNA, 20 bp, Artificial Sequence
  Description of Artificial Sequence: Synthetic oligonucleotide
  Target: FXN; (-) strand; PAM type: NRG; PAM sequence: AAG
tttaccatattaaccatgtt

SEQ ID NO: 13106 - DNA, 20 bp, Artificial Sequence
  Description of Artificial Sequence: Synthetic oligonucleotide
  Target: FXN; (-) strand; PAM type: NRG; PAM sequence: AAG
tttaattttactatagtaaa

SEQ ID NO: 13107 - DNA, 20 bp, Artificial Sequence
  Description of Artificial Sequence: Synthetic oligonucleotide
  Target: FXN; (-) strand; PAM type: NRG; PAM sequence: TAG
ttttttttttaattttacta

SEQ ID NO: 13108 - DNA, 20 bp, Artificial Sequence
  Description of Artificial Sequence: Synthetic oligonucleotide
  Target: FXN; (-) strand; PAM type: NRG; PAM sequence: CGG
caggtgtgagctactgcact

SEQ ID NO: 13109 - DNA, 20 bp, Artificial Sequence
  Description of Artificial Sequence: Synthetic oligonucleotide
  Target: FXN; (-) strand; PAM type: NRG; PAM sequence: GAG
tgggattatgttacaggtgt

SEQ ID NO: 13110 - DNA, 20 bp, Artificial Sequence
  Description of Artificial Sequence: Synthetic oligonucleotide
  Target: FXN; (-) strand; PAM type: NRG; PAM sequence: AGG
aagtgctgggattatgttac

SEQ ID NO: 13111 - DNA, 20 bp, Artificial Sequence
  Description of Artificial Sequence: Synthetic oligonucleotide
  Target: FXN; (-) strand; PAM type: NRG; PAM sequence: CAG
aaagtgctgggattatgtta

SEQ ID NO: 13112 - DNA, 20 bp, Artificial Sequence
  Description of Artificial Sequence: Synthetic oligonucleotide
  Target: FXN; (-) strand; PAM type: NRG; PAM sequence: GGG
cctcggcctcccaaagtgct

SEQ ID NO: 13113 - DNA, 20 bp, Artificial Sequence
  Description of Artificial Sequence: Synthetic oligonucleotide
  Target: FXN; (-) strand; PAM type: NRG; PAM sequence: TGG
acctcggcctcccaaagtgc

SEQ ID NO: 13114 - DNA, 20 bp, Artificial Sequence
  Description of Artificial Sequence: Synthetic oligonucleotide
  Target: FXN; (-) strand; PAM type: NRG; PAM sequence: AAG
cctcctacctcggcctccca

SEQ ID NO: 13115 - DNA, 20 bp, Artificial Sequence
  Description of Artificial Sequence: Synthetic oligonucleotide
  Target: FXN; (-) strand; PAM type: NRG; PAM sequence: CGG
ctcaagtgatcctcctacct

SEQ ID NO: 13116 - DNA, 20 bp, Artificial Sequence
  Description of Artificial Sequence: Synthetic oligonucleotide
  Target: FXN; (-) strand; PAM type: NRG; PAM sequence: AAG
ggtttcaaacttctggcctc

SEQ ID NO: 13117 - DNA, 20 bp, Artificial Sequence
  Description of Artificial Sequence: Synthetic oligonucleotide
  Target: FXN; (-) strand; PAM type: NRG; PAM sequence: TGG
ccaggctggtttcaaacttc

SEQ ID NO: 13118 - DNA, 20 bp, Artificial Sequence
  Description of Artificial Sequence: Synthetic oligonucleotide
  Target: FXN; (-) strand; PAM type: NRG; PAM sequence: TGG
tctcgctatattgaccaggc

SEQ ID NO: 13119 - DNA, 20 bp, Artificial Sequence
  Description of Artificial Sequence: Synthetic oligonucleotide
  Target: FXN; (-) strand; PAM type: NRG; PAM sequence: AGG
gaggtctcgctatattgacc

SEQ ID NO: 13120 - DNA, 20 bp, Artificial Sequence
  Description of Artificial Sequence: Synthetic oligonucleotide
  Target: FXN; (-) strand; PAM type: NRG; PAM sequence: CAG
tgaggtctcgctatattgac

SEQ ID NO: 13121 - DNA, 20 bp, Artificial Sequence
  Description of Artificial Sequence: Synthetic oligonucleotide
  Target: FXN; (-) strand; PAM type: NRG; PAM sequence: AGG
atttttcttttgtagagatg

SEQ ID NO: 13122 - DNA, 20 bp, Artificial Sequence
  Description of Artificial Sequence: Synthetic oligonucleotide
  Target: FXN; (-) strand; PAM type: NRG; PAM sequence: GAG
catttttcttttgtagagat

SEQ ID NO: 13123 - DNA, 20 bp, Artificial Sequence
  Description of Artificial Sequence: Synthetic oligonucleotide
  Target: FXN; (-) strand; PAM type: NRG; PAM sequence: GAG
tttaacatttttcttttgta

SEQ ID NO: 13124 - DNA, 20 bp, Artificial Sequence
  Description of Artificial Sequence: Synthetic oligonucleotide
  Target: FXN; (-) strand; PAM type: NRG; PAM sequence: TAG
attttaacatttttcttttg

SEQ ID NO: 13125 - DNA, 20 bp, Artificial Sequence
  Description of Artificial Sequence: Synthetic oligonucleotide
  Target: FXN; (-) strand; PAM type: NRG; PAM sequence: CAG
cctccagagagctgggacta

SEQ ID NO: 13126 - DNA, 20 bp, Artificial Sequence
  Description of Artificial Sequence: Synthetic oligonucleotide
  Target: FXN; (-) strand; PAM type: NRG; PAM sequence: GGG
gtccctgcctccagagagct

SEQ ID NO: 13127 - DNA, 20 bp, Artificial Sequence
  Description of Artificial Sequence: Synthetic oligonucleotide
  Target: FXN; (-) strand; PAM type: NRG; PAM sequence: TGG
agtccctgcctccagagagc

SEQ ID NO: 13128 - DNA, 20 bp, Artificial Sequence
  Description of Artificial Sequence: Synthetic oligonucleotide
  Target: FXN; (-) strand; PAM type: NRG; PAM sequence: GAG
actcagtccctgcctccaga

SEQ ID NO: 13129 - DNA, 20 bp, Artificial Sequence
  Description of Artificial Sequence: Synthetic oligonucleotide
  Target: FXN; (-) strand; PAM type: NRG; PAM sequence: GAG
tgactcagtccctgcctcca

SEQ ID NO: 13130 - DNA, 20 bp, Artificial Sequence
  Description of Artificial Sequence: Synthetic oligonucleotide
  Target: FXN; (-) strand; PAM type: NRG; PAM sequence: CAG
tctgactcagtccctgcctc

SEQ ID NO: 13131 - DNA, 20 bp, Artificial Sequence
  Description of Artificial Sequence: Synthetic oligonucleotide
  Target: FXN; (-) strand; PAM type: NRG; PAM sequence: CAG
gctcaagtgatcctctgact

SEQ ID NO: 13132 - DNA, 20 bp, Artificial Sequence
  Description of Artificial Sequence: Synthetic oligonucleotide
  Target: FXN; (-) strand; PAM type: NRG; PAM sequence: AAG
agcctcaaacccctatgctc

SEQ ID NO: 13133 - DNA, 20 bp, Artificial Sequence
  Description of Artificial Sequence: Synthetic oligonucleotide
  Target: FXN; (-) strand; PAM type: NRG; PAM sequence: CAG
ggcaggatcatggctcactg

SEQ ID NO: 13134 - DNA, 20 bp, Artificial Sequence
  Description of Artificial Sequence: Synthetic oligonucleotide
  Target: FXN; (-) strand; PAM type: NRG; PAM sequence: TGG
ctgcagcagtggcaggatca

SEQ ID NO: 13135 - DNA, 20 bp, Artificial Sequence
  Description of Artificial Sequence: Synthetic oligonucleotide
  Target: FXN; (-) strand; PAM type: NRG; PAM sequence: AGG
gctcaggctgcagcagtggc

SEQ ID NO: 13136 - DNA, 20 bp, Artificial Sequence
  Description of Artificial Sequence: Synthetic oligonucleotide
  Target: FXN; (-) strand; PAM type: NRG; PAM sequence: CAG
tgctcaggctgcagcagtgg

SEQ ID NO: 13137 - DNA, 20 bp, Artificial Sequence
  Description of Artificial Sequence: Synthetic oligonucleotide
  Target: FXN; (-) strand; PAM type: NRG; PAM sequence: TGG
tgttgctcaggctgcagcag

SEQ ID NO: 13138 - DNA, 20 bp, Artificial Sequence
  Description of Artificial Sequence: Synthetic oligonucleotide
  Target: FXN; (-) strand; PAM type: NRG; PAM sequence: CAG
ctctgttgctcaggctgcag

SEQ ID NO: 13139 - DNA, 20 bp, Artificial Sequence
  Description of Artificial Sequence: Synthetic oligonucleotide
  Target: FXN; (-) strand; PAM type: NRG; PAM sequence: CAG
ttgctctgttgctcaggctg

SEQ ID NO: 13140 - DNA, 20 bp, Artificial Sequence
  Description of Artificial Sequence: Synthetic oligonucleotide
  Target: FXN; (-) strand; PAM type: NRG; PAM sequence: AGG
agggtcttgctctgttgctc

SEQ ID NO: 13141 - DNA, 20 bp, Artificial Sequence
  Description of Artificial Sequence: Synthetic oligonucleotide
  Target: FXN; (-) strand; PAM type: NRG; PAM sequence: CAG
cagggtcttgctctgttgct

SEQ ID NO: 13142 - DNA, 20 bp, Artificial Sequence
  Description of Artificial Sequence: Synthetic oligonucleotide
  Target: FXN; (-) strand; PAM type: NRG; PAM sequence: GGG
gtttgtttgtttttacaaca

SEQ ID NO: 13143 - DNA, 20 bp, Artificial Sequence
  Description of Artificial Sequence: Synthetic oligonucleotide
  Target: FXN; (-) strand; PAM type: NRG; PAM sequence: AGG
tgtttgtttgtttttacaac

SEQ ID NO: 13144 - DNA, 20 bp, Artificial Sequence
  Description of Artificial Sequence: Synthetic oligonucleotide
  Target: FXN; (-) strand; PAM type: NRG; PAM sequence: CAG
ttgtttgtttgtttttacaa

SEQ ID NO: 13145 - DNA, 20 bp, Artificial Sequence
  Description of Artificial Sequence: Synthetic oligonucleotide
  Target: FXN; (-) strand; PAM type: NRG; PAM sequence: CAG
cactctcaggtatcagctgc

SEQ ID NO: 13146 - DNA, 20 bp, Artificial Sequence
  Description of Artificial Sequence: Synthetic oligonucleotide
  Target: FXN; (-) strand; PAM type: NRG; PAM sequence: CAG
agatattcactctcaggtat

SEQ ID NO: 13147 - DNA, 20 bp, Artificial Sequence
  Description of Artificial Sequence: Synthetic oligonucleotide
  Target: FXN; (-) strand; PAM type: NRG; PAM sequence: AGG
gataaaagatattcactctc

SEQ ID NO: 13148 - DNA, 20 bp, Artificial Sequence
  Description of Artificial Sequence: Synthetic oligonucleotide
  Target: FXN; (-) strand; PAM type: NRG; PAM sequence: CAG
cgataaaagatattcactct

SEQ ID NO: 13149 - DNA, 20 bp, Artificial Sequence
  Description of Artificial Sequence: Synthetic oligonucleotide
  Target: FXN; (-) strand; PAM type: NRG; PAM sequence: AAG
atcccattaaccagcgataa

SEQ ID NO: 13150 - DNA, 20 bp, Artificial Sequence
  Description of Artificial Sequence: Synthetic oligonucleotide
  Target: FXN; (-) strand; PAM type: NRG; PAM sequence: CAG
attctctcaatcccattaac

SEQ ID NO: 13151 - DNA, 20 bp, Artificial Sequence
  Description of Artificial Sequence: Synthetic oligonucleotide
  Target: FXN; (-) strand; PAM type: NRG; PAM sequence: AAG
actgttctttctataagatg

SEQ ID NO: 13152 - DNA, 20 bp, Artificial Sequence
  Description of Artificial Sequence: Synthetic oligonucleotide
  Target: FXN; (-) strand; PAM type: NRG; PAM sequence: AAG
aaagacactgttctttctat

SEQ ID NO: 13153 - DNA, 20 bp, Artificial Sequence
  Description of Artificial Sequence: Synthetic oligonucleotide
  Target: FXN; (-) strand; PAM type: NRG; PAM sequence: AAG
tccaggtctctgtgggtcca

SEQ ID NO: 13154 - DNA, 20 bp, Artificial Sequence
  Description of Artificial Sequence: Synthetic oligonucleotide
  Target: FXN; (-) strand; PAM type: NRG; PAM sequence: GGG
tcttaaatccaggtctctgt

SEQ ID NO: 13155 - DNA, 20 bp, Artificial Sequence
  Description of Artificial Sequence: Synthetic oligonucleotide
  Target: FXN; (-) strand; PAM type: NRG; PAM sequence: TGG
atcttaaatccaggtctctg

SEQ ID NO: 13156 - DNA, 20 bp, Artificial Sequence
  Description of Artificial Sequence: Synthetic oligonucleotide
  Target: FXN; (-) strand; PAM type: NRG; PAM sequence: AGG
gcagagctaatcttaaatcc

SEQ ID NO: 13157 - DNA, 20 bp, Artificial Sequence
  Description of Artificial Sequence: Synthetic oligonucleotide
  Target: FXN; (-) strand; PAM type: NRG; PAM sequence: CAG
ggcagagctaatcttaaatc

SEQ ID NO: 13158 - DNA, 20 bp, Artificial Sequence
  Description of Artificial Sequence: Synthetic oligonucleotide
  Target: FXN; (-) strand; PAM type: NRG; PAM sequence: GAG
agagtactcagtaattggca

SEQ ID NO: 13159 - DNA, 20 bp, Artificial Sequence
  Description of Artificial Sequence: Synthetic oligonucleotide
  Target: FXN; (-) strand; PAM type: NRG; PAM sequence: CAG
aaagagtactcagtaattgg

SEQ ID NO: 13160 - DNA, 20 bp, Artificial Sequence
  Description of Artificial Sequence: Synthetic oligonucleotide
  Target: FXN; (-) strand; PAM type: NRG; PAM sequence: TGG
agtaaagagtactcagtaat

SEQ ID NO: 13161 - DNA, 20 bp, Artificial Sequence
  Description of Artificial Sequence: Synthetic oligonucleotide
  Target: FXN; (-) strand; PAM type: NRG; PAM sequence: CAG
ggttcatagtaaagagtact

SEQ ID NO: 13162 - DNA, 20 bp, Artificial Sequence
  Description of Artificial Sequence: Synthetic oligonucleotide
  Target: FXN; (-) strand; PAM type: NRG; PAM sequence: GAG
aaacagaggttcatagtaaa

SEQ ID NO: 13163 - DNA, 20 bp, Artificial Sequence
  Description of Artificial Sequence: Synthetic oligonucleotide
  Target: FXN; (-) strand; PAM type: NRG; PAM sequence: AAG
gaaaacagaggttcatagta

SEQ ID NO: 13164 - DNA, 20 bp, Artificial Sequence
  Description of Artificial Sequence: Synthetic oligonucleotide
  Target: FXN; (-) strand; PAM type: NRG; PAM sequence: TAG
atgaggaaaacagaggttca

SEQ ID NO: 13165 - DNA, 20 bp, Artificial Sequence
  Description of Artificial Sequence: Synthetic oligonucleotide
  Target: FXN; (-) strand; PAM type: NRG; PAM sequence: AGG
ttcacagatgaggaaaacag

SEQ ID NO: 13166 - DNA, 20 bp, Artificial Sequence
  Description of Artificial Sequence: Synthetic oligonucleotide
  Target: FXN; (-) strand; PAM type: NRG; PAM sequence: GAG
tttcacagatgaggaaaaca

SEQ ID NO: 13167 - DNA, 20 bp, Artificial Sequence
  Description of Artificial Sequence: Synthetic oligonucleotide
  Target: FXN; (-) strand; PAM type: NRG; PAM sequence: CAG
agtttcacagatgaggaaaa

SEQ ID NO: 13168 - DNA, 20 bp, Artificial Sequence
  Description of Artificial Sequence: Synthetic oligonucleotide
  Target: FXN; (-) strand; PAM type: NRG; PAM sequence: AGG
ttattccagtttcacagatg

SEQ ID NO: 13169 - DNA, 20 bp, Artificial Sequence
  Description of Artificial Sequence: Synthetic oligonucleotide
  Target: FXN; (-) strand; PAM type: NRG; PAM sequence: GAG
attattccagtttcacagat

SEQ ID NO: 13170 - DNA, 20 bp, Artificial Sequence
  Description of Artificial Sequence: Synthetic oligonucleotide
  Target: FXN; (-) strand; PAM type: NRG; PAM sequence: CAG
gattcattattccagtttca

SEQ ID NO: 13171 - DNA, 20 bp, Artificial Sequence
  Description of Artificial Sequence: Synthetic oligonucleotide
  Target: FXN; (-) strand; PAM type: NRG; PAM sequence: CAG
ggcggtaggattcattattc

SEQ ID NO: 13172 - DNA, 20 bp, Artificial Sequence
  Description of Artificial Sequence: Synthetic oligonucleotide
  Target: FXN; (-) strand; PAM type: NRG; PAM sequence: AGG
tgactacaattgttggcggt

SEQ ID NO: 13173 - DNA, 20 bp, Artificial Sequence
  Description of Artificial Sequence: Synthetic oligonucleotide
  Target: FXN; (-) strand; PAM type: NRG; PAM sequence: TAG
ttgactacaattgttggcgg

SEQ ID NO: 13174 - DNA, 20 bp, Artificial Sequence
  Description of Artificial Sequence: Synthetic oligonucleotide
  Target: FXN; (-) strand; PAM type: NRG; PAM sequence: CGG
aacttgactacaattgttgg

SEQ ID NO: 13175 - DNA, 20 bp, Artificial Sequence
  Description of Artificial Sequence: Synthetic oligonucleotide
  Target: FXN; (-) strand; PAM type: NRG; PAM sequence: TGG
tccaacttgactacaattgt

SEQ ID NO: 13176 - DNA, 20 bp, Artificial Sequence
  Description of Artificial Sequence: Synthetic oligonucleotide
  Target: FXN; (-) strand; PAM type: NRG; PAM sequence: TGG
actgtgccaggcttggtgtt

SEQ ID NO: 13177 - DNA, 20 bp, Artificial Sequence
  Description of Artificial Sequence: Synthetic oligonucleotide
  Target: FXN; (-) strand; PAM type: NRG; PAM sequence: TGG
ggttcctactgtgccaggct

SEQ ID NO: 13178 - DNA, 20 bp, Artificial Sequence
  Description of Artificial Sequence: Synthetic oligonucleotide
  Target: FXN; (-) strand; PAM type: NRG; PAM sequence: AGG
tactcggttcctactgtgcc

SEQ ID NO: 13179 - DNA, 20 bp, Artificial Sequence
  Description of Artificial Sequence: Synthetic oligonucleotide
  Target: FXN; (-) strand; PAM type: NRG; PAM sequence: CAG
ttactcggttcctactgtgc

SEQ ID NO: 13180 - DNA, 20 bp, Artificial Sequence
  Description of Artificial Sequence: Synthetic oligonucleotide
  Target: FXN; (-) strand; PAM type: NRG; PAM sequence: CGG
aatattaaccactatttact

SEQ ID NO: 13181 - DNA, 20 bp, Artificial Sequence
  Description of Artificial Sequence: Synthetic oligonucleotide
  Target: FXN; (-) strand; PAM type: NRG; PAM sequence: CAG
tgatggagacgtcagcaatg

SEQ ID NO: 13182 - DNA, 20 bp, Artificial Sequence
  Description of Artificial Sequence: Synthetic oligonucleotide
  Target: FXN; (-) strand; PAM type: NRG; PAM sequence: CAG
tatagaaatgatggagacgt

SEQ ID NO: 13183 - DNA, 20 bp, Artificial Sequence
  Description of Artificial Sequence: Synthetic oligonucleotide
  Target: FXN; (-) strand; PAM type: NRG; PAM sequence: GAG
acaaatgtatagaaatgatg

SEQ ID NO: 13184 - DNA, 20 bp, Artificial Sequence
  Description of Artificial Sequence: Synthetic oligonucleotide
  Target: FXN; (-) strand; PAM type: NRG; PAM sequence: TGG
aaacaaatgtatagaaatga

SEQ ID NO: 13185 - DNA, 20 bp, Artificial Sequence
  Description of Artificial Sequence: Synthetic oligonucleotide
  Target: FXN; (-) strand; PAM type: NRG; PAM sequence: TAG
ctgattcaaaaacaaatgta

SEQ ID NO: 13186 - DNA, 20 bp, Artificial Sequence
  Description of Artificial Sequence: Synthetic oligonucleotide
  Target: FXN; (-) strand; PAM type: NRG; PAM sequence: GGG
atgggacaaggggcactact

SEQ ID NO: 13187 - DNA, 20 bp, Artificial Sequence
  Description of Artificial Sequence: Synthetic oligonucleotide
  Target: FXN; (-) strand; PAM type: NRG; PAM sequence: TGG
aatgggacaaggggcactac

SEQ ID NO: 13188 - DNA, 20 bp, Artificial Sequence
  Description of Artificial Sequence: Synthetic oligonucleotide
  Target: FXN; (-) strand; PAM type: NRG; PAM sequence: GGG
actgataggaatgggacaag

SEQ ID NO: 13189 - DNA, 20 bp, Artificial Sequence
  Description of Artificial Sequence: Synthetic oligonucleotide
  Target: FXN; (-) strand; PAM type: NRG; PAM sequence: GGG
aactgataggaatgggacaa

SEQ ID NO: 13190 - DNA, 20 bp, Artificial Sequence
  Description of Artificial Sequence: Synthetic oligonucleotide
  Target: FXN; (-) strand; PAM type: NRG; PAM sequence: AGG
taactgataggaatgggaca

SEQ ID NO: 13191 - DNA, 20 bp, Artificial Sequence
  Description of Artificial Sequence: Synthetic oligonucleotide
  Target: FXN; (-) strand; PAM type: NRG; PAM sequence: AAG
ataactgataggaatgggac

SEQ ID NO: 13192 - DNA, 20 bp, Artificial Sequence
  Description of Artificial Sequence: Synthetic oligonucleotide
  Target: FXN; (-) strand; PAM type: NRG; PAM sequence: GGG
ataatataactgataggaat

SEQ ID NO: 13193 - DNA, 20 bp, Artificial Sequence
  Description of Artificial Sequence: Synthetic oligonucleotide
  Target: FXN; (-) strand; PAM type: NRG; PAM sequence: TGG
aataatataactgataggaa

SEQ ID NO: 13194 - DNA, 20 bp, Artificial Sequence
  Description of Artificial Sequence: Synthetic oligonucleotide
  Target: FXN; (-) strand; PAM type: NRG; PAM sequence: AGG
acaataataatataactgat

SEQ ID NO: 13195 - DNA, 20 bp, Artificial Sequence
  Description of Artificial Sequence: Synthetic oligonucleotide
  Target: FXN; (-) strand; PAM type: NRG; PAM sequence: TAG
aacaataataatataactga

SEQ ID NO: 13196 - DNA, 20 bp, Artificial Sequence
  Description of Artificial Sequence: Synthetic oligonucleotide
  Target: FXN; (-) strand; PAM type: NRG; PAM sequence: TAG
gttattgaaattccagaggg

SEQ ID NO: 13197 - DNA, 20 bp, Artificial Sequence
  Description of Artificial Sequence: Synthetic oligonucleotide
  Target: FXN; (-) strand; PAM type: NRG; PAM sequence: GGG
agagttattgaaattccaga

SEQ ID NO: 13198 - DNA, 20 bp, Artificial Sequence
  Description of Artificial Sequence: Synthetic oligonucleotide
  Target: FXN; (-) strand; PAM type: NRG; PAM sequence: AGG
aagagttattgaaattccag

SEQ ID NO: 13199 - DNA, 20 bp, Artificial Sequence
  Description of Artificial Sequence: Synthetic oligonucleotide
  Target: FXN; (-) strand; PAM type: NRG; PAM sequence: GAG
aaagagttattgaaattcca

SEQ ID NO: 13200 - DNA, 20 bp, Artificial Sequence
  Description of Artificial Sequence: Synthetic oligonucleotide
  Target: FXN; (-) strand; PAM type: NRG; PAM sequence: CAG
acaaagagttattgaaattc

SEQ ID NO: 13201 - DNA, 20 bp, Artificial Sequence
  Description of Artificial Sequence: Synthetic oligonucleotide
  Target: FXN; (-) strand; PAM type: NRG; PAM sequence: GAG
caaaaaacccaaaaaacaaa

SEQ ID NO: 13202 - DNA, 20 bp, Artificial Sequence
  Description of Artificial Sequence: Synthetic oligonucleotide
  Target: FXN; (-) strand; PAM type: NRG; PAM sequence: AAG
aacaaaaaacccaaaaaaca

SEQ ID NO: 13203 - DNA, 20 bp, Artificial Sequence
  Description of Artificial Sequence: Synthetic oligonucleotide
  Target: FXN; (-) strand; PAM type: NRG; PAM sequence: AAG
gagatcctgtctcaaaagca

SEQ ID NO: 13204 - DNA, 20 bp, Artificial Sequence
  Description of Artificial Sequence: Synthetic oligonucleotide
  Target: FXN; (-) strand; PAM type: NRG; PAM sequence: AAG
cgacagagatcctgtctcaa

SEQ ID NO: 13205 - DNA, 20 bp, Artificial Sequence
  Description of Artificial Sequence: Synthetic oligonucleotide
  Target: FXN; (-) strand; PAM type: NRG; PAM sequence: GAG
acacaccagactgggcgaca

SEQ ID NO: 13206 - DNA, 20 bp, Artificial Sequence
  Description of Artificial Sequence: Synthetic oligonucleotide
  Target: FXN; (-) strand; PAM type: NRG; PAM sequence: CAG
ctacacaccagactgggcga

SEQ ID NO: 13207 - DNA, 20 bp, Artificial Sequence
  Description of Artificial Sequence: Synthetic oligonucleotide
  Target: FXN; (-) strand; PAM type: NRG; PAM sequence: GGG
acaccactacacaccagact

SEQ ID NO: 13208 - DNA, 20 bp, Artificial Sequence
  Description of Artificial Sequence: Synthetic oligonucleotide
  Target: FXN; (-) strand; PAM type: NRG; PAM sequence: TGG
cacaccactacacaccagac

SEQ ID NO: 13209 - DNA, 20 bp, Artificial Sequence
  Description of Artificial Sequence: Synthetic oligonucleotide
  Target: FXN; (-) strand; PAM type: NRG; PAM sequence: CAG
gagatcacaccactacacac

SEQ ID NO: 13210 - DNA, 20 bp, Artificial Sequence
  Description of Artificial Sequence: Synthetic oligonucleotide
  Target: FXN; (-) strand; PAM type: NRG; PAM sequence: GAG
ggttgaggctgcagtgagct

SEQ ID NO: 13211 - DNA, 20 bp, Artificial Sequence
  Description of Artificial Sequence: Synthetic oligonucleotide
  Target: FXN; (-) strand; PAM type: NRG; PAM sequence: GAG
caggaggttgaggctgcagt

SEQ ID NO: 13212 - DNA, 20 bp, Artificial Sequence
  Description of Artificial Sequence: Synthetic oligonucleotide
  Target: FXN; (-) strand; PAM type: NRG; PAM sequence: CAG
agcccaggaggttgaggctg

SEQ ID NO: 13213 - DNA, 20 bp, Artificial Sequence
  Description of Artificial Sequence: Synthetic oligonucleotide
  Target: FXN; (-) strand; PAM type: NRG; PAM sequence: AGG
cacctgagcccaggaggttg

SEQ ID NO: 13214 - DNA, 20 bp, Artificial Sequence
  Description of Artificial Sequence: Synthetic oligonucleotide
  Target: FXN; (-) strand; PAM type: NRG; PAM sequence: GAG
tcacctgagcccaggaggtt

SEQ ID NO: 13215 - DNA, 20 bp, Artificial Sequence
  Description of Artificial Sequence: Synthetic oligonucleotide
  Target: FXN; (-) strand; PAM type: NRG; PAM sequence: AGG
gaggatcacctgagcccagg

SEQ ID NO: 13216 - DNA, 20 bp, Artificial Sequence
  Description of Artificial Sequence: Synthetic oligonucleotide
  Target: FXN; (-) strand; PAM type: NRG; PAM sequence: GAG
ggaggatcacctgagcccag

SEQ ID NO: 13217 - DNA, 20 bp, Artificial Sequence
  Description of Artificial Sequence: Synthetic oligonucleotide
  Target: FXN; (-) strand; PAM type: NRG; PAM sequence: AGG
tgggaggatcacctgagccc

SEQ ID NO: 13218 - DNA, 20 bp, Artificial Sequence
  Description of Artificial Sequence: Synthetic oligonucleotide
  Target: FXN; (-) strand; PAM type: NRG; PAM sequence: CAG
gtgggaggatcacctgagcc

SEQ ID NO: 13219 - DNA, 20 bp, Artificial Sequence
  Description of Artificial Sequence: Synthetic oligonucleotide
  Target: FXN; (-) strand; PAM type: NRG; PAM sequence: GAG
ctgaagtgggaggatcacct

SEQ ID NO: 13220 - DNA, 20 bp, Artificial Sequence
  Description of Artificial Sequence: Synthetic oligonucleotide
  Target: FXN; (-) strand; PAM type: NRG; PAM sequence: AGG
acttgggaggctgaagtggg

SEQ ID NO: 13221 - DNA, 20 bp, Artificial Sequence
  Description of Artificial Sequence: Synthetic oligonucleotide
  Target: FXN; (-) strand; PAM type: NRG; PAM sequence: GAG
tacttgggaggctgaagtgg

SEQ ID NO: 13222 - DNA, 20 bp, Artificial Sequence
  Description of Artificial Sequence: Synthetic oligonucleotide
  Target: FXN; (-) strand; PAM type: NRG; PAM sequence: GGG
gctacttgggaggctgaagt

SEQ ID NO: 13223 - DNA, 20 bp, Artificial Sequence
  Description of Artificial Sequence: Synthetic oligonucleotide
  Target: FXN; (-) strand; PAM type: NRG; PAM sequence: TGG
agctacttgggaggctgaag

SEQ ID NO: 13224 - DNA, 20 bp, Artificial Sequence
  Description of Artificial Sequence: Synthetic oligonucleotide
  Target: FXN; (-) strand; PAM type: NRG; PAM sequence: AAG
cccagctacttgggaggctg

SEQ ID NO: 13225 - DNA, 20 bp, Artificial Sequence
  Description of Artificial Sequence: Synthetic oligonucleotide
  Target: FXN; (-) strand; PAM type: NRG; PAM sequence: AGG
tgtggtcccagctacttggg

SEQ ID NO: 13226 - DNA, 20 bp, Artificial Sequence
  Description of Artificial Sequence: Synthetic oligonucleotide
  Target: FXN; (-) strand; PAM type: NRG; PAM sequence: GAG
ctgtggtcccagctacttgg

SEQ ID NO: 13227 - DNA, 20 bp, Artificial Sequence
  Description of Artificial Sequence: Synthetic oligonucleotide
  Target: FXN; (-) strand; PAM type: NRG; PAM sequence: GGG
gcctgtggtcccagctactt

SEQ ID NO: 13228 - DNA, 20 bp, Artificial Sequence
  Description of Artificial Sequence: Synthetic oligonucleotide
  Target: FXN; (-) strand; PAM type: NRG; PAM sequence: TGG
cgcctgtggtcccagctact

SEQ ID NO: 13229 - DNA, 20 bp, Artificial Sequence
  Description of Artificial Sequence: Synthetic oligonucleotide
  Target: FXN; (-) strand; PAM type: NRG; PAM sequence: CAG
gtggcatgcgcctgtggtcc

SEQ ID NO: 13230 - DNA, 20 bp, Artificial Sequence
  Description of Artificial Sequence: Synthetic oligonucleotide
  Target: FXN; (-) strand; PAM type: NRG; PAM sequence: TGG
agtgtggtggcatgcgcctg

SEQ ID NO: 13231 - DNA, 20 bp, Artificial Sequence
  Description of Artificial Sequence: Synthetic oligonucleotide
  Target: FXN; (-) strand; PAM type: NRG; PAM sequence: TGG
caaaaattagccaagtgtgg

SEQ ID NO: 13232 - DNA, 20 bp, Artificial Sequence
  Description of Artificial Sequence: Synthetic oligonucleotide
  Target: FXN; (-) strand; PAM type: NRG; PAM sequence: TGG
atgcaaaaattagccaagtg

SEQ ID NO: 13233 - DNA, 20 bp, Artificial Sequence
  Description of Artificial Sequence: Synthetic oligonucleotide
  Target: FXN; (-) strand; PAM type: NRG; PAM sequence: AAG
taaaaatgcaaaaattagcc

SEQ ID NO: 13234 - DNA, 20 bp, Artificial Sequence
  Description of Artificial Sequence: Synthetic oligonucleotide
  Target: FXN; (-) strand; PAM type: NRG; PAM sequence: TAG
tctactaaaaatgcaaaaat

SEQ ID NO: 13235 - DNA, 20 bp, Artificial Sequence
  Description of Artificial Sequence: Synthetic oligonucleotide
  Target: FXN; (-) strand; PAM type: NRG; PAM sequence: TGG
ccagaccggcctaggcaata

SEQ ID NO: 13236 - DNA, 20 bp, Artificial Sequence
  Description of Artificial Sequence: Synthetic oligonucleotide
  Target: FXN; (-) strand; PAM type: NRG; PAM sequence: AGG
cagaagttccagaccggcct

SEQ ID NO: 13237 - DNA, 20 bp, Artificial Sequence
  Description of Artificial Sequence: Synthetic oligonucleotide
  Target: FXN; (-) strand; PAM type: NRG; PAM sequence: TAG
ccagaagttccagaccggcc

SEQ ID NO: 13238 - DNA, 20 bp, Artificial Sequence
  Description of Artificial Sequence: Synthetic oligonucleotide
  Target: FXN; (-) strand; PAM type: NRG; PAM sequence: CGG
tgagcccagaagttccagac

SEQ ID NO: 13239 - DNA, 20 bp, Artificial Sequence
  Description of Artificial Sequence: Synthetic oligonucleotide
  Target: FXN; (-) strand; PAM type: NRG; PAM sequence: CAG
tggcttgagcccagaagttc

SEQ ID NO: 13240 - DNA, 20 bp, Artificial Sequence
  Description of Artificial Sequence: Synthetic oligonucleotide
  Target: FXN; (-) strand; PAM type: NRG; PAM sequence: AAG
ggcagatggcttgagcccag

SEQ ID NO: 13241 - DNA, 20 bp, Artificial Sequence
  Description of Artificial Sequence: Synthetic oligonucleotide
  Target: FXN; (-) strand; PAM type: NRG; PAM sequence: CAG
gcaggcagatggcttgagcc

SEQ ID NO: 13242 - DNA, 20 bp, Artificial Sequence
  Description of Artificial Sequence: Synthetic oligonucleotide
  Target: FXN; (-) strand; PAM type: NRG; PAM sequence: GAG
ccgaggcaggcagatggctt

SEQ ID NO: 13243 - DNA, 20 bp, Artificial Sequence
  Description of Artificial Sequence: Synthetic oligonucleotide
  Target: FXN; (-) strand; PAM type: NRG; PAM sequence: TGG
gggaggccgaggcaggcaga

SEQ ID NO: 13244 - DNA, 20 bp, Artificial Sequence
  Description of Artificial Sequence: Synthetic oligonucleotide
  Target: FXN; (-) strand; PAM type: NRG; PAM sequence: CAG
ctttgggaggccgaggcagg

SEQ ID NO: 13245 - DNA, 20 bp, Artificial Sequence
  Description of Artificial Sequence: Synthetic oligonucleotide
  Target: FXN; (-) strand; PAM type: NRG; PAM sequence: AGG
gcactttgggaggccgaggc

SEQ ID NO: 13246 - DNA, 20 bp, Artificial Sequence
  Description of Artificial Sequence: Synthetic oligonucleotide
  Target: FXN; (-) strand; PAM type: NRG; PAM sequence: CAG
agcactttgggaggccgagg

SEQ ID NO: 13247 - DNA, 20 bp, Artificial Sequence
  Description of Artificial Sequence: Synthetic oligonucleotide
  Target: FXN; (-) strand; PAM type: NRG; PAM sequence: AGG
tccagcactttgggaggccg

SEQ ID NO: 13248 - DNA, 20 bp, Artificial Sequence
  Description of Artificial Sequence: Synthetic oligonucleotide
  Target: FXN; (-) strand; PAM type: NRG; PAM sequence: GAG
ttccagcactttgggaggcc

SEQ ID NO: 13249 - DNA, 20 bp, Artificial Sequence
  Description of Artificial Sequence: Synthetic oligonucleotide
  Target: FXN; (-) strand; PAM type: NRG; PAM sequence: AGG
tgaaattccagcactttggg

SEQ ID NO: 13250 - DNA, 20 bp, Artificial Sequence
  Description of Artificial Sequence: Synthetic oligonucleotide
  Target: FXN; (-) strand; PAM type: NRG; PAM sequence: GAG
ctgaaattccagcactttgg

SEQ ID NO: 13251 - DNA, 20 bp, Artificial Sequence
  Description of Artificial Sequence: Synthetic oligonucleotide
  Target: FXN; (-) strand; PAM type: NRG; PAM sequence: GGG
gcctgaaattccagcacttt

SEQ ID NO: 13252 - DNA, 20 bp, Artificial Sequence
  Description of Artificial Sequence: Synthetic oligonucleotide
  Target: FXN; (-) strand; PAM type: NRG; PAM sequence: TGG
tgcctgaaattccagcactt

SEQ ID NO: 13253 - DNA, 20 bp, Artificial Sequence
  Description of Artificial Sequence: Synthetic oligonucleotide
  Target: FXN; (-) strand; PAM type: NRG; PAM sequence: CAG
atggctcatgcctgaaattc

SEQ ID NO: 13254 - DNA, 20 bp, Artificial Sequence
  Description of Artificial Sequence: Synthetic oligonucleotide
  Target: FXN; (-) strand; PAM type: NRG; PAM sequence: TGG
agagctatttaggccaggca

SEQ ID NO: 13255 - DNA, 20 bp, Artificial Sequence
  Description of Artificial Sequence: Synthetic oligonucleotide
  Target: FXN; (-) strand; PAM type: NRG; PAM sequence: AGG
cacagagagctatttaggcc

SEQ ID NO: 13256 - DNA, 20 bp, Artificial Sequence
  Description of Artificial Sequence: Synthetic oligonucleotide
  Target: FXN; (-) strand; PAM type: NRG; PAM sequence: CAG
acacagagagctatttaggc

SEQ ID NO: 13257 - DNA, 20 bp, Artificial Sequence
  Description of Artificial Sequence: Synthetic oligonucleotide
  Target: FXN; (-) strand; PAM type: NRG; PAM sequence: AGG
gcaaacacagagagctattt

SEQ ID NO: 13258 - DNA, 20 bp, Artificial Sequence
  Description of Artificial Sequence: Synthetic oligonucleotide
  Target: FXN; (-) strand; PAM type: NRG; PAM sequence: TAG
tgcaaacacagagagctatt

SEQ ID NO: 13259 - DNA, 20 bp, Artificial Sequence
  Description of Artificial Sequence: Synthetic oligonucleotide
  Target: FXN; (-) strand; PAM type: NRG; PAM sequence: GAG
cacacttttgcaaacacaga

SEQ ID NO: 13260 - DNA, 20 bp, Artificial Sequence
  Description of Artificial Sequence: Synthetic oligonucleotide
  Target: FXN; (-) strand; PAM type: NRG; PAM sequence: GAG
aacacacttttgcaaacaca

SEQ ID NO: 13261 - DNA, 20 bp, Artificial Sequence
  Description of Artificial Sequence: Synthetic oligonucleotide
  Target: FXN; (-) strand; PAM type: NRG; PAM sequence: CAG
ataacacacttttgcaaaca

SEQ ID NO: 13262 - DNA, 20 bp, Artificial Sequence
  Description of Artificial Sequence: Synthetic oligonucleotide
  Target: FXN; (-) strand; PAM type: NRG; PAM sequence: AGG
agagcctccatccaatcgag

SEQ ID NO: 13263 - DNA, 20 bp, Artificial Sequence
  Description of Artificial Sequence: Synthetic oligonucleotide
  Target: FXN; (-) strand; PAM type: NRG; PAM sequence: GAG
tagagcctccatccaatcga

SEQ ID NO: 13264 - DNA, 20 bp, Artificial Sequence
  Description of Artificial Sequence: Synthetic oligonucleotide
  Target: FXN; (-) strand; PAM type: NRG; PAM sequence: GAG
tctagagcctccatccaatc

SEQ ID NO: 13265 - DNA, 20 bp, Artificial Sequence
  Description of Artificial Sequence: Synthetic oligonucleotide
  Target: FXN; (-) strand; PAM type: NRG; PAM sequence: GAG
gcctttttctgtgcattcta

SEQ ID NO: 13266 - DNA, 20 bp, Artificial Sequence
  Description of Artificial Sequence: Synthetic oligonucleotide
  Target: FXN; (-) strand; PAM type: NRG; PAM sequence: TAG
cagcctttttctgtgcattc

SEQ ID NO: 13267 - DNA, 20 bp, Artificial Sequence
  Description of Artificial Sequence: Synthetic oligonucleotide
  Target: FXN; (-) strand; PAM type: NRG; PAM sequence: CAG
cttgcagagatacacggtgg

SEQ ID NO: 13268 - DNA, 20 bp, Artificial Sequence
  Description of Artificial Sequence: Synthetic oligonucleotide
  Target: FXN; (-) strand; PAM type: NRG; PAM sequence: TGG
tgacttgcagagatacacgg

SEQ ID NO: 13269 - DNA, 20 bp, Artificial Sequence
  Description of Artificial Sequence: Synthetic oligonucleotide
  Target: FXN; (-) strand; PAM type: NRG; PAM sequence: CGG
gcatgacttgcagagataca

SEQ ID NO: 13270 - DNA, 20 bp, Artificial Sequence
  Description of Artificial Sequence: Synthetic oligonucleotide
  Target: FXN; (-) strand; PAM type: NRG; PAM sequence: GAG
catcttgtgcatgacttgca

SEQ ID NO: 13271 - DNA, 20 bp, Artificial Sequence
  Description of Artificial Sequence: Synthetic oligonucleotide
  Target: FXN; (-) strand; PAM type: NRG; PAM sequence: CAG
cccatcttgtgcatgacttg

SEQ ID NO: 13272 - DNA, 20 bp, Artificial Sequence
  Description of Artificial Sequence: Synthetic oligonucleotide
  Target: FXN; (-) strand; PAM type: NRG; PAM sequence: AAG
ttgaactggtaagcaggggg

SEQ ID NO: 13273 - DNA, 20 bp, Artificial Sequence
  Description of Artificial Sequence: Synthetic oligonucleotide
  Target: FXN; (-) strand; PAM type: NRG; PAM sequence: GGG
tatttgaactggtaagcagg

SEQ ID NO: 13274 - DNA, 20 bp, Artificial Sequence
  Description of Artificial Sequence: Synthetic oligonucleotide
  Target: FXN; (-) strand; PAM type: NRG; PAM sequence: GGG
gtatttgaactggtaagcag

SEQ ID NO: 13275 - DNA, 20 bp, Artificial Sequence
  Description of Artificial Sequence: Synthetic oligonucleotide
  Target: FXN; (-) strand; PAM type: NRG; PAM sequence: GGG
tgtatttgaactggtaagca

SEQ ID NO: 13276 - DNA, 20 bp, Artificial Sequence
  Description of Artificial Sequence: Synthetic oligonucleotide
  Target: FXN; (-) strand; PAM type: NRG; PAM sequence: AGG
ctgtatttgaactggtaagc

SEQ ID NO: 13277 - DNA, 20 bp, Artificial Sequence
  Description of Artificial Sequence: Synthetic oligonucleotide
  Target: FXN; (-) strand; PAM type: NRG; PAM sequence: CAG
tctgtatttgaactggtaag

SEQ ID NO: 13278 - DNA, 20 bp, Artificial Sequence
  Description of Artificial Sequence: Synthetic oligonucleotide
  Target: FXN; (-) strand; PAM type: NRG; PAM sequence: AAG
ttctctgtatttgaactggt

SEQ ID NO: 13279 - DNA, 20 bp, Artificial Sequence
  Description of Artificial Sequence: Synthetic oligonucleotide
  Target: FXN; (-) strand; PAM type: NRG; PAM sequence: TGG
ctagttctctgtatttgaac

SEQ ID NO: 13280 - DNA, 20 bp, Artificial Sequence
  Description of Artificial Sequence: Synthetic oligonucleotide
  Target: FXN; (-) strand; PAM type: NRG; PAM sequence: TAG
gaaagaaacagctacagggc

SEQ ID NO: 13281 - DNA, 20 bp, Artificial Sequence
  Description of Artificial Sequence: Synthetic oligonucleotide
  Target: FXN; (-) strand; PAM type: NRG; PAM sequence: GGG
atatgaaagaaacagctaca

SEQ ID NO: 13282 - DNA, 20 bp, Artificial Sequence
  Description of Artificial Sequence: Synthetic oligonucleotide
  Target: FXN; (-) strand; PAM type: NRG; PAM sequence: AGG
gatatgaaagaaacagctac

SEQ ID NO: 13283 - DNA, 20 bp, Artificial Sequence
  Description of Artificial Sequence: Synthetic oligonucleotide
  Target: FXN; (-) strand; PAM type: NRG; PAM sequence: CAG
agatatgaaagaaacagcta

SEQ ID NO: 13284 - DNA, 20 bp, Artificial Sequence
  Description of Artificial Sequence: Synthetic oligonucleotide
  Target: FXN; (-) strand; PAM type: NRG; PAM sequence: CAG
tgggtgagatatgaaagaaa

SEQ ID NO: 13285 - DNA, 20 bp, Artificial Sequence
  Description of Artificial Sequence: Synthetic oligonucleotide
  Target: FXN; (-) strand; PAM type: NRG; PAM sequence: AAG
ttagaatgggtgagatatga

SEQ ID NO: 13286 - DNA, 20 bp, Artificial Sequence
  Description of Artificial Sequence: Synthetic oligonucleotide
  Target: FXN; (-) strand; PAM type: NRG; PAM sequence: GAG
gtggtctctttagaatgggt

SEQ ID NO: 13287 - DNA, 20 bp, Artificial Sequence
  Description of Artificial Sequence: Synthetic oligonucleotide
  Target: FXN; (-) strand; PAM type: NRG; PAM sequence: GGG
gcctgtggtctctttagaat

SEQ ID NO: 13288 - DNA, 20 bp, Artificial Sequence
  Description of Artificial Sequence: Synthetic oligonucleotide
  Target: FXN; (-) strand; PAM type: NRG; PAM sequence: TGG
ggcctgtggtctctttagaa

SEQ ID NO: 13289 - DNA, 20 bp, Artificial Sequence
  Description of Artificial Sequence: Synthetic oligonucleotide
  Target: FXN; (-) strand; PAM type: NRG; PAM sequence: TAG
tctaaggcctgtggtctctt

SEQ ID NO: 13290 - DNA, 20 bp, Artificial Sequence
  Description of Artificial Sequence: Synthetic oligonucleotide
  Target: FXN; (-) strand; PAM type: NRG; PAM sequence: TGG
tcctttacttctaaggcctg

SEQ ID NO: 13291 - DNA, 20 bp, Artificial Sequence
  Description of Artificial Sequence: Synthetic oligonucleotide
  Target: FXN; (-) strand; PAM type: NRG; PAM sequence: AGG
aaaagagtcctttacttcta

SEQ ID NO: 13292 - DNA, 20 bp, Artificial Sequence
  Description of Artificial Sequence: Synthetic oligonucleotide
  Target: FXN; (-) strand; PAM type: NRG; PAM sequence: AAG
caaaagagtcctttacttct

SEQ ID NO: 13293 - DNA, 20 bp, Artificial Sequence
  Description of Artificial Sequence: Synthetic oligonucleotide
  Target: FXN; (-) strand; PAM type: NRG; PAM sequence: GAG
aaaacactctttcaacaaaa

SEQ ID NO: 13294 - DNA, 20 bp, Artificial Sequence
  Description of Artificial Sequence: Synthetic oligonucleotide
  Target: FXN; (-) strand; PAM type: NRG; PAM sequence: AAG
tgaaaacactctttcaacaa

SEQ ID NO: 13295 - DNA, 20 bp, Artificial Sequence
  Description of Artificial Sequence: Synthetic oligonucleotide
  Target: FXN; (-) strand; PAM type: NRG; PAM sequence: TGG
gaattcttcaaaagactagt

SEQ ID NO: 13296 - DNA, 20 bp, Artificial Sequence
  Description of Artificial Sequence: Synthetic oligonucleotide
  Target: FXN; (-) strand; PAM type: NRG; PAM sequence: TAG
ccttgaattcttcaaaagac

SEQ ID NO: 13297 - DNA, 20 bp, Artificial Sequence
  Description of Artificial Sequence: Synthetic oligonucleotide
  Target: FXN; (-) strand; PAM type: NRG; PAM sequence: AAG
aagagccttgaattcttcaa

SEQ ID NO: 13298 - DNA, 20 bp, Artificial Sequence
  Description of Artificial Sequence: Synthetic oligonucleotide
  Target: FXN; (-) strand; PAM type: NRG; PAM sequence: GAG
aggctttatttttctctaaa

SEQ ID NO: 13299 - DNA, 20 bp, Artificial Sequence
  Description of Artificial Sequence: Synthetic oligonucleotide
  Target: FXN; (-) strand; PAM type: NRG; PAM sequence: AAG
caaggctttatttttctcta

SEQ ID NO: 13300 - DNA, 20 bp, Artificial Sequence
  Description of Artificial Sequence: Synthetic oligonucleotide
  Target: FXN; (-) strand; PAM type: NRG; PAM sequence: AGG
gcttctcagatactcctcca

SEQ ID NO: 13301 - DNA, 20 bp, Artificial Sequence
  Description of Artificial Sequence: Synthetic oligonucleotide
  Target: FXN; (-) strand; PAM type: NRG; PAM sequence: AAG
agcttctcagatactcctcc

SEQ ID NO: 13302 - DNA, 20 bp, Artificial Sequence
  Description of Artificial Sequence: Synthetic oligonucleotide
  Target: FXN; (-) strand; PAM type: NRG; PAM sequence: CAG
cacgcatctaacaagcttct

SEQ ID NO: 13303 - DNA, 20 bp, Artificial Sequence
  Description of Artificial Sequence: Synthetic oligonucleotide
  Target: FXN; (-) strand; PAM type: NRG; PAM sequence: AAG
actcttcccacgcatctaac

SEQ ID NO: 13304 - DNA, 20 bp, Artificial Sequence
  Description of Artificial Sequence: Synthetic oligonucleotide
  Target: FXN; (-) strand; PAM type: NRG; PAM sequence: CAG
cagatgaagttttttatttc

SEQ ID NO: 13305 - DNA, 20 bp, Artificial Sequence
  Description of Artificial Sequence: Synthetic oligonucleotide
  Target: FXN; (-) strand; PAM type: NRG; PAM sequence: AAG
gaaggcagaaactccagatg

SEQ ID NO: 13306 - DNA, 20 bp, Artificial Sequence
  Description of Artificial Sequence: Synthetic oligonucleotide
  Target: FXN; (-) strand; PAM type: NRG; PAM sequence: CAG
ttggtagaaggcagaaactc

SEQ ID NO: 13307 - DNA, 20 bp, Artificial Sequence
  Description of Artificial Sequence: Synthetic oligonucleotide
  Target: FXN; (-) strand; PAM type: NRG; PAM sequence: CAG
tcagctctgttggtagaagg

SEQ ID NO: 13308 - DNA, 20 bp, Artificial Sequence
  Description of Artificial Sequence: Synthetic oligonucleotide
  Target: FXN; (-) strand; PAM type: NRG; PAM sequence: AGG
gcttcagctctgttggtaga

SEQ ID NO: 13309 - DNA, 20 bp, Artificial Sequence
  Description of Artificial Sequence: Synthetic oligonucleotide
  Target: FXN; (-) strand; PAM type: NRG; PAM sequence: AAG
agcttcagctctgttggtag

SEQ ID NO: 13310 - DNA, 20 bp, Artificial Sequence
  Description of Artificial Sequence: Synthetic oligonucleotide
  Target: FXN; (-) strand; PAM type: NRG; PAM sequence: TAG
attagcttcagctctgttgg

SEQ ID NO: 13311 - DNA, 20 bp, Artificial Sequence
  Description of Artificial Sequence: Synthetic oligonucleotide
  Target: FXN; (-) strand; PAM type: NRG; PAM sequence: TGG
agcattagcttcagctctgt

SEQ ID NO: 13312 - DNA, 20 bp, Artificial Sequence
  Description of Artificial Sequence: Synthetic oligonucleotide
  Target: FXN; (-) strand; PAM type: NRG; PAM sequence: CAG
tcttaggagagcattagctt

SEQ ID NO: 13313 - DNA, 20 bp, Artificial Sequence
  Description of Artificial Sequence: Synthetic oligonucleotide
  Target: FXN; (-) strand; PAM type: NRG; PAM sequence: TAG
tgcttgtcttaggagagcat

SEQ ID NO: 13314 - DNA, 20 bp, Artificial Sequence
  Description of Artificial Sequence: Synthetic oligonucleotide
  Target: FXN; (-) strand; PAM type: NRG; PAM sequence: GAG
ctgctttgcttgtcttagga

SEQ ID NO: 13315 - DNA, 20 bp, Artificial Sequence
  Description of Artificial Sequence: Synthetic oligonucleotide
  Target: FXN; (-) strand; PAM type: NRG; PAM sequence: GAG
atctgctttgcttgtcttag

SEQ ID NO: 13316 - DNA, 20 bp, Artificial Sequence
  Description of Artificial Sequence: Synthetic oligonucleotide
  Target: FXN; (-) strand; PAM type: NRG; PAM sequence: AGG
ccatctgctttgcttgtctt

SEQ ID NO: 13317 - DNA, 20 bp, Artificial Sequence
  Description of Artificial Sequence: Synthetic oligonucleotide
  Target: FXN; (-) strand; PAM type: NRG; PAM sequence: TAG
accatctgctttgcttgtct

SEQ ID NO: 13318 - DNA, 20 bp, Artificial Sequence
  Description of Artificial Sequence: Synthetic oligonucleotide
  Target: FXN; (-) strand; PAM type: NRG; PAM sequence: AAG
gaagtaaaaggaaggtaagg

SEQ ID NO: 13319 - DNA, 20 bp, Artificial Sequence
  Description of Artificial Sequence: Synthetic oligonucleotide
  Target: FXN; (-) strand; PAM type: NRG; PAM sequence: AGG
gaggaagtaaaaggaaggta

SEQ ID NO: 13320 - DNA, 20 bp, Artificial Sequence
  Description of Artificial Sequence: Synthetic oligonucleotide
  Target: FXN; (-) strand; PAM type: NRG; PAM sequence: AAG
agaggaagtaaaaggaaggt

SEQ ID NO: 13321 - DNA, 20 bp, Artificial Sequence
  Description of Artificial Sequence: Synthetic oligonucleotide
  Target: FXN; (-) strand; PAM type: NRG; PAM sequence: AGG
ttacagaggaagtaaaagga

SEQ ID NO: 13322 - DNA, 20 bp, Artificial Sequence
  Description of Artificial Sequence: Synthetic oligonucleotide
  Target: FXN; (-) strand; PAM type: NRG; PAM sequence: AAG
attacagaggaagtaaaagg

SEQ ID NO: 13323 - DNA, 20 bp, Artificial Sequence
  Description of Artificial Sequence: Synthetic oligonucleotide
  Target: FXN; (-) strand; PAM type: NRG; PAM sequence: AGG
tctattacagaggaagtaaa

SEQ ID NO: 13324 - DNA, 20 bp, Artificial Sequence
  Description of Artificial Sequence: Synthetic oligonucleotide
  Target: FXN; (-) strand; PAM type: NRG; PAM sequence: AAG
gtctattacagaggaagtaa

SEQ ID NO: 13325 - DNA, 20 bp, Artificial Sequence
  Description of Artificial Sequence: Synthetic oligonucleotide
  Target: FXN; (-) strand; PAM type: NRG; PAM sequence: AAG
tgacaagtctattacagagg

SEQ ID NO: 13326 - DNA, 20 bp, Artificial Sequence
  Description of Artificial Sequence: Synthetic oligonucleotide
  Target: FXN; (-) strand; PAM type: NRG; PAM sequence: AGG
acatgacaagtctattacag

SEQ ID NO: 13327 - DNA, 20 bp, Artificial Sequence
  Description of Artificial Sequence: Synthetic oligonucleotide
  Target: FXN; (-) strand; PAM type: NRG; PAM sequence: GAG
gacatgacaagtctattaca

SEQ ID NO: 13328 - DNA, 20 bp, Artificial Sequence
  Description of Artificial Sequence: Synthetic oligonucleotide
  Target: FXN; (-) strand; PAM type: NRG; PAM sequence: CAG
cagacatgacaagtctatta

SEQ ID NO: 13329 - DNA, 20 bp, Artificial Sequence
  Description of Artificial Sequence: Synthetic oligonucleotide
  Target: FXN; (-) strand; PAM type: NRG; PAM sequence: AAG
actcaaacatcagacatgac

SEQ ID NO: 13330 - DNA, 20 bp, Artificial Sequence
  Description of Artificial Sequence: Synthetic oligonucleotide
  Target: FXN; (-) strand; PAM type: NRG; PAM sequence: CAG
taccacgtcaactcaaacat

SEQ ID NO: 13331 - DNA, 20 bp, Artificial Sequence
  Description of Artificial Sequence: Synthetic oligonucleotide
  Target: FXN; (-) strand; PAM type: NRG; PAM sequence: GAG
tgcagactctaactctatta

SEQ ID NO: 13332 - DNA, 20 bp, Artificial Sequence
  Description of Artificial Sequence: Synthetic oligonucleotide
  Target: FXN; (-) strand; PAM type: NRG; PAM sequence: TAG
aatgcagactctaactctat

SEQ ID NO: 13333 - DNA, 20 bp, Artificial Sequence
  Description of Artificial Sequence: Synthetic oligonucleotide
  Target: FXN; (-) strand; PAM type: NRG; PAM sequence: CAG
tagaggacataaaaaaaatg

SEQ ID NO: 13334 - DNA, 20 bp, Artificial Sequence
  Description of Artificial Sequence: Synthetic oligonucleotide
  Target: FXN; (-) strand; PAM type: NRG; PAM sequence: AGG
catcaaccagaacatactag

SEQ ID NO: 13335 - DNA, 20 bp, Artificial Sequence
  Description of Artificial Sequence: Synthetic oligonucleotide
  Target: FXN; (-) strand; PAM type: NRG; PAM sequence: GAG
ccatcaaccagaacatacta

SEQ ID NO: 13336 - DNA, 20 bp, Artificial Sequence
  Description of Artificial Sequence: Synthetic oligonucleotide
  Target: FXN; (-) strand; PAM type: NRG; PAM sequence: TAG
aaccatcaaccagaacatac

SEQ ID NO: 13337 - DNA, 20 bp, Artificial Sequence
  Description of Artificial Sequence: Synthetic oligonucleotide
  Target: FXN; (-) strand; PAM type: NRG; PAM sequence: CAG
tgttgccctcaaccatcaac

SEQ ID NO: 13338 - DNA, 20 bp, Artificial Sequence
  Description of Artificial Sequence: Synthetic oligonucleotide
  Target: FXN; (-) strand; PAM type: NRG; PAM sequence: TGG
gtgctggcatctgggactgc

SEQ ID NO: 13339 - DNA, 20 bp, Artificial Sequence
  Description of Artificial Sequence: Synthetic oligonucleotide
  Target: FXN; (-) strand; PAM type: NRG; PAM sequence: GGG
aggtcttggtgctggcatct

SEQ ID NO: 13340 - DNA, 20 bp, Artificial Sequence
  Description of Artificial Sequence: Synthetic oligonucleotide
  Target: FXN; (-) strand; PAM type: NRG; PAM sequence: TGG
caggtcttggtgctggcatc

SEQ ID NO: 13341 - DNA, 20 bp, Artificial Sequence
  Description of Artificial Sequence: Synthetic oligonucleotide
  Target: FXN; (-) strand; PAM type: NRG; PAM sequence: TGG
cctgtctcaggtcttggtgc

SEQ ID NO: 13342 - DNA, 20 bp, Artificial Sequence
  Description of Artificial Sequence: Synthetic oligonucleotide
  Target: FXN; (-) strand; PAM type: NRG; PAM sequence: TGG
aagtgacctgtctcaggtct

SEQ ID NO: 13343 - DNA, 20 bp, Artificial Sequence
  Description of Artificial Sequence: Synthetic oligonucleotide
  Target: FXN; (-) strand; PAM type: NRG; PAM sequence: AGG
agagttaagtgacctgtctc

SEQ ID NO: 13344 - DNA, 20 bp, Artificial Sequence
  Description of Artificial Sequence: Synthetic oligonucleotide
  Target: FXN; (-) strand; PAM type: NRG; PAM sequence: CAG
gagagttaagtgacctgtct

SEQ ID NO: 13345 - DNA, 20 bp, Artificial Sequence
  Description of Artificial Sequence: Synthetic oligonucleotide
  Target: FXN; (-) strand; PAM type: NRG; PAM sequence: AAG
gtggtgaagctcggagagtt

SEQ ID NO: 13346 - DNA, 20 bp, Artificial Sequence
  Description of Artificial Sequence: Synthetic oligonucleotide
  Target: FXN; (-) strand; PAM type: NRG; PAM sequence: GAG
gaatggtggtgaagctcgga

SEQ ID NO: 13347 - DNA, 20 bp, Artificial Sequence
  Description of Artificial Sequence: Synthetic oligonucleotide
  Target: FXN; (-) strand; PAM type: NRG; PAM sequence: GAG
gagaatggtggtgaagctcg

SEQ ID NO: 13348 - DNA, 20 bp, Artificial Sequence
  Description of Artificial Sequence: Synthetic oligonucleotide
  Target: FXN; (-) strand; PAM type: NRG; PAM sequence: CGG
gtgagaatggtggtgaagct

SEQ ID NO: 13349 - DNA, 20 bp, Artificial Sequence
  Description of Artificial Sequence: Synthetic oligonucleotide
  Target: FXN; (-) strand; PAM type: NRG; PAM sequence: AAG
gcaaggtgagaatggtggtg

SEQ ID NO: 13350 - DNA, 20 bp, Artificial Sequence
  Description of Artificial Sequence: Synthetic oligonucleotide
  Target: FXN; (-) strand; PAM type: NRG; PAM sequence: TGG
ggtctgcaaggtgagaatgg

SEQ ID NO: 13351 - DNA, 20 bp, Artificial Sequence
  Description of Artificial Sequence: Synthetic oligonucleotide
  Target: FXN; (-) strand; PAM type: NRG; PAM sequence: TGG
tgaggtctgcaaggtgagaa

SEQ ID NO: 13352 - DNA, 20 bp, Artificial Sequence
  Description of Artificial Sequence: Synthetic oligonucleotide
  Target: FXN; (-) strand; PAM type: NRG; PAM sequence: GAG
ccctgtgaggtctgcaaggt

SEQ ID NO: 13353 - DNA, 20 bp, Artificial Sequence
  Description of Artificial Sequence: Synthetic oligonucleotide
  Target: FXN; (-) strand; PAM type: NRG; PAM sequence: AGG
tgttccctgtgaggtctgca

SEQ ID NO: 13354 - DNA, 20 bp, Artificial Sequence
  Description of Artificial Sequence: Synthetic oligonucleotide
  Target: FXN; (-) strand; PAM type: NRG; PAM sequence: AAG
ctgttccctgtgaggtctgc

SEQ ID NO: 13355 - DNA, 20 bp, Artificial Sequence
  Description of Artificial Sequence: Synthetic oligonucleotide
  Target: FXN; (-) strand; PAM type: NRG; PAM sequence: AGG
agctttccctgttccctgtg

SEQ ID NO: 13356 - DNA, 20 bp, Artificial Sequence
  Description of Artificial Sequence: Synthetic oligonucleotide
  Target: FXN; (-) strand; PAM type: NRG; PAM sequence: GAG
gagctttccctgttccctgt

SEQ ID NO: 13357 - DNA, 20 bp, Artificial Sequence
  Description of Artificial Sequence: Synthetic oligonucleotide
  Target: FXN; (-) strand; PAM type: NRG; PAM sequence: GAG
taatgatgttgtatctcata

SEQ ID NO: 13358 - DNA, 20 bp, Artificial Sequence
  Description of Artificial Sequence: Synthetic oligonucleotide
  Target: FXN; (-) strand; PAM type: NRG; PAM sequence: TAG
cataatgatgttgtatctca

SEQ ID NO: 13359 - DNA, 20 bp, Artificial Sequence
  Description of Artificial Sequence: Synthetic oligonucleotide
  Target: FXN; (-) strand; PAM type: NRG; PAM sequence: AGG
tttgctttcagaatcagaat

SEQ ID NO: 13360 - DNA, 20 bp, Artificial Sequence
  Description of Artificial Sequence: Synthetic oligonucleotide
  Target: FXN; (-) strand; PAM type: NRG; PAM sequence: TAG
ctttgctttcagaatcagaa

SEQ ID NO: 13361 - DNA, 20 bp, Artificial Sequence
  Description of Artificial Sequence: Synthetic oligonucleotide
  Target: FXN; (-) strand; PAM type: NRG; PAM sequence: CAG
aagagctttgctttcagaat

SEQ ID NO: 13362 - DNA, 20 bp, Artificial Sequence
  Description of Artificial Sequence: Synthetic oligonucleotide
  Target: FXN; (-) strand; PAM type: NRG; PAM sequence: CAG
tgtaggaagagctttgcttt

SEQ ID NO: 13363 - DNA, 20 bp, Artificial Sequence
  Description of Artificial Sequence: Synthetic oligonucleotide
  Target: FXN; (-) strand; PAM type: NRG; PAM sequence: GAG
aataggagtttgtgtaggaa

SEQ ID NO: 13364 - DNA, 20 bp, Artificial Sequence
  Description of Artificial Sequence: Synthetic oligonucleotide
  Target: FXN; (-) strand; PAM type: NRG; PAM sequence: AAG
gaaataggagtttgtgtagg

SEQ ID NO: 13365 - DNA, 20 bp, Artificial Sequence
  Description of Artificial Sequence: Synthetic oligonucleotide
  Target: FXN; (-) strand; PAM type: NRG; PAM sequence: AGG
ttagaaataggagtttgtgt

SEQ ID NO: 13366 - DNA, 20 bp, Artificial Sequence
  Description of Artificial Sequence: Synthetic oligonucleotide
  Target: FXN; (-) strand; PAM type: NRG; PAM sequence: TAG
tttagaaataggagtttgtg

SEQ ID NO: 13367 - DNA, 20 bp, Artificial Sequence
  Description of Artificial Sequence: Synthetic oligonucleotide
  Target: FXN; (-) strand; PAM type: NRG; PAM sequence: GAG
cttttagtatttagaaatag

SEQ ID NO: 13368 - DNA, 20 bp, Artificial Sequence
  Description of Artificial Sequence: Synthetic oligonucleotide
  Target: FXN; (-) strand; PAM type: NRG; PAM sequence: AGG
gtcttttagtatttagaaat

SEQ ID NO: 13369 - DNA, 20 bp, Artificial Sequence
  Description of Artificial Sequence: Synthetic oligonucleotide
  Target: FXN; (-) strand; PAM type: NRG; PAM sequence: TAG
tgtcttttagtatttagaaa

SEQ ID NO: 13370 - DNA, 20 bp, Artificial Sequence
  Description of Artificial Sequence: Synthetic oligonucleotide
  Target: FXN; (-) strand; PAM type: NRG; PAM sequence: TAG
aagaaatgtcttttagtatt

SEQ ID NO: 13371 - DNA, 20 bp, Artificial Sequence
  Description of Artificial Sequence: Synthetic oligonucleotide
  Target: FXN; (-) strand; PAM type: NRG; PAM sequence: TAG
caccataaagaaatgtcttt

SEQ ID NO: 13372 - DNA, 20 bp, Artificial Sequence
  Description of Artificial Sequence: Synthetic oligonucleotide
  Target: FXN; (-) strand; PAM type: NRG; PAM sequence: AAG
agtacacaaaatacaccata

SEQ ID NO: 13373 - DNA, 20 bp, Artificial Sequence
  Description of Artificial Sequence: Synthetic oligonucleotide
  Target: FXN; (-) strand; PAM type: NRG; PAM sequence: AAG
tcaacactttccatttctac

SEQ ID NO: 13374 - DNA, 20 bp, Artificial Sequence
  Description of Artificial Sequence: Synthetic oligonucleotide
  Target: FXN; (-) strand; PAM type: NRG; PAM sequence: TAG
aaattaaaacaagaaaaagt

SEQ ID NO: 13375 - DNA, 20 bp, Artificial Sequence
  Description of Artificial Sequence: Synthetic oligonucleotide
  Target: FXN; (-) strand; PAM type: NRG; PAM sequence: AAG
aaagaaattaaaacaagaaa

SEQ ID NO: 13376 - DNA, 20 bp, Artificial Sequence
  Description of Artificial Sequence: Synthetic oligonucleotide
  Target: FXN; (-) strand; PAM type: NRG; PAM sequence: AAG
aagcataaagaaattaaaac

SEQ ID NO: 13377 - DNA, 20 bp, Artificial Sequence
  Description of Artificial Sequence: Synthetic oligonucleotide
  Target: FXN; (-) strand; PAM type: NRG; PAM sequence: AAG
ttaggtggaaaaaaagcata

SEQ ID NO: 13378 - DNA, 20 bp, Artificial Sequence
  Description of Artificial Sequence: Synthetic oligonucleotide
  Target: FXN; (-) strand; PAM type: NRG; PAM sequence: AAG
taggggattaggtggaaaaa

SEQ ID NO: 13379 - DNA, 20 bp, Artificial Sequence
  Description of Artificial Sequence: Synthetic oligonucleotide
  Target: FXN; (-) strand; PAM type: NRG; PAM sequence: TGG
caccactctaggggattagg

SEQ ID NO: 13380 - DNA, 20 bp, Artificial Sequence
  Description of Artificial Sequence: Synthetic oligonucleotide
  Target: FXN; (-) strand; PAM type: NRG; PAM sequence: AGG
agacaccactctaggggatt

SEQ ID NO: 13381 - DNA, 20 bp, Artificial Sequence
  Description of Artificial Sequence: Synthetic oligonucleotide
  Target: FXN; (-) strand; PAM type: NRG; PAM sequence: TAG
aagacaccactctaggggat

SEQ ID NO: 13382 - DNA, 20 bp, Artificial Sequence
  Description of Artificial Sequence: Synthetic oligonucleotide
  Target: FXN; (-) strand; PAM type: NRG; PAM sequence: GGG
cagttaagacaccactctag

SEQ ID NO: 13383 - DNA, 20 bp, Artificial Sequence
  Description of Artificial Sequence: Synthetic oligonucleotide
  Target: FXN; (-) strand; PAM type: NRG; PAM sequence: GGG
acagttaagacaccactcta

SEQ ID NO: 13384 - DNA, 20 bp, Artificial Sequence
  Description of Artificial Sequence: Synthetic oligonucleotide
  Target: FXN; (-) strand; PAM type: NRG; PAM sequence: AGG
gacagttaagacaccactct

SEQ ID NO: 13385 - DNA, 20 bp, Artificial Sequence
  Description of Artificial Sequence: Synthetic oligonucleotide
  Target: FXN; (-) strand; PAM type: NRG; PAM sequence: TAG
tgacagttaagacaccactc

SEQ ID NO: 13386 - DNA, 20 bp, Artificial Sequence
  Description of Artificial Sequence: Synthetic oligonucleotide
  Target: FXN; (-) strand; PAM type: NRG; PAM sequence: AAG
ctccacccagtttgacagtt

SEQ ID NO: 13387 - DNA, 20 bp, Artificial Sequence
  Description of Artificial Sequence: Synthetic oligonucleotide
  Target: FXN; (-) strand; PAM type: NRG; PAM sequence: CAG
tagatctccacccagtttga

SEQ ID NO: 13388 - DNA, 20 bp, Artificial Sequence
  Description of Artificial Sequence: Synthetic oligonucleotide
  Target: FXN; (-) strand; PAM type: NRG; PAM sequence: CAG
taggttcctagatctccacc

SEQ ID NO: 13389 - DNA, 20 bp, Artificial Sequence
  Description of Artificial Sequence: Synthetic oligonucleotide
  Target: FXN; (-) strand; PAM type: NRG; PAM sequence: TAG
ttgttgatcacataggttcc

SEQ ID NO: 13390 - DNA, 20 bp, Artificial Sequence
  Description of Artificial Sequence: Synthetic oligonucleotide
  Target: FXN; (-) strand; PAM type: NRG; PAM sequence: AGG
cgtctgcttgttgatcacat

SEQ ID NO: 13391 - DNA, 20 bp, Artificial Sequence
  Description of Artificial Sequence: Synthetic oligonucleotide
  Target: FXN; (-) strand; PAM type: NRG; PAM sequence: TAG
gcgtctgcttgttgatcaca

SEQ ID NO: 13392 - DNA, 20 bp, Artificial Sequence
  Description of Artificial Sequence: Synthetic oligonucleotide
  Target: FXN; (-) strand; PAM type: NRG; PAM sequence: TGG
gatagccagatttgcttgtt

SEQ ID NO: 13393 - DNA, 20 bp, Artificial Sequence
  Description of Artificial Sequence: Synthetic oligonucleotide
  Target: FXN; (-) strand; PAM type: NRG; PAM sequence: CAG
acctggatggagaagatagc

SEQ ID NO: 13394 - DNA, 20 bp, Artificial Sequence
  Description of Artificial Sequence: Synthetic oligonucleotide
  Target: FXN; (-) strand; PAM type: NRG; PAM sequence: TAG
acatacctggatggagaaga

SEQ ID NO: 13395 - DNA, 20 bp, Artificial Sequence
  Description of Artificial Sequence: Synthetic oligonucleotide
  Target: FXN; (-) strand; PAM type: NRG; PAM sequence: AAG
acctacatacctggatggag

SEQ ID NO: 13396 - DNA, 20 bp, Artificial Sequence
  Description of Artificial Sequence: Synthetic oligonucleotide
  Target: FXN; (-) strand; PAM type: NRG; PAM sequence: GAG
catacctacatacctggatg

SEQ ID NO: 13397 - DNA, 20 bp, Artificial Sequence
  Description of Artificial Sequence: Synthetic oligonucleotide
  Target: FXN; (-) strand; PAM type: NRG; PAM sequence: TGG
aacatacctacatacctgga

SEQ ID NO: 13398 - DNA, 20 bp, Artificial Sequence
  Description of Artificial Sequence: Synthetic oligonucleotide
  Target: FXN; (-) strand; PAM type: NRG; PAM sequence: TGG
tctgaacatacctacatacc

SEQ ID NO: 13399 - DNA, 20 bp, Artificial Sequence
  Description of Artificial Sequence: Synthetic oligonucleotide
  Target: FXN; (-) strand; PAM type: NRG; PAM sequence: AAG
gtcacatttcggaagtcttt

SEQ ID NO: 13400 - DNA, 20 bp, Artificial Sequence
  Description of Artificial Sequence: Synthetic oligonucleotide
  Target: FXN; (-) strand; PAM type: NRG; PAM sequence: AAG
tccacaatgtcacatttcgg

SEQ ID NO: 13401 - DNA, 20 bp, Artificial Sequence
  Description of Artificial Sequence: Synthetic oligonucleotide
  Target: FXN; (-) strand; PAM type: NRG; PAM sequence: CGG
tggtccacaatgtcacattt

SEQ ID NO: 13402 - DNA, 20 bp, Artificial Sequence
  Description of Artificial Sequence: Synthetic oligonucleotide
  Target: FXN; (-) strand; PAM type: NRG; PAM sequence: TGG
ctcagccgacatttcttaaa

SEQ ID NO: 13403 - DNA, 20 bp, Artificial Sequence
  Description of Artificial Sequence: Synthetic oligonucleotide
  Target: FXN; (-) strand; PAM type: NRG; PAM sequence: CAG
caggtgtcagccactgtgct

SEQ ID NO: 13404 - DNA, 20 bp, Artificial Sequence
  Description of Artificial Sequence: Synthetic oligonucleotide
  Target: FXN; (-) strand; PAM type: NRG; PAM sequence: CAG
agtgttgggattacaggtgt

SEQ ID NO: 13405 - DNA, 20 bp, Artificial Sequence
  Description of Artificial Sequence: Synthetic oligonucleotide
  Target: FXN; (-) strand; PAM type: NRG; PAM sequence: AGG
tctcaaagtgttgggattac

SEQ ID NO: 13406 - DNA, 20 bp, Artificial Sequence
  Description of Artificial Sequence: Synthetic oligonucleotide
  Target: FXN; (-) strand; PAM type: NRG; PAM sequence: CAG
ctctcaaagtgttgggatta

SEQ ID NO: 13407 - DNA, 20 bp, Artificial Sequence
  Description of Artificial Sequence: Synthetic oligonucleotide
  Target: FXN; (-) strand; PAM type: NRG; PAM sequence: GGG
cctcagcctctcaaagtgtt

SEQ ID NO: 13408 - DNA, 20 bp, Artificial Sequence
  Description of Artificial Sequence: Synthetic oligonucleotide
  Target: FXN; (-) strand; PAM type: NRG; PAM sequence: TGG
acctcagcctctcaaagtgt

SEQ ID NO: 13409 - DNA, 20 bp, Artificial Sequence
  Description of Artificial Sequence: Synthetic oligonucleotide
  Target: FXN; (-) strand; PAM type: NRG; PAM sequence: AAG
cctcctacctcagcctctca

SEQ ID NO: 13410 - DNA, 20 bp, Artificial Sequence
  Description of Artificial Sequence: Synthetic oligonucleotide
  Target: FXN; (-) strand; PAM type: NRG; PAM sequence: CAG
ctcaagtgatcctcctacct

SEQ ID NO: 13411 - DNA, 20 bp, Artificial Sequence
  Description of Artificial Sequence: Synthetic oligonucleotide
  Target: FXN; (-) strand; PAM type: NRG; PAM sequence: AAG
ggttctgaactcctgtcctc

SEQ ID NO: 13412 - DNA, 20 bp, Artificial Sequence
  Description of Artificial Sequence: Synthetic oligonucleotide
  Target: FXN; (-) strand; PAM type: NRG; PAM sequence: TGG
actcactatgttgcccagga

SEQ ID NO: 13413 - DNA, 20 bp, Artificial Sequence
  Description of Artificial Sequence: Synthetic oligonucleotide
  Target: FXN; (-) strand; PAM type: NRG; PAM sequence: AGG
agggactcactatgttgccc

SEQ ID NO: 13414 - DNA, 20 bp, Artificial Sequence
  Description of Artificial Sequence: Synthetic oligonucleotide
  Target: FXN; (-) strand; PAM type: NRG; PAM sequence: CAG
cagggactcactatgttgcc

SEQ ID NO: 13415 - DNA, 20 bp, Artificial Sequence
  Description of Artificial Sequence: Synthetic oligonucleotide
  Target: FXN; (-) strand; PAM type: NRG; PAM sequence: GGG
ttattttctttacagagaca

SEQ ID NO: 13416 - DNA, 20 bp, Artificial Sequence
  Description of Artificial Sequence: Synthetic oligonucleotide
  Target: FXN; (-) strand; PAM type: NRG; PAM sequence: AGG
tttattttctttacagagac

SEQ ID NO: 13417 - DNA, 20 bp, Artificial Sequence
  Description of Artificial Sequence: Synthetic oligonucleotide
  Target: FXN; (-) strand; PAM type: NRG; PAM sequence: CAG
ttttattttctttacagaga

SEQ ID NO: 13418 - DNA, 20 bp, Artificial Sequence
  Description of Artificial Sequence: Synthetic oligonucleotide
  Target: FXN; (-) strand; PAM type: NRG; PAM sequence: GAG
ttatttttattttctttaca

SEQ ID NO: 13419 - DNA, 20 bp, Artificial Sequence
  Description of Artificial Sequence: Synthetic oligonucleotide
  Target: FXN; (-) strand; PAM type: NRG; PAM sequence: CAG
ctttatttttattttcttta

SEQ ID NO: 13420 - DNA, 20 bp, Artificial Sequence
  Description of Artificial Sequence: Synthetic oligonucleotide
  Target: FXN; (-) strand; PAM type: NRG; PAM sequence: CAG
tacaggtgtaagcctgcacc

SEQ ID NO: 13421 - DNA, 20 bp, Artificial Sequence
  Description of Artificial Sequence: Synthetic oligonucleotide
  Target: FXN; (-) strand; PAM type: NRG; PAM sequence: AAG
agtgctgggattacaggtgt

SEQ ID NO: 13422 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctgggattac

SEQ ID NO: 13423 - DNA, 20 bp, Artificial Sequence
  Description of Artificial Sequence: Synthetic oligonucleotide
  Target: FXN; (-) strand; PAM type: NRG; PAM sequence: CAG
ctcccaaagtgctgggatta

SEQ ID NO: 13424 - DNA, 20 bp, Artificial Sequence
  Description of Artificial Sequence: Synthetic oligonucleotide
  Target: FXN; (-) strand; PAM type: NRG; PAM sequence: GGG
ccttggcctcccaaagtgct

SEQ ID NO: 13425 - DNA, 20 bp, Artificial Sequence
  Description of Artificial Sequence: Synthetic oligonucleotide
  Target: FXN; (-) strand; PAM type: NRG; PAM sequence: TGG
gccttggcctcccaaagtgc

SEQ ID NO: 13426 - DNA, 20 bp, Artificial Sequence
  Description of Artificial Sequence: Synthetic oligonucleotide
  Target: FXN; (-) strand; PAM type: NRG; PAM sequence: AAG
ccacaggccttggcctccca

SEQ ID NO: 13427 - DNA, 20 bp, Artificial Sequence
  Description of Artificial Sequence: Synthetic oligonucleotide
  Target: FXN; (-) strand; PAM type: NRG; PAM sequence: TGG
ctcaagtgatccacaggcct

SEQ ID NO: 13428 - DNA, 20 bp, Artificial Sequence
  Description of Artificial Sequence: Synthetic oligonucleotide
  Target: FXN; (-) strand; PAM type: NRG; PAM sequence: AGG
cctgagctcaagtgatccac

SEQ ID NO: 13429 - DNA, 20 bp, Artificial Sequence
  Description of Artificial Sequence: Synthetic oligonucleotide
  Target: FXN; (-) strand; PAM type: NRG; PAM sequence: CAG
tcctgagctcaagtgatcca

SEQ ID NO: 13430 - DNA, 20 bp, Artificial Sequence
  Description of Artificial Sequence: Synthetic oligonucleotide
  Target: FXN; (-) strand; PAM type: NRG; PAM sequence: AAG
ggtctcaaactcctgagctc

SEQ ID NO: 13431 - DNA, 20 bp, Artificial Sequence
  Description of Artificial Sequence: Synthetic oligonucleotide
  Target: FXN; (-) strand; PAM type: NRG; PAM sequence: GAG
caggctggtctcaaactcct

SEQ ID NO: 13432 - DNA, 20 bp, Artificial Sequence
  Description of Artificial Sequence: Synthetic oligonucleotide
  Target: FXN; (-) strand; PAM type: NRG; PAM sequence: TGG
ctttgtgacattgcccaggc

SEQ ID NO: 13433 - DNA, 20 bp, Artificial Sequence
  Description of Artificial Sequence: Synthetic oligonucleotide
  Target: FXN; (-) strand; PAM type: NRG; PAM sequence: AGG
ggggctttgtgacattgccc

SEQ ID NO: 13434 - DNA, 20 bp, Artificial Sequence
  Description of Artificial Sequence: Synthetic oligonucleotide
  Target: FXN; (-) strand; PAM type: NRG; PAM sequence: CAG
tggggctttgtgacattgcc

SEQ ID NO: 13435 - DNA, 20 bp, Artificial Sequence
  Description of Artificial Sequence: Synthetic oligonucleotide
  Target: FXN; (-) strand; PAM type: NRG; PAM sequence: GGG
ttatatttttagtagaggtg

SEQ ID NO: 13436 - DNA, 20 bp, Artificial Sequence
  Description of Artificial Sequence: Synthetic oligonucleotide
  Target: FXN; (-) strand; PAM type: NRG; PAM sequence: GGG
tttatatttttagtagaggt

SEQ ID NO: 13437 - DNA, 20 bp, Artificial Sequence
  Description of Artificial Sequence: Synthetic oligonucleotide
  Target: FXN; (-) strand; PAM type: NRG; PAM sequence: TGG
ttttatatttttagtagagg

SEQ ID NO: 13438 - DNA, 20 bp, Artificial Sequence
  Description of Artificial Sequence: Synthetic oligonucleotide
  Target: FXN; (-) strand; PAM type: NRG; PAM sequence: AGG
aatttttatatttttagtag

SEQ ID NO: 13439 - DNA, 20 bp, Artificial Sequence
  Description of Artificial Sequence: Synthetic oligonucleotide
  Target: FXN; (-) strand; PAM type: NRG; PAM sequence: GAG
taatttttatatttttagta

SEQ ID NO: 13440 - DNA, 20 bp, Artificial Sequence
  Description of Artificial Sequence: Synthetic oligonucleotide
  Target: FXN; (-) strand; PAM type: NRG; PAM sequence: TAG
gctaatttttatatttttag

SEQ ID NO: 13441 - DNA, 20 bp, Artificial Sequence
  Description of Artificial Sequence: Synthetic oligonucleotide
  Target: FXN; (-) strand; PAM type: NRG; PAM sequence: TAG
ctggctaatttttatatttt

SEQ ID NO: 13442 - DNA, 20 bp, Artificial Sequence
  Description of Artificial Sequence: Synthetic oligonucleotide
  Target: FXN; (-) strand; PAM type: NRG; PAM sequence: TGG
taggcgtgtgccaccacacc

SEQ ID NO: 13443 - DNA, 20 bp, Artificial Sequence
  Description of Artificial Sequence: Synthetic oligonucleotide
  Target: FXN; (-) strand; PAM type: NRG; PAM sequence: AGG
ttccaagtagttgggactat

SEQ ID NO: 13444 - DNA, 20 bp, Artificial Sequence
  Description of Artificial Sequence: Synthetic oligonucleotide
  Target: FXN; (-) strand; PAM type: NRG; PAM sequence: TAG
cttccaagtagttgggacta

SEQ ID NO: 13445 - DNA, 20 bp, Artificial Sequence
  Description of Artificial Sequence: Synthetic oligonucleotide
  Target: FXN; (-) strand; PAM type: NRG; PAM sequence: GGG
cctcagccttccaagtagtt

SEQ ID NO: 13446 - DNA, 20 bp, Artificial Sequence
  Description of Artificial Sequence: Synthetic oligonucleotide
  Target: FXN; (-) strand; PAM type: NRG; PAM sequence: TGG
acctcagccttccaagtagt

SEQ ID NO: 13447 - DNA, 20 bp, Artificial Sequence
  Description of Artificial Sequence: Synthetic oligonucleotide
  Target: FXN; (-) strand; PAM type: NRG; PAM sequence: TAG
ctcaacctcagccttccaag

SEQ ID NO: 13448 - DNA, 20 bp, Artificial Sequence
  Description of Artificial Sequence: Synthetic oligonucleotide
  Target: FXN; (-) strand; PAM type: NRG; PAM sequence: AAG
aggctcaacctcagccttcc

SEQ ID NO: 13449 - DNA, 20 bp, Artificial Sequence
  Description of Artificial Sequence: Synthetic oligonucleotide
  Target: FXN; (-) strand; PAM type: NRG; PAM sequence: CAG
ctcaggctgaggctcaacct

SEQ ID NO: 13450 - DNA, 20 bp, Artificial Sequence
  Description of Artificial Sequence: Synthetic oligonucleotide
  Target: FXN; (-) strand; PAM type: NRG; PAM sequence: AGG
cacctcctgggctcaggctg

SEQ ID NO: 13451 - DNA, 20 bp, Artificial Sequence
  Description of Artificial Sequence: Synthetic oligonucleotide
  Target: FXN; (-) strand; PAM type: NRG; PAM sequence: GAG
ccacctcctgggctcaggct

SEQ ID NO: 13452 - DNA, 20 bp, Artificial Sequence
  Description of Artificial Sequence: Synthetic oligonucleotide
  Target: FXN; (-) strand; PAM type: NRG; PAM sequence: AGG
aacctccacctcctgggctc

SEQ ID NO: 13453 - DNA, 20 bp, Artificial Sequence
  Description of Artificial Sequence: Synthetic oligonucleotide
  Target: FXN; (-) strand; PAM type: NRG; PAM sequence: CAG
caacctccacctcctgggct

SEQ ID NO: 13454 - DNA, 20 bp, Artificial Sequence
  Description of Artificial Sequence: Synthetic oligonucleotide
  Target: FXN; (-) strand; PAM type: NRG; PAM sequence: GGG
cactgcaacctccacctcct

SEQ ID NO: 13455 - DNA, 20 bp, Artificial Sequence
  Description of Artificial Sequence: Synthetic oligonucleotide
  Target: FXN; (-) strand; PAM type: NRG; PAM sequence: TGG
tcactgcaacctccacctcc

SEQ ID NO: 13456 - DNA, 20 bp, Artificial Sequence
  Description of Artificial Sequence: Synthetic oligonucleotide
  Target: FXN; (-) strand; PAM type: NRG; PAM sequence: TGG
ggagtgcagtggcgcgatct

SEQ ID NO: 13457 - DNA, 20 bp, Artificial Sequence
  Description of Artificial Sequence: Synthetic oligonucleotide
  Target: FXN; (-) strand; PAM type: NRG; PAM sequence: TGG
ttgcccaggctggagtgcag

SEQ ID NO: 13458 - DNA, 20 bp, Artificial Sequence
  Description of Artificial Sequence: Synthetic oligonucleotide
  Target: FXN; (-) strand; PAM type: NRG; PAM sequence: CAG
ctgttgcccaggctggagtg

SEQ ID NO: 13459 - DNA, 20 bp, Artificial Sequence
  Description of Artificial Sequence: Synthetic oligonucleotide
  Target: FXN; (-) strand; PAM type: NRG; PAM sequence: GAG
tggccctgttgcccaggctg

SEQ ID NO: 13460 - DNA, 20 bp, Artificial Sequence
  Description of Artificial Sequence: Synthetic oligonucleotide
  Target: FXN; (-) strand; PAM type: NRG; PAM sequence: TGG
tctggccctgttgcccaggc

SEQ ID NO: 13461 - DNA, 20 bp, Artificial Sequence
  Description of Artificial Sequence: Synthetic oligonucleotide
  Target: FXN; (-) strand; PAM type: NRG; PAM sequence: AGG
agggtctggccctgttgccc

SEQ ID NO: 13462 - DNA, 20 bp, Artificial Sequence
  Description of Artificial Sequence: Synthetic oligonucleotide
  Target: FXN; (-) strand; PAM type: NRG; PAM sequence: CAG
cagggtctggccctgttgcc

SEQ ID NO: 13463 - DNA, 20 bp, Artificial Sequence
  Description of Artificial Sequence: Synthetic oligonucleotide
  Target: FXN; (-) strand; PAM type: NRG; PAM sequence: TGG
tttttttttgggacagggtc

SEQ ID NO: 13464 - DNA, 20 bp, Artificial Sequence
  Description of Artificial Sequence: Synthetic oligonucleotide
  Target: FXN; (-) strand; PAM type: NRG; PAM sequence: GGG
ttttttttttttttgggaca

SEQ ID NO: 13465 - DNA, 20 bp, Artificial Sequence
  Description of Artificial Sequence: Synthetic oligonucleotide
  Target: FXN; (-) strand; PAM type: NRG; PAM sequence: AGG
tttttttttttttttgggac

SEQ ID NO: 13466 - DNA, 20 bp, Artificial Sequence
  Description of Artificial Sequence: Synthetic oligonucleotide
  Target: FXN; (-) strand; PAM type: NRG; PAM sequence: CAG
ctttttttttttttttggga

SEQ ID NO: 13467 - DNA, 20 bp, Artificial Sequence
  Description of Artificial Sequence: Synthetic oligonucleotide
  Target: FXN; (-) strand; PAM type: NRG; PAM sequence: GGG
atgacttttttttttttttt

SEQ ID NO: 13468 - DNA, 20 bp, Artificial Sequence
  Description of Artificial Sequence: Synthetic oligonucleotide
  Target: FXN; (-) strand; PAM type: NRG; PAM sequence: TGG
gatgactttttttttttttt

SEQ ID NO: 13469 - DNA, 20 bp, Artificial Sequence
  Description of Artificial Sequence: Synthetic oligonucleotide
  Target: FXN; (-) strand; PAM type: NRG; PAM sequence: AAG
acttacaaggatgctaacat

SEQ ID NO: 13470 - DNA, 20 bp, Artificial Sequence
  Description of Artificial Sequence: Synthetic oligonucleotide
  Target: FXN; (-) strand; PAM type: NRG; PAM sequence: AGG
tcaggaaaggctcacttaca

SEQ ID NO: 13471 - DNA, 20 bp, Artificial Sequence
  Description of Artificial Sequence: Synthetic oligonucleotide
  Target: FXN; (-) strand; PAM type: NRG; PAM sequence: AAG
atcaggaaaggctcacttac

SEQ ID NO: 13472 - DNA, 20 bp, Artificial Sequence
  Description of Artificial Sequence: Synthetic oligonucleotide
  Target: FXN; (-) strand; PAM type: NRG; PAM sequence: AGG
aggctgcaaaatatcaggaa

SEQ ID NO: 13473 - DNA, 20 bp, Artificial Sequence
  Description of Artificial Sequence: Synthetic oligonucleotide
  Target: FXN; (-) strand; PAM type: NRG; PAM sequence: AAG
caggctgcaaaatatcagga

SEQ ID NO: 13474 - DNA, 20 bp, Artificial Sequence
  Description of Artificial Sequence: Synthetic oligonucleotide
  Target: FXN; (-) strand; PAM type: NRG; PAM sequence: AGG
gagacaggctgcaaaatatc

SEQ ID NO: 13475 - DNA, 20 bp, Artificial Sequence
  Description of Artificial Sequence: Synthetic oligonucleotide
  Target: FXN; (-) strand; PAM type: NRG; PAM sequence: CAG
tgagacaggctgcaaaatat

SEQ ID NO: 13476 - DNA, 20 bp, Artificial Sequence
  Description of Artificial Sequence: Synthetic oligonucleotide
  Target: FXN; (-) strand; PAM type: NRG; PAM sequence: AGG
ttttctactgagaatgagac

SEQ ID NO: 13477 - DNA, 20 bp, Artificial Sequence
  Description of Artificial Sequence: Synthetic oligonucleotide
  Target: FXN; (-) strand; PAM type: NRG; PAM sequence: CAG
cttttctactgagaatgaga

SEQ ID NO: 13478 - DNA, 20 bp, Artificial Sequence
  Description of Artificial Sequence: Synthetic oligonucleotide
  Target: FXN; (-) strand; PAM type: NRG; PAM sequence: GAG
taaacttttctactgagaat

SEQ ID NO: 13479 - DNA, 20 bp, Artificial Sequence
  Description of Artificial Sequence: Synthetic oligonucleotide
  Target: FXN; (-) strand; PAM type: NRG; PAM sequence: GAG
ctagagtaaacttttctact

SEQ ID NO: 13480 - DNA, 20 bp, Artificial Sequence
  Description of Artificial Sequence: Synthetic oligonucleotide
  Target: FXN; (-) strand; PAM type: NRG; PAM sequence: GAG
agggagaagttatgtaacta

SEQ ID NO: 13481 - DNA, 20 bp, Artificial Sequence
  Description of Artificial Sequence: Synthetic oligonucleotide
  Target: FXN; (-) strand; PAM type: NRG; PAM sequence: TAG
gcagggagaagttatgtaac

SEQ ID NO: 13482 - DNA, 20 bp, Artificial Sequence
  Description of Artificial Sequence: Synthetic oligonucleotide
  Target: FXN; (-) strand; PAM type: NRG; PAM sequence: AAG
tccaaattgtcagcagggag

SEQ ID NO: 13483 - DNA, 20 bp, Artificial Sequence
  Description of Artificial Sequence: Synthetic oligonucleotide
  Target: FXN; (-) strand; PAM type: NRG; PAM sequence: GAG
gtatccaaattgtcagcagg

SEQ ID NO: 13484 - DNA, 20 bp, Artificial Sequence
  Description of Artificial Sequence: Synthetic oligonucleotide
  Target: FXN; (-) strand; PAM type: NRG; PAM sequence: GGG
cagtatccaaattgtcagca

SEQ ID NO: 13485 - DNA, 20 bp, Artificial Sequence
  Description of Artificial Sequence: Synthetic oligonucleotide
  Target: FXN; (-) strand; PAM type: NRG; PAM sequence: AGG
acagtatccaaattgtcagc

SEQ ID NO: 13486 - DNA, 20 bp, Artificial Sequence
  Description of Artificial Sequence: Synthetic oligonucleotide
  Target: FXN; (-) strand; PAM type: NRG; PAM sequence: CAG
tacagtatccaaattgtcag

SEQ ID NO: 13487 - DNA, 20 bp, Artificial Sequence
  Description of Artificial Sequence: Synthetic oligonucleotide
  Target: FXN; (-) strand; PAM type: NRG; PAM sequence: CAG
gcttacagtatccaaattgt

SEQ ID NO: 13488 - DNA, 20 bp, Artificial Sequence
  Description of Artificial Sequence: Synthetic oligonucleotide
  Target: FXN; (-) strand; PAM type: NRG; PAM sequence: CAG
aatatcctgatgcctgctta

SEQ ID NO: 13489 - DNA, 20 bp, Artificial Sequence
  Description of Artificial Sequence: Synthetic oligonucleotide
  Target: FXN; (-) strand; PAM type: NRG; PAM sequence: CAG
aagttataagctactcactt

SEQ ID NO: 13490 - DNA, 20 bp, Artificial Sequence
  Description of Artificial Sequence: Synthetic oligonucleotide
  Target: FXN; (-) strand; PAM type: NRG; PAM sequence: AAG
gctggatttggaaaagttat

SEQ ID NO: 13491 - DNA, 20 bp, Artificial Sequence
  Description of Artificial Sequence: Synthetic oligonucleotide
  Target: FXN; (-) strand; PAM type: NRG; PAM sequence: AAG
tgtctaggctggatttggaa

SEQ ID NO: 13492 - DNA, 20 bp, Artificial Sequence
  Description of Artificial Sequence: Synthetic oligonucleotide
  Target: FXN; (-) strand; PAM type: NRG; PAM sequence: TGG
aaaactgtctaggctggatt

SEQ ID NO: 13493 - DNA, 20 bp, Artificial Sequence
  Description of Artificial Sequence: Synthetic oligonucleotide
  Target: FXN; (-) strand; PAM type: NRG; PAM sequence: TGG
tagaggaaaactgtctaggc

SEQ ID NO: 13494 - DNA, 20 bp, Artificial Sequence
  Description of Artificial Sequence: Synthetic oligonucleotide
  Target: FXN; (-) strand; PAM type: NRG; PAM sequence: AGG
ttaatagaggaaaactgtct

SEQ ID NO: 13495 - DNA, 20 bp, Artificial Sequence
  Description of Artificial Sequence: Synthetic oligonucleotide
  Target: FXN; (-) strand; PAM type: NRG; PAM sequence: TAG
tttaatagaggaaaactgtc

SEQ ID NO: 13496 - DNA, 20 bp, Artificial Sequence
  Description of Artificial Sequence: Synthetic oligonucleotide
  Target: FXN; (-) strand; PAM type: NRG; PAM sequence: AGG
tcagggcaataatttaatag

SEQ ID NO: 13497 - DNA, 20 bp, Artificial Sequence
  Description of Artificial Sequence: Synthetic oligonucleotide
  Target: FXN; (-) strand; PAM type: NRG; PAM sequence: GAG
gtcagggcaataatttaata

SEQ ID NO: 13498 - DNA, 20 bp, Artificial Sequence
  Description of Artificial Sequence: Synthetic oligonucleotide
  Target: FXN; (-) strand; PAM type: NRG; PAM sequence: TAG
aagtcagggcaataatttaa

SEQ ID NO: 13499 - DNA, 20 bp, Artificial Sequence
  Description of Artificial Sequence: Synthetic oligonucleotide
  Target: FXN; (-) strand; PAM type: NRG; PAM sequence: GGG
agtagcttcttttaaagtca

SEQ ID NO: 13500 - DNA, 20 bp, Artificial Sequence
  Description of Artificial Sequence: Synthetic oligonucleotide
  Target: FXN; (-) strand; PAM type: NRG; PAM sequence: AGG
aagtagcttcttttaaagtc

SEQ ID NO: 13501 - DNA, 20 bp, Artificial Sequence
  Description of Artificial Sequence: Synthetic oligonucleotide
  Target: FXN; (-) strand; PAM type: NRG; PAM sequence: CAG
aaagtagcttcttttaaagt

SEQ ID NO: 13502 - DNA, 20 bp, Artificial Sequence
  Description of Artificial Sequence: Synthetic oligonucleotide
  Target: FXN; (-) strand; PAM type: NRG; PAM sequence: AAG
gtcaaaagtagcttctttta

SEQ ID NO: 13503 - DNA, 20 bp, Artificial Sequence
  Description of Artificial Sequence: Synthetic oligonucleotide
  Target: FXN; (-) strand; PAM type: NRG; PAM sequence: TAG
aaacgctacaaggtcaaaag

SEQ ID NO: 13504 - DNA, 20 bp, Artificial Sequence
  Description of Artificial Sequence: Synthetic oligonucleotide
  Target: FXN; (-) strand; PAM type: NRG; PAM sequence: AAG
ttcaaacgctacaaggtcaa

SEQ ID NO: 13505 - DNA, 20 bp, Artificial Sequence
  Description of Artificial Sequence: Synthetic oligonucleotide
  Target: FXN; (-) strand; PAM type: NRG; PAM sequence: AGG
caacttgttcaaacgctaca

SEQ ID NO: 13506 - DNA, 20 bp, Artificial Sequence
  Description of Artificial Sequence: Synthetic oligonucleotide
  Target: FXN; (-) strand; PAM type: NRG; PAM sequence: AAG
gcaacttgttcaaacgctac

SEQ ID NO: 13507 - DNA, 20 bp, Artificial Sequence
  Description of Artificial Sequence: Synthetic oligonucleotide
  Target: FXN; (-) strand; PAM type: NRG; PAM sequence: AAG
tttaacttgctttgaagaca

SEQ ID NO: 13508 - DNA, 20 bp, Artificial Sequence
  Description of Artificial Sequence: Synthetic oligonucleotide
  Target: FXN; (-) strand; PAM type: NRG; PAM sequence: AAG
tcaaactttaacttgctttg

SEQ ID NO: 13509 - DNA, 20 bp, Artificial Sequence
  Description of Artificial Sequence: Synthetic oligonucleotide
  Target: FXN; (-) strand; PAM type: NRG; PAM sequence: AGG
gagaggctcaaaacaagtag

SEQ ID NO: 13510 - DNA, 20 bp, Artificial Sequence
  Description of Artificial Sequence: Synthetic oligonucleotide
  Target: FXN; (-) strand; PAM type: NRG; PAM sequence: GAG
tgagaggctcaaaacaagta

SEQ ID NO: 13511 - DNA, 20 bp, Artificial Sequence
  Description of Artificial Sequence: Synthetic oligonucleotide
  Target: FXN; (-) strand; PAM type: NRG; PAM sequence: TAG
cctgagaggctcaaaacaag

SEQ ID NO: 13512 - DNA, 20 bp, Artificial Sequence
  Description of Artificial Sequence: Synthetic oligonucleotide
  Target: FXN; (-) strand; PAM type: NRG; PAM sequence: AAG
ttacctgagaggctcaaaac

SEQ ID NO: 13513 - DNA, 20 bp, Artificial Sequence
  Description of Artificial Sequence: Synthetic oligonucleotide
  Target: FXN; (-) strand; PAM type: NRG; PAM sequence: AGG
caaataaccctttacctgag

SEQ ID NO: 13514 - DNA, 20 bp, Artificial Sequence
  Description of Artificial Sequence: Synthetic oligonucleotide
  Target: FXN; (-) strand; PAM type: NRG; PAM sequence: GAG
tcaaataaccctttacctga

SEQ ID NO: 13515 - DNA, 20 bp, Artificial Sequence
  Description of Artificial Sequence: Synthetic oligonucleotide
  Target: FXN; (-) strand; PAM type: NRG; PAM sequence: GAG
attcaaataaccctttacct

SEQ ID NO: 13516 - DNA, 20 bp, Artificial Sequence
  Description of Artificial Sequence: Synthetic oligonucleotide
  Target: FXN; (-) strand; PAM type: NRG; PAM sequence: GGG
acacaaccccaacctgcaaa

SEQ ID NO: 13517 - DNA, 20 bp, Artificial Sequence
  Description of Artificial Sequence: Synthetic oligonucleotide
  Target: FXN; (-) strand; PAM type: NRG; PAM sequence: AGG
tacacaaccccaacctgcaa

SEQ ID NO: 13518 - DNA, 20 bp, Artificial Sequence
  Description of Artificial Sequence: Synthetic oligonucleotide
  Target: FXN; (-) strand; PAM type: NRG; PAM sequence: AAG
gtacacaaccccaacctgca

SEQ ID NO: 13519 - DNA, 20 bp, Artificial Sequence
  Description of Artificial Sequence: Synthetic oligonucleotide
  Target: FXN; (-) strand; PAM type: NRG; PAM sequence: GGG
aacactctaccacctccaca

SEQ ID NO: 13520 - DNA, 20 bp, Artificial Sequence
  Description of Artificial Sequence: Synthetic oligonucleotide
  Target: FXN; (-) strand; PAM type: NRG; PAM sequence: AGG
taacactctaccacctccac

SEQ ID NO: 13521 - DNA, 20 bp, Artificial Sequence
  Description of Artificial Sequence: Synthetic oligonucleotide
  Target: FXN; (-) strand; PAM type: NRG; PAM sequence: CAG
ataacactctaccacctcca

SEQ ID NO: 13522 - DNA, 20 bp, Artificial Sequence
  Description of Artificial Sequence: Synthetic oligonucleotide
  Target: FXN; (-) strand; PAM type: NRG; PAM sequence: CAG
agggattaaatgccctggag

SEQ ID NO: 13523 - DNA, 20 bp, Artificial Sequence
  Description of Artificial Sequence: Synthetic oligonucleotide
  Target: FXN; (-) strand; PAM type: NRG; PAM sequence: GAG
aggagggattaaatgccctg

SEQ ID NO: 13524 - DNA, 20 bp, Artificial Sequence
  Description of Artificial Sequence: Synthetic oligonucleotide
  Target: FXN; (-) strand; PAM type: NRG; PAM sequence: TGG
gcaggagggattaaatgccc

SEQ ID NO: 13525 - DNA, 20 bp, Artificial Sequence
  Description of Artificial Sequence: Synthetic oligonucleotide
  Target: FXN; (-) strand; PAM type: NRG; PAM sequence: GGG
catcaatggaaaaggcagga

SEQ ID NO: 13526 - DNA, 20 bp, Artificial Sequence
  Description of Artificial Sequence: Synthetic oligonucleotide
  Target: FXN; (-) strand; PAM type: NRG; PAM sequence: AGG
acatcaatggaaaaggcagg

SEQ ID NO: 13527 - DNA, 20 bp, Artificial Sequence
  Description of Artificial Sequence: Synthetic oligonucleotide
  Target: FXN; (-) strand; PAM type: NRG; PAM sequence: GAG
cacatcaatggaaaaggcag

SEQ ID NO: 13528 - DNA, 20 bp, Artificial Sequence
  Description of Artificial Sequence: Synthetic oligonucleotide
  Target: FXN; (-) strand; PAM type: NRG; PAM sequence: AGG
agcacatcaatggaaaaggc

SEQ ID NO: 13529 - DNA, 20 bp, Artificial Sequence
  Description of Artificial Sequence: Synthetic oligonucleotide
  Target: FXN; (-) strand; PAM type: NRG; PAM sequence: CAG
aagcacatcaatggaaaagg

SEQ ID NO: 13530 - DNA, 20 bp, Artificial Sequence
  Description of Artificial Sequence: Synthetic oligonucleotide
  Target: FXN; (-) strand; PAM type: NRG; PAM sequence: AGG
tgaaagcacatcaatggaaa

SEQ ID NO: 13531 - DNA, 20 bp, Artificial Sequence
  Description of Artificial Sequence: Synthetic oligonucleotide
  Target: FXN; (-) strand; PAM type: NRG; PAM sequence: AAG
ttgaaagcacatcaatggaa

SEQ ID NO: 13532 - DNA, 20 bp, Artificial Sequence
  Description of Artificial Sequence: Synthetic oligonucleotide
  Target: FXN; (-) strand; PAM type: NRG; PAM sequence: TGG
ctagattgaaagcacatcaa

SEQ ID NO: 13533 - DNA, 20 bp, Artificial Sequence
  Description of Artificial Sequence: Synthetic oligonucleotide
  Target: FXN; (-) strand; PAM type: NRG; PAM sequence: AAG
cttttattcctctagattga

SEQ ID NO: 13534 - DNA, 20 bp, Artificial Sequence
  Description of Artificial Sequence: Synthetic oligonucleotide
  Target: FXN; (-) strand; PAM type: NRG; PAM sequence: TAG
aacacaatcttttattcctc

SEQ ID NO: 13535 - DNA, 20 bp, Artificial Sequence
  Description of Artificial Sequence: Synthetic oligonucleotide
  Target: FXN; (-) strand; PAM type: NRG; PAM sequence: AGG
caggctttcagatgctatgc

SEQ ID NO: 13536 - DNA, 20 bp, Artificial Sequence
  Description of Artificial Sequence: Synthetic oligonucleotide
  Target: FXN; (-) strand; PAM type: NRG; PAM sequence: CAG
tcaggctttcagatgctatg

SEQ ID NO: 13537 - DNA, 20 bp, Artificial Sequence
  Description of Artificial Sequence: Synthetic oligonucleotide
  Target: FXN; (-) strand; PAM type: NRG; PAM sequence: CAG
cctgcatgttctcaggcttt

SEQ ID NO: 13538 - DNA, 20 bp, Artificial Sequence
  Description of Artificial Sequence: Synthetic oligonucleotide
  Target: FXN; (-) strand; PAM type: NRG; PAM sequence: AGG
gtctctccctgcatgttctc

SEQ ID NO: 13539 - DNA, 20 bp, Artificial Sequence
  Description of Artificial Sequence: Synthetic oligonucleotide
  Target: FXN; (-) strand; PAM type: NRG; PAM sequence: CAG
tgtctctccctgcatgttct

SEQ ID NO: 13540 - DNA, 20 bp, Artificial Sequence
  Description of Artificial Sequence: Synthetic oligonucleotide
  Target: FXN; (-) strand; PAM type: NRG; PAM sequence: GGG
gccaggctgctgagggatga

SEQ ID NO: 13541 - DNA, 20 bp, Artificial Sequence
  Description of Artificial Sequence: Synthetic oligonucleotide
  Target: FXN; (-) strand; PAM type: NRG; PAM sequence: AGG
agccaggctgctgagggatg

SEQ ID NO: 13542 - DNA, 20 bp, Artificial Sequence
  Description of Artificial Sequence: Synthetic oligonucleotide
  Target: FXN; (-) strand; PAM type: NRG; PAM sequence: GAG
cagccaggctgctgagggat

SEQ ID NO: 13543 - DNA, 20 bp, Artificial Sequence
  Description of Artificial Sequence: Synthetic oligonucleotide
  Target: FXN; (-) strand; PAM type: NRG; PAM sequence: GGG
aacagcagccaggctgctga

SEQ ID NO: 13544 - DNA, 20 bp, Artificial Sequence
  Description of Artificial Sequence: Synthetic oligonucleotide
  Target: FXN; (-) strand; PAM type: NRG; PAM sequence: AGG
caacagcagccaggctgctg

SEQ ID NO: 13545 - DNA, 20 bp, Artificial Sequence
  Description of Artificial Sequence: Synthetic oligonucleotide
  Target: FXN; (-) strand; PAM type: NRG; PAM sequence: GAG
tcaacagcagccaggctgct

SEQ ID NO: 13546 - DNA, 20 bp, Artificial Sequence
  Description of Artificial Sequence: Synthetic oligonucleotide
  Target: FXN; (-) strand; PAM type: NRG; PAM sequence: AGG
caaccacttcaacagcagcc

SEQ ID NO: 13547 - DNA, 20 bp, Artificial Sequence
  Description of Artificial Sequence: Synthetic oligonucleotide
  Target: FXN; (-) strand; PAM type: NRG; PAM sequence: CAG
acaaccacttcaacagcagc

SEQ ID NO: 13548 - DNA, 20 bp, Artificial Sequence
  Description of Artificial Sequence: Synthetic oligonucleotide
  Target: FXN; (-) strand; PAM type: NRG; PAM sequence: CAG
tcttacaaccacttcaacag

SEQ ID NO: 13549 - DNA, 20 bp, Artificial Sequence
  Description of Artificial Sequence: Synthetic oligonucleotide
  Target: FXN; (-) strand; PAM type: NRG; PAM sequence: CAG
ctttcttacaaccacttcaa

SEQ ID NO: 13550 - DNA, 20 bp, Artificial Sequence
  Description of Artificial Sequence: Synthetic oligonucleotide
  Target: FXN; (-) strand; PAM type: NRG; PAM sequence: GGG
tggatctgagaacgttttgt

SEQ ID NO: 13551 - DNA, 20 bp, Artificial Sequence
  Description of Artificial Sequence: Synthetic oligonucleotide
  Target: FXN; (-) strand; PAM type: NRG; PAM sequence: TGG
ctggatctgagaacgttttg

SEQ ID NO: 13552 - DNA, 20 bp, Artificial Sequence
  Description of Artificial Sequence: Synthetic oligonucleotide
  Target: FXN; (-) strand; PAM type: NRG; PAM sequence: GAG
gctaatgaatgactggatct

SEQ ID NO: 13553 - DNA, 20 bp, Artificial Sequence
  Description of Artificial Sequence: Synthetic oligonucleotide
  Target: FXN; (-) strand; PAM type: NRG; PAM sequence: TGG
tggaagtgctaatgaatgac

SEQ ID NO: 13554 - DNA, 20 bp, Artificial Sequence
  Description of Artificial Sequence: Synthetic oligonucleotide
  Target: FXN; (-) strand; PAM type: NRG; PAM sequence: AAG
agtcaacatgctctctttgg

SEQ ID NO: 13555 - DNA, 20 bp, Artificial Sequence
  Description of Artificial Sequence: Synthetic oligonucleotide
  Target: FXN; (-) strand; PAM type: NRG; PAM sequence: TGG
cacagtcaacatgctctctt

SEQ ID NO: 13556 - DNA, 20 bp, Artificial Sequence
  Description of Artificial Sequence: Synthetic oligonucleotide
  Target: FXN; (-) strand; PAM type: NRG; PAM sequence: CAG
tctggccctttcccaattca

SEQ ID NO: 13557 - DNA, 20 bp, Artificial Sequence
  Description of Artificial Sequence: Synthetic oligonucleotide
  Target: FXN; (-) strand; PAM type: NRG; PAM sequence: TGG
aattctatgctagttttatc

SEQ ID NO: 13558 - DNA, 20 bp, Artificial Sequence
  Description of Artificial Sequence: Synthetic oligonucleotide
  Target: FXN; (-) strand; PAM type: NRG; PAM sequence: TAG
tctttcaaagaattctatgc

SEQ ID NO: 13559 - DNA, 20 bp, Artificial Sequence
  Description of Artificial Sequence: Synthetic oligonucleotide
  Target: FXN; (-) strand; PAM type: NRG; PAM sequence: AAG
caaataccgttagtctttca

SEQ ID NO: 13560 - DNA, 20 bp, Artificial Sequence
  Description of Artificial Sequence: Synthetic oligonucleotide
  Target: FXN; (-) strand; PAM type: NRG; PAM sequence: TAG
ttaaaaaatgcaaataccgt

SEQ ID NO: 13561 - DNA, 20 bp, Artificial Sequence
  Description of Artificial Sequence: Synthetic oligonucleotide
  Target: FXN; (-) strand; PAM type: NRG; PAM sequence: AGG
caatgttagggggtagagta

SEQ ID NO: 13562 - DNA, 20 bp, Artificial Sequence
  Description of Artificial Sequence: Synthetic oligonucleotide
  Target: FXN; (-) strand; PAM type: NRG; PAM sequence: AAG
tcaatgttagggggtagagt

SEQ ID NO: 13563 - DNA, 20 bp, Artificial Sequence
  Description of Artificial Sequence: Synthetic oligonucleotide
  Target: FXN; (-) strand; PAM type: NRG; PAM sequence: GAG
gatgtcaatgttagggggta

SEQ ID NO: 13564 - DNA, 20 bp, Artificial Sequence
  Description of Artificial Sequence: Synthetic oligonucleotide
  Target: FXN; (-) strand; PAM type: NRG; PAM sequence: TAG
atgatgtcaatgttaggggg

SEQ ID NO: 13565 - DNA, 20 bp, Artificial Sequence
  Description of Artificial Sequence: Synthetic oligonucleotide
  Target: FXN; (-) strand; PAM type: NRG; PAM sequence: GGG
aaaatgatgtcaatgttagg

SEQ ID NO: 13566 - DNA, 20 bp, Artificial Sequence
  Description of Artificial Sequence: Synthetic oligonucleotide
  Target: FXN; (-) strand; PAM type: NRG; PAM sequence: GGG
aaaaatgatgtcaatgttag

SEQ ID NO: 13567 - DNA, 20 bp, Artificial Sequence
  Description of Artificial Sequence: Synthetic oligonucleotide
  Target: FXN; (-) strand; PAM type: NRG; PAM sequence: GGG
taaaaatgatgtcaatgtta

SEQ ID NO: 13568 - DNA, 20 bp, Artificial Sequence
  Description of Artificial Sequence: Synthetic oligonucleotide
  Target: FXN; (-) strand; PAM type: NRG; PAM sequence: AGG
ctaaaaatgatgtcaatgtt

SEQ ID NO: 13569 - DNA, 20 bp, Artificial Sequence
  Description of Artificial Sequence: Synthetic oligonucleotide
  Target: FXN; (-) strand; PAM type: NRG; PAM sequence: TAG
cctaaaaatgatgtcaatgt

SEQ ID NO: 13570 - DNA, 20 bp, Artificial Sequence
  Description of Artificial Sequence: Synthetic oligonucleotide
  Target: FXN; (-) strand; PAM type: NRG; PAM sequence: GGG
gagatcacagaataataaat

SEQ ID NO: 13571 - DNA, 20 bp, Artificial Sequence
  Description of Artificial Sequence: Synthetic oligonucleotide
  Target: FXN; (-) strand; PAM type: NRG; PAM sequence: TGG
agagatcacagaataataaa

SEQ ID NO: 13572 - DNA, 20 bp, Artificial Sequence
  Description of Artificial Sequence: Synthetic oligonucleotide
  Target: FXN; (-) strand; PAM type: NRG; PAM sequence: CAG
gaacaaagcattagagatca

SEQ ID NO: 13573 - DNA, 20 bp, Artificial Sequence
  Description of Artificial Sequence: Synthetic oligonucleotide
  Target: FXN; (-) strand; PAM type: NRG; PAM sequence: GAG
ttattctgaacaaagcatta

SEQ ID NO: 13574 - DNA, 20 bp, Artificial Sequence
  Description of Artificial Sequence: Synthetic oligonucleotide
  Target: FXN; (-) strand; PAM type: NRG; PAM sequence: TAG
atttattctgaacaaagcat

SEQ ID NO: 13575 - DNA, 20 bp, Artificial Sequence
  Description of Artificial Sequence: Synthetic oligonucleotide
  Target: FXN; (-) strand; PAM type: NRG; PAM sequence: AAG
cacactatttattctgaaca

SEQ ID NO: 13576 - DNA, 20 bp, Artificial Sequence
  Description of Artificial Sequence: Synthetic oligonucleotide
  Target: FXN; (-) strand; PAM type: NRG; PAM sequence: AGG
ttggatgaaagtgtggggaa

SEQ ID NO: 13577 - DNA, 20 bp, Artificial Sequence
  Description of Artificial Sequence: Synthetic oligonucleotide
  Target: FXN; (-) strand; PAM type: NRG; PAM sequence: AAG
cttggatgaaagtgtgggga

SEQ ID NO: 13578 - DNA, 20 bp, Artificial Sequence
  Description of Artificial Sequence: Synthetic oligonucleotide
  Target: FXN; (-) strand; PAM type: NRG; PAM sequence: GGG
acttcttggatgaaagtgtg

SEQ ID NO: 13579 - DNA, 20 bp, Artificial Sequence
  Description of Artificial Sequence: Synthetic oligonucleotide
  Target: FXN; (-) strand; PAM type: NRG; PAM sequence: GGG
cacttcttggatgaaagtgt

SEQ ID NO: 13580 - DNA, 20 bp, Artificial Sequence
  Description of Artificial Sequence: Synthetic oligonucleotide
  Target: FXN; (-) strand; PAM type: NRG; PAM sequence: TGG
acacttcttggatgaaagtg

SEQ ID NO: 13581 - DNA, 20 bp, Artificial Sequence
  Description of Artificial Sequence: Synthetic oligonucleotide
  Target: FXN; (-) strand; PAM type: NRG; PAM sequence: AAG
ctagcacacttcttggatga

SEQ ID NO: 13582 - DNA, 20 bp, Artificial Sequence
  Description of Artificial Sequence: Synthetic oligonucleotide
  Target: FXN; (-) strand; PAM type: NRG; PAM sequence: TGG
ttgaactctagcacacttct

SEQ ID NO: 13583 - DNA, 20 bp, Artificial Sequence
  Description of Artificial Sequence: Synthetic oligonucleotide
  Target: FXN; (-) strand; PAM type: NRG; PAM sequence: TAG
gtgctgtttttgttgaactc

SEQ ID NO: 13584 - DNA, 20 bp, Artificial Sequence
  Description of Artificial Sequence: Synthetic oligonucleotide
  Target: FXN; (-) strand; PAM type: NRG; PAM sequence: TAG
cctagaatgacagtgatttc

SEQ ID NO: 13585 - DNA, 20 bp, Artificial Sequence
  Description of Artificial Sequence: Synthetic oligonucleotide
  Target: FXN; (-) strand; PAM type: NRG; PAM sequence: CAG
ttagggccttcctagaatga

SEQ ID NO: 13586 - DNA, 20 bp, Artificial Sequence
  Description of Artificial Sequence: Synthetic oligonucleotide
  Target: FXN; (-) strand; PAM type: NRG; PAM sequence: TAG
tctgtgaattagggccttcc

SEQ ID NO: 13587 - DNA, 20 bp, Artificial Sequence
  Description of Artificial Sequence: Synthetic oligonucleotide
  Target: FXN; (-) strand; PAM type: NRG; PAM sequence: GGG
ccaatacaatctgtgaatta

SEQ ID NO: 13588 - DNA, 20 bp, Artificial Sequence
  Description of Artificial Sequence: Synthetic oligonucleotide
  Target: FXN; (-) strand; PAM type: NRG; PAM sequence: AGG
accaatacaatctgtgaatt

SEQ ID NO: 13589 - DNA, 20 bp, Artificial Sequence
  Description of Artificial Sequence: Synthetic oligonucleotide
  Target: FXN; (-) strand; PAM type: NRG; PAM sequence: TAG
aaccaatacaatctgtgaat

SEQ ID NO: 13590 - DNA, 20 bp, Artificial Sequence
  Description of Artificial Sequence: Synthetic oligonucleotide
  Target: FXN; (-) strand; PAM type: NRG; PAM sequence: GGG
caacctccagcacactaact

SEQ ID NO: 13591 - DNA, 20 bp, Artificial Sequence
  Description of Artificial Sequence: Synthetic oligonucleotide
  Target: FXN; (-) strand; PAM type: NRG; PAM sequence: TGG
ccaacctccagcacactaac

SEQ ID NO: 13592 - DNA, 20 bp, Artificial Sequence
  Description of Artificial Sequence: Synthetic oligonucleotide
  Target: FXN; (-) strand; PAM type: NRG; PAM sequence: CAG
ggttaaaatcctccaacctc

SEQ ID NO: 13593 - DNA, 20 bp, Artificial Sequence
  Description of Artificial Sequence: Synthetic oligonucleotide
  Target: FXN; (-) strand; PAM type: NRG; PAM sequence: AGG
agaggctagttggcccacag

SEQ ID NO: 13594 - DNA, 20 bp, Artificial Sequence
  Description of Artificial Sequence: Synthetic oligonucleotide
  Target: FXN; (-) strand; PAM type: NRG; PAM sequence: GAG
cagaggctagttggcccaca

SEQ ID NO: 13595 - DNA, 20 bp, Artificial Sequence
  Description of Artificial Sequence: Synthetic oligonucleotide
  Target: FXN; (-) strand; PAM type: NRG; PAM sequence: CAG
cacagaggctagttggccca

SEQ ID NO: 13596 - DNA, 20 bp, Artificial Sequence
  Description of Artificial Sequence: Synthetic oligonucleotide
  Target: FXN; (-) strand; PAM type: NRG; PAM sequence: TGG
ctgaggccacagaggctagt

SEQ ID NO: 13597 - DNA, 20 bp, Artificial Sequence
  Description of Artificial Sequence: Synthetic oligonucleotide
  Target: FXN; (-) strand; PAM type: NRG; PAM sequence: TAG
atgactgaggccacagaggc

SEQ ID NO: 13598 - DNA, 20 bp, Artificial Sequence
  Description of Artificial Sequence: Synthetic oligonucleotide
  Target: FXN; (-) strand; PAM type: NRG; PAM sequence: AGG
aagaatgactgaggccacag

SEQ ID NO: 13599 - DNA, 20 bp, Artificial Sequence
  Description of Artificial Sequence: Synthetic oligonucleotide
  Target: FXN; (-) strand; PAM type: NRG; PAM sequence: GAG
gaagaatgactgaggccaca

SEQ ID NO: 13600 - DNA, 20 bp, Artificial Sequence
  Description of Artificial Sequence: Synthetic oligonucleotide
  Target: FXN; (-) strand; PAM type: NRG; PAM sequence: CAG
aggaagaatgactgaggcca

SEQ ID NO: 13601 - DNA, 20 bp, Artificial Sequence
  Description of Artificial Sequence: Synthetic oligonucleotide
  Target: FXN; (-) strand; PAM type: NRG; PAM sequence: AGG
agggtcaggaagaatgactg

SEQ ID NO: 13602 - DNA, 20 bp, Artificial Sequence
  Description of Artificial Sequence: Synthetic oligonucleotide
  Target: FXN; (-) strand; PAM type: NRG; PAM sequence: GAG
cagggtcaggaagaatgact

SEQ ID NO: 13603 - DNA, 20 bp, Artificial Sequence
  Description of Artificial Sequence: Synthetic oligonucleotide
  Target: FXN; (-) strand; PAM type: NRG; PAM sequence: AAG
caagcacagccagggtcagg

SEQ ID NO: 13604 - DNA, 20 bp, Artificial Sequence
  Description of Artificial Sequence: Synthetic oligonucleotide
  Target: FXN; (-) strand; PAM type: NRG; PAM sequence: AGG
gctcaagcacagccagggtc

SEQ ID NO: 13605 - DNA, 20 bp, Artificial Sequence
  Description of Artificial Sequence: Synthetic oligonucleotide
  Target: FXN; (-) strand; PAM type: NRG; PAM sequence: CAG
ggctcaagcacagccagggt

SEQ ID NO: 13606 - DNA, 20 bp, Artificial Sequence
  Description of Artificial Sequence: Synthetic oligonucleotide
  Target: FXN; (-) strand; PAM type: NRG; PAM sequence: GGG
cacaggctcaagcacagcca

SEQ ID NO: 13607 - DNA, 20 bp, Artificial Sequence
  Description of Artificial Sequence: Synthetic oligonucleotide
  Target: FXN; (-) strand; PAM type: NRG; PAM sequence: AGG
acacaggctcaagcacagcc

SEQ ID NO: 13608 - DNA, 20 bp, Artificial Sequence
  Description of Artificial Sequence: Synthetic oligonucleotide
  Target: FXN; (-) strand; PAM type: NRG; PAM sequence: CAG
cacacaggctcaagcacagc

SEQ ID NO: 13609 - DNA, 20 bp, Artificial Sequence
  Description of Artificial Sequence: Synthetic oligonucleotide
  Target: FXN; (-) strand; PAM type: NRG; PAM sequence: CAG
agaacacacaggctcaagca

SEQ ID NO: 13610 - DNA, 20 bp, Artificial Sequence
  Description of Artificial Sequence: Synthetic oligonucleotide
  Target: FXN; (-) strand; PAM type: NRG; PAM sequence: AAG
ggataagaacacacaggctc

SEQ ID NO: 13611 - DNA, 20 bp, Artificial Sequence
  Description of Artificial Sequence: Synthetic oligonucleotide
  Target: FXN; (-) strand; PAM type: NRG; PAM sequence: AGG
gatgaaggataagaacacac

SEQ ID NO: 13612 - DNA, 20 bp, Artificial Sequence
  Description of Artificial Sequence: Synthetic oligonucleotide
  Target: FXN; (-) strand; PAM type: NRG; PAM sequence: CAG
agatgaaggataagaacaca

SEQ ID NO: 13613 - DNA, 20 bp, Artificial Sequence
  Description of Artificial Sequence: Synthetic oligonucleotide
  Target: FXN; (-) strand; PAM type: NRG; PAM sequence: AAG
ttcccccggagatgaaggat

SEQ ID NO: 13614 - DNA, 20 bp, Artificial Sequence
  Description of Artificial Sequence: Synthetic oligonucleotide
  Target: FXN; (-) strand; PAM type: NRG; PAM sequence: AGG
cttcgttcccccggagatga

SEQ ID NO: 13615 - DNA, 20 bp, Artificial Sequence
  Description of Artificial Sequence: Synthetic oligonucleotide
  Target: FXN; (-) strand; PAM type: NRG; PAM sequence: AAG
acttcgttcccccggagatg

SEQ ID NO: 13616 - DNA, 20 bp, Artificial Sequence
  Description of Artificial Sequence: Synthetic oligonucleotide
  Target: FXN; (-) strand; PAM type: NRG; PAM sequence: GAG
tgatccacttcgttcccccg

SEQ ID NO: 13617 - DNA, 20 bp, Artificial Sequence
  Description of Artificial Sequence: Synthetic oligonucleotide
  Target: FXN; (-) strand; PAM type: NRG; PAM sequence: CGG
gctgatccacttcgttcccc

SEQ ID NO: 13618 - DNA, 20 bp, Artificial Sequence
  Description of Artificial Sequence: Synthetic oligonucleotide
  Target: FXN; (-) strand; PAM type: NRG; PAM sequence: GAG
ccaaaagtgatcgctggacc

SEQ ID NO: 13619 - DNA, 20 bp, Artificial Sequence
  Description of Artificial Sequence: Synthetic oligonucleotide
  Target: FXN; (-) strand; PAM type: NRG; PAM sequence: TGG
tgatccccaaaagtgatcgc

SEQ ID NO: 13620 - DNA, 20 bp, Artificial Sequence
  Description of Artificial Sequence: Synthetic oligonucleotide
  Target: FXN; (-) strand; PAM type: NRG; PAM sequence: AAG
acaaagccactgatccccaa

SEQ ID NO: 13621 - DNA, 20 bp, Artificial Sequence
  Description of Artificial Sequence: Synthetic oligonucleotide
  Target: FXN; (-) strand; PAM type: NRG; PAM sequence: AAG
gtgcctgcccgatatctaca

SEQ ID NO: 13622 - DNA, 20 bp, Artificial Sequence
  Description of Artificial Sequence: Synthetic oligonucleotide
  Target: FXN; (-) strand; PAM type: NRG; PAM sequence: AAG
ggggaaagttcttttggggt

SEQ ID NO: 13623 - DNA, 20 bp, Artificial Sequence
  Description of Artificial Sequence: Synthetic oligonucleotide
  Target: FXN; (-) strand; PAM type: NRG; PAM sequence: GGG
atatggggaaagttcttttg

SEQ ID NO: 13624 - DNA, 20 bp, Artificial Sequence
  Description of Artificial Sequence: Synthetic oligonucleotide
  Target: FXN; (-) strand; PAM type: NRG; PAM sequence: GGG
gatatggggaaagttctttt

SEQ ID NO: 13625 - DNA, 20 bp, Artificial Sequence
  Description of Artificial Sequence: Synthetic oligonucleotide
  Target: FXN; (-) strand; PAM type: NRG; PAM sequence: TGG
agatatggggaaagttcttt

SEQ ID NO: 13626 - DNA, 20 bp, Artificial Sequence
  Description of Artificial Sequence: Synthetic oligonucleotide
  Target: FXN; (-) strand; PAM type: NRG; PAM sequence: AAG
tcagtcttcagatatgggga

SEQ ID NO: 13627 - DNA, 20 bp, Artificial Sequence
  Description of Artificial Sequence: Synthetic oligonucleotide
  Target: FXN; (-) strand; PAM type: NRG; PAM sequence: GGG
gttttcagtcttcagatatg

SEQ ID NO: 13628 - DNA, 20 bp, Artificial Sequence
  Description of Artificial Sequence: Synthetic oligonucleotide
  Target: FXN; (-) strand; PAM type: NRG; PAM sequence: GGG
cgttttcagtcttcagatat

SEQ ID NO: 13629 - DNA, 20 bp, Artificial Sequence
  Description of Artificial Sequence: Synthetic oligonucleotide
  Target: FXN; (-) strand; PAM type: NRG; PAM sequence: TGG
acgttttcagtcttcagata

SEQ ID NO: 13630 - DNA, 20 bp, Artificial Sequence
  Description of Artificial Sequence: Synthetic oligonucleotide
  Target: FXN; (-) strand; PAM type: NRG; PAM sequence: CAG
atatggacgttttcagtctt

SEQ ID NO: 13631 - DNA, 20 bp, Artificial Sequence
  Description of Artificial Sequence: Synthetic oligonucleotide
  Target: FXN; (-) strand; PAM type: NRG; PAM sequence: CAG
aaatacgatatggacgtttt

SEQ ID NO: 13632 - DNA, 20 bp, Artificial Sequence
  Description of Artificial Sequence: Synthetic oligonucleotide
  Target: FXN; (-) strand; PAM type: NRG; PAM sequence: TGG
cagtgtgtccaaatacgata

SEQ ID NO: 13633 - DNA, 20 bp, Artificial Sequence
  Description of Artificial Sequence: Synthetic oligonucleotide
  Target: FXN; (-) strand; PAM type: NRG; PAM sequence: CAG
agctagagcgtattgctggg

SEQ ID NO: 13634 - DNA, 20 bp, Artificial Sequence
  Description of Artificial Sequence: Synthetic oligonucleotide
  Target: FXN; (-) strand; PAM type: NRG; PAM sequence: GGG
cacagctagagcgtattgct

SEQ ID NO: 13635 - DNA, 20 bp, Artificial Sequence
  Description of Artificial Sequence: Synthetic oligonucleotide
  Target: FXN; (-) strand; PAM type: NRG; PAM sequence: TGG
acacagctagagcgtattgc

SEQ ID NO: 13636 - DNA, 20 bp, Artificial Sequence
  Description of Artificial Sequence: Synthetic oligonucleotide
  Target: FXN; (-) strand; PAM type: NRG; PAM sequence: GAG
catgcttctgaacacagcta

SEQ ID NO: 13637 - DNA, 20 bp, Artificial Sequence
  Description of Artificial Sequence: Synthetic oligonucleotide
  Target: FXN; (-) strand; PAM type: NRG; PAM sequence: TAG
cccatgcttctgaacacagc

SEQ ID NO: 13638 - DNA, 20 bp, Artificial Sequence
  Description of Artificial Sequence: Synthetic oligonucleotide
  Target: FXN; (-) strand; PAM type: NRG; PAM sequence: CAG
aattcccatgcttctgaaca

SEQ ID NO: 13639 - DNA, 20 bp, Artificial Sequence
  Description of Artificial Sequence: Synthetic oligonucleotide
  Target: FXN; (-) strand; PAM type: NRG; PAM sequence: CAG
acagtaaacggcatgctcag

SEQ ID NO: 13640 - DNA, 20 bp, Artificial Sequence
  Description of Artificial Sequence: Synthetic oligonucleotide
  Target: FXN; (-) strand; PAM type: NRG; PAM sequence: CAG
gtgacagtaaacggcatgct

SEQ ID NO: 13641 - DNA, 20 bp, Artificial Sequence
  Description of Artificial Sequence: Synthetic oligonucleotide
  Target: FXN; (-) strand; PAM type: NRG; PAM sequence: CGG
atagtatctgtgacagtaaa

SEQ ID NO: 13642 - DNA, 20 bp, Artificial Sequence
  Description of Artificial Sequence: Synthetic oligonucleotide
  Target: FXN; (-) strand; PAM type: NRG; PAM sequence: CAG
gaggaagatagtatctgtga

SEQ ID NO: 13643 - DNA, 20 bp, Artificial Sequence
  Description of Artificial Sequence: Synthetic oligonucleotide
  Target: FXN; (-) strand; PAM type: NRG; PAM sequence: TAG
ttttttttttttgaggaaga

SEQ ID NO: 13644 - DNA, 20 bp, Artificial Sequence
  Description of Artificial Sequence: Synthetic oligonucleotide
  Target: FXN; (-) strand; PAM type: NRG; PAM sequence: AAG
tatattttttttttttgagg

SEQ ID NO: 13645 - DNA, 20 bp, Artificial Sequence
  Description of Artificial Sequence: Synthetic oligonucleotide
  Target: FXN; (-) strand; PAM type: NRG; PAM sequence: AGG
atatatattttttttttttg

SEQ ID NO: 13646 - DNA, 20 bp, Artificial Sequence
  Description of Artificial Sequence: Synthetic oligonucleotide
  Target: FXN; (-) strand; PAM type: NRG; PAM sequence: GAG
tatatatatttttttttttt

SEQ ID NO: 13647 - DNA, 20 bp, Artificial Sequence
  Description of Artificial Sequence: Synthetic oligonucleotide
  Target: FXN; (-) strand; PAM type: NRG; PAM sequence: CAG
ggcacctcttcagtctcacc

SEQ ID NO: 13648 - DNA, 20 bp, Artificial Sequence
  Description of Artificial Sequence: Synthetic oligonucleotide
  Target: FXN; (-) strand; PAM type: NRG; PAM sequence: CAG
ctctggccaaggcacctctt

SEQ ID NO: 13649 - DNA, 20 bp, Artificial Sequence
  Description of Artificial Sequence: Synthetic oligonucleotide
  Target: FXN; (-) strand; PAM type: NRG; PAM sequence: AGG
ggtgtggcctgctctggcca

SEQ ID NO: 13650 - DNA, 20 bp, Artificial Sequence
  Description of Artificial Sequence: Synthetic oligonucleotide
  Target: FXN; (-) strand; PAM type: NRG; PAM sequence: AAG
gggtgtggcctgctctggcc

SEQ ID NO: 13651 - DNA, 20 bp, Artificial Sequence
  Description of Artificial Sequence: Synthetic oligonucleotide
  Target: FXN; (-) strand; PAM type: NRG; PAM sequence: TGG
tctctgggtgtggcctgctc

SEQ ID NO: 13652 - DNA, 20 bp, Artificial Sequence
  Description of Artificial Sequence: Synthetic oligonucleotide
  Target: FXN; (-) strand; PAM type: NRG; PAM sequence: TGG
gagcctgtggtctctgggtg

SEQ ID NO: 13653 - DNA, 20 bp, Artificial Sequence
  Description of Artificial Sequence: Synthetic oligonucleotide
  Target: FXN; (-) strand; PAM type: NRG; PAM sequence: GGG
ccggggagcctgtggtctct

SEQ ID NO: 13654 - DNA, 20 bp, Artificial Sequence
  Description of Artificial Sequence: Synthetic oligonucleotide
  Target: FXN; (-) strand; PAM type: NRG; PAM sequence: TGG
accggggagcctgtggtctc

SEQ ID NO: 13655 - DNA, 20 bp, Artificial Sequence
  Description of Artificial Sequence: Synthetic oligonucleotide
  Target: FXN; (-) strand; PAM type: NRG; PAM sequence: TGG
gaggtggaccggggagcctg

SEQ ID NO: 13656 - DNA, 20 bp, Artificial Sequence
  Description of Artificial Sequence: Synthetic oligonucleotide
  Target: FXN; (-) strand; PAM type: NRG; PAM sequence: GAG
ggggcctgaggtggaccggg

SEQ ID NO: 13657 - DNA, 20 bp, Artificial Sequence
  Description of Artificial Sequence: Synthetic oligonucleotide
  Target: FXN; (-) strand; PAM type: NRG; PAM sequence: GGG
gaggggcctgaggtggaccg

SEQ ID NO: 13658 - DNA, 20 bp, Artificial Sequence
  Description of Artificial Sequence: Synthetic oligonucleotide
  Target: FXN; (-) strand; PAM type: NRG; PAM sequence: GGG
ggaggggcctgaggtggacc

SEQ ID NO: 13659 - DNA, 20 bp, Artificial Sequence
  Description of Artificial Sequence: Synthetic oligonucleotide
  Target: FXN; (-) strand; PAM type: NRG; PAM sequence: CGG
gggaggggcctgaggtggac

SEQ ID NO: 13660 - DNA, 20 bp, Artificial Sequence
  Description of Artificial Sequence: Synthetic oligonucleotide
  Target: FXN; (-) strand; PAM type: NRG; PAM sequence: TGG
ggaaggggaggggcctgagg

SEQ ID NO: 13661 - DNA, 20 bp, Artificial Sequence
  Description of Artificial Sequence: Synthetic oligonucleotide
  Target: FXN; (-) strand; PAM type: NRG; PAM sequence: AGG
gcaggaaggggaggggcctg

SEQ ID NO: 13662 - DNA, 20 bp, Artificial Sequence
  Description of Artificial Sequence: Synthetic oligonucleotide
  Target: FXN; (-) strand; PAM type: NRG; PAM sequence: GAG
cgcaggaaggggaggggcct

SEQ ID NO: 13663 - DNA, 20 bp, Artificial Sequence
  Description of Artificial Sequence: Synthetic oligonucleotide
  Target: FXN; (-) strand; PAM type: NRG; PAM sequence: GGG
aaacggcgcaggaaggggag

SEQ ID NO: 13664 - DNA, 20 bp, Artificial Sequence
  Description of Artificial Sequence: Synthetic oligonucleotide
  Target: FXN; (-) strand; PAM type: NRG; PAM sequence: GGG
gaaacggcgcaggaagggga

SEQ ID NO: 13665 - DNA, 20 bp, Artificial Sequence
  Description of Artificial Sequence: Synthetic oligonucleotide
  Target: FXN; (-) strand; PAM type: NRG; PAM sequence: AGG
ggaaacggcgcaggaagggg

SEQ ID NO: 13666 - DNA, 20 bp, Artificial Sequence
  Description of Artificial Sequence: Synthetic oligonucleotide
  Target: FXN; (-) strand; PAM type: NRG; PAM sequence: GAG
cggaaacggcgcaggaaggg

SEQ ID NO: 13667 - DNA, 20 bp, Artificial Sequence
  Description of Artificial Sequence: Synthetic oligonucleotide
  Target: FXN; (-) strand; PAM type: NRG; PAM sequence: GGG
gccggaaacggcgcaggaag

SEQ ID NO: 13668 - DNA, 20 bp, Artificial Sequence
  Description of Artificial Sequence: Synthetic oligonucleotide
  Target: FXN; (-) strand; PAM type: NRG; PAM sequence: GGG
tgccggaaacggcgcaggaa

SEQ ID NO: 13669 - DNA, 20 bp, Artificial Sequence
  Description of Artificial Sequence: Synthetic oligonucleotide
  Target: FXN; (-) strand; PAM type: NRG; PAM sequence: AGG
ctgccggaaacggcgcagga

SEQ ID NO: 13670 - DNA, 20 bp, Artificial Sequence
  Description of Artificial Sequence: Synthetic oligonucleotide
  Target: FXN; (-) strand; PAM type: NRG; PAM sequence: AAG
tctgccggaaacggcgcagg

SEQ ID NO: 13671 - DNA, 20 bp, Artificial Sequence
  Description of Artificial Sequence: Synthetic oligonucleotide
  Target: FXN; (-) strand; PAM type: NRG; PAM sequence: AGG
ggatctgccggaaacggcgc

SEQ ID NO: 13672 - DNA, 20 bp, Artificial Sequence
  Description of Artificial Sequence: Synthetic oligonucleotide
  Target: FXN; (-) strand; PAM type: NRG; PAM sequence: CAG
tggatctgccggaaacggcg

SEQ ID NO: 13673 - DNA, 20 bp, Artificial Sequence
  Description of Artificial Sequence: Synthetic oligonucleotide
  Target: FXN; (-) strand; PAM type: NRG; PAM sequence: CGG
cactctggatctgccggaaa

SEQ ID NO: 13674 - DNA, 20 bp, Artificial Sequence
  Description of Artificial Sequence: Synthetic oligonucleotide
  Target: FXN; (-) strand; PAM type: NRG; PAM sequence: CGG
ggtggccactctggatctgc

SEQ ID NO: 13675 - DNA, 20 bp, Artificial Sequence
  Description of Artificial Sequence: Synthetic oligonucleotide
  Target: FXN; (-) strand; PAM type: NRG; PAM sequence: TGG
ccatccggcggtggccactc

SEQ ID NO: 13676 - DNA, 20 bp, Artificial Sequence
  Description of Artificial Sequence: Synthetic oligonucleotide
  Target: FXN; (-) strand; PAM type: NRG; PAM sequence: TGG
ccccgactcccatccggcgg

SEQ ID NO: 13677 - DNA, 20 bp, Artificial Sequence
  Description of Artificial Sequence: Synthetic oligonucleotide
  Target: FXN; (-) strand; PAM type: NRG; PAM sequence: CGG
ttcccccgactcccatccgg

SEQ ID NO: 13678 - DNA, 20 bp, Artificial Sequence
  Description of Artificial Sequence: Synthetic oligonucleotide
  Target: FXN; (-) strand; PAM type: NRG; PAM sequence: CGG
cccttcccccgactcccatc

SEQ ID NO: 13679 - DNA, 20 bp, Artificial Sequence
  Description of Artificial Sequence: Synthetic oligonucleotide
  Target: FXN; (-) strand; PAM type: NRG; PAM sequence: GGG
gcactgagagcttgtcctca

SEQ ID NO: 13680 - DNA, 20 bp, Artificial Sequence
  Description of Artificial Sequence: Synthetic oligonucleotide
  Target: FXN; (-) strand; PAM type: NRG; PAM sequence: AGG
agcactgagagcttgtcctc

SEQ ID NO: 13681 - DNA, 20 bp, Artificial Sequence
  Description of Artificial Sequence: Synthetic oligonucleotide
  Target: FXN; (-) strand; PAM type: NRG; PAM sequence: CAG
aagcactgagagcttgtcct

SEQ ID NO: 13682 - DNA, 20 bp, Artificial Sequence
  Description of Artificial Sequence: Synthetic oligonucleotide
  Target: FXN; (-) strand; PAM type: NRG; PAM sequence: GAG
acttcccacagaagcactga

SEQ ID NO: 13683 - DNA, 20 bp, Artificial Sequence
  Description of Artificial Sequence: Synthetic oligonucleotide
  Target: FXN; (-) strand; PAM type: NRG; PAM sequence: GAG
ccacttcccacagaagcact

SEQ ID NO: 13684 - DNA, 20 bp, Artificial Sequence
  Description of Artificial Sequence: Synthetic oligonucleotide
  Target: FXN; (-) strand; PAM type: NRG; PAM sequence: AAG
cttgccgccacttcccacag

SEQ ID NO: 13685 - DNA, 20 bp, Artificial Sequence
  Description of Artificial Sequence: Synthetic oligonucleotide
  Target: FXN; (-) strand; PAM type: NRG; PAM sequence: CAG
cgtcttgccgccacttccca

SEQ ID NO: 13686 - DNA, 20 bp, Artificial Sequence
  Description of Artificial Sequence: Synthetic oligonucleotide
  Target: FXN; (-) strand; PAM type: NRG; PAM sequence: GAG
cggcctccatcccccgctgg

SEQ ID NO: 13687 - DNA, 20 bp, Artificial Sequence
  Description of Artificial Sequence: Synthetic oligonucleotide
  Target: FXN; (-) strand; PAM type: NRG; PAM sequence: GGG
ctcggcctccatcccccgct

SEQ ID NO: 13688 - DNA, 20 bp, Artificial Sequence
  Description of Artificial Sequence: Synthetic oligonucleotide
  Target: FXN; (-) strand; PAM type: NRG; PAM sequence: TGG
actcggcctccatcccccgc

SEQ ID NO: 13689 - DNA, 20 bp, Artificial Sequence
  Description of Artificial Sequence: Synthetic oligonucleotide
  Target: FXN; (-) strand; PAM type: NRG; PAM sequence: CGG
cagtgaccagcagactgact

SEQ ID NO: 13690 - DNA, 20 bp, Artificial Sequence
  Description of Artificial Sequence: Synthetic oligonucleotide
  Target: FXN; (-) strand; PAM type: NRG; PAM sequence: CAG
tcctggcctccagtgaccag

SEQ ID NO: 13691 - DNA, 20 bp, Artificial Sequence
  Description of Artificial Sequence: Synthetic oligonucleotide
  Target: FXN; (-) strand; PAM type: NRG; PAM sequence: CAG
gcatcctggcctccagtgac

SEQ ID NO: 13692 - DNA, 20 bp, Artificial Sequence
  Description of Artificial Sequence: Synthetic oligonucleotide
  Target: FXN; (-) strand; PAM type: NRG; PAM sequence: CAG
ttaggcagcatcctggcctc

SEQ ID NO: 13693 - DNA, 20 bp, Artificial Sequence
  Description of Artificial Sequence: Synthetic oligonucleotide
  Target: FXN; (-) strand; PAM type: NRG; PAM sequence: TGG
ggctgtgttaggcagcatcc

SEQ ID NO: 13694 - DNA, 20 bp, Artificial Sequence
  Description of Artificial Sequence: Synthetic oligonucleotide
  Target: FXN; (-) strand; PAM type: NRG; PAM sequence: CAG
agcgggacggctgtgttagg

SEQ ID NO: 13695 - DNA, 20 bp, Artificial Sequence
  Description of Artificial Sequence: Synthetic oligonucleotide
  Target: FXN; (-) strand; PAM type: NRG; PAM sequence: AGG
cggagcgggacggctgtgtt

SEQ ID NO: 13696 - DNA, 20 bp, Artificial Sequence
  Description of Artificial Sequence: Synthetic oligonucleotide
  Target: FXN; (-) strand; PAM type: NRG; PAM sequence: TAG
ccggagcgggacggctgtgt

SEQ ID NO: 13697 - DNA, 20 bp, Artificial Sequence
  Description of Artificial Sequence: Synthetic oligonucleotide
  Target: FXN; (-) strand; PAM type: NRG; PAM sequence: CGG
tggtgaggcccggagcggga

SEQ ID NO: 13698 - DNA, 20 bp, Artificial Sequence
  Description of Artificial Sequence: Synthetic oligonucleotide
  Target: FXN; (-) strand; PAM type: NRG; PAM sequence: GGG
ctggtggtgaggcccggagc

SEQ ID NO: 13699 - DNA, 20 bp, Artificial Sequence
  Description of Artificial Sequence: Synthetic oligonucleotide
  Target: FXN; (-) strand; PAM type: NRG; PAM sequence: CGG
cctggtggtgaggcccggag

SEQ ID NO: 13700 - DNA, 20 bp, Artificial Sequence
  Description of Artificial Sequence: Synthetic oligonucleotide
  Target: FXN; (-) strand; PAM type: NRG; PAM sequence: GAG
cgccctggtggtgaggcccg

SEQ ID NO: 13701 - DNA, 20 bp, Artificial Sequence
  Description of Artificial Sequence: Synthetic oligonucleotide
  Target: FXN; (-) strand; PAM type: NRG; PAM sequence: CGG
gccgccctggtggtgaggcc

SEQ ID NO: 13702 - DNA, 20 bp, Artificial Sequence
  Description of Artificial Sequence: Synthetic oligonucleotide
  Target: FXN; (-) strand; PAM type: NRG; PAM sequence: AGG
ggagagccgccctggtggtg

SEQ ID NO: 13703 - DNA, 20 bp, Artificial Sequence
  Description of Artificial Sequence: Synthetic oligonucleotide
  Target: FXN; (-) strand; PAM type: NRG; PAM sequence: GAG
gggagagccgccctggtggt

SEQ ID NO: 13704 - DNA, 20 bp, Artificial Sequence
  Description of Artificial Sequence: Synthetic oligonucleotide
  Target: FXN; (-) strand; PAM type: NRG; PAM sequence: TGG
agtggggagagccgccctgg

SEQ ID NO: 13705 - DNA, 20 bp, Artificial Sequence
  Description of Artificial Sequence: Synthetic oligonucleotide
  Target: FXN; (-) strand; PAM type: NRG; PAM sequence: TGG
gggagtggggagagccgccc

SEQ ID NO: 13706 - DNA, 20 bp, Artificial Sequence
  Description of Artificial Sequence: Synthetic oligonucleotide
  Target: FXN; (-) strand; PAM type: NRG; PAM sequence: GAG
cagcaggccgggagtgggga

SEQ ID NO: 13707 - DNA, 20 bp, Artificial Sequence
  Description of Artificial Sequence: Synthetic oligonucleotide
  Target: FXN; (-) strand; PAM type: NRG; PAM sequence: GAG
ggcagcaggccgggagtggg

SEQ ID NO: 13708 - DNA, 20 bp, Artificial Sequence
  Description of Artificial Sequence: Synthetic oligonucleotide
  Target: FXN; (-) strand; PAM type: NRG; PAM sequence: GGG
tgggcagcaggccgggagtg

SEQ ID NO: 13709 - DNA, 20 bp, Artificial Sequence
  Description of Artificial Sequence: Synthetic oligonucleotide
  Target: FXN; (-) strand; PAM type: NRG; PAM sequence: GGG
gtgggcagcaggccgggagt

SEQ ID NO: 13710 - DNA, 20 bp, Artificial Sequence
  Description of Artificial Sequence: Synthetic oligonucleotide
  Target: FXN; (-) strand; PAM type: NRG; PAM sequence: TGG
tgtgggcagcaggccgggag

SEQ ID NO: 13711 - DNA, 20 bp, Artificial Sequence
  Description of Artificial Sequence: Synthetic oligonucleotide
  Target: FXN; (-) strand; PAM type: NRG; PAM sequence: GAG
ctgtgtgggcagcaggccgg

SEQ ID NO: 13712 - DNA, 20 bp, Artificial Sequence
  Description of Artificial Sequence: Synthetic oligonucleotide
  Target: FXN; (-) strand; PAM type: NRG; PAM sequence: GGG
gtctgtgtgggcagcaggcc

SEQ ID NO: 13713 - DNA, 20 bp, Artificial Sequence
  Description of Artificial Sequence: Synthetic oligonucleotide
  Target: FXN; (-) strand; PAM type: NRG; PAM sequence: CGG
agtctgtgtgggcagcaggc

SEQ ID NO: 13714 - DNA, 20 bp, Artificial Sequence
  Description of Artificial Sequence: Synthetic oligonucleotide
  Target: FXN; (-) strand; PAM type: NRG; PAM sequence: AGG
ccgcagtctgtgtgggcagc

SEQ ID NO: 13715 - DNA, 20 bp, Artificial Sequence
  Description of Artificial Sequence: Synthetic oligonucleotide
  Target: FXN; (-) strand; PAM type: NRG; PAM sequence: CAG
cccgcagtctgtgtgggcag

SEQ ID NO: 13716 - DNA, 20 bp, Artificial Sequence
  Description of Artificial Sequence: Synthetic oligonucleotide
  Target: FXN; (-) strand; PAM type: NRG; PAM sequence: CAG
aaccccgcagtctgtgtggg

SEQ ID NO: 13717 - DNA, 20 bp, Artificial Sequence
  Description of Artificial Sequence: Synthetic oligonucleotide
  Target: FXN; (-) strand; PAM type: NRG; PAM sequence: GGG
cggaaccccgcagtctgtgt

SEQ ID NO: 13718 - DNA, 20 bp, Artificial Sequence
  Description of Artificial Sequence: Synthetic oligonucleotide
  Target: FXN; (-) strand; PAM type: NRG; PAM sequence: TGG
ccggaaccccgcagtctgtg

SEQ ID NO: 13719 - DNA, 20 bp, Artificial Sequence
  Description of Artificial Sequence: Synthetic oligonucleotide
  Target: FXN; (-) strand; PAM type: NRG; PAM sequence: CAG
cctgctcccccggaaccccg

SEQ ID NO: 13720 - DNA, 20 bp, Artificial Sequence
  Description of Artificial Sequence: Synthetic oligonucleotide
  Target: FXN; (-) strand; PAM type: NRG; PAM sequence: CGG
cggcctgggtcctgctcccc

SEQ ID NO: 13721 - DNA, 20 bp, Artificial Sequence
  Description of Artificial Sequence: Synthetic oligonucleotide
  Target: FXN; (-) strand; PAM type: NRG; PAM sequence: GGG
agacaggcgcagaacggcct

SEQ ID NO: 13722 - DNA, 20 bp, Artificial Sequence
  Description of Artificial Sequence: Synthetic oligonucleotide
  Target: FXN; (-) strand; PAM type: NRG; PAM sequence: TGG
aagacaggcgcagaacggcc

SEQ ID NO: 13723 - DNA, 20 bp, Artificial Sequence
  Description of Artificial Sequence: Synthetic oligonucleotide
  Target: FXN; (-) strand; PAM type: NRG; PAM sequence: CGG
ccaagaagacaggcgcagaa

SEQ ID NO: 13724 - DNA, 20 bp, Artificial Sequence
  Description of Artificial Sequence: Synthetic oligonucleotide
  Target: FXN; (-) strand; PAM type: NRG; PAM sequence: CAG
tccttccaagaagacaggcg

SEQ ID NO: 13725 - DNA, 20 bp, Artificial Sequence
  Description of Artificial Sequence: Synthetic oligonucleotide
  Target: FXN; (-) strand; PAM type: NRG; PAM sequence: AGG
cctgctccttccaagaagac

SEQ ID NO: 13726 - DNA, 20 bp, Artificial Sequence
  Description of Artificial Sequence: Synthetic oligonucleotide
  Target: FXN; (-) strand; PAM type: NRG; PAM sequence: CAG
gcctgctccttccaagaaga

SEQ ID NO: 13727 - DNA, 20 bp, Artificial Sequence
  Description of Artificial Sequence: Synthetic oligonucleotide
  Target: FXN; (-) strand; PAM type: NRG; PAM sequence: AAG
tccggcctgctccttccaag

SEQ ID NO: 13728 - DNA, 20 bp, Artificial Sequence
  Description of Artificial Sequence: Synthetic oligonucleotide
  Target: FXN; (-) strand; PAM type: NRG; PAM sequence: AAG
cgctccggcctgctccttcc

SEQ ID NO: 13729 - DNA, 20 bp, Artificial Sequence
  Description of Artificial Sequence: Synthetic oligonucleotide
  Target: FXN; (-) strand; PAM type: NRG; PAM sequence: CGG
tacacggcgctcccgcgctc

SEQ ID NO: 13730 - DNA, 20 bp, Artificial Sequence
  Description of Artificial Sequence: Synthetic oligonucleotide
  Target: FXN; (-) strand; PAM type: NRG; PAM sequence: CGG
ccttcgcaggtacagctaca

SEQ ID NO: 13731 - DNA, 20 bp, Artificial Sequence
  Description of Artificial Sequence: Synthetic oligonucleotide
  Target: FXN; (-) strand; PAM type: NRG; PAM sequence: CAG
atcctgtgccttcgcaggta

SEQ ID NO: 13732 - DNA, 20 bp, Artificial Sequence
  Description of Artificial Sequence: Synthetic oligonucleotide
  Target: FXN; (-) strand; PAM type: NRG; PAM sequence: AGG
gcggaatcctgtgccttcgc

SEQ ID NO: 13733 - DNA, 20 bp, Artificial Sequence
  Description of Artificial Sequence: Synthetic oligonucleotide
  Target: FXN; (-) strand; PAM type: NRG; PAM sequence: CAG
cgcggaatcctgtgccttcg

SEQ ID NO: 13734 - DNA, 20 bp, Artificial Sequence
  Description of Artificial Sequence: Synthetic oligonucleotide
  Target: FXN; (-) strand; PAM type: NRG; PAM sequence: CGG
gaaactgcgggatcttcccg

SEQ ID NO: 13735 - DNA, 20 bp, Artificial Sequence
  Description of Artificial Sequence: Synthetic oligonucleotide
  Target: FXN; (-) strand; PAM type: NRG; PAM sequence: GGG
tgacgacggcccgaaactgc

SEQ ID NO: 13736 - DNA, 20 bp, Artificial Sequence
  Description of Artificial Sequence: Synthetic oligonucleotide
  Target: FXN; (-) strand; PAM type: NRG; PAM sequence: CGG
atgacgacggcccgaaactg

SEQ ID NO: 13737 - DNA, 20 bp, Artificial Sequence
  Description of Artificial Sequence: Synthetic oligonucleotide
  Target: FXN; (-) strand; PAM type: NRG; PAM sequence: CGG
aggtataaaaacaatgacga

SEQ ID NO: 13738 - DNA, 20 bp, Artificial Sequence
  Description of Artificial Sequence: Synthetic oligonucleotide
  Target: FXN; (-) strand; PAM type: NRG; PAM sequence: AGG
ctggtcatgccatttgccac

SEQ ID NO: 13739 - DNA, 20 bp, Artificial Sequence
  Description of Artificial Sequence: Synthetic oligonucleotide
  Target: FXN; (-) strand; PAM type: NRG; PAM sequence: CAG
tctggtcatgccatttgcca

SEQ ID NO: 13740 - DNA, 20 bp, Artificial Sequence
  Description of Artificial Sequence: Synthetic oligonucleotide
  Target: FXN; (-) strand; PAM type: NRG; PAM sequence: TGG
tccagacataaccgtgtgtc

SEQ ID NO: 13741 - DNA, 20 bp, Artificial Sequence
  Description of Artificial Sequence: Synthetic oligonucleotide
  Target: FXN; (-) strand; PAM type: NRG; PAM sequence: CAG
ctcctctacaggggtttctc

SEQ ID NO: 13742 - DNA, 20 bp, Artificial Sequence
  Description of Artificial Sequence: Synthetic oligonucleotide
  Target: FXN; (-) strand; PAM type: NRG; PAM sequence: GGG
aacctcctgctcctctacag

SEQ ID NO: 13743 - DNA, 20 bp, Artificial Sequence
  Description of Artificial Sequence: Synthetic oligonucleotide
  Target: FXN; (-) strand; PAM type: NRG; PAM sequence: GGG
caacctcctgctcctctaca

SEQ ID NO: 13744 - DNA, 20 bp, Artificial Sequence
  Description of Artificial Sequence: Synthetic oligonucleotide
  Target: FXN; (-) strand; PAM type: NRG; PAM sequence: AGG
acaacctcctgctcctctac

SEQ ID NO: 13745 - DNA, 20 bp, Artificial Sequence
  Description of Artificial Sequence: Synthetic oligonucleotide
  Target: FXN; (-) strand; PAM type: NRG; PAM sequence: CAG
cacaacctcctgctcctcta

SEQ ID NO: 13746 - DNA, 20 bp, Artificial Sequence
  Description of Artificial Sequence: Synthetic oligonucleotide
  Target: FXN; (-) strand; PAM type: NRG; PAM sequence: CAG
ggcagccactgtccgggcca

SEQ ID NO: 13747 - DNA, 20 bp, Artificial Sequence
  Description of Artificial Sequence: Synthetic oligonucleotide
  Target: FXN; (-) strand; PAM type: NRG; PAM sequence: GGG
ctgctcggcagccactgtcc

SEQ ID NO: 13748 - DNA, 20 bp, Artificial Sequence
  Description of Artificial Sequence: Synthetic oligonucleotide
  Target: FXN; (-) strand; PAM type: NRG; PAM sequence: CGG
actgctcggcagccactgtc

SEQ ID NO: 13749 - DNA, 20 bp, Artificial Sequence
  Description of Artificial Sequence: Synthetic oligonucleotide
  Target: FXN; (-) strand; PAM type: NRG; PAM sequence: CAG
tgcaggctccaactgctcgg

SEQ ID NO: 13750 - DNA, 20 bp, Artificial Sequence
  Description of Artificial Sequence: Synthetic oligonucleotide
  Target: FXN; (-) strand; PAM type: NRG; PAM sequence: CGG
gggtgcaggctccaactgct

SEQ ID NO: 13751 - DNA, 20 bp, Artificial Sequence
  Description of Artificial Sequence: Synthetic oligonucleotide
  Target: FXN; (-) strand; PAM type: NRG; PAM sequence: AGG
tagccaagttgggcgggtgc

SEQ ID NO: 13752 - DNA, 20 bp, Artificial Sequence
  Description of Artificial Sequence: Synthetic oligonucleotide
  Target: FXN; (-) strand; PAM type: NRG; PAM sequence: CAG
ttagccaagttgggcgggtg

SEQ ID NO: 13753 - DNA, 20 bp, Artificial Sequence
  Description of Artificial Sequence: Synthetic oligonucleotide
  Target: FXN; (-) strand; PAM type: NRG; PAM sequence: GGG
cttctttagccaagttgggc

SEQ ID NO: 13754 - DNA, 20 bp, Artificial Sequence
  Description of Artificial Sequence: Synthetic oligonucleotide
  Target: FXN; (-) strand; PAM type: NRG; PAM sequence: CGG
acttctttagccaagttggg

SEQ ID NO: 13755 - DNA, 20 bp, Artificial Sequence
  Description of Artificial Sequence: Synthetic oligonucleotide
  Target: FXN; (-) strand; PAM type: NRG; PAM sequence: GGG
gggacttctttagccaagtt

SEQ ID NO: 13756 - DNA, 20 bp, Artificial Sequence
  Description of Artificial Sequence: Synthetic oligonucleotide
  Target: FXN; (-) strand; PAM type: NRG; PAM sequence: TGG
ggggacttctttagccaagt

SEQ ID NO: 13757 - DNA, 20 bp, Artificial Sequence
  Description of Artificial Sequence: Synthetic oligonucleotide
  Target: FXN; (-) strand; PAM type: NRG; PAM sequence: AAG
gtatggggacttctttagcc

SEQ ID NO: 13758 - DNA, 20 bp, Artificial Sequence
  Description of Artificial Sequence: Synthetic oligonucleotide
  Target: FXN; (-) strand; PAM type: NRG; PAM sequence: TAG
agagagtatggggacttctt

SEQ ID NO: 13759 - DNA, 20 bp, Artificial Sequence
  Description of Artificial Sequence: Synthetic oligonucleotide
  Target: FXN; (-) strand; PAM type: NRG; PAM sequence: GGG
tcttttccacagagagtatg

SEQ ID NO: 13760 - DNA, 20 bp, Artificial Sequence
  Description of Artificial Sequence: Synthetic oligonucleotide
  Target: FXN; (-) strand; PAM type: NRG; PAM sequence: GGG
atcttttccacagagagtat

SEQ ID NO: 13761 - DNA, 20 bp, Artificial Sequence
  Description of Artificial Sequence: Synthetic oligonucleotide
  Target: FXN; (-) strand; PAM type: NRG; PAM sequence: TGG
aatcttttccacagagagta

SEQ ID NO: 13762 - DNA, 20 bp, Artificial Sequence
  Description of Artificial Sequence: Synthetic oligonucleotide
  Target: FXN; (-) strand; PAM type: NRG; PAM sequence: GAG
ctggaaatcttttccacaga

SEQ ID NO: 13763 - DNA, 20 bp, Artificial Sequence
  Description of Artificial Sequence: Synthetic oligonucleotide
  Target: FXN; (-) strand; PAM type: NRG; PAM sequence: GAG
ttctggaaatcttttccaca

SEQ ID NO: 13764 - DNA, 20 bp, Artificial Sequence
  Description of Artificial Sequence: Synthetic oligonucleotide
  Target: FXN; (-) strand; PAM type: NRG; PAM sequence: CAG
gcttctggaaatcttttcca

SEQ ID NO: 13765 - DNA, 20 bp, Artificial Sequence
  Description of Artificial Sequence: Synthetic oligonucleotide
  Target: FXN; (-) strand; PAM type: NRG; PAM sequence: TGG
gatattgacacaacagcttc

SEQ ID NO: 13766 - DNA, 20 bp, Artificial Sequence
  Description of Artificial Sequence: Synthetic oligonucleotide
  Target: FXN; (-) strand; PAM type: NRG; PAM sequence: CAG
aggctttgatattgacacaa

SEQ ID NO: 13767 - DNA, 20 bp, Artificial Sequence
  Description of Artificial Sequence: Synthetic oligonucleotide
  Target: FXN; (-) strand; PAM type: NRG; PAM sequence: AGG
ttgttgttgttgttgttttg

SEQ ID NO: 13768 - DNA, 20 bp, Artificial Sequence
  Description of Artificial Sequence: Synthetic oligonucleotide
  Target: FXN; (-) strand; PAM type: NRG; PAM sequence: GAG
gttgttgttgttgttgtttt

SEQ ID NO: 13769 - DNA, 20 bp, Artificial Sequence
  Description of Artificial Sequence: Synthetic oligonucleotide
  Target: FXN; (-) strand; PAM type: NRG; PAM sequence: AGG
tacttttcaaagcagactca

SEQ ID NO: 13770 - DNA, 20 bp, Artificial Sequence
  Description of Artificial Sequence: Synthetic oligonucleotide
  Target: FXN; (-) strand; PAM type: NRG; PAM sequence: AAG
ctacttttcaaagcagactc

SEQ ID NO: 13771 - DNA, 20 bp, Artificial Sequence
  Description of Artificial Sequence: Synthetic oligonucleotide
  Target: FXN; (-) strand; PAM type: NRG; PAM sequence: CAG
tttcaccctacttttcaaag

SEQ ID NO: 13772 - DNA, 20 bp, Artificial Sequence
  Description of Artificial Sequence: Synthetic oligonucleotide
  Target: FXN; (-) strand; PAM type: NRG; PAM sequence: AAG
gaatttcaccctacttttca

SEQ ID NO: 13773 - DNA, 20 bp, Artificial Sequence
  Description of Artificial Sequence: Synthetic oligonucleotide
  Target: FXN; (-) strand; PAM type: NRG; PAM sequence: CAG
ttgccagttgaatgcctctg

SEQ ID NO: 13774 - DNA, 20 bp, Artificial Sequence
  Description of Artificial Sequence: Synthetic oligonucleotide
  Target: FXN; (-) strand; PAM type: NRG; PAM sequence: CAG
ctatgagggtggtatcttgc

SEQ ID NO: 13775 - DNA, 20 bp, Artificial Sequence
  Description of Artificial Sequence: Synthetic oligonucleotide
  Target: FXN; (-) strand; PAM type: NRG; PAM sequence: TGG
tgcagatctggctatgaggg

SEQ ID NO: 13776 - DNA, 20 bp, Artificial Sequence
  Description of Artificial Sequence: Synthetic oligonucleotide
  Target: FXN; (-) strand; PAM type: NRG; PAM sequence: GGG
acctgcagatctggctatga

SEQ ID NO: 13777 - DNA, 20 bp, Artificial Sequence
  Description of Artificial Sequence: Synthetic oligonucleotide
  Target: FXN; (-) strand; PAM type: NRG; PAM sequence: AGG
gacctgcagatctggctatg

SEQ ID NO: 13778 - DNA, 20 bp, Artificial Sequence
  Description of Artificial Sequence: Synthetic oligonucleotide
  Target: FXN; (-) strand; PAM type: NRG; PAM sequence: GAG
agacctgcagatctggctat

SEQ ID NO: 13779 - DNA, 20 bp, Artificial Sequence
  Description of Artificial Sequence: Synthetic oligonucleotide
  Target: FXN; (-) strand; PAM type: NRG; PAM sequence: TGG
atggctgagacctgcagatc

SEQ ID NO: 13780 - DNA, 20 bp, Artificial Sequence
  Description of Artificial Sequence: Synthetic oligonucleotide
  Target: FXN; (-) strand; PAM type: NRG; PAM sequence: CAG
ggcatgatggctgagacctg

SEQ ID NO: 13781 - DNA, 20 bp, Artificial Sequence
  Description of Artificial Sequence: Synthetic oligonucleotide
  Target: FXN; (-) strand; PAM type: NRG; PAM sequence: GAG
ttttccctggcatgatggct

SEQ ID NO: 13782 - DNA, 20 bp, Artificial Sequence
  Description of Artificial Sequence: Synthetic oligonucleotide
  Target: FXN; (-) strand; PAM type: NRG; PAM sequence: TGG
gagcattttccctggcatga

SEQ ID NO: 13783 - DNA, 20 bp, Artificial Sequence
  Description of Artificial Sequence: Synthetic oligonucleotide
  Target: FXN; (-) strand; PAM type: NRG; PAM sequence: TGG
ggtgaatggagcattttccc

SEQ ID NO: 13784 - DNA, 20 bp, Artificial Sequence
  Description of Artificial Sequence: Synthetic oligonucleotide
  Target: FXN; (-) strand; PAM type: NRG; PAM sequence: GAG
aagctgaggagtggtgaatg

SEQ ID NO: 13785 - DNA, 20 bp, Artificial Sequence
  Description of Artificial Sequence: Synthetic oligonucleotide
  Target: FXN; (-) strand; PAM type: NRG; PAM sequence: TGG
agaagctgaggagtggtgaa

SEQ ID NO: 13786 - DNA, 20 bp, Artificial Sequence
  Description of Artificial Sequence: Synthetic oligonucleotide
  Target: FXN; (-) strand; PAM type: NRG; PAM sequence: TGG
cagaagcagaagctgaggag

SEQ ID NO: 13787 - DNA, 20 bp, Artificial Sequence
  Description of Artificial Sequence: Synthetic oligonucleotide
  Target: FXN; (-) strand; PAM type: NRG; PAM sequence: GAG
aaccagaagcagaagctgag

SEQ ID NO: 13788 - DNA, 20 bp, Artificial Sequence
  Description of Artificial Sequence: Synthetic oligonucleotide
  Target: FXN; (-) strand; PAM type: NRG; PAM sequence: AGG
gaaaccagaagcagaagctg

SEQ ID NO: 13789 - DNA, 20 bp, Artificial Sequence
  Description of Artificial Sequence: Synthetic oligonucleotide
  Target: FXN; (-) strand; PAM type: NRG; PAM sequence: GAG
tgaaaccagaagcagaagct

SEQ ID NO: 13790 - DNA, 20 bp, Artificial Sequence
  Description of Artificial Sequence: Synthetic oligonucleotide
  Target: FXN; (-) strand; PAM type: NRG; PAM sequence: AAG
acctctgaaaccagaagcag

SEQ ID NO: 13791 - DNA, 20 bp, Artificial Sequence
  Description of Artificial Sequence: Synthetic oligonucleotide
  Target: FXN; (-) strand; PAM type: NRG; PAM sequence: CAG
gagacctctgaaaccagaag

SEQ ID NO: 13792 - DNA, 20 bp, Artificial Sequence
  Description of Artificial Sequence: Synthetic oligonucleotide
  Target: FXN; (-) strand; PAM type: NRG; PAM sequence: AAG
acagagacctctgaaaccag

SEQ ID NO: 13793 - DNA, 20 bp, Artificial Sequence
  Description of Artificial Sequence: Synthetic oligonucleotide
  Target: FXN; (-) strand; PAM type: NRG; PAM sequence: CAG
aatacagagacctctgaaac

SEQ ID NO: 13794 - DNA, 20 bp, Artificial Sequence
  Description of Artificial Sequence: Synthetic oligonucleotide
  Target: FXN; (-) strand; PAM type: NRG; PAM sequence: GAG
tttaaagcccctccaataca

SEQ ID NO: 13795 - DNA, 20 bp, Artificial Sequence
  Description of Artificial Sequence: Synthetic oligonucleotide
  Target: FXN; (-) strand; PAM type: NRG; PAM sequence: CAG
gctttaaagcccctccaata

SEQ ID NO: 13796 - DNA, 20 bp, Artificial Sequence
  Description of Artificial Sequence: Synthetic oligonucleotide
  Target: FXN; (-) strand; PAM type: NRG; PAM sequence: AAG
taaagacccttcttgcttta

SEQ ID NO: 13797 - DNA, 20 bp, Artificial Sequence
  Description of Artificial Sequence: Synthetic oligonucleotide
  Target: FXN; (-) strand; PAM type: NRG; PAM sequence: AAG
tgaataagagtaagtgggta

SEQ ID NO: 13798 - DNA, 20 bp, Artificial Sequence
  Description of Artificial Sequence: Synthetic oligonucleotide
  Target: FXN; (-) strand; PAM type: NRG; PAM sequence: GGG
atctgtgaataagagtaagt

SEQ ID NO: 13799 - DNA, 20 bp, Artificial Sequence
  Description of Artificial Sequence: Synthetic oligonucleotide
  Target: FXN; (-) strand; PAM type: NRG; PAM sequence: TGG
catctgtgaataagagtaag

SEQ ID NO: 13800 - DNA, 20 bp, Artificial Sequence
  Description of Artificial Sequence: Synthetic oligonucleotide
  Target: FXN; (-) strand; PAM type: NRG; PAM sequence: AAG
tcacatctgtgaataagagt

SEQ ID NO: 13801 - DNA, 20 bp, Artificial Sequence
  Description of Artificial Sequence: Synthetic oligonucleotide
  Target: FXN; (-) strand; PAM type: NRG; PAM sequence: GAG
atattcacatctgtgaataa

SEQ ID NO: 13802 - DNA, 20 bp, Artificial Sequence
  Description of Artificial Sequence: Synthetic oligonucleotide
  Target: FXN; (-) strand; PAM type: NRG; PAM sequence: AAG
gcatattcacatctgtgaat

SEQ ID NO: 13803 - DNA, 20 bp, Artificial Sequence
  Description of Artificial Sequence: Synthetic oligonucleotide
  Target: FXN; (-) strand; PAM type: NRG; PAM sequence: TGG
ggacatgtcactttccccac

SEQ ID NO: 13804 - DNA, 20 bp, Artificial Sequence
  Description of Artificial Sequence: Synthetic oligonucleotide
  Target: FXN; (-) strand; PAM type: NRG; PAM sequence: AGG
tgttgactctattctgactt

SEQ ID NO: 13805 - DNA, 20 bp, Artificial Sequence
  Description of Artificial Sequence: Synthetic oligonucleotide
  Target: FXN; (-) strand; PAM type: NRG; PAM sequence: TAG
ttgttgactctattctgact

SEQ ID NO: 13806 - DNA, 20 bp, Artificial Sequence
  Description of Artificial Sequence: Synthetic oligonucleotide
  Target: FXN; (-) strand; PAM type: NRG; PAM sequence: GGG
actagaggctaagtcatttt

SEQ ID NO: 13807 - DNA, 20 bp, Artificial Sequence
  Description of Artificial Sequence: Synthetic oligonucleotide
  Target: FXN; (-) strand; PAM type: NRG; PAM sequence: TGG
cactagaggctaagtcattt

SEQ ID NO: 13808 - DNA, 20 bp, Artificial Sequence
  Description of Artificial Sequence: Synthetic oligonucleotide
  Target: FXN; (-) strand; PAM type: NRG; PAM sequence: AAG
cccattatacactagaggct

SEQ ID NO: 13809 - DNA, 20 bp, Artificial Sequence
  Description of Artificial Sequence: Synthetic oligonucleotide
  Target: FXN; (-) strand; PAM type: NRG; PAM sequence: AGG
caatgcccattatacactag

SEQ ID NO: 13810 - DNA, 20 bp, Artificial Sequence
  Description of Artificial Sequence: Synthetic oligonucleotide
  Target: FXN; (-) strand; PAM type: NRG; PAM sequence: GAG
tcaatgcccattatacacta

SEQ ID NO: 13811 - DNA, 20 bp, Artificial Sequence
  Description of Artificial Sequence: Synthetic oligonucleotide
  Target: FXN; (-) strand; PAM type: NRG; PAM sequence: TAG
catcaatgcccattatacac

SEQ ID NO: 13812 - DNA, 20 bp, Artificial Sequence
  Description of Artificial Sequence: Synthetic oligonucleotide
  Target: FXN; (-) strand; PAM type: NRG; PAM sequence: TAG
cttcatctctgtatttccag

SEQ ID NO: 13813 - DNA, 20 bp, Artificial Sequence
  Description of Artificial Sequence: Synthetic oligonucleotide
  Target: FXN; (-) strand; PAM type: NRG; PAM sequence: CAG
tttcttcatctctgtatttc

SEQ ID NO: 13814 - DNA, 20 bp, Artificial Sequence
  Description of Artificial Sequence: Synthetic oligonucleotide
  Target: FXN; (-) strand; PAM type: NRG; PAM sequence: GGG
agattgagctccttgaagat

SEQ ID NO: 13815 - DNA, 20 bp, Artificial Sequence
  Description of Artificial Sequence: Synthetic oligonucleotide
  Target: FXN; (-) strand; PAM type: NRG; PAM sequence: TGG
tagattgagctccttgaaga

SEQ ID NO: 13816 - DNA, 20 bp, Artificial Sequence
  Description of Artificial Sequence: Synthetic oligonucleotide
  Target: FXN; (-) strand; PAM type: NRG; PAM sequence: AAG
ttgctagattgagctccttg

SEQ ID NO: 13817 - DNA, 20 bp, Artificial Sequence
  Description of Artificial Sequence: Synthetic oligonucleotide
  Target: FXN; (-) strand; PAM type: NRG; PAM sequence: GAG
tctgtctcccttgctagatt

SEQ ID NO: 13818 - DNA, 20 bp, Artificial Sequence
  Description of Artificial Sequence: Synthetic oligonucleotide
  Target: FXN; (-) strand; PAM type: NRG; PAM sequence: TAG
aaagagtctgtctcccttgc

SEQ ID NO: 13819 - DNA, 20 bp, Artificial Sequence
  Description of Artificial Sequence: Synthetic oligonucleotide
  Target: FXN; (-) strand; PAM type: NRG; PAM sequence: GAG
agcccggtcccacctacaaa

SEQ ID NO: 13820 - DNA, 20 bp, Artificial Sequence
  Description of Artificial Sequence: Synthetic oligonucleotide
  Target: FXN; (-) strand; PAM type: NRG; PAM sequence: AAG
gaagcccggtcccacctaca

SEQ ID NO: 13821 - DNA, 20 bp, Artificial Sequence
  Description of Artificial Sequence: Synthetic oligonucleotide
  Target: FXN; (-) strand; PAM type: NRG; PAM sequence: CGG
ccttctgctgcagggaagcc

SEQ ID NO: 13822 - DNA, 20 bp, Artificial Sequence
  Description of Artificial Sequence: Synthetic oligonucleotide
  Target: FXN; (-) strand; PAM type: NRG; PAM sequence: AAG
agcttccttctgctgcaggg

SEQ ID NO: 13823 - DNA, 20 bp, Artificial Sequence
  Description of Artificial Sequence: Synthetic oligonucleotide
  Target: FXN; (-) strand; PAM type: NRG; PAM sequence: GGG
tcaagcttccttctgctgca

SEQ ID NO: 13824 - DNA, 20 bp, Artificial Sequence
  Description of Artificial Sequence: Synthetic oligonucleotide
  Target: FXN; (-) strand; PAM type: NRG; PAM sequence: AGG
ttcaagcttccttctgctgc

SEQ ID NO: 13825 - DNA, 20 bp, Artificial Sequence
  Description of Artificial Sequence: Synthetic oligonucleotide
  Target: FXN; (-) strand; PAM type: NRG; PAM sequence: CAG
tttcaagcttccttctgctg

SEQ ID NO: 13826 - DNA, 20 bp, Artificial Sequence
  Description of Artificial Sequence: Synthetic oligonucleotide
  Target: FXN; (-) strand; PAM type: NRG; PAM sequence: AAG
tgaggctcgttaccaatttc

SEQ ID NO: 13827 - DNA, 20 bp, Artificial Sequence
  Description of Artificial Sequence: Synthetic oligonucleotide
  Target: FXN; (-) strand; PAM type: NRG; PAM sequence: AGG
gcctgcctctgtcccttctg

SEQ ID NO: 13828 - DNA, 20 bp, Artificial Sequence
  Description of Artificial Sequence: Synthetic oligonucleotide
  Target: FXN; (-) strand; PAM type: NRG; PAM sequence: GAG
ggcctgcctctgtcccttct

SEQ ID NO: 13829 - DNA, 20 bp, Artificial Sequence
  Description of Artificial Sequence: Synthetic oligonucleotide
  Target: FXN; (-) strand; PAM type: NRG; PAM sequence: TGG
atcctctcagggtagcatgg

SEQ ID NO: 13830 - DNA, 20 bp, Artificial Sequence
  Description of Artificial Sequence: Synthetic oligonucleotide
  Target: FXN; (-) strand; PAM type: NRG; PAM sequence: TGG
gcgatcctctcagggtagca

SEQ ID NO: 13831 - DNA, 20 bp, Artificial Sequence
  Description of Artificial Sequence: Synthetic oligonucleotide
  Target: FXN; (-) strand; PAM type: NRG; PAM sequence: TAG
cacatgcgatcctctcaggg

SEQ ID NO: 13832 - DNA, 20 bp, Artificial Sequence
  Description of Artificial Sequence: Synthetic oligonucleotide
  Target: FXN; (-) strand; PAM type: NRG; PAM sequence: GGG
gtccacatgcgatcctctca

SEQ ID NO: 13833 - DNA, 20 bp, Artificial Sequence
  Description of Artificial Sequence: Synthetic oligonucleotide
  Target: FXN; (-) strand; PAM type: NRG; PAM sequence: AGG
tgtccacatgcgatcctctc

SEQ ID NO: 13834 - DNA, 20 bp, Artificial Sequence
  Description of Artificial Sequence: Synthetic oligonucleotide
  Target: FXN; (-) strand; PAM type: NRG; PAM sequence: CAG
gtgtccacatgcgatcctct

SEQ ID NO: 13835 - DNA, 20 bp, Artificial Sequence
  Description of Artificial Sequence: Synthetic oligonucleotide
  Target: FXN; (-) strand; PAM type: NRG; PAM sequence: TAG
gtcaaagcagggccaggtca

SEQ ID NO: 13836 - DNA, 20 bp, Artificial Sequence
  Description of Artificial Sequence: Synthetic oligonucleotide
  Target: FXN; (-) strand; PAM type: NRG; PAM sequence: AGG
tagtgggtcaaagcagggcc

SEQ ID NO: 13837 - DNA, 20 bp, Artificial Sequence
  Description of Artificial Sequence: Synthetic oligonucleotide
  Target: FXN; (-) strand; PAM type: NRG; PAM sequence: CAG
ctagtgggtcaaagcagggc

SEQ ID NO: 13838 - DNA, 20 bp, Artificial Sequence
  Description of Artificial Sequence: Synthetic oligonucleotide
  Target: FXN; (-) strand; PAM type: NRG; PAM sequence: GGG
acagctagtgggtcaaagca

SEQ ID NO: 13839 - DNA, 20 bp, Artificial Sequence
  Description of Artificial Sequence: Synthetic oligonucleotide
  Target: FXN; (-) strand; PAM type: NRG; PAM sequence: AGG
cacagctagtgggtcaaagc

SEQ ID NO: 13840 - DNA, 20 bp, Artificial Sequence
  Description of Artificial Sequence: Synthetic oligonucleotide
  Target: FXN; (-) strand; PAM type: NRG; PAM sequence: CAG
gcacagctagtgggtcaaag

SEQ ID NO: 13841 - DNA, 20 bp, Artificial Sequence
  Description of Artificial Sequence: Synthetic oligonucleotide
  Target: FXN; (-) strand; PAM type: NRG; PAM sequence: AAG
acagcacagctagtgggtca

SEQ ID NO: 13842 - DNA, 20 bp, Artificial Sequence
  Description of Artificial Sequence: Synthetic oligonucleotide
  Target: FXN; (-) strand; PAM type: NRG; PAM sequence: GGG
ggccctacagcacagctagt

SEQ ID NO: 13843 - DNA, 20 bp, Artificial Sequence
  Description of Artificial Sequence: Synthetic oligonucleotide
  Target: FXN; (-) strand; PAM type: NRG; PAM sequence: TGG
tggccctacagcacagctag

SEQ ID NO: 13844 - DNA, 20 bp, Artificial Sequence
  Description of Artificial Sequence: Synthetic oligonucleotide
  Target: FXN; (-) strand; PAM type: NRG; PAM sequence: TAG
acctggccctacagcacagc

SEQ ID NO: 13845 - DNA, 20 bp, Artificial Sequence
  Description of Artificial Sequence: Synthetic oligonucleotide
  Target: FXN; (-) strand; PAM type: NRG; PAM sequence: CAG
ctccacctggccctacagca

SEQ ID NO: 13846 - DNA, 20 bp, Artificial Sequence
  Description of Artificial Sequence: Synthetic oligonucleotide
  Target: FXN; (-) strand; PAM type: NRG; PAM sequence: CAG
ccaggctccacctggcccta

SEQ ID NO: 13847 - DNA, 20 bp, Artificial Sequence
  Description of Artificial Sequence: Synthetic oligonucleotide
  Target: FXN; (-) strand; PAM type: NRG; PAM sequence: TGG
aggccactccaggctccacc

SEQ ID NO: 13848 - DNA, 20 bp, Artificial Sequence
  Description of Artificial Sequence: Synthetic oligonucleotide
  Target: FXN; (-) strand; PAM type: NRG; PAM sequence: AGG
cccttagcacaggccactcc

SEQ ID NO: 13849 - DNA, 20 bp, Artificial Sequence
  Description of Artificial Sequence: Synthetic oligonucleotide
  Target: FXN; (-) strand; PAM type: NRG; PAM sequence: CAG
ccccttagcacaggccactc

SEQ ID NO: 13850 - DNA, 20 bp, Artificial Sequence
  Description of Artificial Sequence: Synthetic oligonucleotide
  Target: FXN; (-) strand; PAM type: NRG; PAM sequence: AGG
tcatagtagccccttagcac

SEQ ID NO: 13851 - DNA, 20 bp, Artificial Sequence
  Description of Artificial Sequence: Synthetic oligonucleotide
  Target: FXN; (-) strand; PAM type: NRG; PAM sequence: CAG
ctcatagtagccccttagca

SEQ ID NO: 13852 - DNA, 20 bp, Artificial Sequence
  Description of Artificial Sequence: Synthetic oligonucleotide
  Target: FXN; (-) strand; PAM type: NRG; PAM sequence: TAG
aagagctcatagtagcccct

SEQ ID NO: 13853 - DNA, 20 bp, Artificial Sequence
  Description of Artificial Sequence: Synthetic oligonucleotide
  Target: FXN; (-) strand; PAM type: NRG; PAM sequence: TAG
ggagtggaaagagctcatag

SEQ ID NO: 13854 - DNA, 20 bp, Artificial Sequence
  Description of Artificial Sequence: Synthetic oligonucleotide
  Target: FXN; (-) strand; PAM type: NRG; PAM sequence: TAG
gggggagtggaaagagctca

SEQ ID NO: 13855 - DNA, 20 bp, Artificial Sequence
  Description of Artificial Sequence: Synthetic oligonucleotide
  Target: FXN; (-) strand; PAM type: NRG; PAM sequence: GAG
atgccttgggggagtggaaa

SEQ ID NO: 13856 - DNA, 20 bp, Artificial Sequence
  Description of Artificial Sequence: Synthetic oligonucleotide
  Target: FXN; (-) strand; PAM type: NRG; PAM sequence: AAG
caatgccttgggggagtgga

SEQ ID NO: 13857 - DNA, 20 bp, Artificial Sequence
  Description of Artificial Sequence: Synthetic oligonucleotide
  Target: FXN; (-) strand; PAM type: NRG; PAM sequence: TGG
tatgcaatgccttgggggag

SEQ ID NO: 13858 - DNA, 20 bp, Artificial Sequence
  Description of Artificial Sequence: Synthetic oligonucleotide
  Target: FXN; (-) strand; PAM type: NRG; PAM sequence: GAG
atttatgcaatgccttgggg

SEQ ID NO: 13859 - DNA, 20 bp, Artificial Sequence
  Description of Artificial Sequence: Synthetic oligonucleotide
  Target: FXN; (-) strand; PAM type: NRG; PAM sequence: GGG
ttatttatgcaatgccttgg

SEQ ID NO: 13860 - DNA, 20 bp, Artificial Sequence
  Description of Artificial Sequence: Synthetic oligonucleotide
  Target: FXN; (-) strand; PAM type: NRG; PAM sequence: GGG
attatttatgcaatgccttg

SEQ ID NO: 13861 - DNA, 20 bp, Artificial Sequence
  Description of Artificial Sequence: Synthetic oligonucleotide
  Target: FXN; (-) strand; PAM type: NRG; PAM sequence: GGG
cattatttatgcaatgcctt

SEQ ID NO: 13862 - DNA, 20 bp, Artificial Sequence
  Description of Artificial Sequence: Synthetic oligonucleotide
  Target: FXN; (-) strand; PAM type: NRG; PAM sequence: TGG
acattatttatgcaatgcct

SEQ ID NO: 13863 - DNA, 20 bp, Artificial Sequence
  Description of Artificial Sequence: Synthetic oligonucleotide
  Target: FXN; (-) strand; PAM type: NRG; PAM sequence: AAG
gattttgctgtgcaaacaga

SEQ ID NO: 13864 - DNA, 20 bp, Artificial Sequence
  Description of Artificial Sequence: Synthetic oligonucleotide
  Target: FXN; (-) strand; PAM type: NRG; PAM sequence: CAG
ccctgattttgctgtgcaaa

SEQ ID NO: 13865 - DNA, 20 bp, Artificial Sequence
  Description of Artificial Sequence: Synthetic oligonucleotide
  Target: FXN; (-) strand; PAM type: NRG; PAM sequence: TAG
aggggaggcaccccatgttc

SEQ ID NO: 13866 - DNA, 20 bp, Artificial Sequence
  Description of Artificial Sequence: Synthetic oligonucleotide
  Target: FXN; (-) strand; PAM type: NRG; PAM sequence: AGG
tgttgggctggggggagggg

SEQ ID NO: 13867 - DNA, 20 bp, Artificial Sequence
  Description of Artificial Sequence: Synthetic oligonucleotide
  Target: FXN; (-) strand; PAM type: NRG; PAM sequence: GAG
ctgttgggctggggggaggg

SEQ ID NO: 13868 - DNA, 20 bp, Artificial Sequence
  Description of Artificial Sequence: Synthetic oligonucleotide
  Target: FXN; (-) strand; PAM type: NRG; PAM sequence: GGG
ttctgttgggctggggggag

SEQ ID NO: 13869 - DNA, 20 bp, Artificial Sequence
  Description of Artificial Sequence: Synthetic oligonucleotide
  Target: FXN; (-) strand; PAM type: NRG; PAM sequence: GGG
cttctgttgggctgggggga

SEQ ID NO: 13870 - DNA, 20 bp, Artificial Sequence
  Description of Artificial Sequence: Synthetic oligonucleotide
  Target: FXN; (-) strand; PAM type: NRG; PAM sequence: AGG
acttctgttgggctgggggg

SEQ ID NO: 13871 - DNA, 20 bp, Artificial Sequence
  Description of Artificial Sequence: Synthetic oligonucleotide
  Target: FXN; (-) strand; PAM type: NRG; PAM sequence: GAG
aacttctgttgggctggggg

SEQ ID NO: 13872 - DNA, 20 bp, Artificial Sequence
  Description of Artificial Sequence: Synthetic oligonucleotide
  Target: FXN; (-) strand; PAM type: NRG; PAM sequence: GGG
agaacttctgttgggctggg

SEQ ID NO: 13873 - DNA, 20 bp, Artificial Sequence
  Description of Artificial Sequence: Synthetic oligonucleotide
  Target: FXN; (-) strand; PAM type: NRG; PAM sequence: GGG
tagaacttctgttgggctgg

SEQ ID NO: 13874 - DNA, 20 bp, Artificial Sequence
  Description of Artificial Sequence: Synthetic oligonucleotide
  Target: FXN; (-) strand; PAM type: NRG; PAM sequence: GGG
gtagaacttctgttgggctg

SEQ ID NO: 13875 - DNA, 20 bp, Artificial Sequence
  Description of Artificial Sequence: Synthetic oligonucleotide
  Target: FXN; (-) strand; PAM type: NRG; PAM sequence: GGG
tgtagaacttctgttgggct

SEQ ID NO: 13876 - DNA, 20 bp, Artificial Sequence
  Description of Artificial Sequence: Synthetic oligonucleotide
  Target: FXN; (-) strand; PAM type: NRG; PAM sequence: TGG
ttgtagaacttctgttgggc

SEQ ID NO: 13877 - DNA, 20 bp, Artificial Sequence
  Description of Artificial Sequence: Synthetic oligonucleotide
  Target: FXN; (-) strand; PAM type: NRG; PAM sequence: GGG
gtcattgtagaacttctgtt

SEQ ID NO: 13878 - DNA, 20 bp, Artificial Sequence
  Description of Artificial Sequence: Synthetic oligonucleotide
  Target: FXN; (-) strand; PAM type: NRG; PAM sequence: TGG
agtcattgtagaacttctgt

SEQ ID NO: 13879 - DNA, 20 bp, Artificial Sequence
  Description of Artificial Sequence: Synthetic oligonucleotide
  Target: FXN; (-) strand; PAM type: NRG; PAM sequence: TAG
caagggcccatcagtcattg

SEQ ID NO: 13880 - DNA, 20 bp, Artificial Sequence
  Description of Artificial Sequence: Synthetic oligonucleotide
  Target: FXN; (-) strand; PAM type: NRG; PAM sequence: CAG
aaacaaaaacaagggcccat

SEQ ID NO: 13881 - DNA, 20 bp, Artificial Sequence
  Description of Artificial Sequence: Synthetic oligonucleotide
  Target: FXN; (-) strand; PAM type: NRG; PAM sequence: GGG
tccgtctcaaacaaaaacaa

SEQ ID NO: 13882 - DNA, 20 bp, Artificial Sequence
  Description of Artificial Sequence: Synthetic oligonucleotide
  Target: FXN; (-) strand; PAM type: NRG; PAM sequence: AGG
ttccgtctcaaacaaaaaca

SEQ ID NO: 13883 - DNA, 20 bp, Artificial Sequence
  Description of Artificial Sequence: Synthetic oligonucleotide
  Target: FXN; (-) strand; PAM type: NRG; PAM sequence: AAG
gttccgtctcaaacaaaaac

SEQ ID NO: 13884 - DNA, 20 bp, Artificial Sequence
  Description of Artificial Sequence: Synthetic oligonucleotide
  Target: FXN; (-) strand; PAM type: NRG; PAM sequence: GGG
tcaccactcggaaccctgtg

SEQ ID NO: 13885 - DNA, 20 bp, Artificial Sequence
  Description of Artificial Sequence: Synthetic oligonucleotide
  Target: FXN; (-) strand; PAM type: NRG; PAM sequence: GGG
atcaccactcggaaccctgt

SEQ ID NO: 13886 - DNA, 20 bp, Artificial Sequence
  Description of Artificial Sequence: Synthetic oligonucleotide
  Target: FXN; (-) strand; PAM type: NRG; PAM sequence: TGG
aatcaccactcggaaccctg

SEQ ID NO: 13887 - DNA, 20 bp, Artificial Sequence
  Description of Artificial Sequence: Synthetic oligonucleotide
  Target: FXN; (-) strand; PAM type: NRG; PAM sequence: CGG
gtgggccacaaatcaccact

SEQ ID NO: 13888 - DNA, 20 bp, Artificial Sequence
  Description of Artificial Sequence: Synthetic oligonucleotide
  Target: FXN; (-) strand; PAM type: NRG; PAM sequence: GGG
tccacttgccagtggcctgt

SEQ ID NO: 13889 - DNA, 20 bp, Artificial Sequence
  Description of Artificial Sequence: Synthetic oligonucleotide
  Target: FXN; (-) strand; PAM type: NRG; PAM sequence: TGG
ctccacttgccagtggcctg

SEQ ID NO: 13890 - DNA, 20 bp, Artificial Sequence
  Description of Artificial Sequence: Synthetic oligonucleotide
  Target: FXN; (-) strand; PAM type: NRG; PAM sequence: TGG
gctctgcctccacttgccag

SEQ ID NO: 13891 - DNA, 20 bp, Artificial Sequence
  Description of Artificial Sequence: Synthetic oligonucleotide
  Target: FXN; (-) strand; PAM type: NRG; PAM sequence: CAG
gcagctctgcctccacttgc

SEQ ID NO: 13892 - DNA, 20 bp, Artificial Sequence
  Description of Artificial Sequence: Synthetic oligonucleotide
  Target: FXN; (-) strand; PAM type: NRG; PAM sequence: CAG
tgtggctcccgagggctctg

SEQ ID NO: 13893 - DNA, 20 bp, Artificial Sequence
  Description of Artificial Sequence: Synthetic oligonucleotide
  Target: FXN; (-) strand; PAM type: NRG; PAM sequence: GGG
aggccctctgtggctcccga

SEQ ID NO: 13894 - DNA, 20 bp, Artificial Sequence
  Description of Artificial Sequence: Synthetic oligonucleotide
  Target: FXN; (-) strand; PAM type: NRG; PAM sequence: AGG
caggccctctgtggctcccg

SEQ ID NO: 13895 - DNA, 20 bp, Artificial Sequence
  Description of Artificial Sequence: Synthetic oligonucleotide
  Target: FXN; (-) strand; PAM type: NRG; PAM sequence: GAG
gcaggccctctgtggctccc

SEQ ID NO: 13896 - DNA, 20 bp, Artificial Sequence
  Description of Artificial Sequence: Synthetic oligonucleotide
  Target: FXN; (-) strand; PAM type: NRG; PAM sequence: TGG
ggcggccagcaggccctctg

SEQ ID NO: 13897 - DNA, 20 bp, Artificial Sequence
  Description of Artificial Sequence: Synthetic oligonucleotide
  Target: FXN; (-) strand; PAM type: NRG; PAM sequence: AGG
ggcatgtcgtggcggccagc

SEQ ID NO: 13898 - DNA, 20 bp, Artificial Sequence
  Description of Artificial Sequence: Synthetic oligonucleotide
  Target: FXN; (-) strand; PAM type: NRG; PAM sequence: CAG
tggcatgtcgtggcggccag

SEQ ID NO: 13899 - DNA, 20 bp, Artificial Sequence
  Description of Artificial Sequence: Synthetic oligonucleotide
  Target: FXN; (-) strand; PAM type: NRG; PAM sequence: CAG
agttggcatgtcgtggcggc

SEQ ID NO: 13900 - DNA, 20 bp, Artificial Sequence
  Description of Artificial Sequence: Synthetic oligonucleotide
  Target: FXN; (-) strand; PAM type: NRG; PAM sequence: CGG
gctgagttggcatgtcgtgg

SEQ ID NO: 13901 - DNA, 20 bp, Artificial Sequence
  Description of Artificial Sequence: Synthetic oligonucleotide
  Target: FXN; (-) strand; PAM type: NRG; PAM sequence: TGG
gcagctgagttggcatgtcg

SEQ ID NO: 13902 - DNA, 20 bp, Artificial Sequence
  Description of Artificial Sequence: Synthetic oligonucleotide
  Target: FXN; (-) strand; PAM type: NRG; PAM sequence: TGG
agggccagcagcagctgagt

SEQ ID NO: 13903 - DNA, 20 bp, Artificial Sequence
  Description of Artificial Sequence: Synthetic oligonucleotide
  Target: FXN; (-) strand; PAM type: NRG; PAM sequence: GAG
caggagggccagcagcagct

SEQ ID NO: 13904 - DNA, 20 bp, Artificial Sequence
  Description of Artificial Sequence: Synthetic oligonucleotide
  Target: FXN; (-) strand; PAM type: NRG; PAM sequence: CAG
gcccacaggagggccagcag

SEQ ID NO: 13905 - DNA, 20 bp, Artificial Sequence
  Description of Artificial Sequence: Synthetic oligonucleotide
  Target: FXN; (-) strand; PAM type: NRG; PAM sequence: CAG
gccgcccacaggagggccag

SEQ ID NO: 13906 - DNA, 20 bp, Artificial Sequence
  Description of Artificial Sequence: Synthetic oligonucleotide
  Target: FXN; (-) strand; PAM type: NRG; PAM sequence: CAG
actgccgcccacaggagggc

SEQ ID NO: 13907 - DNA, 20 bp, Artificial Sequence
  Description of Artificial Sequence: Synthetic oligonucleotide
  Target: FXN; (-) strand; PAM type: NRG; PAM sequence: GGG
tagcactgccgcccacagga

SEQ ID NO: 13908 - DNA, 20 bp, Artificial Sequence
  Description of Artificial Sequence: Synthetic oligonucleotide
  Target: FXN; (-) strand; PAM type: NRG; PAM sequence: AGG
ctagcactgccgcccacagg

SEQ ID NO: 13909 - DNA, 20 bp, Artificial Sequence
  Description of Artificial Sequence: Synthetic oligonucleotide
  Target: FXN; (-) strand; PAM type: NRG; PAM sequence: GAG
actagcactgccgcccacag

SEQ ID NO: 13910 - DNA, 20 bp, Artificial Sequence
  Description of Artificial Sequence: Synthetic oligonucleotide
  Target: FXN; (-) strand; PAM type: NRG; PAM sequence: AGG
tcactagcactgccgcccac

SEQ ID NO: 13911 - DNA, 20 bp, Artificial Sequence
  Description of Artificial Sequence: Synthetic oligonucleotide
  Target: FXN; (-) strand; PAM type: NRG; PAM sequence: CAG
atcactagcactgccgccca

SEQ ID NO: 13912 - DNA, 20 bp, Artificial Sequence
  Description of Artificial Sequence: Synthetic oligonucleotide
  Target: FXN; (-) strand; PAM type: NRG; PAM sequence: TAG
cctaagattctgcacatcac

SEQ ID NO: 13913 - DNA, 20 bp, Artificial Sequence
  Description of Artificial Sequence: Synthetic oligonucleotide
  Target: FXN; (-) strand; PAM type: NRG; PAM sequence: AAG
ggttccttggcactagtcct

SEQ ID NO: 13914 - DNA, 20 bp, Artificial Sequence
  Description of Artificial Sequence: Synthetic oligonucleotide
  Target: FXN; (-) strand; PAM type: NRG; PAM sequence: TAG
atttataggttccttggcac

SEQ ID NO: 13915 - DNA, 20 bp, Artificial Sequence
  Description of Artificial Sequence: Synthetic oligonucleotide
  Target: FXN; (-) strand; PAM type: NRG; PAM sequence: TGG
cagggtatttataggttcct

SEQ ID NO: 13916 - DNA, 20 bp, Artificial Sequence
  Description of Artificial Sequence: Synthetic oligonucleotide
  Target: FXN; (-) strand; PAM type: NRG; PAM sequence: AGG
gggtcacccagggtatttat

SEQ ID NO: 13917 - DNA, 20 bp, Artificial Sequence
  Description of Artificial Sequence: Synthetic oligonucleotide
  Target: FXN; (-) strand; PAM type: NRG; PAM sequence: TAG
tgggtcacccagggtattta

SEQ ID NO: 13918 - DNA, 20 bp, Artificial Sequence
  Description of Artificial Sequence: Synthetic oligonucleotide
  Target: FXN; (-) strand; PAM type: NRG; PAM sequence: GGG
gtgcacgcctgggtcaccca

SEQ ID NO: 13919 - DNA, 20 bp, Artificial Sequence
  Description of Artificial Sequence: Synthetic oligonucleotide
  Target: FXN; (-) strand; PAM type: NRG; PAM sequence: AGG
agtgcacgcctgggtcaccc

SEQ ID NO: 13920 - DNA, 20 bp, Artificial Sequence
  Description of Artificial Sequence: Synthetic oligonucleotide
  Target: FXN; (-) strand; PAM type: NRG; PAM sequence: CAG
cagtgcacgcctgggtcacc

SEQ ID NO: 13921 - DNA, 20 bp, Artificial Sequence
  Description of Artificial Sequence: Synthetic oligonucleotide
  Target: FXN; (-) strand; PAM type: NRG; PAM sequence: GGG
caccacagcagtgcacgcct

SEQ ID NO: 13922 - DNA, 20 bp, Artificial Sequence
  Description of Artificial Sequence: Synthetic oligonucleotide
  Target: FXN; (-) strand; PAM type: NRG; PAM sequence: TGG
ccaccacagcagtgcacgcc

SEQ ID NO: 13923 - DNA, 20 bp, Artificial Sequence
  Description of Artificial Sequence: Synthetic oligonucleotide
  Target: FXN; (-) strand; PAM type: NRG; PAM sequence: CAG
gactgtgaaggccaccacag

SEQ ID NO: 13924 - DNA, 20 bp, Artificial Sequence
  Description of Artificial Sequence: Synthetic oligonucleotide
  Target: FXN; (-) strand; PAM type: NRG; PAM sequence: CAG
tctgactgtgaaggccacca

SEQ ID NO: 13925 - DNA, 20 bp, Artificial Sequence
  Description of Artificial Sequence: Synthetic oligonucleotide
  Target: FXN; (-) strand; PAM type: NRG; PAM sequence: AGG
ttgtcatcttctgactgtga

SEQ ID NO: 13926 - DNA, 20 bp, Artificial Sequence
  Description of Artificial Sequence: Synthetic oligonucleotide
  Target: FXN; (-) strand; PAM type: NRG; PAM sequence: AAG
cttgtcatcttctgactgtg

SEQ ID NO: 13927 - DNA, 20 bp, Artificial Sequence
  Description of Artificial Sequence: Synthetic oligonucleotide
  Target: FXN; (-) strand; PAM type: NRG; PAM sequence: CAG
tgggccgattctccccttct

SEQ ID NO: 13928 - DNA, 20 bp, Artificial Sequence
  Description of Artificial Sequence: Synthetic oligonucleotide
  Target: FXN; (-) strand; PAM type: NRG; PAM sequence: GGG
ctttctgtggatctcacctt

SEQ ID NO: 13929 - DNA, 20 bp, Artificial Sequence
  Description of Artificial Sequence: Synthetic oligonucleotide
  Target: FXN; (-) strand; PAM type: NRG; PAM sequence: TGG
cctttctgtggatctcacct

SEQ ID NO: 13930 - DNA, 20 bp, Artificial Sequence
  Description of Artificial Sequence: Synthetic oligonucleotide
  Target: FXN; (-) strand; PAM type: NRG; PAM sequence: TGG
tcttggccctggcctttctg

SEQ ID NO: 13931 - DNA, 20 bp, Artificial Sequence
  Description of Artificial Sequence: Synthetic oligonucleotide
  Target: FXN; (-) strand; PAM type: NRG; PAM sequence: TGG
tgctggccgcatcttggccc

SEQ ID NO: 13932 - DNA, 20 bp, Artificial Sequence
  Description of Artificial Sequence: Synthetic oligonucleotide
  Target: FXN; (-) strand; PAM type: NRG; PAM sequence: TGG
ctgaggtgctggccgcatct

SEQ ID NO: 13933 - DNA, 20 bp, Artificial Sequence
  Description of Artificial Sequence: Synthetic oligonucleotide
  Target: FXN; (-) strand; PAM type: NRG; PAM sequence: TGG
ccaccaccagcctgaggtgc

SEQ ID NO: 13934 - DNA, 20 bp, Artificial Sequence
  Description of Artificial Sequence: Synthetic oligonucleotide
  Target: FXN; (-) strand; PAM type: NRG; PAM sequence: AGG
gtaagaccaccaccagcctg

SEQ ID NO: 13935 - DNA, 20 bp, Artificial Sequence
  Description of Artificial Sequence: Synthetic oligonucleotide
  Target: FXN; (-) strand; PAM type: NRG; PAM sequence: GAG
cgtaagaccaccaccagcct

SEQ ID NO: 13936 - DNA, 20 bp, Artificial Sequence
  Description of Artificial Sequence: Synthetic oligonucleotide
  Target: FXN; (-) strand; PAM type: NRG; PAM sequence: CAG
ggtcaacgtaagaccaccac

SEQ ID NO: 13937 - DNA, 20 bp, Artificial Sequence
  Description of Artificial Sequence: Synthetic oligonucleotide
  Target: FXN; (-) strand; PAM type: NRG; PAM sequence: AAG
gcctctggcatggtcaacgt

SEQ ID NO: 13938 - DNA, 20 bp, Artificial Sequence
  Description of Artificial Sequence: Synthetic oligonucleotide
  Target: FXN; (-) strand; PAM type: NRG; PAM sequence: TGG
tcaaggactggcctctggca

SEQ ID NO: 13939 - DNA, 20 bp, Artificial Sequence
  Description of Artificial Sequence: Synthetic oligonucleotide
  Target: FXN; (-) strand; PAM type: NRG; PAM sequence: TGG
agcaatcaaggactggcctc

SEQ ID NO: 13940 - DNA, 20 bp, Artificial Sequence
  Description of Artificial Sequence: Synthetic oligonucleotide
  Target: FXN; (-) strand; PAM type: NRG; PAM sequence: TGG
ggtttggagcaatcaaggac

SEQ ID NO: 13941 - DNA, 20 bp, Artificial Sequence
  Description of Artificial Sequence: Synthetic oligonucleotide
  Target: FXN; (-) strand; PAM type: NRG; PAM sequence: AGG
cagagggtttggagcaatca

SEQ ID NO: 13942 - DNA, 20 bp, Artificial Sequence
  Description of Artificial Sequence: Synthetic oligonucleotide
  Target: FXN; (-) strand; PAM type: NRG; PAM sequence: AAG
acagagggtttggagcaatc

SEQ ID NO: 13943 - DNA, 20 bp, Artificial Sequence
  Description of Artificial Sequence: Synthetic oligonucleotide
  Target: FXN; (-) strand; PAM type: NRG; PAM sequence: GAG
accctcgaacagagggtttg

SEQ ID NO: 13944 - DNA, 20 bp, Artificial Sequence
  Description of Artificial Sequence: Synthetic oligonucleotide
  Target: FXN; (-) strand; PAM type: NRG; PAM sequence: TGG
gaaccctcgaacagagggtt

SEQ ID NO: 13945 - DNA, 20 bp, Artificial Sequence
  Description of Artificial Sequence: Synthetic oligonucleotide
  Target: FXN; (-) strand; PAM type: NRG; PAM sequence: GGG
atttggaaccctcgaacaga

SEQ ID NO: 13946 - DNA, 20 bp, Artificial Sequence
  Description of Artificial Sequence: Synthetic oligonucleotide
  Target: FXN; (-) strand; PAM type: NRG; PAM sequence: AGG
catttggaaccctcgaacag

SEQ ID NO: 13947 - DNA, 20 bp, Artificial Sequence
  Description of Artificial Sequence: Synthetic oligonucleotide
  Target: FXN; (-) strand; PAM type: NRG; PAM sequence: GAG
tcatttggaaccctcgaaca

SEQ ID NO: 13948 - DNA, 20 bp, Artificial Sequence
  Description of Artificial Sequence: Synthetic oligonucleotide
  Target: FXN; (-) strand; PAM type: NRG; PAM sequence: CAG
tttcatttggaaccctcgaa

SEQ ID NO: 13949 - DNA, 20 bp, Artificial Sequence
  Description of Artificial Sequence: Synthetic oligonucleotide
  Target: FXN; (-) strand; PAM type: NRG; PAM sequence: TGG
gaggacctgctcatttcatt

SEQ ID NO: 13950 - DNA, 20 bp, Artificial Sequence
  Description of Artificial Sequence: Synthetic oligonucleotide
  Target: FXN; (-) strand; PAM type: NRG; PAM sequence: AGG
ctaacctaggtcctgacacg

SEQ ID NO: 13951 - DNA, 20 bp, Artificial Sequence
  Description of Artificial Sequence: Synthetic oligonucleotide
  Target: FXN; (-) strand; PAM type: NRG; PAM sequence: GAG
actaacctaggtcctgacac

SEQ ID NO: 13952 - DNA, 20 bp, Artificial Sequence
  Description of Artificial Sequence: Synthetic oligonucleotide
  Target: FXN; (-) strand; PAM type: NRG; PAM sequence: AGG
gctttttcagaaactaacct

SEQ ID NO: 13953 - DNA, 20 bp, Artificial Sequence
  Description of Artificial Sequence: Synthetic oligonucleotide
  Target: FXN; (-) strand; PAM type: NRG; PAM sequence: TAG
tgctttttcagaaactaacc

SEQ ID NO: 13954 - DNA, 20 bp, Artificial Sequence
  Description of Artificial Sequence: Synthetic oligonucleotide
  Target: FXN; (-) strand; PAM type: NRG; PAM sequence: CAG
gcctgcttttcatgcttttt

SEQ ID NO: 13955 - DNA, 20 bp, Artificial Sequence
  Description of Artificial Sequence: Synthetic oligonucleotide
  Target: FXN; (-) strand; PAM type: NRG; PAM sequence: AGG
gtcactcggggaagttcagg

SEQ ID NO: 13956 - DNA, 20 bp, Artificial Sequence
  Description of Artificial Sequence: Synthetic oligonucleotide
  Target: FXN; (-) strand; PAM type: NRG; PAM sequence: GAG
agtcactcggggaagttcag

SEQ ID NO: 13957 - DNA, 20 bp, Artificial Sequence
  Description of Artificial Sequence: Synthetic oligonucleotide
  Target: FXN; (-) strand; PAM type: NRG; PAM sequence: AGG
tcagtcactcggggaagttc

SEQ ID NO: 13958 - DNA, 20 bp, Artificial Sequence
  Description of Artificial Sequence: Synthetic oligonucleotide
  Target: FXN; (-) strand; PAM type: NRG; PAM sequence: CAG
atcagtcactcggggaagtt

SEQ ID NO: 13959 - DNA, 20 bp, Artificial Sequence
  Description of Artificial Sequence: Synthetic oligonucleotide
  Target: FXN; (-) strand; PAM type: NRG; PAM sequence: AAG
tttgcatcagtcactcgggg

SEQ ID NO: 13960 - DNA, 20 bp, Artificial Sequence
  Description of Artificial Sequence: Synthetic oligonucleotide
  Target: FXN; (-) strand; PAM type: NRG; PAM sequence: GGG
cactttgcatcagtcactcg

SEQ ID NO: 13961 - DNA, 20 bp, Artificial Sequence
  Description of Artificial Sequence: Synthetic oligonucleotide
  Target: FXN; (-) strand; PAM type: NRG; PAM sequence: GGG
gcactttgcatcagtcactc

SEQ ID NO: 13962 - DNA, 20 bp, Artificial Sequence
  Description of Artificial Sequence: Synthetic oligonucleotide
  Target: FXN; (-) strand; PAM type: NRG; PAM sequence: CGG
cgcactttgcatcagtcact

SEQ ID NO: 13963 - DNA, 20 bp, Artificial Sequence
  Description of Artificial Sequence: Synthetic oligonucleotide
  Target: FXN; (-) strand; PAM type: NRG; PAM sequence: CAG
atgcaggacgcactttgcat

SEQ ID NO: 13964 - DNA, 20 bp, Artificial Sequence
  Description of Artificial Sequence: Synthetic oligonucleotide
  Target: FXN; (-) strand; PAM type: NRG; PAM sequence: AGG
catggtgctgtgaagcatgc

SEQ ID NO: 13965 - DNA, 20 bp, Artificial Sequence
  Description of Artificial Sequence: Synthetic oligonucleotide
  Target: FXN; (-) strand; PAM type: NRG; PAM sequence: CAG
ccatggtgctgtgaagcatg

SEQ ID NO: 13966 - DNA, 20 bp, Artificial Sequence
  Description of Artificial Sequence: Synthetic oligonucleotide
  Target: FXN; (-) strand; PAM type: NRG; PAM sequence: AAG
atcctctccatggtgctgtg

SEQ ID NO: 13967 - DNA, 20 bp, Artificial Sequence
  Description of Artificial Sequence: Synthetic oligonucleotide
  Target: FXN; (-) strand; PAM type: NRG; PAM sequence: TGG
gcccctgaagatcctctcca

SEQ ID NO: 13968 - DNA, 20 bp, Artificial Sequence
  Description of Artificial Sequence: Synthetic oligonucleotide
  Target: FXN; (-) strand; PAM type: NRG; PAM sequence: AAG
tagtctgcagtttgcccctg

SEQ ID NO: 13969 - DNA, 20 bp, Artificial Sequence
  Description of Artificial Sequence: Synthetic oligonucleotide
  Target: FXN; (-) strand; PAM type: NRG; PAM sequence: CAG
gccgtcattcagatagtctg

SEQ ID NO: 13970 - DNA, 20 bp, Artificial Sequence
  Description of Artificial Sequence: Synthetic oligonucleotide
  Target: FXN; (-) strand; PAM type: NRG; PAM sequence: TAG
ggtcagtgccgtcattcaga

SEQ ID NO: 13971 - DNA, 20 bp, Artificial Sequence
  Description of Artificial Sequence: Synthetic oligonucleotide
  Target: FXN; (-) strand; PAM type: NRG; PAM sequence: CAG
tgatggtcagtgccgtcatt

SEQ ID NO: 13972 - DNA, 20 bp, Artificial Sequence
  Description of Artificial Sequence: Synthetic oligonucleotide
  Target: FXN; (-) strand; PAM type: NRG; PAM sequence: CAG
ctctgcggtttgctgatggt

SEQ ID NO: 13973 - DNA, 20 bp, Artificial Sequence
  Description of Artificial Sequence: Synthetic oligonucleotide
  Target: FXN; (-) strand; PAM type: NRG; PAM sequence: TGG
gcagctctgcggtttgctga

SEQ ID NO: 13974 - DNA, 20 bp, Artificial Sequence
  Description of Artificial Sequence: Synthetic oligonucleotide
  Target: FXN; (-) strand; PAM type: NRG; PAM sequence: CGG
ttcttggtcaggcagctctg

SEQ ID NO: 13975 - DNA, 20 bp, Artificial Sequence
  Description of Artificial Sequence: Synthetic oligonucleotide
  Target: FXN; (-) strand; PAM type: NRG; PAM sequence: CAG
ctcgcaatttcttggtcagg

SEQ ID NO: 13976 - DNA, 20 bp, Artificial Sequence
  Description of Artificial Sequence: Synthetic oligonucleotide
  Target: FXN; (-) strand; PAM type: NRG; PAM sequence: AGG
tgtctcgcaatttcttggtc

SEQ ID NO: 13977 - DNA, 20 bp, Artificial Sequence
  Description of Artificial Sequence: Synthetic oligonucleotide
  Target: FXN; (-) strand; PAM type: NRG; PAM sequence: CAG
ctgtctcgcaatttcttggt

SEQ ID NO: 13978 - DNA, 20 bp, Artificial Sequence
  Description of Artificial Sequence: Synthetic oligonucleotide
  Target: FXN; (-) strand; PAM type: NRG; PAM sequence: TGG
gcttctgtctcgcaatttct

SEQ ID NO: 13979 - DNA, 20 bp, Artificial Sequence
  Description of Artificial Sequence: Synthetic oligonucleotide
  Target: FXN; (-) strand; PAM type: NRG; PAM sequence: AAG
gccccttcttcttcgcctgc

SEQ ID NO: 13980 - DNA, 20 bp, Artificial Sequence
  Description of Artificial Sequence: Synthetic oligonucleotide
  Target: FXN; (-) strand; PAM type: NRG; PAM sequence: TGG
caggcgtgagccactgtgtc

SEQ ID NO: 13981 - DNA, 20 bp, Artificial Sequence
  Description of Artificial Sequence: Synthetic oligonucleotide
  Target: FXN; (-) strand; PAM type: NRG; PAM sequence: GAG
agtgctgggattacaggcgt

SEQ ID NO: 13982 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctgggattac

SEQ ID NO: 13983 - DNA, 20 bp, Artificial Sequence
  Description of Artificial Sequence: Synthetic oligonucleotide
  Target: FXN; (-) strand; PAM type: NRG; PAM sequence: CAG
ctcccaaagtgctgggatta

SEQ ID NO: 13984 - DNA, 20 bp, Artificial Sequence
  Description of Artificial Sequence: Synthetic oligonucleotide
  Target: FXN; (-) strand; PAM type: NRG; PAM sequence: GGG
ccttggcctcccaaagtgct

SEQ ID NO: 13985 - DNA, 20 bp, Artificial Sequence
  Description of Artificial Sequence: Synthetic oligonucleotide
  Target: FXN; (-) strand; PAM type: NRG; PAM sequence: TGG
gccttggcctcccaaagtgc

SEQ ID NO: 13986 - DNA, 20 bp, Artificial Sequence
  Description of Artificial Sequence: Synthetic oligonucleotide
  Target: FXN; (-) strand; PAM type: NRG; PAM sequence: AAG
ccgcctgccttggcctccca

SEQ ID NO: 13987 - DNA, 20 bp, Artificial Sequence
  Description of Artificial Sequence: Synthetic oligonucleotide
  Target: FXN; (-) strand; PAM type: NRG; PAM sequence: TGG
ctcaagtgatccgcctgcct

SEQ ID NO: 13988 - DNA, 20 bp, Artificial Sequence
  Description of Artificial Sequence: Synthetic oligonucleotide
  Target: FXN; (-) strand; PAM type: NRG; PAM sequence: AAG
ggtctcaaactcctgacctc

SEQ ID NO: 13989 - DNA, 20 bp, Artificial Sequence
  Description of Artificial Sequence: Synthetic oligonucleotide
  Target: FXN; (-) strand; PAM type: NRG; PAM sequence: TGG
tttcactatgttgcccaggc

SEQ ID NO: 13990 - DNA, 20 bp, Artificial Sequence
  Description of Artificial Sequence: Synthetic oligonucleotide
  Target: FXN; (-) strand; PAM type: NRG; PAM sequence: AGG
agggtttcactatgttgccc

SEQ ID NO: 13991 - DNA, 20 bp, Artificial Sequence
  Description of Artificial Sequence: Synthetic oligonucleotide
  Target: FXN; (-) strand; PAM type: NRG; PAM sequence: CAG
cagggtttcactatgttgcc

SEQ ID NO: 13992 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagagaca

SEQ ID NO: 13993 - DNA, 20 bp, Artificial Sequence
  Description of Artificial Sequence: Synthetic oligonucleotide
  Target: FXN; (-) strand; PAM type: NRG; PAM sequence: AGG
tttgtatttttagtagagac

SEQ ID NO: 13994 - DNA, 20 bp, Artificial Sequence
  Description of Artificial Sequence: Synthetic oligonucleotide
  Target: FXN; (-) strand; PAM type: NRG; PAM sequence: CAG
ttttgtatttttagtagaga

SEQ ID NO: 13995 - DNA, 20 bp, Artificial Sequence
  Description of Artificial Sequence: Synthetic oligonucleotide
  Target: FXN; (-) strand; PAM type: NRG; PAM sequence: GAG
aattttttgtatttttagta

SEQ ID NO: 13996 - DNA, 20 bp, Artificial Sequence
  Description of Artificial Sequence: Synthetic oligonucleotide
  Target: FXN; (-) strand; PAM type: NRG; PAM sequence: TAG
cgaattttttgtatttttag

SEQ ID NO: 13997 - DNA, 20 bp, Artificial Sequence
  Description of Artificial Sequence: Synthetic oligonucleotide
  Target: FXN; (-) strand; PAM type: NRG; PAM sequence: TAG
tggcgaattttttgtatttt

SEQ ID NO: 13998 - DNA, 20 bp, Artificial Sequence
  Description of Artificial Sequence: Synthetic oligonucleotide
  Target: FXN; (-) strand; PAM type: NRG; PAM sequence: TGG
caggtgcctgccaccatgcc

SEQ ID NO: 13999 - DNA, 20 bp, Artificial Sequence
  Description of Artificial Sequence: Synthetic oligonucleotide
  Target: FXN; (-) strand; PAM type: NRG; PAM sequence: AGG
tcccaagcagctgggattac

SEQ ID NO: 14000 - DNA, 20 bp, Artificial Sequence
  Description of Artificial Sequence: Synthetic oligonucleotide
  Target: FXN; (-) strand; PAM type: NRG; PAM sequence: CAG
ctcccaagcagctgggatta

SEQ ID NO: 14001 - DNA, 20 bp, Artificial Sequence
  Description of Artificial Sequence: Synthetic oligonucleotide
  Target: FXN; (-) strand; PAM type: NRG; PAM sequence: GGG
tctcagtctcccaagcagct

SEQ ID NO: 14002 - DNA, 20 bp, Artificial Sequence
  Description of Artificial Sequence: Synthetic oligonucleotide
  Target: FXN; (-) strand; PAM type: NRG; PAM sequence: TGG
gtctcagtctcccaagcagc

SEQ ID NO: 14003 - DNA, 20 bp, Artificial Sequence
  Description of Artificial Sequence: Synthetic oligonucleotide
  Target: FXN; (-) strand; PAM type: NRG; PAM sequence: CAG
tcctgtctcagtctcccaag

SEQ ID NO: 14004 - DNA, 20 bp, Artificial Sequence
  Description of Artificial Sequence: Synthetic oligonucleotide
  Target: FXN; (-) strand; PAM type: NRG; PAM sequence: AAG
ttctcctgtctcagtctccc

SEQ ID NO: 14005 - DNA, 20 bp, Artificial Sequence
  Description of Artificial Sequence: Synthetic oligonucleotide
  Target: FXN; (-) strand; PAM type: NRG; PAM sequence: CAG
ttcaagcaattctcctgtct

SEQ ID NO: 14006 - DNA, 20 bp, Artificial Sequence
  Description of Artificial Sequence: Synthetic oligonucleotide
  Target: FXN; (-) strand; PAM type: NRG; PAM sequence: AAG
aaccttcgcctcctgggttc

SEQ ID NO: 14007 - DNA, 20 bp, Artificial Sequence
  Description of Artificial Sequence: Synthetic oligonucleotide
  Target: FXN; (-) strand; PAM type: NRG; PAM sequence: GGG
cgttacaaccttcgcctcct

SEQ ID NO: 14008 - DNA, 20 bp, Artificial Sequence
  Description of Artificial Sequence: Synthetic oligonucleotide
  Target: FXN; (-) strand; PAM type: NRG; PAM sequence: TGG
tcgttacaaccttcgcctcc

SEQ ID NO: 14009 - DNA, 20 bp, Artificial Sequence
  Description of Artificial Sequence: Synthetic oligonucleotide
  Target: FXN; (-) strand; PAM type: NRG; PAM sequence: CAG
ggagtgctgtggcacgattt

SEQ ID NO: 14010 - DNA, 20 bp, Artificial Sequence
  Description of Artificial Sequence: Synthetic oligonucleotide
  Target: FXN; (-) strand; PAM type: NRG; PAM sequence: TGG
tcgcccaggatggagtgctg

SEQ ID NO: 14011 - DNA, 20 bp, Artificial Sequence
  Description of Artificial Sequence: Synthetic oligonucleotide
  Target: FXN; (-) strand; PAM type: NRG; PAM sequence: GAG
tcactctgtcgcccaggatg

SEQ ID NO: 14012 - DNA, 20 bp, Artificial Sequence
  Description of Artificial Sequence: Synthetic oligonucleotide
  Target: FXN; (-) strand; PAM type: NRG; PAM sequence: TGG
tctcactctgtcgcccagga

SEQ ID NO: 14013 - DNA, 20 bp, Artificial Sequence
  Description of Artificial Sequence: Synthetic oligonucleotide
  Target: FXN; (-) strand; PAM type: NRG; PAM sequence: AGG
acagtctcactctgtcgccc

SEQ ID NO: 14014 - DNA, 20 bp, Artificial Sequence
  Description of Artificial Sequence: Synthetic oligonucleotide
  Target: FXN; (-) strand; PAM type: NRG; PAM sequence: CAG
gacagtctcactctgtcgcc

SEQ ID NO: 14015 - DNA, 20 bp, Artificial Sequence
  Description of Artificial Sequence: Synthetic oligonucleotide
  Target: FXN; (-) strand; PAM type: NRG; PAM sequence: CAG
ttctcctcctttttttgaga

SEQ ID NO: 14016 - DNA, 20 bp, Artificial Sequence
  Description of Artificial Sequence: Synthetic oligonucleotide
  Target: FXN; (-) strand; PAM type: NRG; PAM sequence: GAG
cttcttctcctccttttttt

SEQ ID NO: 14017 - DNA, 20 bp, Artificial Sequence
  Description of Artificial Sequence: Synthetic oligonucleotide
  Target: FXN; (-) strand; PAM type: NRG; PAM sequence: TGG
ggcctgtttcattcctgcct

SEQ ID NO: 14018 - DNA, 20 bp, Artificial Sequence
  Description of Artificial Sequence: Synthetic oligonucleotide
  Target: FXN; (-) strand; PAM type: NRG; PAM sequence: TGG
ttgcttcactccaacattca

SEQ ID NO: 14019 - DNA, 20 bp, Artificial Sequence
  Description of Artificial Sequence: Synthetic oligonucleotide
  Target: FXN; (-) strand; PAM type: NRG; PAM sequence: CAG
gccgcttagcacgaggaggc

SEQ ID NO: 14020 - DNA, 20 bp, Artificial Sequence
  Description of Artificial Sequence: Synthetic oligonucleotide
  Target: FXN; (-) strand; PAM type: NRG; PAM sequence: AGG
agtagccgcttagcacgagg

SEQ ID NO: 14021 - DNA, 20 bp, Artificial Sequence
  Description of Artificial Sequence: Synthetic oligonucleotide
  Target: FXN; (-) strand; PAM type: NRG; PAM sequence: GAG
cagtagccgcttagcacgag

SEQ ID NO: 14022 - DNA, 20 bp, Artificial Sequence
  Description of Artificial Sequence: Synthetic oligonucleotide
  Target: FXN; (-) strand; PAM type: NRG; PAM sequence: AGG
cacagtagccgcttagcacg

SEQ ID NO: 14023 - DNA, 20 bp, Artificial Sequence
  Description of Artificial Sequence: Synthetic oligonucleotide
  Target: FXN; (-) strand; PAM type: NRG; PAM sequence: GAG
tcacagtagccgcttagcac

SEQ ID NO: 14024 - DNA, 20 bp, Artificial Sequence
  Description of Artificial Sequence: Synthetic oligonucleotide
  Target: FXN; (-) strand; PAM type: NRG; PAM sequence: TAG
aagaactcacagtagccgct

SEQ ID NO: 14025 - DNA, 20 bp, Artificial Sequence
  Description of Artificial Sequence: Synthetic oligonucleotide
  Target: FXN; (-) strand; PAM type: NRG; PAM sequence: TAG
ggagtggaaagaactcacag

SEQ ID NO: 14026 - DNA, 20 bp, Artificial Sequence
  Description of Artificial Sequence: Synthetic oligonucleotide
  Target: FXN; (-) strand; PAM type: NRG; PAM sequence: CAG
gggggagtggaaagaactca

SEQ ID NO: 14027 - DNA, 20 bp, Artificial Sequence
  Description of Artificial Sequence: Synthetic oligonucleotide
  Target: FXN; (-) strand; PAM type: NRG; PAM sequence: AAG
caatgtcttgggggagtgga

SEQ ID NO: 14028 - DNA, 20 bp, Artificial Sequence
  Description of Artificial Sequence: Synthetic oligonucleotide
  Target: FXN; (-) strand; PAM type: NRG; PAM sequence: TGG
tatgcaatgtcttgggggag

SEQ ID NO: 14029 - DNA, 20 bp, Artificial Sequence
  Description of Artificial Sequence: Synthetic oligonucleotide
  Target: FXN; (-) strand; PAM type: NRG; PAM sequence: GAG
atttatgcaatgtcttgggg

SEQ ID NO: 14030 - DNA, 20 bp, Artificial Sequence
  Description of Artificial Sequence: Synthetic oligonucleotide
  Target: FXN; (-) strand; PAM type: NRG; PAM sequence: GGG
ttatttatgcaatgtcttgg

SEQ ID NO: 14031 - DNA, 20 bp, Artificial Sequence
  Description of Artificial Sequence: Synthetic oligonucleotide
  Target: FXN; (-) strand; PAM type: NRG; PAM sequence: GGG
attatttatgcaatgtcttg

SEQ ID NO: 14032 - DNA, 20 bp, Artificial Sequence
  Description of Artificial Sequence: Synthetic oligonucleotide
  Target: FXN; (-) strand; PAM type: NRG; PAM sequence: GGG
cattatttatgcaatgtctt

SEQ ID NO: 14033 - DNA, 20 bp, Artificial Sequence
  Description of Artificial Sequence: Synthetic oligonucleotide
  Target: FXN; (-) strand; PAM type: NRG; PAM sequence: TGG
acattatttatgcaatgtct

SEQ ID NO: 14034 - DNA, 20 bp, Artificial Sequence
  Description of Artificial Sequence: Synthetic oligonucleotide
  Target: FXN; (-) strand; PAM type: NRG; PAM sequence: AAG
tcagcggggtgagtgtcaga

SEQ ID NO: 14035 - DNA, 20 bp, Artificial Sequence
  Description of Artificial Sequence: Synthetic oligonucleotide
  Target: FXN; (-) strand; PAM type: NRG; PAM sequence: CAG
acattcagcggggtgagtgt

SEQ ID NO: 14036 - DNA, 20 bp, Artificial Sequence
  Description of Artificial Sequence: Synthetic oligonucleotide
  Target: FXN; (-) strand; PAM type: NRG; PAM sequence: GAG
ggcaggacattcagcggggt

SEQ ID NO: 14037 - DNA, 20 bp, Artificial Sequence
  Description of Artificial Sequence: Synthetic oligonucleotide
  Target: FXN; (-) strand; PAM type: NRG; PAM sequence: GGG
cagaggcaggacattcagcg

SEQ ID NO: 14038 - DNA, 20 bp, Artificial Sequence
  Description of Artificial Sequence: Synthetic oligonucleotide
  Target: FXN; (-) strand; PAM type: NRG; PAM sequence: GGG
gcagaggcaggacattcagc

SEQ ID NO: 14039 - DNA, 20 bp, Artificial Sequence
  Description of Artificial Sequence: Synthetic oligonucleotide
  Target: FXN; (-) strand; PAM type: NRG; PAM sequence: CGG
agcagaggcaggacattcag

SEQ ID NO: 14040 - DNA, 20 bp, Artificial Sequence
  Description of Artificial Sequence: Synthetic oligonucleotide
  Target: FXN; (-) strand; PAM type: NRG; PAM sequence: CAG
ttgagcagaggcaggacatt

SEQ ID NO: 14041 - DNA, 20 bp, Artificial Sequence
  Description of Artificial Sequence: Synthetic oligonucleotide
  Target: FXN; (-) strand; PAM type: NRG; PAM sequence: AGG
taccacccttgagcagaggc

SEQ ID NO: 14042 - DNA, 20 bp, Artificial Sequence
  Description of Artificial Sequence: Synthetic oligonucleotide
  Target: FXN; (-) strand; PAM type: NRG; PAM sequence: CAG
ataccacccttgagcagagg

SEQ ID NO: 14043 - DNA, 20 bp, Artificial Sequence
  Description of Artificial Sequence: Synthetic oligonucleotide
  Target: FXN; (-) strand; PAM type: NRG; PAM sequence: AGG
atcataccacccttgagcag

SEQ ID NO: 14044 - DNA, 20 bp, Artificial Sequence
  Description of Artificial Sequence: Synthetic oligonucleotide
  Target: FXN; (-) strand; PAM type: NRG; PAM sequence: GAG
catcataccacccttgagca

SEQ ID NO: 14045 - DNA, 20 bp, Artificial Sequence
  Description of Artificial Sequence: Synthetic oligonucleotide
  Target: FXN; (-) strand; PAM type: NRG; PAM sequence: CAG
cccatcataccacccttgag

SEQ ID NO: 14046 - DNA, 20 bp, Artificial Sequence
  Description of Artificial Sequence: Synthetic oligonucleotide
  Target: FXN; (-) strand; PAM type: NRG; PAM sequence: GAG
gtccccatcataccaccctt

SEQ ID NO: 14047 - DNA, 20 bp, Artificial Sequence
  Description of Artificial Sequence: Synthetic oligonucleotide
  Target: FXN; (-) strand; PAM type: NRG; PAM sequence: AAG
ccctgttcccctccactgcc

SEQ ID NO: 14048 - DNA, 20 bp, Artificial Sequence
  Description of Artificial Sequence: Synthetic oligonucleotide
  Target: FXN; (-) strand; PAM type: NRG; PAM sequence: TGG
agcggggagaccaccatgtc

SEQ ID NO: 14049 - DNA, 20 bp, Artificial Sequence
  Description of Artificial Sequence: Synthetic oligonucleotide
  Target: FXN; (-) strand; PAM type: NRG; PAM sequence: GAG
acttgtagccaggaagcggg

SEQ ID NO: 14050 - DNA, 20 bp, Artificial Sequence
  Description of Artificial Sequence: Synthetic oligonucleotide
  Target: FXN; (-) strand; PAM type: NRG; PAM sequence: GGG
ggacttgtagccaggaagcg

SEQ ID NO: 14051 - DNA, 20 bp, Artificial Sequence
  Description of Artificial Sequence: Synthetic oligonucleotide
  Target: FXN; (-) strand; PAM type: NRG; PAM sequence: GGG
gggacttgtagccaggaagc

SEQ ID NO: 14052 - DNA, 20 bp, Artificial Sequence
  Description of Artificial Sequence: Synthetic oligonucleotide
  Target: FXN; (-) strand; PAM type: NRG; PAM sequence: CGG
agggacttgtagccaggaag

SEQ ID NO: 14053 - DNA, 20 bp, Artificial Sequence
  Description of Artificial Sequence: Synthetic oligonucleotide
  Target: FXN; (-) strand; PAM type: NRG; PAM sequence: AAG
cagagggacttgtagccagg

SEQ ID NO: 14054 - DNA, 20 bp, Artificial Sequence
  Description of Artificial Sequence: Synthetic oligonucleotide
  Target: FXN; (-) strand; PAM type: NRG; PAM sequence: AGG
cttcagagggacttgtagcc

SEQ ID NO: 14055 - DNA, 20 bp, Artificial Sequence
  Description of Artificial Sequence: Synthetic oligonucleotide
  Target: FXN; (-) strand; PAM type: NRG; PAM sequence: CAG
tcttcagagggacttgtagc

SEQ ID NO: 14056 - DNA, 20 bp, Artificial Sequence
  Description of Artificial Sequence: Synthetic oligonucleotide
  Target: FXN; (-) strand; PAM type: NRG; PAM sequence: TAG
gatttcttcagagggacttg

SEQ ID NO: 14057 - DNA, 20 bp, Artificial Sequence
  Description of Artificial Sequence: Synthetic oligonucleotide
  Target: FXN; (-) strand; PAM type: NRG; PAM sequence: GGG
ctcctttggatttcttcaga

SEQ ID NO: 14058 - DNA, 20 bp, Artificial Sequence
  Description of Artificial Sequence: Synthetic oligonucleotide
  Target: FXN; (-) strand; PAM type: NRG; PAM sequence: AGG
actcctttggatttcttcag

SEQ ID NO: 14059 - DNA, 20 bp, Artificial Sequence
  Description of Artificial Sequence: Synthetic oligonucleotide
  Target: FXN; (-) strand; PAM type: NRG; PAM sequence: GAG
tactcctttggatttcttca

SEQ ID NO: 14060 - DNA, 20 bp, Artificial Sequence
  Description of Artificial Sequence: Synthetic oligonucleotide
  Target: FXN; (-) strand; PAM type: NRG; PAM sequence: CAG
tttactcctttggatttctt

SEQ ID NO: 14061 - DNA, 20 bp, Artificial Sequence
  Description of Artificial Sequence: Synthetic oligonucleotide
  Target: FXN; (-) strand; PAM type: NRG; PAM sequence: TGG
ctccaagctctttactcctt

SEQ ID NO: 14062 - DNA, 20 bp, Artificial Sequence
  Description of Artificial Sequence: Synthetic oligonucleotide
  Target: FXN; (-) strand; PAM type: NRG; PAM sequence: AAG
cctacagaggcctactctcc

SEQ ID NO: 14063 - DNA, 20 bp, Artificial Sequence
  Description of Artificial Sequence: Synthetic oligonucleotide
  Target: FXN; (-) strand; PAM type: NRG; PAM sequence: AGG
tgtgcccttgcaccctacag

SEQ ID NO: 14064 - DNA, 20 bp, Artificial Sequence
  Description of Artificial Sequence: Synthetic oligonucleotide
  Target: FXN; (-) strand; PAM type: NRG; PAM sequence: GAG
ctgtgcccttgcaccctaca

SEQ ID NO: 14065 - DNA, 20 bp, Artificial Sequence
  Description of Artificial Sequence: Synthetic oligonucleotide
  Target: FXN; (-) strand; PAM type: NRG; PAM sequence: CAG
agctgtgcccttgcacccta

SEQ ID NO: 14066 - DNA, 20 bp, Artificial Sequence
  Description of Artificial Sequence: Synthetic oligonucleotide
  Target: FXN; (-) strand; PAM type: NRG; PAM sequence: CAG
agcctcaggagctccgtctc

SEQ ID NO: 14067 - DNA, 20 bp, Artificial Sequence
  Description of Artificial Sequence: Synthetic oligonucleotide
  Target: FXN; (-) strand; PAM type: NRG; PAM sequence: GAG
agcatcagctgcagcctcag

SEQ ID NO: 14068 - DNA, 20 bp, Artificial Sequence
  Description of Artificial Sequence: Synthetic oligonucleotide
  Target: FXN; (-) strand; PAM type: NRG; PAM sequence: AGG
gcagcatcagctgcagcctc

SEQ ID NO: 14069 - DNA, 20 bp, Artificial Sequence
  Description of Artificial Sequence: Synthetic oligonucleotide
  Target: FXN; (-) strand; PAM type: NRG; PAM sequence: CAG
ggcagcatcagctgcagcct

SEQ ID NO: 14070 - DNA, 20 bp, Artificial Sequence
  Description of Artificial Sequence: Synthetic oligonucleotide
  Target: FXN; (-) strand; PAM type: NRG; PAM sequence: CAG
agagcgggcagcatcagctg

SEQ ID NO: 14071 - DNA, 20 bp, Artificial Sequence
  Description of Artificial Sequence: Synthetic oligonucleotide
  Target: FXN; (-) strand; PAM type: NRG; PAM sequence: CAG
tcaggcagagcgggcagcat

SEQ ID NO: 14072 - DNA, 20 bp, Artificial Sequence
  Description of Artificial Sequence: Synthetic oligonucleotide
  Target: FXN; (-) strand; PAM type: NRG; PAM sequence: CAG
tgcagttcaggcagagcggg

SEQ ID NO: 14073 - DNA, 20 bp, Artificial Sequence
  Description of Artificial Sequence: Synthetic oligonucleotide
  Target: FXN; (-) strand; PAM type: NRG; PAM sequence: GGG
tggtgcagttcaggcagagc

SEQ ID NO: 14074 - DNA, 20 bp, Artificial Sequence
  Description of Artificial Sequence: Synthetic oligonucleotide
  Target: FXN; (-) strand; PAM type: NRG; PAM sequence: CGG
ttggtgcagttcaggcagag

SEQ ID NO: 14075 - DNA, 20 bp, Artificial Sequence
  Description of Artificial Sequence: Synthetic oligonucleotide
  Target: FXN; (-) strand; PAM type: NRG; PAM sequence: GAG
tttttggtgcagttcaggca

SEQ ID NO: 14076 - DNA, 20 bp, Artificial Sequence
  Description of Artificial Sequence: Synthetic oligonucleotide
  Target: FXN; (-) strand; PAM type: NRG; PAM sequence: CAG
cgtttttggtgcagttcagg

SEQ ID NO: 14077 - DNA, 20 bp, Artificial Sequence
  Description of Artificial Sequence: Synthetic oligonucleotide
  Target: FXN; (-) strand; PAM type: NRG; PAM sequence: AGG
tcacgtttttggtgcagttc

SEQ ID NO: 14078 - DNA, 20 bp, Artificial Sequence
  Description of Artificial Sequence: Synthetic oligonucleotide
  Target: FXN; (-) strand; PAM type: NRG; PAM sequence: CAG
atcacgtttttggtgcagtt

SEQ ID NO: 14079 - DNA, 20 bp, Artificial Sequence
  Description of Artificial Sequence: Synthetic oligonucleotide
  Target: FXN; (-) strand; PAM type: NRG; PAM sequence: CAG
gcctcatcacgtttttggtg

SEQ ID NO: 14080 - DNA, 20 bp, Artificial Sequence
  Description of Artificial Sequence: Synthetic oligonucleotide
  Target: FXN; (-) strand; PAM type: NRG; PAM sequence: TGG
ctatggcctcatcacgtttt

SEQ ID NO: 14081 - DNA, 20 bp, Artificial Sequence
  Description of Artificial Sequence: Synthetic oligonucleotide
  Target: FXN; (-) strand; PAM type: NRG; PAM sequence: TGG
tcctccgtggactcccgcta

SEQ ID NO: 14082 - DNA, 20 bp, Artificial Sequence
  Description of Artificial Sequence: Synthetic oligonucleotide
  Target: FXN; (-) strand; PAM type: NRG; PAM sequence: TGG
gcagtaggcatcctcctccg

SEQ ID NO: 14083 - DNA, 20 bp, Artificial Sequence
  Description of Artificial Sequence: Synthetic oligonucleotide
  Target: FXN; (-) strand; PAM type: NRG; PAM sequence: AGG
tctgctagaggtcgggcagt

SEQ ID NO: 14084 - DNA, 20 bp, Artificial Sequence
  Description of Artificial Sequence: Synthetic oligonucleotide
  Target: FXN; (-) strand; PAM type: NRG; PAM sequence: TAG
ctctgctagaggtcgggcag

SEQ ID NO: 14085 - DNA, 20 bp, Artificial Sequence
  Description of Artificial Sequence: Synthetic oligonucleotide
  Target: FXN; (-) strand; PAM type: NRG; PAM sequence: CAG
agtctctgctagaggtcggg

SEQ ID NO: 14086 - DNA, 20 bp, Artificial Sequence
  Description of Artificial Sequence: Synthetic oligonucleotide
  Target: FXN; (-) strand; PAM type: NRG; PAM sequence: GGG
cttagtctctgctagaggtc

SEQ ID NO: 14087 - DNA, 20 bp, Artificial Sequence
  Description of Artificial Sequence: Synthetic oligonucleotide
  Target: FXN; (-) strand; PAM type: NRG; PAM sequence: CGG
gcttagtctctgctagaggt

SEQ ID NO: 14088 - DNA, 20 bp, Artificial Sequence
  Description of Artificial Sequence: Synthetic oligonucleotide
  Target: FXN; (-) strand; PAM type: NRG; PAM sequence: AGG
ccttgcttagtctctgctag

SEQ ID NO: 14089 - DNA, 20 bp, Artificial Sequence
  Description of Artificial Sequence: Synthetic oligonucleotide
  Target: FXN; (-) strand; PAM type: NRG; PAM sequence: GAG
accttgcttagtctctgcta

SEQ ID NO: 14090 - DNA, 20 bp, Artificial Sequence
  Description of Artificial Sequence: Synthetic oligonucleotide
  Target: FXN; (-) strand; PAM type: NRG; PAM sequence: TAG
gcaccttgcttagtctctgc

SEQ ID NO: 14091 - DNA, 20 bp, Artificial Sequence
  Description of Artificial Sequence: Synthetic oligonucleotide
  Target: FXN; (-) strand; PAM type: NRG; PAM sequence: TAG
aagttttcatgcaccttgct

SEQ ID NO: 14092 - DNA, 20 bp, Artificial Sequence
  Description of Artificial Sequence: Synthetic oligonucleotide
  Target: FXN; (-) strand; PAM type: NRG; PAM sequence: AAG
gggtgtgacacatgtggttc

SEQ ID NO: 14093 - DNA, 20 bp, Artificial Sequence
  Description of Artificial Sequence: Synthetic oligonucleotide
  Target: FXN; (-) strand; PAM type: NRG; PAM sequence: TGG
ggtcatgggtgtgacacatg

SEQ ID NO: 14094 - DNA, 20 bp, Artificial Sequence
  Description of Artificial Sequence: Synthetic oligonucleotide
  Target: FXN; (-) strand; PAM type: NRG; PAM sequence: GGG
catcttcatgtagtggtcat

SEQ ID NO: 14095 - DNA, 20 bp, Artificial Sequence
  Description of Artificial Sequence: Synthetic oligonucleotide
  Target: FXN; (-) strand; PAM type: NRG; PAM sequence: TGG
ccatcttcatgtagtggtca

SEQ ID NO: 14096 - DNA, 20 bp, Artificial Sequence
  Description of Artificial Sequence: Synthetic oligonucleotide
  Target: FXN; (-) strand; PAM type: NRG; PAM sequence: TGG
tttgggccatcttcatgtag

SEQ ID NO: 14097 - DNA, 20 bp, Artificial Sequence
  Description of Artificial Sequence: Synthetic oligonucleotide
  Target: FXN; (-) strand; PAM type: NRG; PAM sequence: TAG
ggttttgggccatcttcatg

SEQ ID NO: 14098 - DNA, 20 bp, Artificial Sequence
  Description of Artificial Sequence: Synthetic oligonucleotide
  Target: FXN; (-) strand; PAM type: NRG; PAM sequence: GGG
caattcctgggccaggtttt

SEQ ID NO: 14099 - DNA, 20 bp, Artificial Sequence
  Description of Artificial Sequence: Synthetic oligonucleotide
  Target: FXN; (-) strand; PAM type: NRG; PAM sequence: TGG
tcaattcctgggccaggttt

SEQ ID NO: 14100 - DNA, 20 bp, Artificial Sequence
  Description of Artificial Sequence: Synthetic oligonucleotide
  Target: FXN; (-) strand; PAM type: NRG; PAM sequence: AGG
ctttcttcaattcctgggcc

SEQ ID NO: 14101 - DNA, 20 bp, Artificial Sequence
  Description of Artificial Sequence: Synthetic oligonucleotide
  Target: FXN; (-) strand; PAM type: NRG; PAM sequence: CAG
tctttcttcaattcctgggc

SEQ ID NO: 14102 - DNA, 20 bp, Artificial Sequence
  Description of Artificial Sequence: Synthetic oligonucleotide
  Target: FXN; (-) strand; PAM type: NRG; PAM sequence: GGG
agagtctttcttcaattcct

SEQ ID NO: 14103 - DNA, 20 bp, Artificial Sequence
  Description of Artificial Sequence: Synthetic oligonucleotide
  Target: FXN; (-) strand; PAM type: NRG; PAM sequence: TGG
aagagtctttcttcaattcc

SEQ ID NO: 14104 - DNA, 20 bp, Artificial Sequence
  Description of Artificial Sequence: Synthetic oligonucleotide
  Target: FXN; (-) strand; PAM type: NRG; PAM sequence: GAG
tttcttacagcaaattggaa

SEQ ID NO: 14105 - DNA, 20 bp, Artificial Sequence
  Description of Artificial Sequence: Synthetic oligonucleotide
  Target: FXN; (-) strand; PAM type: NRG; PAM sequence: AAG
attttcttacagcaaattgg

SEQ ID NO: 14106 - DNA, 20 bp, Artificial Sequence
  Description of Artificial Sequence: Synthetic oligonucleotide
  Target: FXN; (-) strand; PAM type: NRG; PAM sequence: TGG
gccattttcttacagcaaat

SEQ ID NO: 14107 - DNA, 20 bp, Artificial Sequence
  Description of Artificial Sequence: Synthetic oligonucleotide
  Target: FXN; (-) strand; PAM type: NRG; PAM sequence: CAG
ccccctgggccattttctta

SEQ ID NO: 14108 - DNA, 20 bp, Artificial Sequence
  Description of Artificial Sequence: Synthetic oligonucleotide
  Target: FXN; (-) strand; PAM type: NRG; PAM sequence: GGG
agctaccgtgcttgccccct

SEQ ID NO: 14109 - DNA, 20 bp, Artificial Sequence
  Description of Artificial Sequence: Synthetic oligonucleotide
  Target: FXN; (-) strand; PAM type: NRG; PAM sequence: TGG
gagctaccgtgcttgccccc

SEQ ID NO: 14110 - DNA, 20 bp, Artificial Sequence
  Description of Artificial Sequence: Synthetic oligonucleotide
  Target: FXN; (-) strand; PAM type: NRG; PAM sequence: GAG
agtgctaggattacaggtgt

SEQ ID NO: 14111 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctaggattac

SEQ ID NO: 14112 - DNA, 20 bp, Artificial Sequence
  Description of Artificial Sequence: Synthetic oligonucleotide
  Target: FXN; (-) strand; PAM type: NRG; PAM sequence: CAG
ttcccaaagtgctaggatta

SEQ ID NO: 14113 - DNA, 20 bp, Artificial Sequence
  Description of Artificial Sequence: Synthetic oligonucleotide
  Target: FXN; (-) strand; PAM type: NRG; PAM sequence: AGG
cgtcagcttcccaaagtgct

SEQ ID NO: 14114 - DNA, 20 bp, Artificial Sequence
  Description of Artificial Sequence: Synthetic oligonucleotide
  Target: FXN; (-) strand; PAM type: NRG; PAM sequence: TAG
gcgtcagcttcccaaagtgc

SEQ ID NO: 14115 - DNA, 20 bp, Artificial Sequence
  Description of Artificial Sequence: Synthetic oligonucleotide
  Target: FXN; (-) strand; PAM type: NRG; PAM sequence: AAG
ctgcctgcgtcagcttccca

SEQ ID NO: 14116 - DNA, 20 bp, Artificial Sequence
  Description of Artificial Sequence: Synthetic oligonucleotide
  Target: FXN; (-) strand; PAM type: NRG; PAM sequence: CAG
ctcaagccatctgcctgcgt

SEQ ID NO: 14117 - DNA, 20 bp, Artificial Sequence
  Description of Artificial Sequence: Synthetic oligonucleotide
  Target: FXN; (-) strand; PAM type: NRG; PAM sequence: AAG
ggtctggaactcctgagctc

SEQ ID NO: 14118 - DNA, 20 bp, Artificial Sequence
  Description of Artificial Sequence: Synthetic oligonucleotide
  Target: FXN; (-) strand; PAM type: NRG; PAM sequence: GAG
caggctggtctggaactcct

SEQ ID NO: 14119 - DNA, 20 bp, Artificial Sequence
  Description of Artificial Sequence: Synthetic oligonucleotide
  Target: FXN; (-) strand; PAM type: NRG; PAM sequence: TGG
ccatgttgcccaggctggtc

SEQ ID NO: 14120 - DNA, 20 bp, Artificial Sequence
  Description of Artificial Sequence: Synthetic oligonucleotide
  Target: FXN; (-) strand; PAM type: NRG; PAM sequence: TGG
tttcaccatgttgcccaggc

SEQ ID NO: 14121 - DNA, 20 bp, Artificial Sequence
  Description of Artificial Sequence: Synthetic oligonucleotide
  Target: FXN; (-) strand; PAM type: NRG; PAM sequence: AGG
ggggtttcaccatgttgccc

SEQ ID NO: 14122 - DNA, 20 bp, Artificial Sequence
  Description of Artificial Sequence: Synthetic oligonucleotide
  Target: FXN; (-) strand; PAM type: NRG; PAM sequence: CAG
cggggtttcaccatgttgcc

SEQ ID NO: 14123 - DNA, 20 bp, Artificial Sequence
  Description of Artificial Sequence: Synthetic oligonucleotide
  Target: FXN; (-) strand; PAM type: NRG; PAM sequence: GGG
ttgtatttttggtagagacg

SEQ ID NO: 14124 - DNA, 20 bp, Artificial Sequence
  Description of Artificial Sequence: Synthetic oligonucleotide
  Target: FXN; (-) strand; PAM type: NRG; PAM sequence: GGG
tttgtatttttggtagagac

SEQ ID NO: 14125 - DNA, 20 bp, Artificial Sequence
  Description of Artificial Sequence: Synthetic oligonucleotide
  Target: FXN; (-) strand; PAM type: NRG; PAM sequence: CGG
ttttgtatttttggtagaga

SEQ ID NO: 14126 - DNA, 20 bp, Artificial Sequence
  Description of Artificial Sequence: Synthetic oligonucleotide
  Target: FXN; (-) strand; PAM type: NRG; PAM sequence: GAG
taatttttgtatttttggta

SEQ ID NO: 14127 - DNA, 20 bp, Artificial Sequence
  Description of Artificial Sequence: Synthetic oligonucleotide
  Target: FXN; (-) strand; PAM type: NRG; PAM sequence: TAG
gctaatttttgtatttttgg

SEQ ID NO: 14128 - DNA, 20 bp, Artificial Sequence
  Description of Artificial Sequence: Synthetic oligonucleotide
  Target: FXN; (-) strand; PAM type: NRG; PAM sequence: TGG
ccggctaatttttgtatttt

SEQ ID NO: 14129 - DNA, 20 bp, Artificial Sequence
  Description of Artificial Sequence: Synthetic oligonucleotide
  Target: FXN; (-) strand; PAM type: NRG; PAM sequence: CGG
caggcatgcatcaccacacc

SEQ ID NO: 14130 - DNA, 20 bp, Artificial Sequence
  Description of Artificial Sequence: Synthetic oligonucleotide
  Target: FXN; (-) strand; PAM type: NRG; PAM sequence: AGG
tcctgagtagctgggaccac

SEQ ID NO: 14131 - DNA, 20 bp, Artificial Sequence
  Description of Artificial Sequence: Synthetic oligonucleotide
  Target: FXN; (-) strand; PAM type: NRG; PAM sequence: CAG
ctcctgagtagctgggacca

SEQ ID NO: 14132 - DNA, 20 bp, Artificial Sequence
  Description of Artificial Sequence: Synthetic oligonucleotide
  Target: FXN; (-) strand; PAM type: NRG; PAM sequence: GGG
cctcagcctcctgagtagct

SEQ ID NO: 14133 - DNA, 20 bp, Artificial Sequence
  Description of Artificial Sequence: Synthetic oligonucleotide
  Target: FXN; (-) strand; PAM type: NRG; PAM sequence: TGG
acctcagcctcctgagtagc

SEQ ID NO: 14134 - DNA, 20 bp, Artificial Sequence
  Description of Artificial Sequence: Synthetic oligonucleotide
  Target: FXN; (-) strand; PAM type: NRG; PAM sequence: TAG
ttccacctcagcctcctgag

SEQ ID NO: 14135 - DNA, 20 bp, Artificial Sequence
  Description of Artificial Sequence: Synthetic oligonucleotide
  Target: FXN; (-) strand; PAM type: NRG; PAM sequence: GAG
tccttccacctcagcctcct

SEQ ID NO: 14136 - DNA, 20 bp, Artificial Sequence
  Description of Artificial Sequence: Synthetic oligonucleotide
  Target: FXN; (-) strand; PAM type: NRG; PAM sequence: CAG
ctcaggcaatccttccacct

SEQ ID NO: 14137 - DNA, 20 bp, Artificial Sequence
  Description of Artificial Sequence: Synthetic oligonucleotide
  Target: FXN; (-) strand; PAM type: NRG; PAM sequence: AGG
aacctctgccccacagactc

SEQ ID NO: 14138 - DNA, 20 bp, Artificial Sequence
  Description of Artificial Sequence: Synthetic oligonucleotide
  Target: FXN; (-) strand; PAM type: NRG; PAM sequence: CAG
caacctctgccccacagact

SEQ ID NO: 14139 - DNA, 20 bp, Artificial Sequence
  Description of Artificial Sequence: Synthetic oligonucleotide
  Target: FXN; (-) strand; PAM type: NRG; PAM sequence: CAG
tcactgcaacctctgcccca

SEQ ID NO: 14140 - DNA, 20 bp, Artificial Sequence
  Description of Artificial Sequence: Synthetic oligonucleotide
  Target: FXN; (-) strand; PAM type: NRG; PAM sequence: CAG
ggagtgcagtggtgtgatct

SEQ ID NO: 14141 - DNA, 20 bp, Artificial Sequence
  Description of Artificial Sequence: Synthetic oligonucleotide
  Target: FXN; (-) strand; PAM type: NRG; PAM sequence: TGG
tcacccaggctggagtgcag

SEQ ID NO: 14142 - DNA, 20 bp, Artificial Sequence
  Description of Artificial Sequence: Synthetic oligonucleotide
  Target: FXN; (-) strand; PAM type: NRG; PAM sequence: CAG
gtgtcacccaggctggagtg

SEQ ID NO: 14143 - DNA, 20 bp, Artificial Sequence
  Description of Artificial Sequence: Synthetic oligonucleotide
  Target: FXN; (-) strand; PAM type: NRG; PAM sequence: GAG
tcactgtgtcacccaggctg

SEQ ID NO: 14144 - DNA, 20 bp, Artificial Sequence
  Description of Artificial Sequence: Synthetic oligonucleotide
  Target: FXN; (-) strand; PAM type: NRG; PAM sequence: TGG
tctcactgtgtcacccaggc

SEQ ID NO: 14145 - DNA, 20 bp, Artificial Sequence
  Description of Artificial Sequence: Synthetic oligonucleotide
  Target: FXN; (-) strand; PAM type: NRG; PAM sequence: AGG
ggggtctcactgtgtcaccc

SEQ ID NO: 14146 - DNA, 20 bp, Artificial Sequence
  Description of Artificial Sequence: Synthetic oligonucleotide
  Target: FXN; (-) strand; PAM type: NRG; PAM sequence: CAG
tggggtctcactgtgtcacc

SEQ ID NO: 14147 - DNA, 20 bp, Artificial Sequence
  Description of Artificial Sequence: Synthetic oligonucleotide
  Target: FXN; (-) strand; PAM type: NRG; PAM sequence: GGG
ttttttttttttttgagatg

SEQ ID NO: 14148 - DNA, 20 bp, Artificial Sequence
  Description of Artificial Sequence: Synthetic oligonucleotide
  Target: FXN; (-) strand; PAM type: NRG; PAM sequence: GGG
cttttttttttttttgagat

SEQ ID NO: 14149 - DNA, 20 bp, Artificial Sequence
  Description of Artificial Sequence: Synthetic oligonucleotide
  Target: FXN; (-) strand; PAM type: NRG; PAM sequence: TGG
tcttttttttttttttgaga

SEQ ID NO: 14150 - DNA, 20 bp, Artificial Sequence
  Description of Artificial Sequence: Synthetic oligonucleotide
  Target: FXN; (-) strand; PAM type: NRG; PAM sequence: GAG
tctttctttttttttttttt

SEQ ID NO: 14151 - DNA, 20 bp, Artificial Sequence
  Description of Artificial Sequence: Synthetic oligonucleotide
  Target: FXN; (-) strand; PAM type: NRG; PAM sequence: GGG
ggcggccctccagccttcct

SEQ ID NO: 14152 - DNA, 20 bp, Artificial Sequence
  Description of Artificial Sequence: Synthetic oligonucleotide
  Target: FXN; (-) strand; PAM type: NRG; PAM sequence: TGG
cggcggccctccagccttcc

SEQ ID NO: 14153 - DNA, 20 bp, Artificial Sequence
  Description of Artificial Sequence: Synthetic oligonucleotide
  Target: FXN; (-) strand; PAM type: NRG; PAM sequence: CAG
caatggacacggcggccctc

SEQ ID NO: 14154 - DNA, 20 bp, Artificial Sequence
  Description of Artificial Sequence: Synthetic oligonucleotide
  Target: FXN; (-) strand; PAM type: NRG; PAM sequence: CGG
cactctctcaatggacacgg

SEQ ID NO: 14155 - DNA, 20 bp, Artificial Sequence
  Description of Artificial Sequence: Synthetic oligonucleotide
  Target: FXN; (-) strand; PAM type: NRG; PAM sequence: CGG
gagcactctctcaatggaca

SEQ ID NO: 14156 - DNA, 20 bp, Artificial Sequence
  Description of Artificial Sequence: Synthetic oligonucleotide
  Target: FXN; (-) strand; PAM type: NRG; PAM sequence: TGG
tgcctggagcactctctcaa

SEQ ID NO: 14157 - DNA, 20 bp, Artificial Sequence
  Description of Artificial Sequence: Synthetic oligonucleotide
  Target: FXN; (-) strand; PAM type: NRG; PAM sequence: GAG
ttttctttttggagtgcctg

SEQ ID NO: 14158 - DNA, 20 bp, Artificial Sequence
  Description of Artificial Sequence: Synthetic oligonucleotide
  Target: FXN; (-) strand; PAM type: NRG; PAM sequence: TGG
cattttctttttggagtgcc

SEQ ID NO: 14159 - DNA, 20 bp, Artificial Sequence
  Description of Artificial Sequence: Synthetic oligonucleotide
  Target: FXN; (-) strand; PAM type: NRG; PAM sequence: GAG
ttgtggtcattttctttttg

SEQ ID NO: 14160 - DNA, 20 bp, Artificial Sequence
  Description of Artificial Sequence: Synthetic oligonucleotide
  Target: FXN; (-) strand; PAM type: NRG; PAM sequence: TGG
cattgtggtcattttctttt

SEQ ID NO: 14161 - DNA, 20 bp, Artificial Sequence
  Description of Artificial Sequence: Synthetic oligonucleotide
  Target: FXN; (-) strand; PAM type: NRG; PAM sequence: TGG
cagctggtttcttcccattg

SEQ ID NO: 14162 - DNA, 20 bp, Artificial Sequence
  Description of Artificial Sequence: Synthetic oligonucleotide
  Target: FXN; (-) strand; PAM type: NRG; PAM sequence: TGG
aacttggtctcatggtcagc

SEQ ID NO: 14163 - DNA, 20 bp, Artificial Sequence
  Description of Artificial Sequence: Synthetic oligonucleotide
  Target: FXN; (-) strand; PAM type: NRG; PAM sequence: CAG
ttggaacttggtctcatggt

SEQ ID NO: 14164 - DNA, 20 bp, Artificial Sequence
  Description of Artificial Sequence: Synthetic oligonucleotide
  Target: FXN; (-) strand; PAM type: NRG; PAM sequence: TGG
aaggttggaacttggtctca

SEQ ID NO: 14165 - DNA, 20 bp, Artificial Sequence
  Description of Artificial Sequence: Synthetic oligonucleotide
  Target: FXN; (-) strand; PAM type: NRG; PAM sequence: TGG
acttgtaaaaggttggaact

SEQ ID NO: 14166 - DNA, 20 bp, Artificial Sequence
  Description of Artificial Sequence: Synthetic oligonucleotide
  Target: FXN; (-) strand; PAM type: NRG; PAM sequence: TGG
acaggccacttgtaaaaggt

SEQ ID NO: 14167 - DNA, 20 bp, Artificial Sequence
  Description of Artificial Sequence: Synthetic oligonucleotide
  Target: FXN; (-) strand; PAM type: NRG; PAM sequence: AGG
agccacaggccacttgtaaa

SEQ ID NO: 14168 - DNA, 20 bp, Artificial Sequence
  Description of Artificial Sequence: Synthetic oligonucleotide
  Target: FXN; (-) strand; PAM type: NRG; PAM sequence: AAG
gagccacaggccacttgtaa

SEQ ID NO: 14169 - DNA, 20 bp, Artificial Sequence
  Description of Artificial Sequence: Synthetic oligonucleotide
  Target: FXN; (-) strand; PAM type: NRG; PAM sequence: AGG
ggcggggcgccaggagccac

SEQ ID NO: 14170 - DNA, 20 bp, Artificial Sequence
  Description of Artificial Sequence: Synthetic oligonucleotide
  Target: FXN; (-) strand; PAM type: NRG; PAM sequence: CAG
gggcggggcgccaggagcca

SEQ ID NO: 14171 - DNA, 20 bp, Artificial Sequence
  Description of Artificial Sequence: Synthetic oligonucleotide
  Target: FXN; (-) strand; PAM type: NRG; PAM sequence: GAG
agctgtgggcggggcgccag

SEQ ID NO: 14172 - DNA, 20 bp, Artificial Sequence
  Description of Artificial Sequence: Synthetic oligonucleotide
  Target: FXN; (-) strand; PAM type: NRG; PAM sequence: AGG
tcagctgtgggcggggcgcc

SEQ ID NO: 14173 - DNA, 20 bp, Artificial Sequence
  Description of Artificial Sequence: Synthetic oligonucleotide
  Target: FXN; (-) strand; PAM type: NRG; PAM sequence: CAG
gtcagctgtgggcggggcgc

SEQ ID NO: 14174 - DNA, 20 bp, Artificial Sequence
  Description of Artificial Sequence: Synthetic oligonucleotide
  Target: FXN; (-) strand; PAM type: NRG; PAM sequence: GGG
gcccctgtcagctgtgggcg

SEQ ID NO: 14175 - DNA, 20 bp, Artificial Sequence
  Description of Artificial Sequence: Synthetic oligonucleotide
  Target: FXN; (-) strand; PAM type: NRG; PAM sequence: GGG
agcccctgtcagctgtgggc

SEQ ID NO: 14176 - DNA, 20 bp, Artificial Sequence
  Description of Artificial Sequence: Synthetic oligonucleotide
  Target: FXN; (-) strand; PAM type: NRG; PAM sequence: CGG
gagcccctgtcagctgtggg

SEQ ID NO: 14177 - DNA, 20 bp, Artificial Sequence
  Description of Artificial Sequence: Synthetic oligonucleotide
  Target: FXN; (-) strand; PAM type: NRG; PAM sequence: GGG
tctgagcccctgtcagctgt

SEQ ID NO: 14178 - DNA, 20 bp, Artificial Sequence
  Description of Artificial Sequence: Synthetic oligonucleotide
  Target: FXN; (-) strand; PAM type: NRG; PAM sequence: TGG
ttctgagcccctgtcagctg

SEQ ID NO: 14179 - DNA, 20 bp, Artificial Sequence
  Description of Artificial Sequence: Synthetic oligonucleotide
  Target: FXN; (-) strand; PAM type: NRG; PAM sequence: CAG
tagcacttctgagcccctgt

SEQ ID NO: 14180 - DNA, 20 bp, Artificial Sequence
  Description of Artificial Sequence: Synthetic oligonucleotide
  Target: FXN; (-) strand; PAM type: NRG; PAM sequence: GAG
atggtccccctagcacttct

SEQ ID NO: 14181 - DNA, 20 bp, Artificial Sequence
  Description of Artificial Sequence: Synthetic oligonucleotide
  Target: FXN; (-) strand; PAM type: NRG; PAM sequence: TAG
ctggtggcccatggtccccc

SEQ ID NO: 14182 - DNA, 20 bp, Artificial Sequence
  Description of Artificial Sequence: Synthetic oligonucleotide
  Target: FXN; (-) strand; PAM type: NRG; PAM sequence: TGG
ctggtggccctggtggccca

SEQ ID NO: 14183 - DNA, 20 bp, Artificial Sequence
  Description of Artificial Sequence: Synthetic oligonucleotide
  Target: FXN; (-) strand; PAM type: NRG; PAM sequence: TGG
ctccctcctggtggccctgg

SEQ ID NO: 14184 - DNA, 20 bp, Artificial Sequence
  Description of Artificial Sequence: Synthetic oligonucleotide
  Target: FXN; (-) strand; PAM type: NRG; PAM sequence: TGG
tgcctccctcctggtggccc

SEQ ID NO: 14185 - DNA, 20 bp, Artificial Sequence
  Description of Artificial Sequence: Synthetic oligonucleotide
  Target: FXN; (-) strand; PAM type: NRG; PAM sequence: TGG
gttacctgcctccctcctgg

SEQ ID NO: 14186 - DNA, 20 bp, Artificial Sequence
  Description of Artificial Sequence: Synthetic oligonucleotide
  Target: FXN; (-) strand; PAM type: NRG; PAM sequence: TGG
atcgttacctgcctccctcc

SEQ ID NO: 14187 - DNA, 20 bp, Artificial Sequence
  Description of Artificial Sequence: Synthetic oligonucleotide
  Target: FXN; (-) strand; PAM type: NRG; PAM sequence: AAG
ccagctggtgttctgcatcc

SEQ ID NO: 14188 - DNA, 20 bp, Artificial Sequence
  Description of Artificial Sequence: Synthetic oligonucleotide
  Target: FXN; (-) strand; PAM type: NRG; PAM sequence: TGG
gaaaacagaatcaaaccagc

SEQ ID NO: 14189 - DNA, 20 bp, Artificial Sequence
  Description of Artificial Sequence: Synthetic oligonucleotide
  Target: FXN; (-) strand; PAM type: NRG; PAM sequence: CAG
cagggaaaacagaatcaaac

SEQ ID NO: 14190 - DNA, 20 bp, Artificial Sequence
  Description of Artificial Sequence: Synthetic oligonucleotide
  Target: FXN; (-) strand; PAM type: NRG; PAM sequence: CAG
ggacccaggtacagggaaaa

SEQ ID NO: 14191 - DNA, 20 bp, Artificial Sequence
  Description of Artificial Sequence: Synthetic oligonucleotide
  Target: FXN; (-) strand; PAM type: NRG; PAM sequence: GGG
gcattcaggacccaggtaca

SEQ ID NO: 14192 - DNA, 20 bp, Artificial Sequence
  Description of Artificial Sequence: Synthetic oligonucleotide
  Target: FXN; (-) strand; PAM type: NRG; PAM sequence: AGG
ggcattcaggacccaggtac

SEQ ID NO: 14193 - DNA, 20 bp, Artificial Sequence
  Description of Artificial Sequence: Synthetic oligonucleotide
  Target: FXN; (-) strand; PAM type: NRG; PAM sequence: CAG
gggcattcaggacccaggta

SEQ ID NO: 14194 - DNA, 20 bp, Artificial Sequence
  Description of Artificial Sequence: Synthetic oligonucleotide
  Target: FXN; (-) strand; PAM type: NRG; PAM sequence: AGG
cctctgggcattcaggaccc

SEQ ID NO: 14195 - DNA, 20 bp, Artificial Sequence
  Description of Artificial Sequence: Synthetic oligonucleotide
  Target: FXN; (-) strand; PAM type: NRG; PAM sequence: CAG
gcctctgggcattcaggacc

SEQ ID NO: 14196 - DNA, 20 bp, Artificial Sequence
  Description of Artificial Sequence: Synthetic oligonucleotide
  Target: FXN; (-) strand; PAM type: NRG; PAM sequence: AGG
ccctgagcctctgggcattc

SEQ ID NO: 14197 - DNA, 20 bp, Artificial Sequence
  Description of Artificial Sequence: Synthetic oligonucleotide
  Target: FXN; (-) strand; PAM type: NRG; PAM sequence: CAG
tccctgagcctctgggcatt

SEQ ID NO: 14198 - DNA, 20 bp, Artificial Sequence
  Description of Artificial Sequence: Synthetic oligonucleotide
  Target: FXN; (-) strand; PAM type: NRG; PAM sequence: GGG
tggtgtttccctgagcctct

SEQ ID NO: 14199 - DNA, 20 bp, Artificial Sequence
  Description of Artificial Sequence: Synthetic oligonucleotide
  Target: FXN; (-) strand; PAM type: NRG; PAM sequence: TGG
ctggtgtttccctgagcctc

SEQ ID NO: 14200 - DNA, 20 bp, Artificial Sequence
  Description of Artificial Sequence: Synthetic oligonucleotide
  Target: FXN; (-) strand; PAM type: NRG; PAM sequence: GAG
gcactggctggtgtttccct

SEQ ID NO: 14201 - DNA, 20 bp, Artificial Sequence
  Description of Artificial Sequence: Synthetic oligonucleotide
  Target: FXN; (-) strand; PAM type: NRG; PAM sequence: TGG
ttaaaggcagcagcactggc

SEQ ID NO: 14202 - DNA, 20 bp, Artificial Sequence
  Description of Artificial Sequence: Synthetic oligonucleotide
  Target: FXN; (-) strand; PAM type: NRG; PAM sequence: TGG
tgctttaaaggcagcagcac

SEQ ID NO: 14203 - DNA, 20 bp, Artificial Sequence
  Description of Artificial Sequence: Synthetic oligonucleotide
  Target: FXN; (-) strand; PAM type: NRG; PAM sequence: CAG
caaaagtgctttaaaggcag

SEQ ID NO: 14204 - DNA, 20 bp, Artificial Sequence
  Description of Artificial Sequence: Synthetic oligonucleotide
  Target: FXN; (-) strand; PAM type: NRG; PAM sequence: CAG
agtcaaaagtgctttaaagg

SEQ ID NO: 14205 - DNA, 20 bp, Artificial Sequence
  Description of Artificial Sequence: Synthetic oligonucleotide
  Target: FXN; (-) strand; PAM type: NRG; PAM sequence: AGG
atcagtcaaaagtgctttaa

SEQ ID NO: 14206 - DNA, 20 bp, Artificial Sequence
  Description of Artificial Sequence: Synthetic oligonucleotide
  Target: FXN; (-) strand; PAM type: NRG; PAM sequence: AAG
gatcagtcaaaagtgcttta

SEQ ID NO: 14207 - DNA, 20 bp, Artificial Sequence
  Description of Artificial Sequence: Synthetic oligonucleotide
  Target: FXN; (-) strand; PAM type: NRG; PAM sequence: AAG
attaacaagagatcagtcaa

SEQ ID NO: 14208 - DNA, 20 bp, Artificial Sequence
  Description of Artificial Sequence: Synthetic oligonucleotide
  Target: FXN; (-) strand; PAM type: NRG; PAM sequence: CAG
ttgctaaattaacaagagat

SEQ ID NO: 14209 - DNA, 20 bp, Artificial Sequence
  Description of Artificial Sequence: Synthetic oligonucleotide
  Target: FXN; (-) strand; PAM type: NRG; PAM sequence: GAG
aacagttgctaaattaacaa

SEQ ID NO: 14210 - DNA, 20 bp, Artificial Sequence
  Description of Artificial Sequence: Synthetic oligonucleotide
  Target: FXN; (-) strand; PAM type: NRG; PAM sequence: AAG
ataacagttgctaaattaac

SEQ ID NO: 14211 - DNA, 20 bp, Artificial Sequence
  Description of Artificial Sequence: Synthetic oligonucleotide
  Target: FXN; (-) strand; PAM type: NRG; PAM sequence: CAG
actgcagcatcaaccaataa

SEQ ID NO: 14212 - DNA, 20 bp, Artificial Sequence
  Description of Artificial Sequence: Synthetic oligonucleotide
  Target: FXN; (-) strand; PAM type: NRG; PAM sequence: CAG
aacttcaataagagcaactg

SEQ ID NO: 14213 - DNA, 20 bp, Artificial Sequence
  Description of Artificial Sequence: Synthetic oligonucleotide
  Target: FXN; (-) strand; PAM type: NRG; PAM sequence: GAG
tatcaatcaaacttcaataa

SEQ ID NO: 14214 - DNA, 20 bp, Artificial Sequence
  Description of Artificial Sequence: Synthetic oligonucleotide
  Target: FXN; (-) strand; PAM type: NRG; PAM sequence: AAG
gctatcaatcaaacttcaat

SEQ ID NO: 14215 - DNA, 20 bp, Artificial Sequence
  Description of Artificial Sequence: Synthetic oligonucleotide
  Target: FXN; (-) strand; PAM type: NRG; PAM sequence: TAG
aacaacctttatttgaaaaa

SEQ ID NO: 14216 - DNA, 20 bp, Artificial Sequence
  Description of Artificial Sequence: Synthetic oligonucleotide
  Target: FXN; (-) strand; PAM type: NRG; PAM sequence: GAG
gaaccaatgtgaaaggctga

SEQ ID NO: 14217 - DNA, 20 bp, Artificial Sequence
  Description of Artificial Sequence: Synthetic oligonucleotide
  Target: FXN; (-) strand; PAM type: NRG; PAM sequence: GAG
ttgaaccaatgtgaaaggct

SEQ ID NO: 14218 - DNA, 20 bp, Artificial Sequence
  Description of Artificial Sequence: Synthetic oligonucleotide
  Target: FXN; (-) strand; PAM type: NRG; PAM sequence: AGG
atattttgaaccaatgtgaa

SEQ ID NO: 14219 - DNA, 20 bp, Artificial Sequence
  Description of Artificial Sequence: Synthetic oligonucleotide
  Target: FXN; (-) strand; PAM type: NRG; PAM sequence: AAG
gatattttgaaccaatgtga

SEQ ID NO: 14220 - DNA, 20 bp, Artificial Sequence
  Description of Artificial Sequence: Synthetic oligonucleotide
  Target: FXN; (-) strand; PAM type: NRG; PAM sequence: AAG
tcagaaatgcagccagatga

SEQ ID NO: 14221 - DNA, 20 bp, Artificial Sequence
  Description of Artificial Sequence: Synthetic oligonucleotide
  Target: FXN; (-) strand; PAM type: NRG; PAM sequence: CAG
acaaaaatcagaaatgcagc

SEQ ID NO: 14222 - DNA, 20 bp, Artificial Sequence
  Description of Artificial Sequence: Synthetic oligonucleotide
  Target: FXN; (-) strand; PAM type: NRG; PAM sequence: CAG
caaaacaaaaatcagaaatg

SEQ ID NO: 14223 - DNA, 20 bp, Artificial Sequence
  Description of Artificial Sequence: Synthetic oligonucleotide
  Target: FXN; (-) strand; PAM type: NRG; PAM sequence: CAG
aaaaaaaacaaaacaaaaat

SEQ ID NO: 14224 - DNA, 20 bp, Artificial Sequence
  Description of Artificial Sequence: Synthetic oligonucleotide
  Target: FXN; (-) strand; PAM type: NRG; PAM sequence: AAG
aattaaaaataaataaaatt

SEQ ID NO: 14225 - DNA, 20 bp, Artificial Sequence
  Description of Artificial Sequence: Synthetic oligonucleotide
  Target: FXN; (-) strand; PAM type: NRG; PAM sequence: GAG
accaacctaggcaacaaagt

SEQ ID NO: 14226 - DNA, 20 bp, Artificial Sequence
  Description of Artificial Sequence: Synthetic oligonucleotide
  Target: FXN; (-) strand; PAM type: NRG; PAM sequence: AAG
tcagaccaacctaggcaaca

SEQ ID NO: 14227 - DNA, 20 bp, Artificial Sequence
  Description of Artificial Sequence: Synthetic oligonucleotide
  Target: FXN; (-) strand; PAM type: NRG; PAM sequence: AGG
cacgagtttcagaccaacct

SEQ ID NO: 14228 - DNA, 20 bp, Artificial Sequence
  Description of Artificial Sequence: Synthetic oligonucleotide
  Target: FXN; (-) strand; PAM type: NRG; PAM sequence: TAG
ccacgagtttcagaccaacc

SEQ ID NO: 14229 - DNA, 20 bp, Artificial Sequence
  Description of Artificial Sequence: Synthetic oligonucleotide
  Target: FXN; (-) strand; PAM type: NRG; PAM sequence: CAG
ttgcttgaagccacgagttt

SEQ ID NO: 14230 - DNA, 20 bp, Artificial Sequence
  Description of Artificial Sequence: Synthetic oligonucleotide
  Target: FXN; (-) strand; PAM type: NRG; PAM sequence: GAG
ggaggattgcttgaagccac

SEQ ID NO: 14231 - DNA, 20 bp, Artificial Sequence
  Description of Artificial Sequence: Synthetic oligonucleotide
  Target: FXN; (-) strand; PAM type: NRG; PAM sequence: AAG
tgatgtgggaggattgcttg

SEQ ID NO: 14232 - DNA, 20 bp, Artificial Sequence
  Description of Artificial Sequence: Synthetic oligonucleotide
  Target: FXN; (-) strand; PAM type: NRG; PAM sequence: AGG
ctttgggaggctgatgtggg

SEQ ID NO: 14233 - DNA, 20 bp, Artificial Sequence
  Description of Artificial Sequence: Synthetic oligonucleotide
  Target: FXN; (-) strand; PAM type: NRG; PAM sequence: GAG
actttgggaggctgatgtgg

SEQ ID NO: 14234 - DNA, 20 bp, Artificial Sequence
  Description of Artificial Sequence: Synthetic oligonucleotide
  Target: FXN; (-) strand; PAM type: NRG; PAM sequence: GGG
gcactttgggaggctgatgt

SEQ ID NO: 14235 - DNA, 20 bp, Artificial Sequence
  Description of Artificial Sequence: Synthetic oligonucleotide
  Target: FXN; (-) strand; PAM type: NRG; PAM sequence: TGG
agcactttgggaggctgatg

SEQ ID NO: 14236 - DNA, 20 bp, Artificial Sequence
  Description of Artificial Sequence: Synthetic oligonucleotide
  Target: FXN; (-) strand; PAM type: NRG; PAM sequence: AGG
cataaccccagcactttggg

SEQ ID NO: 14237 - DNA, 20 bp, Artificial Sequence
  Description of Artificial Sequence: Synthetic oligonucleotide
  Target: FXN; (-) strand; PAM type: NRG; PAM sequence: GAG
ccataaccccagcactttgg

SEQ ID NO: 14238 - DNA, 20 bp, Artificial Sequence
  Description of Artificial Sequence: Synthetic oligonucleotide
  Target: FXN; (-) strand; PAM type: NRG; PAM sequence: GGG
acccataaccccagcacttt

SEQ ID NO: 14239 - DNA, 20 bp, Artificial Sequence
  Description of Artificial Sequence: Synthetic oligonucleotide
  Target: FXN; (-) strand; PAM type: NRG; PAM sequence: TGG
cacccataaccccagcactt

SEQ ID NO: 14240 - DNA, 20 bp, Artificial Sequence
  Description of Artificial Sequence: Synthetic oligonucleotide
  Target: FXN; (-) strand; PAM type: NRG; PAM sequence: CAG
gtggctcacacccataaccc

SEQ ID NO: 14241 - DNA, 20 bp, Artificial Sequence
  Description of Artificial Sequence: Synthetic oligonucleotide
  Target: FXN; (-) strand; PAM type: NRG; PAM sequence: TGG
aaaaaaacaggctgctgcag

SEQ ID NO: 14242 - DNA, 20 bp, Artificial Sequence
  Description of Artificial Sequence: Synthetic oligonucleotide
  Target: FXN; (-) strand; PAM type: NRG; PAM sequence: CAG
acaaaaaaaacaggctgctg

SEQ ID NO: 14243 - DNA, 20 bp, Artificial Sequence
  Description of Artificial Sequence: Synthetic oligonucleotide
  Target: FXN; (-) strand; PAM type: NRG; PAM sequence: AGG
aacaaacaaacaaaaaaaac

SEQ ID NO: 14244 - DNA, 20 bp, Artificial Sequence
  Description of Artificial Sequence: Synthetic oligonucleotide
  Target: FXN; (-) strand; PAM type: NRG; PAM sequence: CAG
aaacaaacaaacaaaaaaaa

SEQ ID NO: 14245 - DNA, 20 bp, Artificial Sequence
  Description of Artificial Sequence: Synthetic oligonucleotide
  Target: FXN; (-) strand; PAM type: NRG; PAM sequence: AGG
ggtaagactgctgatttcac

SEQ ID NO: 14246 - DNA, 20 bp, Artificial Sequence
  Description of Artificial Sequence: Synthetic oligonucleotide
  Target: FXN; (-) strand; PAM type: NRG; PAM sequence: CAG
aggtaagactgctgatttca

SEQ ID NO: 14247 - DNA, 20 bp, Artificial Sequence
  Description of Artificial Sequence: Synthetic oligonucleotide
  Target: FXN; (-) strand; PAM type: NRG; PAM sequence: AAG
gggtgcgcaaggtgggaggt

SEQ ID NO: 14248 - DNA, 20 bp, Artificial Sequence
  Description of Artificial Sequence: Synthetic oligonucleotide
  Target: FXN; (-) strand; PAM type: NRG; PAM sequence: AGG
ctcagggtgcgcaaggtggg

SEQ ID NO: 14249 - DNA, 20 bp, Artificial Sequence
  Description of Artificial Sequence: Synthetic oligonucleotide
  Target: FXN; (-) strand; PAM type: NRG; PAM sequence: GAG
cctcagggtgcgcaaggtgg

SEQ ID NO: 14250 - DNA, 20 bp, Artificial Sequence
  Description of Artificial Sequence: Synthetic oligonucleotide
  Target: FXN; (-) strand; PAM type: NRG; PAM sequence: GGG
ctcctcagggtgcgcaaggt

SEQ ID NO: 14251 - DNA, 20 bp, Artificial Sequence
  Description of Artificial Sequence: Synthetic oligonucleotide
  Target: FXN; (-) strand; PAM type: NRG; PAM sequence: TGG
cctcctcagggtgcgcaagg

SEQ ID NO: 14252 - DNA, 20 bp, Artificial Sequence
  Description of Artificial Sequence: Synthetic oligonucleotide
  Target: FXN; (-) strand; PAM type: NRG; PAM sequence: AGG
caacctcctcagggtgcgca

SEQ ID NO: 14253 - DNA, 20 bp, Artificial Sequence
  Description of Artificial Sequence: Synthetic oligonucleotide
  Target: FXN; (-) strand; PAM type: NRG; PAM sequence: AAG
gcaacctcctcagggtgcgc

SEQ ID NO: 14254 - DNA, 20 bp, Artificial Sequence
  Description of Artificial Sequence: Synthetic oligonucleotide
  Target: FXN; (-) strand; PAM type: NRG; PAM sequence: GGG
tttattctgcaacctcctca

SEQ ID NO: 14255 - DNA, 20 bp, Artificial Sequence
  Description of Artificial Sequence: Synthetic oligonucleotide
  Target: FXN; (-) strand; PAM type: NRG; PAM sequence: AGG
ctttattctgcaacctcctc

SEQ ID NO: 14256 - DNA, 20 bp, Artificial Sequence
  Description of Artificial Sequence: Synthetic oligonucleotide
  Target: FXN; (-) strand; PAM type: NRG; PAM sequence: CAG
cctttattctgcaacctcct

SEQ ID NO: 14257 - DNA, 20 bp, Artificial Sequence
  Description of Artificial Sequence: Synthetic oligonucleotide
  Target: FXN; (-) strand; PAM type: NRG; PAM sequence: TAG
cactgatgcccacgtgtccc

SEQ ID NO: 14258 - DNA, 20 bp, Artificial Sequence
  Description of Artificial Sequence: Synthetic oligonucleotide
  Target: FXN; (-) strand; PAM type: NRG; PAM sequence: AGG
gcctgaggtgctctgagcac

SEQ ID NO: 14259 - DNA, 20 bp, Artificial Sequence
  Description of Artificial Sequence: Synthetic oligonucleotide
  Target: FXN; (-) strand; PAM type: NRG; PAM sequence: CAG
tgcctgaggtgctctgagca

SEQ ID NO: 14260 - DNA, 20 bp, Artificial Sequence
  Description of Artificial Sequence: Synthetic oligonucleotide
  Target: FXN; (-) strand; PAM type: NRG; PAM sequence: GAG
cacactgcctgaggtgctct

SEQ ID NO: 14261 - DNA, 20 bp, Artificial Sequence
  Description of Artificial Sequence: Synthetic oligonucleotide
  Target: FXN; (-) strand; PAM type: NRG; PAM sequence: AGG
agacccctccacactgcctg

SEQ ID NO: 14262 - DNA, 20 bp, Artificial Sequence
  Description of Artificial Sequence: Synthetic oligonucleotide
  Target: FXN; (-) strand; PAM type: NRG; PAM sequence: GAG
tagacccctccacactgcct

SEQ ID NO: 14263 - DNA, 20 bp, Artificial Sequence
  Description of Artificial Sequence: Synthetic oligonucleotide
  Target: FXN; (-) strand; PAM type: NRG; PAM sequence: TAG
ggcagagcctgagtaacctc

SEQ ID NO: 14264 - DNA, 20 bp, Artificial Sequence
  Description of Artificial Sequence: Synthetic oligonucleotide
  Target: FXN; (-) strand; PAM type: NRG; PAM sequence: GAG
cgggttgccaggcagagcct

SEQ ID NO: 14265 - DNA, 20 bp, Artificial Sequence
  Description of Artificial Sequence: Synthetic oligonucleotide
  Target: FXN; (-) strand; PAM type: NRG; PAM sequence: GAG
tgctatcgggttgccaggca

SEQ ID NO: 14266 - DNA, 20 bp, Artificial Sequence
  Description of Artificial Sequence: Synthetic oligonucleotide
  Target: FXN; (-) strand; PAM type: NRG; PAM sequence: CAG
actgctatcgggttgccagg

SEQ ID NO: 14267 - DNA, 20 bp, Artificial Sequence
  Description of Artificial Sequence: Synthetic oligonucleotide
  Target: FXN; (-) strand; PAM type: NRG; PAM sequence: AGG
gatactgctatcgggttgcc

SEQ ID NO: 14268 - DNA, 20 bp, Artificial Sequence
  Description of Artificial Sequence: Synthetic oligonucleotide
  Target: FXN; (-) strand; PAM type: NRG; PAM sequence: CAG
tgatactgctatcgggttgc

SEQ ID NO: 14269 - DNA, 20 bp, Artificial Sequence
  Description of Artificial Sequence: Synthetic oligonucleotide
  Target: FXN; (-) strand; PAM type: NRG; PAM sequence: GGG
tatactctgatactgctatc

SEQ ID NO: 14270 - DNA, 20 bp, Artificial Sequence
  Description of Artificial Sequence: Synthetic oligonucleotide
  Target: FXN; (-) strand; PAM type: NRG; PAM sequence: CGG
ctatactctgatactgctat

SEQ ID NO: 14271 - DNA, 20 bp, Artificial Sequence
  Description of Artificial Sequence: Synthetic oligonucleotide
  Target: FXN; (-) strand; PAM type: NRG; PAM sequence: TGG
aagcccaaggaccgtcccct

SEQ ID NO: 14272 - DNA, 20 bp, Artificial Sequence
  Description of Artificial Sequence: Synthetic oligonucleotide
  Target: FXN; (-) strand; PAM type: NRG; PAM sequence: AGG
aataaaccacaccaagccca

SEQ ID NO: 14273 - DNA, 20 bp, Artificial Sequence
  Description of Artificial Sequence: Synthetic oligonucleotide
  Target: FXN; (-) strand; PAM type: NRG; PAM sequence: AAG
taataaaccacaccaagccc

SEQ ID NO: 14274 - DNA, 20 bp, Artificial Sequence
  Description of Artificial Sequence: Synthetic oligonucleotide
  Target: FXN; (-) strand; PAM type: NRG; PAM sequence: AAG
aaggactaataaaccacacc

SEQ ID NO: 14275 - DNA, 20 bp, Artificial Sequence
  Description of Artificial Sequence: Synthetic oligonucleotide
  Target: FXN; (-) strand; PAM type: NRG; PAM sequence: AGG
accatcagggtcacaggaaa

SEQ ID NO: 14276 - DNA, 20 bp, Artificial Sequence
  Description of Artificial Sequence: Synthetic oligonucleotide
  Target: FXN; (-) strand; PAM type: NRG; PAM sequence: AAG
aaccatcagggtcacaggaa

SEQ ID NO: 14277 - DNA, 20 bp, Artificial Sequence
  Description of Artificial Sequence: Synthetic oligonucleotide
  Target: FXN; (-) strand; PAM type: NRG; PAM sequence: AGG
aaccaaaccatcagggtcac

SEQ ID NO: 14278 - DNA, 20 bp, Artificial Sequence
  Description of Artificial Sequence: Synthetic oligonucleotide
  Target: FXN; (-) strand; PAM type: NRG; PAM sequence: CAG
gaaccaaaccatcagggtca

SEQ ID NO: 14279 - DNA, 20 bp, Artificial Sequence
  Description of Artificial Sequence: Synthetic oligonucleotide
  Target: FXN; (-) strand; PAM type: NRG; PAM sequence: GGG
atgagtgaaccaaaccatca

SEQ ID NO: 14280 - DNA, 20 bp, Artificial Sequence
  Description of Artificial Sequence: Synthetic oligonucleotide
  Target: FXN; (-) strand; PAM type: NRG; PAM sequence: AGG
aatgagtgaaccaaaccatc

SEQ ID NO: 14281 - DNA, 20 bp, Artificial Sequence
  Description of Artificial Sequence: Synthetic oligonucleotide
  Target: FXN; (-) strand; PAM type: NRG; PAM sequence: CAG
aaatgagtgaaccaaaccat

SEQ ID NO: 14282 - DNA, 20 bp, Artificial Sequence
  Description of Artificial Sequence: Synthetic oligonucleotide
  Target: FXN; (-) strand; PAM type: NRG; PAM sequence: GAG
cccagtatggagataaaaat

SEQ ID NO: 14283 - DNA, 20 bp, Artificial Sequence
  Description of Artificial Sequence: Synthetic oligonucleotide
  Target: FXN; (-) strand; PAM type: NRG; PAM sequence: GAG
ttgaacctgttcccagtatg

SEQ ID NO: 14284 - DNA, 20 bp, Artificial Sequence
  Description of Artificial Sequence: Synthetic oligonucleotide
  Target: FXN; (-) strand; PAM type: NRG; PAM sequence: TGG
gcttgaacctgttcccagta

SEQ ID NO: 14285 - DNA, 20 bp, Artificial Sequence
  Description of Artificial Sequence: Synthetic oligonucleotide
  Target: FXN; (-) strand; PAM type: NRG; PAM sequence: CAG
ctggggcttgaacctgttcc

SEQ ID NO: 14286 - DNA, 20 bp, Artificial Sequence
  Description of Artificial Sequence: Synthetic oligonucleotide
  Target: FXN; (-) strand; PAM type: NRG; PAM sequence: GGG
gcattatcaaccaaatgctg

SEQ ID NO: 14287 - DNA, 20 bp, Artificial Sequence
  Description of Artificial Sequence: Synthetic oligonucleotide
  Target: FXN; (-) strand; PAM type: NRG; PAM sequence: GGG
tgcattatcaaccaaatgct

SEQ ID NO: 14288 - DNA, 20 bp, Artificial Sequence
  Description of Artificial Sequence: Synthetic oligonucleotide
  Target: FXN; (-) strand; PAM type: NRG; PAM sequence: TGG
ctgcattatcaaccaaatgc

SEQ ID NO: 14289 - DNA, 20 bp, Artificial Sequence
  Description of Artificial Sequence: Synthetic oligonucleotide
  Target: FXN; (-) strand; PAM type: NRG; PAM sequence: AGG
cttgggcaataaaagtatca

SEQ ID NO: 14290 - DNA, 20 bp, Artificial Sequence
  Description of Artificial Sequence: Synthetic oligonucleotide
  Target: FXN; (-) strand; PAM type: NRG; PAM sequence: AAG
gcttgggcaataaaagtatc

SEQ ID NO: 14291 - DNA, 20 bp, Artificial Sequence
  Description of Artificial Sequence: Synthetic oligonucleotide
  Target: FXN; (-) strand; PAM type: NRG; PAM sequence: AAG
aagggaagcttgggcaataa

SEQ ID NO: 14292 - DNA, 20 bp, Artificial Sequence
  Description of Artificial Sequence: Synthetic oligonucleotide
  Target: FXN; (-) strand; PAM type: NRG; PAM sequence: GGG
gtcaccaggaagggaagctt

SEQ ID NO: 14293 - DNA, 20 bp, Artificial Sequence
  Description of Artificial Sequence: Synthetic oligonucleotide
  Target: FXN; (-) strand; PAM type: NRG; PAM sequence: TGG
ggtcaccaggaagggaagct

SEQ ID NO: 14294 - DNA, 20 bp, Artificial Sequence
  Description of Artificial Sequence: Synthetic oligonucleotide
  Target: FXN; (-) strand; PAM type: NRG; PAM sequence: AAG
gatgaggtcaccaggaaggg

SEQ ID NO: 14295 - DNA, 20 bp, Artificial Sequence
  Description of Artificial Sequence: Synthetic oligonucleotide
  Target: FXN; (-) strand; PAM type: NRG; PAM sequence: GGG
taggatgaggtcaccaggaa

SEQ ID NO: 14296 - DNA, 20 bp, Artificial Sequence
  Description of Artificial Sequence: Synthetic oligonucleotide
  Target: FXN; (-) strand; PAM type: NRG; PAM sequence: AGG
ctaggatgaggtcaccagga

SEQ ID NO: 14297 - DNA, 20 bp, Artificial Sequence
  Description of Artificial Sequence: Synthetic oligonucleotide
  Target: FXN; (-) strand; PAM type: NRG; PAM sequence: AAG
gctaggatgaggtcaccagg

SEQ ID NO: 14298 - DNA, 20 bp, Artificial Sequence
  Description of Artificial Sequence: Synthetic oligonucleotide
  Target: FXN; (-) strand; PAM type: NRG; PAM sequence: AGG
gaggctaggatgaggtcacc

SEQ ID NO: 14299 - DNA, 20 bp, Artificial Sequence
  Description of Artificial Sequence: Synthetic oligonucleotide
  Target: FXN; (-) strand; PAM type: NRG; PAM sequence: CAG
tgaggctaggatgaggtcac

SEQ ID NO: 14300 - DNA, 20 bp, Artificial Sequence
  Description of Artificial Sequence: Synthetic oligonucleotide
  Target: FXN; (-) strand; PAM type: NRG; PAM sequence: AGG
caaagactgaggctaggatg

SEQ ID NO: 14301 - DNA, 20 bp, Artificial Sequence
  Description of Artificial Sequence: Synthetic oligonucleotide
  Target: FXN; (-) strand; PAM type: NRG; PAM sequence: GAG
ccaaagactgaggctaggat

SEQ ID NO: 14302 - DNA, 20 bp, Artificial Sequence
  Description of Artificial Sequence: Synthetic oligonucleotide
  Target: FXN; (-) strand; PAM type: NRG; PAM sequence: AGG
cttttccaaagactgaggct

SEQ ID NO: 14303 - DNA, 20 bp, Artificial Sequence
  Description of Artificial Sequence: Synthetic oligonucleotide
  Target: FXN; (-) strand; PAM type: NRG; PAM sequence: TAG
gcttttccaaagactgaggc

SEQ ID NO: 14304 - DNA, 20 bp, Artificial Sequence
  Description of Artificial Sequence: Synthetic oligonucleotide
  Target: FXN; (-) strand; PAM type: NRG; PAM sequence: AGG
gagggcttttccaaagactg

SEQ ID NO: 14305 - DNA, 20 bp, Artificial Sequence
  Description of Artificial Sequence: Synthetic oligonucleotide
  Target: FXN; (-) strand; PAM type: NRG; PAM sequence: GAG
ggagggcttttccaaagact

SEQ ID NO: 14306 - DNA, 20 bp, Artificial Sequence
  Description of Artificial Sequence: Synthetic oligonucleotide
  Target: FXN; (-) strand; PAM type: NRG; PAM sequence: AAG
actcaaggagggcttttcca

SEQ ID NO: 14307 - DNA, 20 bp, Artificial Sequence
  Description of Artificial Sequence: Synthetic oligonucleotide
  Target: FXN; (-) strand; PAM type: NRG; PAM sequence: GGG
tctgcctgagcactcaagga

SEQ ID NO: 14308 - DNA, 20 bp, Artificial Sequence
  Description of Artificial Sequence: Synthetic oligonucleotide
  Target: FXN; (-) strand; PAM type: NRG; PAM sequence: AGG
gtctgcctgagcactcaagg

SEQ ID NO: 14309 - DNA, 20 bp, Artificial Sequence
  Description of Artificial Sequence: Synthetic oligonucleotide
  Target: FXN; (-) strand; PAM type: NRG; PAM sequence: GAG
agtctgcctgagcactcaag

SEQ ID NO: 14310 - DNA, 20 bp, Artificial Sequence
  Description of Artificial Sequence: Synthetic oligonucleotide
  Target: FXN; (-) strand; PAM type: NRG; PAM sequence: AGG
tgagtctgcctgagcactca

SEQ ID NO: 14311 - DNA, 20 bp, Artificial Sequence
  Description of Artificial Sequence: Synthetic oligonucleotide
  Target: FXN; (-) strand; PAM type: NRG; PAM sequence: AAG
ctgagtctgcctgagcactc

SEQ ID NO: 14312 - DNA, 20 bp, Artificial Sequence
  Description of Artificial Sequence: Synthetic oligonucleotide
  Target: FXN; (-) strand; PAM type: NRG; PAM sequence: GAG
aagggcacctgagtctgcct

SEQ ID NO: 14313 - DNA, 20 bp, Artificial Sequence
  Description of Artificial Sequence: Synthetic oligonucleotide
  Target: FXN; (-) strand; PAM type: NRG; PAM sequence: GAG
gcccagaagaaagggcacct

SEQ ID NO: 14314 - DNA, 20 bp, Artificial Sequence
  Description of Artificial Sequence: Synthetic oligonucleotide
  Target: FXN; (-) strand; PAM type: NRG; PAM sequence: GGG
gcatgggagcccagaagaaa

SEQ ID NO: 14315 - DNA, 20 bp, Artificial Sequence
  Description of Artificial Sequence: Synthetic oligonucleotide
  Target: FXN; (-) strand; PAM type: NRG; PAM sequence: AGG
tgcatgggagcccagaagaa

SEQ ID NO: 14316 - DNA, 20 bp, Artificial Sequence
  Description of Artificial Sequence: Synthetic oligonucleotide
  Target: FXN; (-) strand; PAM type: NRG; PAM sequence: AAG
gtgcatgggagcccagaaga

SEQ ID NO: 14317 - DNA, 20 bp, Artificial Sequence
  Description of Artificial Sequence: Synthetic oligonucleotide
  Target: FXN; (-) strand; PAM type: NRG; PAM sequence: AAG
cagagtgcatgggagcccag

SEQ ID NO: 14318 - DNA, 20 bp, Artificial Sequence
  Description of Artificial Sequence: Synthetic oligonucleotide
  Target: FXN; (-) strand; PAM type: NRG; PAM sequence: CAG
gaacagagtgcatgggagcc

SEQ ID NO: 14319 - DNA, 20 bp, Artificial Sequence
  Description of Artificial Sequence: Synthetic oligonucleotide
  Target: FXN; (-) strand; PAM type: NRG; PAM sequence: GAG
ggtaagaacagagtgcatgg

SEQ ID NO: 14320 - DNA, 20 bp, Artificial Sequence
  Description of Artificial Sequence: Synthetic oligonucleotide
  Target: FXN; (-) strand; PAM type: NRG; PAM sequence: GGG
gaggtaagaacagagtgcat

SEQ ID NO: 14321 - DNA, 20 bp, Artificial Sequence
  Description of Artificial Sequence: Synthetic oligonucleotide
  Target: FXN; (-) strand; PAM type: NRG; PAM sequence: TGG
ggaggtaagaacagagtgca

SEQ ID NO: 14322 - DNA, 20 bp, Artificial Sequence
  Description of Artificial Sequence: Synthetic oligonucleotide
  Target: FXN; (-) strand; PAM type: NRG; PAM sequence: GAG
ccctgatggaggtaagaaca

SEQ ID NO: 14323 - DNA, 20 bp, Artificial Sequence
  Description of Artificial Sequence: Synthetic oligonucleotide
  Target: FXN; (-) strand; PAM type: NRG; PAM sequence: CAG
caccctgatggaggtaagaa

SEQ ID NO: 14324 - DNA, 20 bp, Artificial Sequence
  Description of Artificial Sequence: Synthetic oligonucleotide
  Target: FXN; (-) strand; PAM type: NRG; PAM sequence: AAG
tgtggcaccctgatggaggt

SEQ ID NO: 14325 - DNA, 20 bp, Artificial Sequence
  Description of Artificial Sequence: Synthetic oligonucleotide
  Target: FXN; (-) strand; PAM type: NRG; PAM sequence: AGG
tgcatgtggcaccctgatgg

SEQ ID NO: 14326 - DNA, 20 bp, Artificial Sequence
  Description of Artificial Sequence: Synthetic oligonucleotide
  Target: FXN; (-) strand; PAM type: NRG; PAM sequence: GAG
gtgcatgtggcaccctgatg

SEQ ID NO: 14327 - DNA, 20 bp, Artificial Sequence
  Description of Artificial Sequence: Synthetic oligonucleotide
  Target: FXN; (-) strand; PAM type: NRG; PAM sequence: TGG
tagtgcatgtggcaccctga

SEQ ID NO: 14328 - DNA, 20 bp, Artificial Sequence
  Description of Artificial Sequence: Synthetic oligonucleotide
  Target: FXN; (-) strand; PAM type: NRG; PAM sequence: TGG
gcagataacactagtgcatg

SEQ ID NO: 14329 - DNA, 20 bp, Artificial Sequence
  Description of Artificial Sequence: Synthetic oligonucleotide
  Target: FXN; (-) strand; PAM type: NRG; PAM sequence: TAG
gccacggcagcagataacac

SEQ ID NO: 14330 - DNA, 20 bp, Artificial Sequence
  Description of Artificial Sequence: Synthetic oligonucleotide
  Target: FXN; (-) strand; PAM type: NRG; PAM sequence: CAG
tggatgattggccacggcag

SEQ ID NO: 14331 - DNA, 20 bp, Artificial Sequence
  Description of Artificial Sequence: Synthetic oligonucleotide
  Target: FXN; (-) strand; PAM type: NRG; PAM sequence: CAG
tcatggatgattggccacgg

SEQ ID NO: 14332 - DNA, 20 bp, Artificial Sequence
  Description of Artificial Sequence: Synthetic oligonucleotide
  Target: FXN; (-) strand; PAM type: NRG; PAM sequence: CGG
gcctcatggatgattggcca

SEQ ID NO: 14333 - DNA, 20 bp, Artificial Sequence
  Description of Artificial Sequence: Synthetic oligonucleotide
  Target: FXN; (-) strand; PAM type: NRG; PAM sequence: TGG
ctcatggcctcatggatgat

SEQ ID NO: 14334 - DNA, 20 bp, Artificial Sequence
  Description of Artificial Sequence: Synthetic oligonucleotide
  Target: FXN; (-) strand; PAM type: NRG; PAM sequence: TGG
tccacttcctcatggcctca

SEQ ID NO: 14335 - DNA, 20 bp, Artificial Sequence
  Description of Artificial Sequence: Synthetic oligonucleotide
  Target: FXN; (-) strand; PAM type: NRG; PAM sequence: TGG
atgtacattccacttcctca

SEQ ID NO: 14336 - DNA, 20 bp, Artificial Sequence
  Description of Artificial Sequence: Synthetic oligonucleotide
  Target: FXN; (-) strand; PAM type: NRG; PAM sequence: CAG
tctgccatgtcttcttatac

SEQ ID NO: 14337 - DNA, 20 bp, Artificial Sequence
  Description of Artificial Sequence: Synthetic oligonucleotide
  Target: FXN; (-) strand; PAM type: NRG; PAM sequence: TGG
cgtgtggacagatcggaggc

SEQ ID NO: 14338 - DNA, 20 bp, Artificial Sequence
  Description of Artificial Sequence: Synthetic oligonucleotide
  Target: FXN; (-) strand; PAM type: NRG; PAM sequence: AGG
tattcgtgtggacagatcgg

SEQ ID NO: 14339 - DNA, 20 bp, Artificial Sequence
  Description of Artificial Sequence: Synthetic oligonucleotide
  Target: FXN; (-) strand; PAM type: NRG; PAM sequence: GAG
gtattcgtgtggacagatcg

SEQ ID NO: 14340 - DNA, 20 bp, Artificial Sequence
  Description of Artificial Sequence: Synthetic oligonucleotide
  Target: FXN; (-) strand; PAM type: NRG; PAM sequence: CGG
ctgtattcgtgtggacagat

SEQ ID NO: 14341 - DNA, 20 bp, Artificial Sequence
  Description of Artificial Sequence: Synthetic oligonucleotide
  Target: FXN; (-) strand; PAM type: NRG; PAM sequence: CAG
gaatgctgtattcgtgtgga

SEQ ID NO: 14342 - DNA, 20 bp, Artificial Sequence
  Description of Artificial Sequence: Synthetic oligonucleotide
  Target: FXN; (-) strand; PAM type: NRG; PAM sequence: TGG
ttgggaatgctgtattcgtg

SEQ ID NO: 14343 - DNA, 20 bp, Artificial Sequence
  Description of Artificial Sequence: Synthetic oligonucleotide
  Target: FXN; (-) strand; PAM type: NRG; PAM sequence: GGG
tggcacatgcacgttgcttt

SEQ ID NO: 14344 - DNA, 20 bp, Artificial Sequence
  Description of Artificial Sequence: Synthetic oligonucleotide
  Target: FXN; (-) strand; PAM type: NRG; PAM sequence: TGG
atggcacatgcacgttgctt

SEQ ID NO: 14345 - DNA, 20 bp, Artificial Sequence
  Description of Artificial Sequence: Synthetic oligonucleotide
  Target: FXN; (-) strand; PAM type: NRG; PAM sequence: TGG
caagctcatccagtgaataa

SEQ ID NO: 14346 - DNA, 20 bp, Artificial Sequence
  Description of Artificial Sequence: Synthetic oligonucleotide
  Target: FXN; (-) strand; PAM type: NRG; PAM sequence: CAG
tcatccacctcaagctcatc

SEQ ID NO: 14347 - DNA, 20 bp, Artificial Sequence
  Description of Artificial Sequence: Synthetic oligonucleotide
  Target: FXN; (-) strand; PAM type: NRG; PAM sequence: AAG
tgggctagttcatccacctc

SEQ ID NO: 14348 - DNA, 20 bp, Artificial Sequence
  Description of Artificial Sequence: Synthetic oligonucleotide
  Target: FXN; (-) strand; PAM type: NRG; PAM sequence: TAG
acattgagagcctggtgggc

SEQ ID NO: 14349 - DNA, 20 bp, Artificial Sequence
  Description of Artificial Sequence: Synthetic oligonucleotide
  Target: FXN; (-) strand; PAM type: NRG; PAM sequence: GGG
catgacattgagagcctggt

SEQ ID NO: 14350 - DNA, 20 bp, Artificial Sequence
  Description of Artificial Sequence: Synthetic oligonucleotide
  Target: FXN; (-) strand; PAM type: NRG; PAM sequence: TGG
tcatgacattgagagcctgg

SEQ ID NO: 14351 - DNA, 20 bp, Artificial Sequence
  Description of Artificial Sequence: Synthetic oligonucleotide
  Target: FXN; (-) strand; PAM type: NRG; PAM sequence: TGG
aattcatgacattgagagcc

SEQ ID NO: 14352 - DNA, 20 bp, Artificial Sequence
  Description of Artificial Sequence: Synthetic oligonucleotide
  Target: FXN; (-) strand; PAM type: NRG; PAM sequence: GAG
tgttaaattcatgacattga

SEQ ID NO: 14353 - DNA, 20 bp, Artificial Sequence
  Description of Artificial Sequence: Synthetic oligonucleotide
  Target: FXN; (-) strand; PAM type: NRG; PAM sequence: GAG
agtgttaaattcatgacatt

SEQ ID NO: 14354 - DNA, 20 bp, Artificial Sequence
  Description of Artificial Sequence: Synthetic oligonucleotide
  Target: FXN; (-) strand; PAM type: NRG; PAM sequence: CAG
aaaacatatttttcttaatt

SEQ ID NO: 14355 - DNA, 20 bp, Artificial Sequence
  Description of Artificial Sequence: Synthetic oligonucleotide
  Target: FXN; (-) strand; PAM type: NRG; PAM sequence: CAG
tccttcctctcctagcaccc

SEQ ID NO: 14356 - DNA, 20 bp, Artificial Sequence
  Description of Artificial Sequence: Synthetic oligonucleotide
  Target: FXN; (-) strand; PAM type: NRG; PAM sequence: TAG
ttccccattccttcctctcc

SEQ ID NO: 14357 - DNA, 20 bp, Artificial Sequence
  Description of Artificial Sequence: Synthetic oligonucleotide
  Target: FXN; (-) strand; PAM type: NRG; PAM sequence: CAG
ggccaactatacccattaaa

SEQ ID NO: 14358 - DNA, 20 bp, Artificial Sequence
  Description of Artificial Sequence: Synthetic oligonucleotide
  Target: FXN; (-) strand; PAM type: NRG; PAM sequence: AGG
gtggaacccacagatacaca

SEQ ID NO: 14359 - DNA, 20 bp, Artificial Sequence
  Description of Artificial Sequence: Synthetic oligonucleotide
  Target: FXN; (-) strand; PAM type: NRG; PAM sequence: AAG
tgtggaacccacagatacac

SEQ ID NO: 14360 - DNA, 20 bp, Artificial Sequence
  Description of Artificial Sequence: Synthetic oligonucleotide
  Target: FXN; (-) strand; PAM type: NRG; PAM sequence: CAG
tgaatcagatgtggaaccca

SEQ ID NO: 14361 - DNA, 20 bp, Artificial Sequence
  Description of Artificial Sequence: Synthetic oligonucleotide
  Target: FXN; (-) strand; PAM type: NRG; PAM sequence: TGG
acggttggttgaatcagatg

SEQ ID NO: 14362 - DNA, 20 bp, Artificial Sequence
  Description of Artificial Sequence: Synthetic oligonucleotide
  Target: FXN; (-) strand; PAM type: NRG; PAM sequence: CAG
tgatccacggttggttgaat

SEQ ID NO: 14363 - DNA, 20 bp, Artificial Sequence
  Description of Artificial Sequence: Synthetic oligonucleotide
  Target: FXN; (-) strand; PAM type: NRG; PAM sequence: TGG
caaatattttgatccacggt

SEQ ID NO: 14364 - DNA, 20 bp, Artificial Sequence
  Description of Artificial Sequence: Synthetic oligonucleotide
  Target: FXN; (-) strand; PAM type: NRG; PAM sequence: CGG
ttttcaaatattttgatcca

SEQ ID NO: 14365 - DNA, 20 bp, Artificial Sequence
  Description of Artificial Sequence: Synthetic oligonucleotide
  Target: FXN; (-) strand; PAM type: NRG; PAM sequence: TGG
gctgttaatagttgttatat

SEQ ID NO: 14366 - DNA, 20 bp, Artificial Sequence
  Description of Artificial Sequence: Synthetic oligonucleotide
  Target: FXN; (-) strand; PAM type: NRG; PAM sequence: TAG
tacaatgtaaatgctgttaa

SEQ ID NO: 14367 - DNA, 20 bp, Artificial Sequence
  Description of Artificial Sequence: Synthetic oligonucleotide
  Target: FXN; (-) strand; PAM type: NRG; PAM sequence: TAG
tccagattacttataatgcc

SEQ ID NO: 14368 - DNA, 20 bp, Artificial Sequence
  Description of Artificial Sequence: Synthetic oligonucleotide
  Target: FXN; (-) strand; PAM type: NRG; PAM sequence: CAG
tgtatgctttaagtcatctc

SEQ ID NO: 14369 - DNA, 20 bp, Artificial Sequence
  Description of Artificial Sequence: Synthetic oligonucleotide
  Target: FXN; (-) strand; PAM type: NRG; PAM sequence: AAG
cacatccttctgtatgcttt

SEQ ID NO: 14370 - DNA, 20 bp, Artificial Sequence
  Description of Artificial Sequence: Synthetic oligonucleotide
  Target: FXN; (-) strand; PAM type: NRG; PAM sequence: AGG
acgatacatgcatctaacct

SEQ ID NO: 14371 - DNA, 20 bp, Artificial Sequence
  Description of Artificial Sequence: Synthetic oligonucleotide
  Target: FXN; (-) strand; PAM type: NRG; PAM sequence: TAG
tacgatacatgcatctaacc

SEQ ID NO: 14372 - DNA, 20 bp, Artificial Sequence
  Description of Artificial Sequence: Synthetic oligonucleotide
  Target: FXN; (-) strand; PAM type: NRG; PAM sequence: TGG
ctcaagtccctgatatgaaa

SEQ ID NO: 14373 - DNA, 20 bp, Artificial Sequence
  Description of Artificial Sequence: Synthetic oligonucleotide
  Target: FXN; (-) strand; PAM type: NRG; PAM sequence: AAG
accaaaatccgtgggtactc

SEQ ID NO: 14374 - DNA, 20 bp, Artificial Sequence
  Description of Artificial Sequence: Synthetic oligonucleotide
  Target: FXN; (-) strand; PAM type: NRG; PAM sequence: GGG
ctgcagataccaaaatccgt

SEQ ID NO: 14375 - DNA, 20 bp, Artificial Sequence
  Description of Artificial Sequence: Synthetic oligonucleotide
  Target: FXN; (-) strand; PAM type: NRG; PAM sequence: TGG
tctgcagataccaaaatccg

SEQ ID NO: 14376 - DNA, 20 bp, Artificial Sequence
  Description of Artificial Sequence: Synthetic oligonucleotide
  Target: FXN; (-) strand; PAM type: NRG; PAM sequence: CAG
ggaaggggttccaggatctg

SEQ ID NO: 14377 - DNA, 20 bp, Artificial Sequence
  Description of Artificial Sequence: Synthetic oligonucleotide
  Target: FXN; (-) strand; PAM type: NRG; PAM sequence: AGG
atccatagggaaggggttcc

SEQ ID NO: 14378 - DNA, 20 bp, Artificial Sequence
  Description of Artificial Sequence: Synthetic oligonucleotide
  Target: FXN; (-) strand; PAM type: NRG; PAM sequence: CAG
tatccatagggaaggggttc

SEQ ID NO: 14379 - DNA, 20 bp, Artificial Sequence
  Description of Artificial Sequence: Synthetic oligonucleotide
  Target: FXN; (-) strand; PAM type: NRG; PAM sequence: GGG
ccttggtatccatagggaag

SEQ ID NO: 14380 - DNA, 20 bp, Artificial Sequence
  Description of Artificial Sequence: Synthetic oligonucleotide
  Target: FXN; (-) strand; PAM type: NRG; PAM sequence: GGG
tccttggtatccatagggaa

SEQ ID NO: 14381 - DNA, 20 bp, Artificial Sequence
  Description of Artificial Sequence: Synthetic oligonucleotide
  Target: FXN; (-) strand; PAM type: NRG; PAM sequence: AGG
ttccttggtatccataggga

SEQ ID NO: 14382 - DNA, 20 bp, Artificial Sequence
  Description of Artificial Sequence: Synthetic oligonucleotide
  Target: FXN; (-) strand; PAM type: NRG; PAM sequence: AAG
gttccttggtatccataggg

SEQ ID NO: 14383 - DNA, 20 bp, Artificial Sequence
  Description of Artificial Sequence: Synthetic oligonucleotide
  Target: FXN; (-) strand; PAM type: NRG; PAM sequence: GGG
gttgttccttggtatccata

SEQ ID NO: 14384 - DNA, 20 bp, Artificial Sequence
  Description of Artificial Sequence: Synthetic oligonucleotide
  Target: FXN; (-) strand; PAM type: NRG; PAM sequence: AGG
tgttgttccttggtatccat

SEQ ID NO: 14385 - DNA, 20 bp, Artificial Sequence
  Description of Artificial Sequence: Synthetic oligonucleotide
  Target: FXN; (-) strand; PAM type: NRG; PAM sequence: TAG
ctgttgttccttggtatcca

SEQ ID NO: 14386 - DNA, 20 bp, Artificial Sequence
  Description of Artificial Sequence: Synthetic oligonucleotide
  Target: FXN; (-) strand; PAM type: NRG; PAM sequence: TGG
gacccagtgctgttgttcct

SEQ ID NO: 14387 - DNA, 20 bp, Artificial Sequence
  Description of Artificial Sequence: Synthetic oligonucleotide
  Target: FXN; (-) strand; PAM type: NRG; PAM sequence: CAG
catcaccccaaaaggagacc

SEQ ID NO: 14388 - DNA, 20 bp, Artificial Sequence
  Description of Artificial Sequence: Synthetic oligonucleotide
  Target: FXN; (-) strand; PAM type: NRG; PAM sequence: GAG
catctgcatcaccccaaaag

SEQ ID NO: 14389 - DNA, 20 bp, Artificial Sequence
  Description of Artificial Sequence: Synthetic oligonucleotide
  Target: FXN; (-) strand; PAM type: NRG; PAM sequence: AGG
aacatctgcatcaccccaaa

SEQ ID NO: 14390 - DNA, 20 bp, Artificial Sequence
  Description of Artificial Sequence: Synthetic oligonucleotide
  Target: FXN; (-) strand; PAM type: NRG; PAM sequence: AAG
aaacatctgcatcaccccaa

SEQ ID NO: 14391 - DNA, 20 bp, Artificial Sequence
  Description of Artificial Sequence: Synthetic oligonucleotide
  Target: FXN; (-) strand; PAM type: NRG; PAM sequence: TAG
gtgcaaccactacctctgcc

SEQ ID NO: 14392 - DNA, 20 bp, Artificial Sequence
  Description of Artificial Sequence: Synthetic oligonucleotide
  Target: FXN; (-) strand; PAM type: NRG; PAM sequence: TAG
atgaataatttggtggcatt

SEQ ID NO: 14393 - DNA, 20 bp, Artificial Sequence
  Description of Artificial Sequence: Synthetic oligonucleotide
  Target: FXN; (-) strand; PAM type: NRG; PAM sequence: TGG
tttaaaaatgaataatttgg

SEQ ID NO: 14394 - DNA, 20 bp, Artificial Sequence
  Description of Artificial Sequence: Synthetic oligonucleotide
  Target: FXN; (-) strand; PAM type: NRG; PAM sequence: TGG
ccatttaaaaatgaataatt

SEQ ID NO: 14395 - DNA, 20 bp, Artificial Sequence
  Description of Artificial Sequence: Synthetic oligonucleotide
  Target: FXN; (-) strand; PAM type: NRG; PAM sequence: AGG
tataatattattagttgtta

SEQ ID NO: 14396 - DNA, 20 bp, Artificial Sequence
  Description of Artificial Sequence: Synthetic oligonucleotide
  Target: FXN; (-) strand; PAM type: NRG; PAM sequence: AAG
ctataatattattagttgtt

SEQ ID NO: 14397 - DNA, 20 bp, Artificial Sequence
  Description of Artificial Sequence: Synthetic oligonucleotide
  Target: FXN; (-) strand; PAM type: NRG; PAM sequence: TAG
tgccttacctataatattat

SEQ ID NO: 14398 - DNA, 20 bp, Artificial Sequence
  Description of Artificial Sequence: Synthetic oligonucleotide
  Target: FXN; (-) strand; PAM type: NRG; PAM sequence: CAG
ttagggccatttttgtgcta

SEQ ID NO: 14399 - DNA, 20 bp, Artificial Sequence
  Description of Artificial Sequence: Synthetic oligonucleotide
  Target: FXN; (-) strand; PAM type: NRG; PAM sequence: GGG
gagcagtgttttaaaaatta

SEQ ID NO: 14400 - DNA, 20 bp, Artificial Sequence
  Description of Artificial Sequence: Synthetic oligonucleotide
  Target: FXN; (-) strand; PAM type: NRG; PAM sequence: AGG
ggagcagtgttttaaaaatt

SEQ ID NO: 14401 - DNA, 20 bp, Artificial Sequence
  Description of Artificial Sequence: Synthetic oligonucleotide
  Target: FXN; (-) strand; PAM type: NRG; PAM sequence: TAG
tggagcagtgttttaaaaat

SEQ ID NO: 14402 - DNA, 20 bp, Artificial Sequence
  Description of Artificial Sequence: Synthetic oligonucleotide
  Target: FXN; (-) strand; PAM type: NRG; PAM sequence: CAG
tgatacctgctatgctggag

SEQ ID NO: 14403 - DNA, 20 bp, Artificial Sequence
  Description of Artificial Sequence: Synthetic oligonucleotide
  Target: FXN; (-) strand; PAM type: NRG; PAM sequence: GAG
atgtgatacctgctatgctg

SEQ ID NO: 14404 - DNA, 20 bp, Artificial Sequence
  Description of Artificial Sequence: Synthetic oligonucleotide
  Target: FXN; (-) strand; PAM type: NRG; PAM sequence: TGG
acatgtgatacctgctatgc

SEQ ID NO: 14405 - DNA, 20 bp, Artificial Sequence
  Description of Artificial Sequence: Synthetic oligonucleotide
  Target: FXN; (-) strand; PAM type: NRG; PAM sequence: CAG
aggtatcacactttgatctc

SEQ ID NO: 14406 - DNA, 20 bp, Artificial Sequence
  Description of Artificial Sequence: Synthetic oligonucleotide
  Target: FXN; (-) strand; PAM type: NRG; PAM sequence: AGG
acccttactgataagtctcc

SEQ ID NO: 14407 - DNA, 20 bp, Artificial Sequence
  Description of Artificial Sequence: Synthetic oligonucleotide
  Target: FXN; (-) strand; PAM type: NRG; PAM sequence: CAG
gacccttactgataagtctc

SEQ ID NO: 14408 - DNA, 20 bp, Artificial Sequence
  Description of Artificial Sequence: Synthetic oligonucleotide
  Target: FXN; (-) strand; PAM type: NRG; PAM sequence: AAG
aacatttgacccttactgat

SEQ ID NO: 14409 - DNA, 20 bp, Artificial Sequence
  Description of Artificial Sequence: Synthetic oligonucleotide
  Target: FXN; (-) strand; PAM type: NRG; PAM sequence: AAG
atatcttctggaacaattcc

SEQ ID NO: 14410 - DNA, 20 bp, Artificial Sequence
  Description of Artificial Sequence: Synthetic oligonucleotide
  Target: FXN; (-) strand; PAM type: NRG; PAM sequence: TGG
gagttatacgatatatcttc

SEQ ID NO: 14411 - DNA, 20 bp, Artificial Sequence
  Description of Artificial Sequence: Synthetic oligonucleotide
  Target: FXN; (-) strand; PAM type: NRG; PAM sequence: GAG
cttatcttagcatctaagaa

SEQ ID NO: 14412 - DNA, 20 bp, Artificial Sequence
  Description of Artificial Sequence: Synthetic oligonucleotide
  Target: FXN; (-) strand; PAM type: NRG; PAM sequence: AAG
ttcttatcttagcatctaag

SEQ ID NO: 14413 - DNA, 20 bp, Artificial Sequence
  Description of Artificial Sequence: Synthetic oligonucleotide
  Target: FXN; (-) strand; PAM type: NRG; PAM sequence: AAG
gccttcttatcttagcatct

SEQ ID NO: 14414 - DNA, 20 bp, Artificial Sequence
  Description of Artificial Sequence: Synthetic oligonucleotide
  Target: FXN; (-) strand; PAM type: NRG; PAM sequence: TAG
gtatatctgccttcttatct

SEQ ID NO: 14415 - DNA, 20 bp, Artificial Sequence
  Description of Artificial Sequence: Synthetic oligonucleotide
  Target: FXN; (-) strand; PAM type: NRG; PAM sequence: TAG
gaaaataacacaaaatgagc

SEQ ID NO: 14416 - DNA, 20 bp, Artificial Sequence
  Description of Artificial Sequence: Synthetic oligonucleotide
  Target: FXN; (-) strand; PAM type: NRG; PAM sequence: GAG
tctagaaaataacacaaaat

SEQ ID NO: 14417 - DNA, 20 bp, Artificial Sequence
  Description of Artificial Sequence: Synthetic oligonucleotide
  Target: FXN; (-) strand; PAM type: NRG; PAM sequence: TAG
aattgactggagtaaagctc

SEQ ID NO: 14418 - DNA, 20 bp, Artificial Sequence
  Description of Artificial Sequence: Synthetic oligonucleotide
  Target: FXN; (-) strand; PAM type: NRG; PAM sequence: AAG
ccaagaaattgactggagta

SEQ ID NO: 14419 - DNA, 20 bp, Artificial Sequence
  Description of Artificial Sequence: Synthetic oligonucleotide
  Target: FXN; (-) strand; PAM type: NRG; PAM sequence: GAG
tgcccccaagaaattgactg

SEQ ID NO: 14420 - DNA, 20 bp, Artificial Sequence
  Description of Artificial Sequence: Synthetic oligonucleotide
  Target: FXN; (-) strand; PAM type: NRG; PAM sequence: TGG
gctgcccccaagaaattgac

SEQ ID NO: 14421 - DNA, 20 bp, Artificial Sequence
  Description of Artificial Sequence: Synthetic oligonucleotide
  Target: FXN; (-) strand; PAM type: NRG; PAM sequence: AAG
attccacaaatgctgccccc

SEQ ID NO: 14422 - DNA, 20 bp, Artificial Sequence
  Description of Artificial Sequence: Synthetic oligonucleotide
  Target: FXN; (-) strand; PAM type: NRG; PAM sequence: CAG
aattccacagcacagccctt

SEQ ID NO: 14423 - DNA, 20 bp, Artificial Sequence
  Description of Artificial Sequence: Synthetic oligonucleotide
  Target: FXN; (-) strand; PAM type: NRG; PAM sequence: CAG
tgcatagtaattccacagca

SEQ ID NO: 14424 - DNA, 20 bp, Artificial Sequence
  Description of Artificial Sequence: Synthetic oligonucleotide
  Target: FXN; (-) strand; PAM type: NRG; PAM sequence: CAG
acaaatgcatagtaattcca

SEQ ID NO: 14425 - DNA, 20 bp, Artificial Sequence
  Description of Artificial Sequence: Synthetic oligonucleotide
  Target: FXN; (-) strand; PAM type: NRG; PAM sequence: TAG
tggaagacaaaacaaatgca

SEQ ID NO: 14426 - DNA, 20 bp, Artificial Sequence
  Description of Artificial Sequence: Synthetic oligonucleotide
  Target: FXN; (-) strand; PAM type: NRG; PAM sequence: AAG
ataacgcttaggtccactgg

SEQ ID NO: 14427 - DNA, 20 bp, Artificial Sequence
  Description of Artificial Sequence: Synthetic oligonucleotide
  Target: FXN; (-) strand; PAM type: NRG; PAM sequence: TGG
gtcataacgcttaggtccac

SEQ ID NO: 14428 - DNA, 20 bp, Artificial Sequence
  Description of Artificial Sequence: Synthetic oligonucleotide
  Target: FXN; (-) strand; PAM type: NRG; PAM sequence: AGG
ccagtccagtcataacgctt

SEQ ID NO: 14429 - DNA, 20 bp, Artificial Sequence
  Description of Artificial Sequence: Synthetic oligonucleotide
  Target: FXN; (-) strand; PAM type: NRG; PAM sequence: TAG
cccagtccagtcataacgct

SEQ ID NO: 14430 - DNA, 20 bp, Artificial Sequence
  Description of Artificial Sequence: Synthetic oligonucleotide
  Target: FXN; (-) strand; PAM type: NRG; PAM sequence: CAG
acacccagtttttcccagtc

SEQ ID NO: 14431 - DNA, 20 bp, Artificial Sequence
  Description of Artificial Sequence: Synthetic oligonucleotide
  Target: FXN; (-) strand; PAM type: NRG; PAM sequence: CAG
ggagtacacccagtttttcc

SEQ ID NO: 14432 - DNA, 20 bp, Artificial Sequence
  Description of Artificial Sequence: Synthetic oligonucleotide
  Target: FXN; (-) strand; PAM type: NRG; PAM sequence: CAG
cgccgtcgtgggagtacacc

SEQ ID NO: 14433 - DNA, 20 bp, Artificial Sequence
  Description of Artificial Sequence: Synthetic oligonucleotide
  Target: FXN; (-) strand; PAM type: NRG; PAM sequence: GAG
ggagggacacgccgtcgtgg

SEQ ID NO: 14434 - DNA, 20 bp, Artificial Sequence
  Description of Artificial Sequence: Synthetic oligonucleotide
  Target: FXN; (-) strand; PAM type: NRG; PAM sequence: GGG
atggagggacacgccgtcgt

SEQ ID NO: 14435 - DNA, 20 bp, Artificial Sequence
  Description of Artificial Sequence: Synthetic oligonucleotide
  Target: FXN; (-) strand; PAM type: NRG; PAM sequence: TGG
catggagggacacgccgtcg

SEQ ID NO: 14436 - DNA, 20 bp, Artificial Sequence
  Description of Artificial Sequence: Synthetic oligonucleotide
  Target: FXN; (-) strand; PAM type: NRG; PAM sequence: GGG
tgcggccagcagctcatgga

SEQ ID NO: 14437 - DNA, 20 bp, Artificial Sequence
  Description of Artificial Sequence: Synthetic oligonucleotide
  Target: FXN; (-) strand; PAM type: NRG; PAM sequence: AGG
ctgcggccagcagctcatgg

SEQ ID NO: 14438 - DNA, 20 bp, Artificial Sequence
  Description of Artificial Sequence: Synthetic oligonucleotide
  Target: FXN; (-) strand; PAM type: NRG; PAM sequence: GAG
tctgcggccagcagctcatg

SEQ ID NO: 14439 - DNA, 20 bp, Artificial Sequence
  Description of Artificial Sequence: Synthetic oligonucleotide
  Target: FXN; (-) strand; PAM type: NRG; PAM sequence: TGG
gctctgcggccagcagctca

SEQ ID NO: 14440 - DNA, 20 bp, Artificial Sequence
  Description of Artificial Sequence: Synthetic oligonucleotide
  Target: FXN; (-) strand; PAM type: NRG; PAM sequence: CAG
ttagtgagctctgcggccag

SEQ ID NO: 14441 - DNA, 20 bp, Artificial Sequence
  Description of Artificial Sequence: Synthetic oligonucleotide
  Target: FXN; (-) strand; PAM type: NRG; PAM sequence: CAG
gctttagtgagctctgcggc

SEQ ID NO: 14442 - DNA, 20 bp, Artificial Sequence
  Description of Artificial Sequence: Synthetic oligonucleotide
  Target: FXN; (-) strand; PAM type: NRG; PAM sequence: CGG
taaggctttagtgagctctg

SEQ ID NO: 14443 - DNA, 20 bp, Artificial Sequence
  Description of Artificial Sequence: Synthetic oligonucleotide
  Target: FXN; (-) strand; PAM type: NRG; PAM sequence: GAG
ttggtttttaaggctttagt

SEQ ID NO: 14444 - DNA, 20 bp, Artificial Sequence
  Description of Artificial Sequence: Synthetic oligonucleotide
  Target: FXN; (-) strand; PAM type: NRG; PAM sequence: TAG
cagtttggtttttaaggctt

SEQ ID NO: 14445 - DNA, 20 bp, Artificial Sequence
  Description of Artificial Sequence: Synthetic oligonucleotide
  Target: FXN; (-) strand; PAM type: NRG; PAM sequence: AGG
caagtccagtttggttttta

SEQ ID NO: 14446 - DNA, 20 bp, Artificial Sequence
  Description of Artificial Sequence: Synthetic oligonucleotide
  Target: FXN; (-) strand; PAM type: NRG; PAM sequence: AAG
acaagtccagtttggttttt

SEQ ID NO: 14447 - DNA, 20 bp, Artificial Sequence
  Description of Artificial Sequence: Synthetic oligonucleotide
  Target: FXN; (-) strand; PAM type: NRG; PAM sequence: TGG
caaggaagacaagtccagtt

SEQ ID NO: 14448 - DNA, 20 bp, Artificial Sequence
  Description of Artificial Sequence: Synthetic oligonucleotide
  Target: FXN; (-) strand; PAM type: NRG; PAM sequence: CAG
taggccaaggaagacaagtc

SEQ ID NO: 14449 - DNA, 20 bp, Artificial Sequence
  Description of Artificial Sequence: Synthetic oligonucleotide
  Target: FXN; (-) strand; PAM type: NRG; PAM sequence: AAG
cggaataggccaaggaagac

SEQ ID NO: 14450 - DNA, 20 bp, Artificial Sequence
  Description of Artificial Sequence: Synthetic oligonucleotide
  Target: FXN; (-) strand; PAM type: NRG; PAM sequence: AAG
ttttccggaataggccaagg

SEQ ID NO: 14451 - DNA, 20 bp, Artificial Sequence
  Description of Artificial Sequence: Synthetic oligonucleotide
  Target: FXN; (-) strand; PAM type: NRG; PAM sequence: AGG
atcttttccggaataggcca

SEQ ID NO: 14452 - DNA, 20 bp, Artificial Sequence
  Description of Artificial Sequence: Synthetic oligonucleotide
  Target: FXN; (-) strand; PAM type: NRG; PAM sequence: AAG
catcttttccggaataggcc

SEQ ID NO: 14453 - DNA, 20 bp, Artificial Sequence
  Description of Artificial Sequence: Synthetic oligonucleotide
  Target: FXN; (-) strand; PAM type: NRG; PAM sequence: AGG
tcaagcatcttttccggaat

SEQ ID NO: 14454 - DNA, 20 bp, Artificial Sequence
  Description of Artificial Sequence: Synthetic oligonucleotide
  Target: FXN; (-) strand; PAM type: NRG; PAM sequence: TAG
atcaagcatcttttccggaa

SEQ ID NO: 14455 - DNA, 20 bp, Artificial Sequence
  Description of Artificial Sequence: Synthetic oligonucleotide
  Target: FXN; (-) strand; PAM type: NRG; PAM sequence: CGG
tgggcatcaagcatcttttc

SEQ ID NO: 14456 - DNA, 20 bp, Artificial Sequence
  Description of Artificial Sequence: Synthetic oligonucleotide
  Target: FXN; (-) strand; PAM type: NRG; PAM sequence: AAG
ttaaaacggggctgggcatc

SEQ ID NO: 14457 - DNA, 20 bp, Artificial Sequence
  Description of Artificial Sequence: Synthetic oligonucleotide
  Target: FXN; (-) strand; PAM type: NRG; PAM sequence: GGG
aatgtccttaaaacggggct

SEQ ID NO: 14458 - DNA, 20 bp, Artificial Sequence
  Description of Artificial Sequence: Synthetic oligonucleotide
  Target: FXN; (-) strand; PAM type: NRG; PAM sequence: TGG
taatgtccttaaaacggggc

SEQ ID NO: 14459 - DNA, 20 bp, Artificial Sequence
  Description of Artificial Sequence: Synthetic oligonucleotide
  Target: FXN; (-) strand; PAM type: NRG; PAM sequence: GGG
cttttaatgtccttaaaacg

SEQ ID NO: 14460 - DNA, 20 bp, Artificial Sequence
  Description of Artificial Sequence: Synthetic oligonucleotide
  Target: FXN; (-) strand; PAM type: NRG; PAM sequence: GGG
gcttttaatgtccttaaaac

SEQ ID NO: 14461 - DNA, 20 bp, Artificial Sequence
  Description of Artificial Sequence: Synthetic oligonucleotide
  Target: FXN; (-) strand; PAM type: NRG; PAM sequence: CGG
agcttttaatgtccttaaaa

SEQ ID NO: 14462 - DNA, 20 bp, Artificial Sequence
  Description of Artificial Sequence: Synthetic oligonucleotide
  Target: FXN; (-) strand; PAM type: NRG; PAM sequence: TAG
aagctggggtcttggcctga

SEQ ID NO: 14463 - DNA, 20 bp, Artificial Sequence
  Description of Artificial Sequence: Synthetic oligonucleotide
  Target: FXN; (-) strand; PAM type: NRG; PAM sequence: TGG
gcataatgaagctggggtct

SEQ ID NO: 14464 - DNA, 20 bp, Artificial Sequence
  Description of Artificial Sequence: Synthetic oligonucleotide
  Target: FXN; (-) strand; PAM type: NRG; PAM sequence: GGG
tcagctgcataatgaagctg

SEQ ID NO: 14465 - DNA, 20 bp, Artificial Sequence
  Description of Artificial Sequence: Synthetic oligonucleotide
  Target: FXN; (-) strand; PAM type: NRG; PAM sequence: GGG
ctcagctgcataatgaagct

SEQ ID NO: 14466 - DNA, 20 bp, Artificial Sequence
  Description of Artificial Sequence: Synthetic oligonucleotide
  Target: FXN; (-) strand; PAM type: NRG; PAM sequence: TGG
cctcagctgcataatgaagc

SEQ ID NO: 14467 - DNA, 20 bp, Artificial Sequence
  Description of Artificial Sequence: Synthetic oligonucleotide
  Target: FXN; (-) strand; PAM type: NRG; PAM sequence: AAG
cagacctcagctgcataatg

SEQ ID NO: 14468 - DNA, 20 bp, Artificial Sequence
  Description of Artificial Sequence: Synthetic oligonucleotide
  Target: FXN; (-) strand; PAM type: NRG; PAM sequence: CAG
caacaacaaaaaacagacct

SEQ ID NO: 14469 - DNA, 20 bp, Artificial Sequence
  Description of Artificial Sequence: Synthetic oligonucleotide
  Target: FXN; (-) strand; PAM type: NRG; PAM sequence: CAG
acaacaacaacaacaaaaaa

SEQ ID NO: 14470 - DNA, 20 bp, Artificial Sequence
  Description of Artificial Sequence: Synthetic oligonucleotide
  Target: FXN; (-) strand; PAM type: NRG; PAM sequence: AGG
gcccaactgtcctcaaaagc

SEQ ID NO: 14471 - DNA, 20 bp, Artificial Sequence
  Description of Artificial Sequence: Synthetic oligonucleotide
  Target: FXN; (-) strand; PAM type: NRG; PAM sequence: CAG
agcccaactgtcctcaaaag

SEQ ID NO: 14472 - DNA, 20 bp, Artificial Sequence
  Description of Artificial Sequence: Synthetic oligonucleotide
  Target: FXN; (-) strand; PAM type: NRG; PAM sequence: AAG
catagcccaactgtcctcaa

SEQ ID NO: 14473 - DNA, 20 bp, Artificial Sequence
  Description of Artificial Sequence: Synthetic oligonucleotide
  Target: FXN; (-) strand; PAM type: NRG; PAM sequence: TAG
ttctacagagctgtgacaca

SEQ ID NO: 14474 - DNA, 20 bp, Artificial Sequence
  Description of Artificial Sequence: Synthetic oligonucleotide
  Target: FXN; (-) strand; PAM type: NRG; PAM sequence: GAG
ggcaacacattctttctaca

SEQ ID NO: 14475 - DNA, 20 bp, Artificial Sequence
  Description of Artificial Sequence: Synthetic oligonucleotide
  Target: FXN; (-) strand; PAM type: NRG; PAM sequence: CAG
gaggcaacacattctttcta

SEQ ID NO: 14476 - DNA, 20 bp, Artificial Sequence
  Description of Artificial Sequence: Synthetic oligonucleotide
  Target: FXN; (-) strand; PAM type: NRG; PAM sequence: AGG
gaacttgggggcaaggtagg

SEQ ID NO: 14477 - DNA, 20 bp, Artificial Sequence
  Description of Artificial Sequence: Synthetic oligonucleotide
  Target: FXN; (-) strand; PAM type: NRG; PAM sequence: GAG
agaacttgggggcaaggtag

SEQ ID NO: 14478 - DNA, 20 bp, Artificial Sequence
  Description of Artificial Sequence: Synthetic oligonucleotide
  Target: FXN; (-) strand; PAM type: NRG; PAM sequence: AGG
tcagaacttgggggcaaggt

SEQ ID NO: 14479 - DNA, 20 bp, Artificial Sequence
  Description of Artificial Sequence: Synthetic oligonucleotide
  Target: FXN; (-) strand; PAM type: NRG; PAM sequence: TAG
atcagaacttgggggcaagg

SEQ ID NO: 14480 - DNA, 20 bp, Artificial Sequence
  Description of Artificial Sequence: Synthetic oligonucleotide
  Target: FXN; (-) strand; PAM type: NRG; PAM sequence: AGG
aaaatcagaacttgggggca

SEQ ID NO: 14481 - DNA, 20 bp, Artificial Sequence
  Description of Artificial Sequence: Synthetic oligonucleotide
  Target: FXN; (-) strand; PAM type: NRG; PAM sequence: AAG
aaaaatcagaacttgggggc

SEQ ID NO: 14482 - DNA, 20 bp, Artificial Sequence
  Description of Artificial Sequence: Synthetic oligonucleotide
  Target: FXN; (-) strand; PAM type: NRG; PAM sequence: GGG
aattaaaaatcagaacttgg

SEQ ID NO: 14483 - DNA, 20 bp, Artificial Sequence
  Description of Artificial Sequence: Synthetic oligonucleotide
  Target: FXN; (-) strand; PAM type: NRG; PAM sequence: GGG
aaattaaaaatcagaacttg

SEQ ID NO: 14484 - DNA, 20 bp, Artificial Sequence
  Description of Artificial Sequence: Synthetic oligonucleotide
  Target: FXN; (-) strand; PAM type: NRG; PAM sequence: GGG
gaaattaaaaatcagaactt

SEQ ID NO: 14485 - DNA, 20 bp, Artificial Sequence
  Description of Artificial Sequence: Synthetic oligonucleotide
  Target: FXN; (-) strand; PAM type: NRG; PAM sequence: TGG
agaaattaaaaatcagaact

SEQ ID NO: 14486 - DNA, 20 bp, Artificial Sequence
  Description of Artificial Sequence: Synthetic oligonucleotide
  Target: FXN; (-) strand; PAM type: NRG; PAM sequence: CAG
cttccatagaaattaaaaat

SEQ ID NO: 14487 - DNA, 20 bp, Artificial Sequence
  Description of Artificial Sequence: Synthetic oligonucleotide
  Target: FXN; (-) strand; PAM type: NRG; PAM sequence: TAG
acaatccaaaaaatcttcca

SEQ ID NO: 14488 - DNA, 20 bp, Artificial Sequence
  Description of Artificial Sequence: Synthetic oligonucleotide
  Target: FXN; (-) strand; PAM type: NRG; PAM sequence: AGG
taaggggtatcatgtgaggg

SEQ ID NO: 14489 - DNA, 20 bp, Artificial Sequence
  Description of Artificial Sequence: Synthetic oligonucleotide
  Target: FXN; (-) strand; PAM type: NRG; PAM sequence: GAG
ataaggggtatcatgtgagg

SEQ ID NO: 14490 - DNA, 20 bp, Artificial Sequence
  Description of Artificial Sequence: Synthetic oligonucleotide
  Target: FXN; (-) strand; PAM type: NRG; PAM sequence: GGG
agataaggggtatcatgtga

SEQ ID NO: 14491 - DNA, 20 bp, Artificial Sequence
  Description of Artificial Sequence: Synthetic oligonucleotide
  Target: FXN; (-) strand; PAM type: NRG; PAM sequence: AGG
aagataaggggtatcatgtg

SEQ ID NO: 14492 - DNA, 20 bp, Artificial Sequence
  Description of Artificial Sequence: Synthetic oligonucleotide
  Target: FXN; (-) strand; PAM type: NRG; PAM sequence: GAG
aaagataaggggtatcatgt

SEQ ID NO: 14493 - DNA, 20 bp, Artificial Sequence
  Description of Artificial Sequence: Synthetic oligonucleotide
  Target: FXN; (-) strand; PAM type: NRG; PAM sequence: GGG
aagacattataaaagataag

SEQ ID NO: 14494 - DNA, 20 bp, Artificial Sequence
  Description of Artificial Sequence: Synthetic oligonucleotide
  Target: FXN; (-) strand; PAM type: NRG; PAM sequence: GGG
taagacattataaaagataa

SEQ ID NO: 14495 - DNA, 20 bp, Artificial Sequence
  Description of Artificial Sequence: Synthetic oligonucleotide
  Target: FXN; (-) strand; PAM type: NRG; PAM sequence: AGG
ataagacattataaaagata

SEQ ID NO: 14496 - DNA, 20 bp, Artificial Sequence
  Description of Artificial Sequence: Synthetic oligonucleotide
  Target: FXN; (-) strand; PAM type: NRG; PAM sequence: AAG
cataagacattataaaagat

SEQ ID NO: 14497 - DNA, 20 bp, Artificial Sequence
  Description of Artificial Sequence: Synthetic oligonucleotide
  Target: FXN; (-) strand; PAM type: NRG; PAM sequence: AAG
ataggcataagacattataa

SEQ ID NO: 14498 - DNA, 20 bp, Artificial Sequence
  Description of Artificial Sequence: Synthetic oligonucleotide
  Target: FXN; (-) strand; PAM type: NRG; PAM sequence: AAG
ttatattcaggtataggcat

SEQ ID NO: 14499 - DNA, 20 bp, Artificial Sequence
  Description of Artificial Sequence: Synthetic oligonucleotide
  Target: FXN; (-) strand; PAM type: NRG; PAM sequence: AGG
aggttgttatattcaggtat

SEQ ID NO: 14500 - DNA, 20 bp, Artificial Sequence
  Description of Artificial Sequence: Synthetic oligonucleotide
  Target: FXN; (-) strand; PAM type: NRG; PAM sequence: TAG
aaggttgttatattcaggta

SEQ ID NO: 14501 - DNA, 20 bp, Artificial Sequence
  Description of Artificial Sequence: Synthetic oligonucleotide
  Target: FXN; (-) strand; PAM type: NRG; PAM sequence: AGG
ttttaaaggttgttatattc

SEQ ID NO: 14502 - DNA, 20 bp, Artificial Sequence
  Description of Artificial Sequence: Synthetic oligonucleotide
  Target: FXN; (-) strand; PAM type: NRG; PAM sequence: CAG
tttttaaaggttgttatatt

SEQ ID NO: 14503 - DNA, 20 bp, Artificial Sequence
  Description of Artificial Sequence: Synthetic oligonucleotide
  Target: FXN; (-) strand; PAM type: NRG; PAM sequence: AGG
ttattattttgcttttttaa

SEQ ID NO: 14504 - DNA, 20 bp, Artificial Sequence
  Description of Artificial Sequence: Synthetic oligonucleotide
  Target: FXN; (-) strand; PAM type: NRG; PAM sequence: AAG
cttattattttgctttttta

SEQ ID NO: 14505 - DNA, 20 bp, Artificial Sequence
  Description of Artificial Sequence: Synthetic oligonucleotide
  Target: FXN; (-) strand; PAM type: NRG; PAM sequence: TGG
agacaattcattttccctcc

SEQ ID NO: 14506 - DNA, 20 bp, Artificial Sequence
  Description of Artificial Sequence: Synthetic oligonucleotide
  Target: FXN; (-) strand; PAM type: NRG; PAM sequence: AAG
ccttcaaagaatgaagagtg

SEQ ID NO: 14507 - DNA, 20 bp, Artificial Sequence
  Description of Artificial Sequence: Synthetic oligonucleotide
  Target: FXN; (-) strand; PAM type: NRG; PAM sequence: GAG
taaatccttcaaagaatgaa

SEQ ID NO: 14508 - DNA, 20 bp, Artificial Sequence
  Description of Artificial Sequence: Synthetic oligonucleotide
  Target: FXN; (-) strand; PAM type: NRG; PAM sequence: AAG
agtaaatccttcaaagaatg

SEQ ID NO: 14509 - DNA, 20 bp, Artificial Sequence
  Description of Artificial Sequence: Synthetic oligonucleotide
  Target: FXN; (-) strand; PAM type: NRG; PAM sequence: AAG
ttcttgcagtaaatccttca

SEQ ID NO: 14510 - DNA, 20 bp, Artificial Sequence
  Description of Artificial Sequence: Synthetic oligonucleotide
  Target: FXN; (-) strand; PAM type: NRG; PAM sequence: CAG
tgctcttcatgtacttcttg

SEQ ID NO: 14511 - DNA, 20 bp, Artificial Sequence
  Description of Artificial Sequence: Synthetic oligonucleotide
  Target: FXN; (-) strand; PAM type: NRG; PAM sequence: CAG
agaacagtgagcaggttgac

SEQ ID NO: 14512 - DNA, 20 bp, Artificial Sequence
  Description of Artificial Sequence: Synthetic oligonucleotide
  Target: FXN; (-) strand; PAM type: NRG; PAM sequence: AGG
ttggagatagaacagtgagc

SEQ ID NO: 14513 - DNA, 20 bp, Artificial Sequence
  Description of Artificial Sequence: Synthetic oligonucleotide
  Target: FXN; (-) strand; PAM type: NRG; PAM sequence: CAG
tttggagatagaacagtgag

SEQ ID NO: 14514 - DNA, 20 bp, Artificial Sequence
  Description of Artificial Sequence: Synthetic oligonucleotide
  Target: FXN; (-) strand; PAM type: NRG; PAM sequence: GAG
tcatttggagatagaacagt

SEQ ID NO: 14515 - DNA, 20 bp, Artificial Sequence
  Description of Artificial Sequence: Synthetic oligonucleotide
  Target: FXN; (-) strand; PAM type: NRG; PAM sequence: CAG
tgtctcatttggagatagaa

SEQ ID NO: 14516 - DNA, 20 bp, Artificial Sequence
  Description of Artificial Sequence: Synthetic oligonucleotide
  Target: FXN; (-) strand; PAM type: NRG; PAM sequence: TAG
taatgtgtctcatttggaga

SEQ ID NO: 14517 - DNA, 20 bp, Artificial Sequence
  Description of Artificial Sequence: Synthetic oligonucleotide
  Target: FXN; (-) strand; PAM type: NRG; PAM sequence: GAG
cctttaatgtgtctcatttg

SEQ ID NO: 14518 - DNA, 20 bp, Artificial Sequence
  Description of Artificial Sequence: Synthetic oligonucleotide
  Target: FXN; (-) strand; PAM type: NRG; PAM sequence: TGG
accctttaatgtgtctcatt

SEQ ID NO: 14519 - DNA, 20 bp, Artificial Sequence
  Description of Artificial Sequence: Synthetic oligonucleotide
  Target: FXN; (-) strand; PAM type: NRG; PAM sequence: AGG
agaagcctgaaaacatttgt

SEQ ID NO: 14520 - DNA, 20 bp, Artificial Sequence
  Description of Artificial Sequence: Synthetic oligonucleotide
  Target: FXN; (-) strand; PAM type: NRG; PAM sequence: TAG
aagaagcctgaaaacatttg

SEQ ID NO: 14521 - DNA, 20 bp, Artificial Sequence
  Description of Artificial Sequence: Synthetic oligonucleotide
  Target: FXN; (-) strand; PAM type: NRG; PAM sequence: AAG
aagtgcttacactttgaaag

SEQ ID NO: 14522 - DNA, 20 bp, Artificial Sequence
  Description of Artificial Sequence: Synthetic oligonucleotide
  Target: FXN; (-) strand; PAM type: NRG; PAM sequence: AAG
cagaagtgcttacactttga

SEQ ID NO: 14523 - DNA, 20 bp, Artificial Sequence
  Description of Artificial Sequence: Synthetic oligonucleotide
  Target: FXN; (-) strand; PAM type: NRG; PAM sequence: AAG
ttcaatgctaaagagctcag

SEQ ID NO: 14524 - DNA, 20 bp, Artificial Sequence
  Description of Artificial Sequence: Synthetic oligonucleotide
  Target: FXN; (-) strand; PAM type: NRG; PAM sequence: CAG
cacttcaatgctaaagagct

SEQ ID NO: 14525 - DNA, 20 bp, Artificial Sequence
  Description of Artificial Sequence: Synthetic oligonucleotide
  Target: FXN; (-) strand; PAM type: NRG; PAM sequence: GAG
ttcgacacttcaatgctaaa

SEQ ID NO: 14526 - DNA, 20 bp, Artificial Sequence
  Description of Artificial Sequence: Synthetic oligonucleotide
  Target: FXN; (-) strand; PAM type: NRG; PAM sequence: AAG
ctttcgacacttcaatgcta

SEQ ID NO: 14527 - DNA, 20 bp, Artificial Sequence
  Description of Artificial Sequence: Synthetic oligonucleotide
  Target: FXN; (-) strand; PAM type: NRG; PAM sequence: GAG
aagaaatgatcttcccgtgt

SEQ ID NO: 14528 - DNA, 20 bp, Artificial Sequence
  Description of Artificial Sequence: Synthetic oligonucleotide
  Target: FXN; (-) strand; PAM type: NRG; PAM sequence: AAG
ggcagtcacagagcacaaat

SEQ ID NO: 14529 - DNA, 20 bp, Artificial Sequence
  Description of Artificial Sequence: Synthetic oligonucleotide
  Target: FXN; (-) strand; PAM type: NRG; PAM sequence: GAG
gccacaccttggcagtcaca

SEQ ID NO: 14530 - DNA, 20 bp, Artificial Sequence
  Description of Artificial Sequence: Synthetic oligonucleotide
  Target: FXN; (-) strand; PAM type: NRG; PAM sequence: CAG
aggccacaccttggcagtca

SEQ ID NO: 14531 - DNA, 20 bp, Artificial Sequence
  Description of Artificial Sequence: Synthetic oligonucleotide
  Target: FXN; (-) strand; PAM type: NRG; PAM sequence: CAG
cagtgcaggccacaccttgg

SEQ ID NO: 14532 - DNA, 20 bp, Artificial Sequence
  Description of Artificial Sequence: Synthetic oligonucleotide
  Target: FXN; (-) strand; PAM type: NRG; PAM sequence: TGG
acccagtgcaggccacacct

SEQ ID NO: 14533 - DNA, 20 bp, Artificial Sequence
  Description of Artificial Sequence: Synthetic oligonucleotide
  Target: FXN; (-) strand; PAM type: NRG; PAM sequence: AGG
ctccctggacaacccagtgc

SEQ ID NO: 14534 - DNA, 20 bp, Artificial Sequence
  Description of Artificial Sequence: Synthetic oligonucleotide
  Target: FXN; (-) strand; PAM type: NRG; PAM sequence: CAG
tctccctggacaacccagtg

SEQ ID NO: 14535 - DNA, 20 bp, Artificial Sequence
  Description of Artificial Sequence: Synthetic oligonucleotide
  Target: FXN; (-) strand; PAM type: NRG; PAM sequence: CAG
ctaggtctccctggacaacc

SEQ ID NO: 14536 - DNA, 20 bp, Artificial Sequence
  Description of Artificial Sequence: Synthetic oligonucleotide
  Target: FXN; (-) strand; PAM type: NRG; PAM sequence: TGG
gaaacagcactaggtctccc

SEQ ID NO: 14537 - DNA, 20 bp, Artificial Sequence
  Description of Artificial Sequence: Synthetic oligonucleotide
  Target: FXN; (-) strand; PAM type: NRG; PAM sequence: AGG
tatgtgggagaaacagcact

SEQ ID NO: 14538 - DNA, 20 bp, Artificial Sequence
  Description of Artificial Sequence: Synthetic oligonucleotide
  Target: FXN; (-) strand; PAM type: NRG; PAM sequence: TAG
atatgtgggagaaacagcac

SEQ ID NO: 14539 - DNA, 20 bp, Artificial Sequence
  Description of Artificial Sequence: Synthetic oligonucleotide
  Target: FXN; (-) strand; PAM type: NRG; PAM sequence: CAG
atgtgaatatgtgggagaaa

SEQ ID NO: 14540 - DNA, 20 bp, Artificial Sequence
  Description of Artificial Sequence: Synthetic oligonucleotide
  Target: FXN; (-) strand; PAM type: NRG; PAM sequence: GAG
acacgtatgtgaatatgtgg

SEQ ID NO: 14541 - DNA, 20 bp, Artificial Sequence
  Description of Artificial Sequence: Synthetic oligonucleotide
  Target: FXN; (-) strand; PAM type: NRG; PAM sequence: GGG
agacacgtatgtgaatatgt

SEQ ID NO: 14542 - DNA, 20 bp, Artificial Sequence
  Description of Artificial Sequence: Synthetic oligonucleotide
  Target: FXN; (-) strand; PAM type: NRG; PAM sequence: TGG
cagacacgtatgtgaatatg

SEQ ID NO: 14543 - DNA, 20 bp, Artificial Sequence
  Description of Artificial Sequence: Synthetic oligonucleotide
  Target: FXN; (-) strand; PAM type: NRG; PAM sequence: CAG
tgaaaaaatatatatacaca

SEQ ID NO: 14544 - DNA, 20 bp, Artificial Sequence
  Description of Artificial Sequence: Synthetic oligonucleotide
  Target: FXN; (-) strand; PAM type: NRG; PAM sequence: CAG
gattttttgcattcttgtag

SEQ ID NO: 14545 - DNA, 20 bp, Artificial Sequence
  Description of Artificial Sequence: Synthetic oligonucleotide
  Target: FXN; (-) strand; PAM type: NRG; PAM sequence: TAG
gaagattttttgcattcttg

SEQ ID NO: 14546 - DNA, 20 bp, Artificial Sequence
  Description of Artificial Sequence: Synthetic oligonucleotide
  Target: FXN; (-) strand; PAM type: NRG; PAM sequence: AAG
tcctcttttcttgtctttgg

SEQ ID NO: 14547 - DNA, 20 bp, Artificial Sequence
  Description of Artificial Sequence: Synthetic oligonucleotide
  Target: FXN; (-) strand; PAM type: NRG; PAM sequence: TGG
ttttcctcttttcttgtctt

SEQ ID NO: 14548 - DNA, 20 bp, Artificial Sequence
  Description of Artificial Sequence: Synthetic oligonucleotide
  Target: FXN; (-) strand; PAM type: NRG; PAM sequence: CGG
catcactcagctcatgaaaa

SEQ ID NO: 14549 - DNA, 20 bp, Artificial Sequence
  Description of Artificial Sequence: Synthetic oligonucleotide
  Target: FXN; (-) strand; PAM type: NRG; PAM sequence: CAG
gtttgttacgctacatcact

SEQ ID NO: 14550 - DNA, 20 bp, Artificial Sequence
  Description of Artificial Sequence: Synthetic oligonucleotide
  Target: FXN; (-) strand; PAM type: NRG; PAM sequence: CAG
atgtttacaaggcacctcct

SEQ ID NO: 14551 - DNA, 20 bp, Artificial Sequence
  Description of Artificial Sequence: Synthetic oligonucleotide
  Target: FXN; (-) strand; PAM type: NRG; PAM sequence: AGG
tctgccccttcatgtttaca

SEQ ID NO: 14552 - DNA, 20 bp, Artificial Sequence
  Description of Artificial Sequence: Synthetic oligonucleotide
  Target: FXN; (-) strand; PAM type: NRG; PAM sequence: AAG
atctgccccttcatgtttac

SEQ ID NO: 14553 - DNA, 20 bp, Artificial Sequence
  Description of Artificial Sequence: Synthetic oligonucleotide
  Target: FXN; (-) strand; PAM type: NRG; PAM sequence: GAG
agggctctctttatcaacat

SEQ ID NO: 14554 - DNA, 20 bp, Artificial Sequence
  Description of Artificial Sequence: Synthetic oligonucleotide
  Target: FXN; (-) strand; PAM type: NRG; PAM sequence: GGG
ctgaactatgtctaggacca

SEQ ID NO: 14555 - DNA, 20 bp, Artificial Sequence
  Description of Artificial Sequence: Synthetic oligonucleotide
  Target: FXN; (-) strand; PAM type: NRG; PAM sequence: AGG
gctgaactatgtctaggacc

SEQ ID NO: 14556 - DNA, 20 bp, Artificial Sequence
  Description of Artificial Sequence: Synthetic oligonucleotide
  Target: FXN; (-) strand; PAM type: NRG; PAM sequence: CAG
ggctgaactatgtctaggac

SEQ ID NO: 14557 - DNA, 20 bp, Artificial Sequence
  Description of Artificial Sequence: Synthetic oligonucleotide
  Target: FXN; (-) strand; PAM type: NRG; PAM sequence: AGG
tttgtggctgaactatgtct

SEQ ID NO: 14558 - DNA, 20 bp, Artificial Sequence
  Description of Artificial Sequence: Synthetic oligonucleotide
  Target: FXN; (-) strand; PAM type: NRG; PAM sequence: TAG
ctttgtggctgaactatgtc

SEQ ID NO: 14559 - DNA, 20 bp, Artificial Sequence
  Description of Artificial Sequence: Synthetic oligonucleotide
  Target: FXN; (-) strand; PAM type: NRG; PAM sequence: TGG
acaaagggacaactactttg

SEQ ID NO: 14560 - DNA, 20 bp, Artificial Sequence
  Description of Artificial Sequence: Synthetic oligonucleotide
  Target: FXN; (-) strand; PAM type: NRG; PAM sequence: GGG
ttgggaaacttgtccacaaa

SEQ ID NO: 14561 - DNA, 20 bp, Artificial Sequence
  Description of Artificial Sequence: Synthetic oligonucleotide
  Target: FXN; (-) strand; PAM type: NRG; PAM sequence: AGG
tttgggaaacttgtccacaa

SEQ ID NO: 14562 - DNA, 20 bp, Artificial Sequence
  Description of Artificial Sequence: Synthetic oligonucleotide
  Target: FXN; (-) strand; PAM type: NRG; PAM sequence: AAG
atttgggaaacttgtccaca

SEQ ID NO: 14563 - DNA, 20 bp, Artificial Sequence
  Description of Artificial Sequence: Synthetic oligonucleotide
  Target: FXN; (-) strand; PAM type: NRG; PAM sequence: GGG
agcagaggtccagggaattt

SEQ ID NO: 14564 - DNA, 20 bp, Artificial Sequence
  Description of Artificial Sequence: Synthetic oligonucleotide
  Target: FXN; (-) strand; PAM type: NRG; PAM sequence: TGG
aagcagaggtccagggaatt

SEQ ID NO: 14565 - DNA, 20 bp, Artificial Sequence
  Description of Artificial Sequence: Synthetic oligonucleotide
  Target: FXN; (-) strand; PAM type: NRG; PAM sequence: GGG
gatggggaagcagaggtcca

SEQ ID NO: 14566 - DNA, 20 bp, Artificial Sequence
  Description of Artificial Sequence: Synthetic oligonucleotide
  Target: FXN; (-) strand; PAM type: NRG; PAM sequence: AGG
agatggggaagcagaggtcc

SEQ ID NO: 14567 - DNA, 20 bp, Artificial Sequence
  Description of Artificial Sequence: Synthetic oligonucleotide
  Target: FXN; (-) strand; PAM type: NRG; PAM sequence: CAG
cagatggggaagcagaggtc

SEQ ID NO: 14568 - DNA, 20 bp, Artificial Sequence
  Description of Artificial Sequence: Synthetic oligonucleotide
  Target: FXN; (-) strand; PAM type: NRG; PAM sequence: AGG
tttaacagatggggaagcag

SEQ ID NO: 14569 - DNA, 20 bp, Artificial Sequence
  Description of Artificial Sequence: Synthetic oligonucleotide
  Target: FXN; (-) strand; PAM type: NRG; PAM sequence: GAG
atttaacagatggggaagca

SEQ ID NO: 14570 - DNA, 20 bp, Artificial Sequence
  Description of Artificial Sequence: Synthetic oligonucleotide
  Target: FXN; (-) strand; PAM type: NRG; PAM sequence: CAG
tcatttaacagatggggaag

SEQ ID NO: 14571 - DNA, 20 bp, Artificial Sequence
  Description of Artificial Sequence: Synthetic oligonucleotide
  Target: FXN; (-) strand; PAM type: NRG; PAM sequence: AAG
ctctcatttaacagatgggg

SEQ ID NO: 14572 - DNA, 20 bp, Artificial Sequence
  Description of Artificial Sequence: Synthetic oligonucleotide
  Target: FXN; (-) strand; PAM type: NRG; PAM sequence: GGG
attctctcatttaacagatg

SEQ ID NO: 14573 - DNA, 20 bp, Artificial Sequence
  Description of Artificial Sequence: Synthetic oligonucleotide
  Target: FXN; (-) strand; PAM type: NRG; PAM sequence: GGG
tattctctcatttaacagat

SEQ ID NO: 14574 - DNA, 20 bp, Artificial Sequence
  Description of Artificial Sequence: Synthetic oligonucleotide
  Target: FXN; (-) strand; PAM type: NRG; PAM sequence: TGG
ctattctctcatttaacaga

SEQ ID NO: 14575 - DNA, 20 bp, Artificial Sequence
  Description of Artificial Sequence: Synthetic oligonucleotide
  Target: FXN; (-) strand; PAM type: NRG; PAM sequence: CAG
tactctattctctcatttaa

SEQ ID NO: 14576 - DNA, 20 bp, Artificial Sequence
  Description of Artificial Sequence: Synthetic oligonucleotide
  Target: FXN; (-) strand; PAM type: NRG; PAM sequence: GGG
tgacaggaccactgaatgct

SEQ ID NO: 14577 - DNA, 20 bp, Artificial Sequence
  Description of Artificial Sequence: Synthetic oligonucleotide
  Target: FXN; (-) strand; PAM type: NRG; PAM sequence: TGG
ttgacaggaccactgaatgc

SEQ ID NO: 14578 - DNA, 20 bp, Artificial Sequence
  Description of Artificial Sequence: Synthetic oligonucleotide
  Target: FXN; (-) strand; PAM type: NRG; PAM sequence: AGG
agcctgttaggttgcttgac

SEQ ID NO: 14579 - DNA, 20 bp, Artificial Sequence
  Description of Artificial Sequence: Synthetic oligonucleotide
  Target: FXN; (-) strand; PAM type: NRG; PAM sequence: CAG
tagcctgttaggttgcttga

SEQ ID NO: 14580 - DNA, 20 bp, Artificial Sequence
  Description of Artificial Sequence: Synthetic oligonucleotide
  Target: FXN; (-) strand; PAM type: NRG; PAM sequence: AGG
ggaattagaactagcctgtt

SEQ ID NO: 14581 - DNA, 20 bp, Artificial Sequence
  Description of Artificial Sequence: Synthetic oligonucleotide
  Target: FXN; (-) strand; PAM type: NRG; PAM sequence: TAG
gggaattagaactagcctgt

SEQ ID NO: 14582 - DNA, 20 bp, Artificial Sequence
  Description of Artificial Sequence: Synthetic oligonucleotide
  Target: FXN; (-) strand; PAM type: NRG; PAM sequence: TAG
acccaatagggaattagaac

SEQ ID NO: 14583 - DNA, 20 bp, Artificial Sequence
  Description of Artificial Sequence: Synthetic oligonucleotide
  Target: FXN; (-) strand; PAM type: NRG; PAM sequence: TAG
tcatctacccaatagggaat

SEQ ID NO: 14584 - DNA, 20 bp, Artificial Sequence
  Description of Artificial Sequence: Synthetic oligonucleotide
  Target: FXN; (-) strand; PAM type: NRG; PAM sequence: GGG
atcccctcatctacccaata

SEQ ID NO: 14585 - DNA, 20 bp, Artificial Sequence
  Description of Artificial Sequence: Synthetic oligonucleotide
  Target: FXN; (-) strand; PAM type: NRG; PAM sequence: AGG
catcccctcatctacccaat

SEQ ID NO: 14586 - DNA, 20 bp, Artificial Sequence
  Description of Artificial Sequence: Synthetic oligonucleotide
  Target: FXN; (-) strand; PAM type: NRG; PAM sequence: TAG
tcatcccctcatctacccaa

SEQ ID NO: 14587 - DNA, 20 bp, Artificial Sequence
  Description of Artificial Sequence: Synthetic oligonucleotide
  Target: FXN; (-) strand; PAM type: NRG; PAM sequence: TAG
caataacaatgtttcctata

SEQ ID NO: 14588 - DNA, 20 bp, Artificial Sequence
  Description of Artificial Sequence: Synthetic oligonucleotide
  Target: FXN; (-) strand; PAM type: NRG; PAM sequence: GGG
attcaactgaaatcacgata

SEQ ID NO: 14589 - DNA, 20 bp, Artificial Sequence
  Description of Artificial Sequence: Synthetic oligonucleotide
  Target: FXN; (-) strand; PAM type: NRG; PAM sequence: AGG
aattcaactgaaatcacgat

SEQ ID NO: 14590 - DNA, 20 bp, Artificial Sequence
  Description of Artificial Sequence: Synthetic oligonucleotide
  Target: FXN; (-) strand; PAM type: NRG; PAM sequence: TAG
gaattcaactgaaatcacga

SEQ ID NO: 14591 - DNA, 20 bp, Artificial Sequence
  Description of Artificial Sequence: Synthetic oligonucleotide
  Target: FXN; (-) strand; PAM type: NRG; PAM sequence: TGG
ccaccgcgccaggccaagga

SEQ ID NO: 14592 - DNA, 20 bp, Artificial Sequence
  Description of Artificial Sequence: Synthetic oligonucleotide
  Target: FXN; (-) strand; PAM type: NRG; PAM sequence: AGG
tgagccaccgcgccaggcca

SEQ ID NO: 14593 - DNA, 20 bp, Artificial Sequence
  Description of Artificial Sequence: Synthetic oligonucleotide
  Target: FXN; (-) strand; PAM type: NRG; PAM sequence: AAG
gtgagccaccgcgccaggcc

SEQ ID NO: 14594 - DNA, 20 bp, Artificial Sequence
  Description of Artificial Sequence: Synthetic oligonucleotide
  Target: FXN; (-) strand; PAM type: NRG; PAM sequence: AGG
caggtgtgagccaccgcgcc

SEQ ID NO: 14595 - DNA, 20 bp, Artificial Sequence
  Description of Artificial Sequence: Synthetic oligonucleotide
  Target: FXN; (-) strand; PAM type: NRG; PAM sequence: CAG
acaggtgtgagccaccgcgc

SEQ ID NO: 14596 - DNA, 20 bp, Artificial Sequence
  Description of Artificial Sequence: Synthetic oligonucleotide
  Target: FXN; (-) strand; PAM type: NRG; PAM sequence: GAG
agtgctgggattacaggtgt

SEQ ID NO: 14597 - DNA, 20 bp, Artificial Sequence
  Description of Artificial Sequence: Synthetic oligonucleotide
  Target: FXN; (-) strand; PAM type: NRG; PAM sequence: AGG
tccaaaagtgctgggattac

SEQ ID NO: 14598 - DNA, 20 bp, Artificial Sequence
  Description of Artificial Sequence: Synthetic oligonucleotide
  Target: FXN; (-) strand; PAM type: NRG; PAM sequence: CAG
ctccaaaagtgctgggatta

SEQ ID NO: 14599 - DNA, 20 bp, Artificial Sequence
  Description of Artificial Sequence: Synthetic oligonucleotide
  Target: FXN; (-) strand; PAM type: NRG; PAM sequence: GGG
ccttggcctccaaaagtgct

SEQ ID NO: 14600 - DNA, 20 bp, Artificial Sequence
  Description of Artificial Sequence: Synthetic oligonucleotide
  Target: FXN; (-) strand; PAM type: NRG; PAM sequence: TGG
accttggcctccaaaagtgc

SEQ ID NO: 14601 - DNA, 20 bp, Artificial Sequence
  Description of Artificial Sequence: Synthetic oligonucleotide
  Target: FXN; (-) strand; PAM type: NRG; PAM sequence: AAG
ccacccaccttggcctccaa

SEQ ID NO: 14602 - DNA, 20 bp, Artificial Sequence
  Description of Artificial Sequence: Synthetic oligonucleotide
  Target: FXN; (-) strand; PAM type: NRG; PAM sequence: TGG
ctcaggtgatccacccacct

SEQ ID NO: 14603 - DNA, 20 bp, Artificial Sequence
  Description of Artificial Sequence: Synthetic oligonucleotide
  Target: FXN; (-) strand; PAM type: NRG; PAM sequence: AGG
ggtcttgaactcctgacctc

SEQ ID NO: 14604 - DNA, 20 bp, Artificial Sequence
  Description of Artificial Sequence: Synthetic oligonucleotide
  Target: FXN; (-) strand; PAM type: NRG; PAM sequence: CAG
tggtcttgaactcctgacct

SEQ ID NO: 14605 - DNA, 20 bp, Artificial Sequence
  Description of Artificial Sequence: Synthetic oligonucleotide
  Target: FXN; (-) strand; PAM type: NRG; PAM sequence: TGG
tttcatcatgttggccaggc

SEQ ID NO: 14606 - DNA, 20 bp, Artificial Sequence
  Description of Artificial Sequence: Synthetic oligonucleotide
  Target: FXN; (-) strand; PAM type: NRG; PAM sequence: AGG
ggggtttcatcatgttggcc

SEQ ID NO: 14607 - DNA, 20 bp, Artificial Sequence
  Description of Artificial Sequence: Synthetic oligonucleotide
  Target: FXN; (-) strand; PAM type: NRG; PAM sequence: CAG
cggggtttcatcatgttggc

SEQ ID NO: 14608 - DNA, 20 bp, Artificial Sequence
  Description of Artificial Sequence: Synthetic oligonucleotide
  Target: FXN; (-) strand; PAM type: NRG; PAM sequence: TGG
gagacggggtttcatcatgt

SEQ ID NO: 14609 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagagacg

SEQ ID NO: 14610 - DNA, 20 bp, Artificial Sequence
  Description of Artificial Sequence: Synthetic oligonucleotide
  Target: FXN; (-) strand; PAM type: NRG; PAM sequence: GGG
tttgtatttttagtagagac

SEQ ID NO: 14611 - DNA, 20 bp, Artificial Sequence
  Description of Artificial Sequence: Synthetic oligonucleotide
  Target: FXN; (-) strand; PAM type: NRG; PAM sequence: CGG
ttttgtatttttagtagaga

SEQ ID NO: 14612 - DNA, 20 bp, Artificial Sequence
  Description of Artificial Sequence: Synthetic oligonucleotide
  Target: FXN; (-) strand; PAM type: NRG; PAM sequence: GAG
aattttttgtatttttagta

SEQ ID NO: 14613 - DNA, 20 bp, Artificial Sequence
  Description of Artificial Sequence: Synthetic oligonucleotide
  Target: FXN; (-) strand; PAM type: NRG; PAM sequence: TAG
ctaattttttgtatttttag

SEQ ID NO: 14614 - DNA, 20 bp, Artificial Sequence
  Description of Artificial Sequence: Synthetic oligonucleotide
  Target: FXN; (-) strand; PAM type: NRG; PAM sequence: TAG
cggctaattttttgtatttt

SEQ ID NO: 14615 - DNA, 20 bp, Artificial Sequence
  Description of Artificial Sequence: Synthetic oligonucleotide
  Target: FXN; (-) strand; PAM type: NRG; PAM sequence: CGG
caggcacctgccatcatgcc

SEQ ID NO: 14616 - DNA, 20 bp, Artificial Sequence
  Description of Artificial Sequence: Synthetic oligonucleotide
  Target: FXN; (-) strand; PAM type: NRG; PAM sequence: AGG
tcccaagtagctgggattac

SEQ ID NO: 14617 - DNA, 20 bp, Artificial Sequence
  Description of Artificial Sequence: Synthetic oligonucleotide
  Target: FXN; (-) strand; PAM type: NRG; PAM sequence: CAG
ctcccaagtagctgggatta

SEQ ID NO: 14618 - DNA, 20 bp, Artificial Sequence
  Description of Artificial Sequence: Synthetic oligonucleotide
  Target: FXN; (-) strand; PAM type: NRG; PAM sequence: GGG
cttcagcctcccaagtagct

SEQ ID NO: 14619 - DNA, 20 bp, Artificial Sequence
  Description of Artificial Sequence: Synthetic oligonucleotide
  Target: FXN; (-) strand; PAM type: NRG; PAM sequence: TGG
gcttcagcctcccaagtagc

SEQ ID NO: 14620 - DNA, 20 bp, Artificial Sequence
  Description of Artificial Sequence: Synthetic oligonucleotide
  Target: FXN; (-) strand; PAM type: NRG; PAM sequence: TAG
ttccgcttcagcctcccaag

SEQ ID NO: 14621 - DNA, 20 bp, Artificial Sequence
  Description of Artificial Sequence: Synthetic oligonucleotide
  Target: FXN; (-) strand; PAM type: NRG; PAM sequence: AAG
ttcttccgcttcagcctccc

SEQ ID NO: 14622 - DNA, 20 bp, Artificial Sequence
  Description of Artificial Sequence: Synthetic oligonucleotide
  Target: FXN; (-) strand; PAM type: NRG; PAM sequence: CAG
ttcaagcgattcttccgctt

SEQ ID NO: 14623 - DNA, 20 bp, Artificial Sequence
  Description of Artificial Sequence: Synthetic oligonucleotide
  Target: FXN; (-) strand; PAM type: NRG; PAM sequence: AAG
caacctccacctctgggttc

SEQ ID NO: 14624 - DNA, 20 bp, Artificial Sequence
  Description of Artificial Sequence: Synthetic oligonucleotide
  Target: FXN; (-) strand; PAM type: NRG; PAM sequence: GGG
tcactgcaacctccacctct

SEQ ID NO: 14625 - DNA, 20 bp, Artificial Sequence
  Description of Artificial Sequence: Synthetic oligonucleotide
  Target: FXN; (-) strand; PAM type: NRG; PAM sequence: TGG
ctcactgcaacctccacctc

SEQ ID NO: 14626 - DNA, 20 bp, Artificial Sequence
  Description of Artificial Sequence: Synthetic oligonucleotide
  Target: FXN; (-) strand; PAM type: NRG; PAM sequence: CGG
acagtgcaatggcacgatct

SEQ ID NO: 14627 - DNA, 20 bp, Artificial Sequence
  Description of Artificial Sequence: Synthetic oligonucleotide
  Target: FXN; (-) strand; PAM type: NRG; PAM sequence: TGG
tcacccaggttacagtgcaa

SEQ ID NO: 14628 - DNA, 20 bp, Artificial Sequence
  Description of Artificial Sequence: Synthetic oligonucleotide
  Target: FXN; (-) strand; PAM type: NRG; PAM sequence: CAG
ttgctcagtcacccaggtta

SEQ ID NO: 14629 - DNA, 20 bp, Artificial Sequence
  Description of Artificial Sequence: Synthetic oligonucleotide
  Target: FXN; (-) strand; PAM type: NRG; PAM sequence: AGG
agagttttgctcagtcaccc

SEQ ID NO: 14630 - DNA, 20 bp, Artificial Sequence
  Description of Artificial Sequence: Synthetic oligonucleotide
  Target: FXN; (-) strand; PAM type: NRG; PAM sequence: CAG
cagagttttgctcagtcacc

SEQ ID NO: 14631 - DNA, 20 bp, Artificial Sequence
  Description of Artificial Sequence: Synthetic oligonucleotide
  Target: FXN; (-) strand; PAM type: NRG; PAM sequence: CAG
ttttgagacagagttttgct

SEQ ID NO: 14632 - DNA, 20 bp, Artificial Sequence
  Description of Artificial Sequence: Synthetic oligonucleotide
  Target: FXN; (-) strand; PAM type: NRG; PAM sequence: GAG
gttattattattttgagaca

SEQ ID NO: 14633 - DNA, 20 bp, Artificial Sequence
  Description of Artificial Sequence: Synthetic oligonucleotide
  Target: FXN; (-) strand; PAM type: NRG; PAM sequence: CAG
ttgttattattattttgaga

SEQ ID NO: 14634 - DNA, 20 bp, Artificial Sequence
  Description of Artificial Sequence: Synthetic oligonucleotide
  Target: FXN; (-) strand; PAM type: NRG; PAM sequence: GAG
tatattgttattattatttt

SEQ ID NO: 14635 - DNA, 20 bp, Artificial Sequence
  Description of Artificial Sequence: Synthetic oligonucleotide
  Target: FXN; (-) strand; PAM type: NRG; PAM sequence: TGG
agtaagggtacaataaagga

SEQ ID NO: 14636 - DNA, 20 bp, Artificial Sequence
  Description of Artificial Sequence: Synthetic oligonucleotide
  Target: FXN; (-) strand; PAM type: NRG; PAM sequence: AGG
acccagtaagggtacaataa

SEQ ID NO: 14637 - DNA, 20 bp, Artificial Sequence
  Description of Artificial Sequence: Synthetic oligonucleotide
  Target: FXN; (-) strand; PAM type: NRG; PAM sequence: AAG
aacccagtaagggtacaata

SEQ ID NO: 14638 - DNA, 20 bp, Artificial Sequence
  Description of Artificial Sequence: Synthetic oligonucleotide
  Target: FXN; (-) strand; PAM type: NRG; PAM sequence: GGG
taatacgattaacccagtaa

SEQ ID NO: 14639 - DNA, 20 bp, Artificial Sequence
  Description of Artificial Sequence: Synthetic oligonucleotide
  Target: FXN; (-) strand; PAM type: NRG; PAM sequence: AGG
ataatacgattaacccagta

SEQ ID NO: 14640 - DNA, 20 bp, Artificial Sequence
  Description of Artificial Sequence: Synthetic oligonucleotide
  Target: FXN; (-) strand; PAM type: NRG; PAM sequence: AAG
tataatacgattaacccagt

SEQ ID NO: 14641 - DNA, 20 bp, Artificial Sequence
  Description of Artificial Sequence: Synthetic oligonucleotide
  Target: FXN; (-) strand; PAM type: NRG; PAM sequence: CAG
gtggtataatacgattaacc

SEQ ID NO: 14642 - DNA, 20 bp, Artificial Sequence
  Description of Artificial Sequence: Synthetic oligonucleotide
  Target: FXN; (-) strand; PAM type: NRG; PAM sequence: TGG
aaaattaaaatgaggtaatg

SEQ ID NO: 14643 - DNA, 20 bp, Artificial Sequence
  Description of Artificial Sequence: Synthetic oligonucleotide
  Target: FXN; (-) strand; PAM type: NRG; PAM sequence: AGG
ggtcagtaaaaattaaaatg

SEQ ID NO: 14644 - DNA, 20 bp, Artificial Sequence
  Description of Artificial Sequence: Synthetic oligonucleotide
  Target: FXN; (-) strand; PAM type: NRG; PAM sequence: GAG
aggtcagtaaaaattaaaat

SEQ ID NO: 14645 - DNA, 20 bp, Artificial Sequence
  Description of Artificial Sequence: Synthetic oligonucleotide
  Target: FXN; (-) strand; PAM type: NRG; PAM sequence: CAG
gctttgtataaagtgcaggt

SEQ ID NO: 14646 - DNA, 20 bp, Artificial Sequence
  Description of Artificial Sequence: Synthetic oligonucleotide
  Target: FXN; (-) strand; PAM type: NRG; PAM sequence: AGG
tgttgctttgtataaagtgc

SEQ ID NO: 14647 - DNA, 20 bp, Artificial Sequence
  Description of Artificial Sequence: Synthetic oligonucleotide
  Target: FXN; (-) strand; PAM type: NRG; PAM sequence: CAG
ttgttgctttgtataaagtg

SEQ ID NO: 14648 - DNA, 20 bp, Artificial Sequence
  Description of Artificial Sequence: Synthetic oligonucleotide
  Target: FXN; (-) strand; PAM type: NRG; PAM sequence: AAG
gaggcttgttgctttgtata

SEQ ID NO: 14649 - DNA, 20 bp, Artificial Sequence
  Description of Artificial Sequence: Synthetic oligonucleotide
  Target: FXN; (-) strand; PAM type: NRG; PAM sequence: AGG
catgaattttaatgtcctgg

SEQ ID NO: 14650 - DNA, 20 bp, Artificial Sequence
  Description of Artificial Sequence: Synthetic oligonucleotide
  Target: FXN; (-) strand; PAM type: NRG; PAM sequence: GAG
gcatgaattttaatgtcctg

SEQ ID NO: 14651 - DNA, 20 bp, Artificial Sequence
  Description of Artificial Sequence: Synthetic oligonucleotide
  Target: FXN; (-) strand; PAM type: NRG; PAM sequence: TGG
ttgcatgaattttaatgtcc

SEQ ID NO: 14652 - DNA, 20 bp, Artificial Sequence
  Description of Artificial Sequence: Synthetic oligonucleotide
  Target: FXN; (-) strand; PAM type: NRG; PAM sequence: GAG
gtaagaaaataatataacat

SEQ ID NO: 14653 - DNA, 20 bp, Artificial Sequence
  Description of Artificial Sequence: Synthetic oligonucleotide
  Target: FXN; (-) strand; PAM type: NRG; PAM sequence: AAG
taataaatccttctttaagt

SEQ ID NO: 14654 - DNA, 20 bp, Artificial Sequence
  Description of Artificial Sequence: Synthetic oligonucleotide
  Target: FXN; (-) strand; PAM type: NRG; PAM sequence: AAG
ccactaataaatccttcttt

SEQ ID NO: 14655 - DNA, 20 bp, Artificial Sequence
  Description of Artificial Sequence: Synthetic oligonucleotide
  Target: FXN; (-) strand; PAM type: NRG; PAM sequence: CAG
caggtgcacgccaccatgcc

SEQ ID NO: 14656 - DNA, 20 bp, Artificial Sequence
  Description of Artificial Sequence: Synthetic oligonucleotide
  Target: FXN; (-) strand; PAM type: NRG; PAM sequence: AGG
tcctgagtacctgggattac

SEQ ID NO: 14657 - DNA, 20 bp, Artificial Sequence
  Description of Artificial Sequence: Synthetic oligonucleotide
  Target: FXN; (-) strand; PAM type: NRG; PAM sequence: CAG
ctcctgagtacctgggatta

SEQ ID NO: 14658 - DNA, 20 bp, Artificial Sequence
  Description of Artificial Sequence: Synthetic oligonucleotide
  Target: FXN; (-) strand; PAM type: NRG; PAM sequence: GGG
tctcagcctcctgagtacct

SEQ ID NO: 14659 - DNA, 20 bp, Artificial Sequence
  Description of Artificial Sequence: Synthetic oligonucleotide
  Target: FXN; (-) strand; PAM type: NRG; PAM sequence: TGG
gtctcagcctcctgagtacc

SEQ ID NO: 14660 - DNA, 20 bp, Artificial Sequence
  Description of Artificial Sequence: Synthetic oligonucleotide
  Target: FXN; (-) strand; PAM type: NRG; PAM sequence: GAG
ttctcccgtctcagcctcct

SEQ ID NO: 14661 - DNA, 20 bp, Artificial Sequence
  Description of Artificial Sequence: Synthetic oligonucleotide
  Target: FXN; (-) strand; PAM type: NRG; PAM sequence: CAG
gtcaagcaattctcccgtct

SEQ ID NO: 14662 - DNA, 20 bp, Artificial Sequence
  Description of Artificial Sequence: Synthetic oligonucleotide
  Target: FXN; (-) strand; PAM type: NRG; PAM sequence: AAG
aacctcctccgcctggggtc

SEQ ID NO: 14663 - DNA, 20 bp, Artificial Sequence
  Description of Artificial Sequence: Synthetic oligonucleotide
  Target: FXN; (-) strand; PAM type: NRG; PAM sequence: GGG
actgtaacctcctccgcctg

SEQ ID NO: 14664 - DNA, 20 bp, Artificial Sequence
  Description of Artificial Sequence: Synthetic oligonucleotide
  Target: FXN; (-) strand; PAM type: NRG; PAM sequence: GGG
cactgtaacctcctccgcct

SEQ ID NO: 14665 - DNA, 20 bp, Artificial Sequence
  Description of Artificial Sequence: Synthetic oligonucleotide
  Target: FXN; (-) strand; PAM type: NRG; PAM sequence: TGG
tcactgtaacctcctccgcc

SEQ ID NO: 14666 - DNA, 20 bp, Artificial Sequence
  Description of Artificial Sequence: Synthetic oligonucleotide
  Target: FXN; (-) strand; PAM type: NRG; PAM sequence: AGG
ggagtctcgctctgtcgctc

SEQ ID NO: 14667 - DNA, 20 bp, Artificial Sequence
  Description of Artificial Sequence: Synthetic oligonucleotide
  Target: FXN; (-) strand; PAM type: NRG; PAM sequence: CAG
cggagtctcgctctgtcgct

SEQ ID NO: 14668 - DNA, 20 bp, Artificial Sequence
  Description of Artificial Sequence: Synthetic oligonucleotide
  Target: FXN; (-) strand; PAM type: NRG; PAM sequence: GAG
ttttttttttttttgagacg

SEQ ID NO: 14669 - DNA, 20 bp, Artificial Sequence
  Description of Artificial Sequence: Synthetic oligonucleotide
  Target: FXN; (-) strand; PAM type: NRG; PAM sequence: CGG
ccttttttttttttttgaga

SEQ ID NO: 14670 - DNA, 20 bp, Artificial Sequence
  Description of Artificial Sequence: Synthetic oligonucleotide
  Target: FXN; (-) strand; PAM type: NRG; PAM sequence: GAG
ccctcctttttttttttttt

SEQ ID NO: 14671 - DNA, 20 bp, Artificial Sequence
  Description of Artificial Sequence: Synthetic oligonucleotide
  Target: FXN; (-) strand; PAM type: NRG; PAM sequence: AAG
tttttattcacccattggaa

SEQ ID NO: 14672 - DNA, 20 bp, Artificial Sequence
  Description of Artificial Sequence: Synthetic oligonucleotide
  Target: FXN; (-) strand; PAM type: NRG; PAM sequence: TGG
atgtgtttttattcacccat

SEQ ID NO: 14673 - DNA, 20 bp, Artificial Sequence
  Description of Artificial Sequence: Synthetic oligonucleotide
  Target: FXN; (-) strand; PAM type: NRG; PAM sequence: TGG
ctgctcccagcttgacttaa

SEQ ID NO: 14674 - DNA, 20 bp, Artificial Sequence
  Description of Artificial Sequence: Synthetic oligonucleotide
  Target: FXN; (-) strand; PAM type: NRG; PAM sequence: CAG
taggtatatgccactgctcc

SEQ ID NO: 14675 - DNA, 20 bp, Artificial Sequence
  Description of Artificial Sequence: Synthetic oligonucleotide
  Target: FXN; (-) strand; PAM type: NRG; PAM sequence: AGG
tcctgtgcagctgggactat

SEQ ID NO: 14676 - DNA, 20 bp, Artificial Sequence
  Description of Artificial Sequence: Synthetic oligonucleotide
  Target: FXN; (-) strand; PAM type: NRG; PAM sequence: TAG
ctcctgtgcagctgggacta

SEQ ID NO: 14677 - DNA, 20 bp, Artificial Sequence
  Description of Artificial Sequence: Synthetic oligonucleotide
  Target: FXN; (-) strand; PAM type: NRG; PAM sequence: GGG
tctcagcctcctgtgcagct

SEQ ID NO: 14678 - DNA, 20 bp, Artificial Sequence
  Description of Artificial Sequence: Synthetic oligonucleotide
  Target: FXN; (-) strand; PAM type: NRG; PAM sequence: TGG
gtctcagcctcctgtgcagc

SEQ ID NO: 14679 - DNA, 20 bp, Artificial Sequence
  Description of Artificial Sequence: Synthetic oligonucleotide
  Target: FXN; (-) strand; PAM type: NRG; PAM sequence: CAG
tcctgtctcagcctcctgtg

SEQ ID NO: 14680 - DNA, 20 bp, Artificial Sequence
  Description of Artificial Sequence: Synthetic oligonucleotide
  Target: FXN; (-) strand; PAM type: NRG; PAM sequence: CAG
ttcaagcaatcctcctgtct

SEQ ID NO: 14681 - DNA, 20 bp, Artificial Sequence
  Description of Artificial Sequence: Synthetic oligonucleotide
  Target: FXN; (-) strand; PAM type: NRG; PAM sequence: AAG
gatctccaattcctggcttc

SEQ ID NO: 14682 - DNA, 20 bp, Artificial Sequence
  Description of Artificial Sequence: Synthetic oligonucleotide
  Target: FXN; (-) strand; PAM type: NRG; PAM sequence: TGG
ccaggctgatctccaattcc

SEQ ID NO: 14683 - DNA, 20 bp, Artificial Sequence
  Description of Artificial Sequence: Synthetic oligonucleotide
  Target: FXN; (-) strand; PAM type: NRG; PAM sequence: AGG
aggatcttgctgtgttgccc

SEQ ID NO: 14684 - DNA, 20 bp, Artificial Sequence
  Description of Artificial Sequence: Synthetic oligonucleotide
  Target: FXN; (-) strand; PAM type: NRG; PAM sequence: CAG
taggatcttgctgtgttgcc

SEQ ID NO: 14685 - DNA, 20 bp, Artificial Sequence
  Description of Artificial Sequence: Synthetic oligonucleotide
  Target: FXN; (-) strand; PAM type: NRG; PAM sequence: AGG
tttttctttttttaagagat

SEQ ID NO: 14686 - DNA, 20 bp, Artificial Sequence
  Description of Artificial Sequence: Synthetic oligonucleotide
  Target: FXN; (-) strand; PAM type: NRG; PAM sequence: TAG
ttttttctttttttaagaga

SEQ ID NO: 14687 - DNA, 20 bp, Artificial Sequence
  Description of Artificial Sequence: Synthetic oligonucleotide
  Target: FXN; (-) strand; PAM type: NRG; PAM sequence: GAG
gtttttttttctttttttaa

SEQ ID NO: 14688 - DNA, 20 bp, Artificial Sequence
  Description of Artificial Sequence: Synthetic oligonucleotide
  Target: FXN; (-) strand; PAM type: NRG; PAM sequence: AAG
aggtttttttttcttttttt

SEQ ID NO: 14689 - DNA, 20 bp, Artificial Sequence
  Description of Artificial Sequence: Synthetic oligonucleotide
  Target: FXN; (-) strand; PAM type: NRG; PAM sequence: AGG
tatactgttttattattaat

SEQ ID NO: 14690 - DNA, 20 bp, Artificial Sequence
  Description of Artificial Sequence: Synthetic oligonucleotide
  Target: FXN; (-) strand; PAM type: NRG; PAM sequence: TAG
ttatactgttttattattaa

SEQ ID NO: 14691 - DNA, 20 bp, Artificial Sequence
  Description of Artificial Sequence: Synthetic oligonucleotide
  Target: FXN; (-) strand; PAM type: NRG; PAM sequence: TAG
gaaaaaatattttacctatt

SEQ ID NO: 14692 - DNA, 20 bp, Artificial Sequence
  Description of Artificial Sequence: Synthetic oligonucleotide
  Target: FXN; (-) strand; PAM type: NRG; PAM sequence: CAG
ctcaaaaaataattttattt

SEQ ID NO: 14693 - DNA, 20 bp, Artificial Sequence
  Description of Artificial Sequence: Synthetic oligonucleotide
  Target: FXN; (-) strand; PAM type: NRG; PAM sequence: CAG
ctgcacttaaacatttccat

SEQ ID NO: 14694 - DNA, 20 bp, Artificial Sequence
  Description of Artificial Sequence: Synthetic oligonucleotide
  Target: FXN; (-) strand; PAM type: NRG; PAM sequence: TGG
atttattttctcactggcac

SEQ ID NO: 14695 - DNA, 20 bp, Artificial Sequence
  Description of Artificial Sequence: Synthetic oligonucleotide
  Target: FXN; (-) strand; PAM type: NRG; PAM sequence: TGG
gatgttatttattttctcac

SEQ ID NO: 14696 - DNA, 20 bp, Artificial Sequence
  Description of Artificial Sequence: Synthetic oligonucleotide
  Target: FXN; (-) strand; PAM type: NRG; PAM sequence: AAG
ctgaaactttcagtagaagc

SEQ ID NO: 14697 - DNA, 20 bp, Artificial Sequence
  Description of Artificial Sequence: Synthetic oligonucleotide
  Target: FXN; (-) strand; PAM type: NRG; PAM sequence: AAG
tgcactgaaactttcagtag

SEQ ID NO: 14698 - DNA, 20 bp, Artificial Sequence
  Description of Artificial Sequence: Synthetic oligonucleotide
  Target: FXN; (-) strand; PAM type: NRG; PAM sequence: TAG
gggtgcactgaaactttcag

SEQ ID NO: 14699 - DNA, 20 bp, Artificial Sequence
  Description of Artificial Sequence: Synthetic oligonucleotide
  Target: FXN; (-) strand; PAM type: NRG; PAM sequence: CAG
gtggggtgcactgaaacttt

SEQ ID NO: 14700 - DNA, 20 bp, Artificial Sequence
  Description of Artificial Sequence: Synthetic oligonucleotide
  Target: FXN; (-) strand; PAM type: NRG; PAM sequence: GGG
caccgagttctaagtaagtg

SEQ ID NO: 14701 - DNA, 20 bp, Artificial Sequence
  Description of Artificial Sequence: Synthetic oligonucleotide
  Target: FXN; (-) strand; PAM type: NRG; PAM sequence: GGG
tcaccgagttctaagtaagt

SEQ ID NO: 14702 - DNA, 20 bp, Artificial Sequence
  Description of Artificial Sequence: Synthetic oligonucleotide
  Target: FXN; (-) strand; PAM type: NRG; PAM sequence: TGG
gtcaccgagttctaagtaag

SEQ ID NO: 14703 - DNA, 20 bp, Artificial Sequence
  Description of Artificial Sequence: Synthetic oligonucleotide
  Target: FXN; (-) strand; PAM type: NRG; PAM sequence: AAG
catgtcaccgagttctaagt

SEQ ID NO: 14704 - DNA, 20 bp, Artificial Sequence
  Description of Artificial Sequence: Synthetic oligonucleotide
  Target: FXN; (-) strand; PAM type: NRG; PAM sequence: AAG
acatcatgtcaccgagttct

SEQ ID NO: 14705 - DNA, 20 bp, Artificial Sequence
  Description of Artificial Sequence: Synthetic oligonucleotide
  Target: FXN; (-) strand; PAM type: NRG; PAM sequence: GAG
aaggagtacatcatgtcacc

SEQ ID NO: 14706 - DNA, 20 bp, Artificial Sequence
  Description of Artificial Sequence: Synthetic oligonucleotide
  Target: FXN; (-) strand; PAM type: NRG; PAM sequence: GAG
gtgctgtgtcccagataaag

SEQ ID NO: 14707 - DNA, 20 bp, Artificial Sequence
  Description of Artificial Sequence: Synthetic oligonucleotide
  Target: FXN; (-) strand; PAM type: NRG; PAM sequence: AGG
ttgtgctgtgtcccagataa

SEQ ID NO: 14708 - DNA, 20 bp, Artificial Sequence
  Description of Artificial Sequence: Synthetic oligonucleotide
  Target: FXN; (-) strand; PAM type: NRG; PAM sequence: AAG
tttgtgctgtgtcccagata

SEQ ID NO: 14709 - DNA, 20 bp, Artificial Sequence
  Description of Artificial Sequence: Synthetic oligonucleotide
  Target: FXN; (-) strand; PAM type: NRG; PAM sequence: CAG
acctcttttgtgctgtgtcc

SEQ ID NO: 14710 - DNA, 20 bp, Artificial Sequence
  Description of Artificial Sequence: Synthetic oligonucleotide
  Target: FXN; (-) strand; PAM type: NRG; PAM sequence: CAG
cttccactttcatgtcagag

SEQ ID NO: 14711 - DNA, 20 bp, Artificial Sequence
  Description of Artificial Sequence: Synthetic oligonucleotide
  Target: FXN; (-) strand; PAM type: NRG; PAM sequence: GAG
taacttccactttcatgtca

SEQ ID NO: 14712 - DNA, 20 bp, Artificial Sequence
  Description of Artificial Sequence: Synthetic oligonucleotide
  Target: FXN; (-) strand; PAM type: NRG; PAM sequence: CAG
cttaacttccactttcatgt

SEQ ID NO: 14713 - DNA, 20 bp, Artificial Sequence
  Description of Artificial Sequence: Synthetic oligonucleotide
  Target: FXN; (-) strand; PAM type: NRG; PAM sequence: CAG
acaaggaccccataagagcc

SEQ ID NO: 14714 - DNA, 20 bp, Artificial Sequence
  Description of Artificial Sequence: Synthetic oligonucleotide
  Target: FXN; (-) strand; PAM type: NRG; PAM sequence: GAG
ggcccacaaggaccccataa

SEQ ID NO: 14715 - DNA, 20 bp, Artificial Sequence
  Description of Artificial Sequence: Synthetic oligonucleotide
  Target: FXN; (-) strand; PAM type: NRG; PAM sequence: AAG
ctggcccacaaggaccccat

SEQ ID NO: 14716 - DNA, 20 bp, Artificial Sequence
  Description of Artificial Sequence: Synthetic oligonucleotide
  Target: FXN; (-) strand; PAM type: NRG; PAM sequence: AGG
gcctgaagggctggcccaca

SEQ ID NO: 14717 - DNA, 20 bp, Artificial Sequence
  Description of Artificial Sequence: Synthetic oligonucleotide
  Target: FXN; (-) strand; PAM type: NRG; PAM sequence: AAG
ggcctgaagggctggcccac

SEQ ID NO: 14718 - DNA, 20 bp, Artificial Sequence
  Description of Artificial Sequence: Synthetic oligonucleotide
  Target: FXN; (-) strand; PAM type: NRG; PAM sequence: TGG
gtaaaataggcctgaagggc

SEQ ID NO: 14719 - DNA, 20 bp, Artificial Sequence
  Description of Artificial Sequence: Synthetic oligonucleotide
  Target: FXN; (-) strand; PAM type: NRG; PAM sequence: GGG
gaaagtaaaataggcctgaa

SEQ ID NO: 14720 - DNA, 20 bp, Artificial Sequence
  Description of Artificial Sequence: Synthetic oligonucleotide
  Target: FXN; (-) strand; PAM type: NRG; PAM sequence: AGG
tgaaagtaaaataggcctga

SEQ ID NO: 14721 - DNA, 20 bp, Artificial Sequence
  Description of Artificial Sequence: Synthetic oligonucleotide
  Target: FXN; (-) strand; PAM type: NRG; PAM sequence: AAG
atgaaagtaaaataggcctg

SEQ ID NO: 14722 - DNA, 20 bp, Artificial Sequence
  Description of Artificial Sequence: Synthetic oligonucleotide
  Target: FXN; (-) strand; PAM type: NRG; PAM sequence: AGG
atgtaaaatgaaagtaaaat

SEQ ID NO: 14723 - DNA, 20 bp, Artificial Sequence
  Description of Artificial Sequence: Synthetic oligonucleotide
  Target: FXN; (-) strand; PAM type: NRG; PAM sequence: TAG
tatgtaaaatgaaagtaaaa

SEQ ID NO: 14724 - DNA, 20 bp, Artificial Sequence
  Description of Artificial Sequence: Synthetic oligonucleotide
  Target: FXN; (-) strand; PAM type: NRG; PAM sequence: AAG
tagagctatatgtaaaatga

SEQ ID NO: 14725 - DNA, 20 bp, Artificial Sequence
  Description of Artificial Sequence: Synthetic oligonucleotide
  Target: FXN; (-) strand; PAM type: NRG; PAM sequence: GAG
cgagataatcaaaccaatta

SEQ ID NO: 14726 - DNA, 20 bp, Artificial Sequence
  Description of Artificial Sequence: Synthetic oligonucleotide
  Target: FXN; (-) strand; PAM type: NRG; PAM sequence: TAG
aacgagataatcaaaccaat

SEQ ID NO: 14727 - DNA, 20 bp, Artificial Sequence
  Description of Artificial Sequence: Synthetic oligonucleotide
  Target: FXN; (-) strand; PAM type: NRG; PAM sequence: GAG
tctcccactgccttgggaac

SEQ ID NO: 14728 - DNA, 20 bp, Artificial Sequence
  Description of Artificial Sequence: Synthetic oligonucleotide
  Target: FXN; (-) strand; PAM type: NRG; PAM sequence: GGG
tggggatctcccactgcctt

SEQ ID NO: 14729 - DNA, 20 bp, Artificial Sequence
  Description of Artificial Sequence: Synthetic oligonucleotide
  Target: FXN; (-) strand; PAM type: NRG; PAM sequence: TGG
atggggatctcccactgcct

SEQ ID NO: 14730 - DNA, 20 bp, Artificial Sequence
  Description of Artificial Sequence: Synthetic oligonucleotide
  Target: FXN; (-) strand; PAM type: NRG; PAM sequence: GGG
cccttttctttccttaaatg

SEQ ID NO: 14731 - DNA, 20 bp, Artificial Sequence
  Description of Artificial Sequence: Synthetic oligonucleotide
  Target: FXN; (-) strand; PAM type: NRG; PAM sequence: GGG
ccccttttctttccttaaat

SEQ ID NO: 14732 - DNA, 20 bp, Artificial Sequence
  Description of Artificial Sequence: Synthetic oligonucleotide
  Target: FXN; (-) strand; PAM type: NRG; PAM sequence: TGG
gccccttttctttccttaaa

SEQ ID NO: 14733 - DNA, 20 bp, Artificial Sequence
  Description of Artificial Sequence: Synthetic oligonucleotide
  Target: FXN; (-) strand; PAM type: NRG; PAM sequence: AGG
caggcatgagccactgtgcc

SEQ ID NO: 14734 - DNA, 20 bp, Artificial Sequence
  Description of Artificial Sequence: Synthetic oligonucleotide
  Target: FXN; (-) strand; PAM type: NRG; PAM sequence: CAG
acaggcatgagccactgtgc

SEQ ID NO: 14735 - DNA, 20 bp, Artificial Sequence
  Description of Artificial Sequence: Synthetic oligonucleotide
  Target: FXN; (-) strand; PAM type: NRG; PAM sequence: GAG
agtgctgggattacaggcat

SEQ ID NO: 14736 - DNA, 20 bp, Artificial Sequence
  Description of Artificial Sequence: Synthetic oligonucleotide
  Target: FXN; (-) strand; PAM type: NRG; PAM sequence: AGG
tcccaaagtgctgggattac

SEQ ID NO: 14737 - DNA, 20 bp, Artificial Sequence
  Description of Artificial Sequence: Synthetic oligonucleotide
  Target: FXN; (-) strand; PAM type: NRG; PAM sequence: CAG
ctcccaaagtgctgggatta

SEQ ID NO: 14738 - DNA, 20 bp, Artificial Sequence
  Description of Artificial Sequence: Synthetic oligonucleotide
  Target: FXN; (-) strand; PAM type: NRG; PAM sequence: GGG
cctcagcctcccaaagtgct

SEQ ID NO: 14739 - DNA, 20 bp, Artificial Sequence
  Description of Artificial Sequence: Synthetic oligonucleotide
  Target: FXN; (-) strand; PAM type: NRG; PAM sequence: TGG
gcctcagcctcccaaagtgc

SEQ ID NO: 14740 - DNA, 20 bp, Artificial Sequence
  Description of Artificial Sequence: Synthetic oligonucleotide
  Target: FXN; (-) strand; PAM type: NRG; PAM sequence: AAG
acacttgcctcagcctccca

SEQ ID NO: 14741 - DNA, 20 bp, Artificial Sequence
  Description of Artificial Sequence: Synthetic oligonucleotide
  Target: FXN; (-) strand; PAM type: NRG; PAM sequence: CAG
ctcaggtgatacacttgcct

SEQ ID NO: 14742 - DNA, 20 bp, Artificial Sequence
  Description of Artificial Sequence: Synthetic oligonucleotide
  Target: FXN; (-) strand; PAM type: NRG; PAM sequence: AGG
ggtcttgaactcctgacctc

SEQ ID NO: 14743 - DNA, 20 bp, Artificial Sequence
  Description of Artificial Sequence: Synthetic oligonucleotide
  Target: FXN; (-) strand; PAM type: NRG; PAM sequence: CAG
tggtcttgaactcctgacct

SEQ ID NO: 14744 - DNA, 20 bp, Artificial Sequence
  Description of Artificial Sequence: Synthetic oligonucleotide
  Target: FXN; (-) strand; PAM type: NRG; PAM sequence: TGG
ttttgccatgttggccaggc

SEQ ID NO: 14745 - DNA, 20 bp, Artificial Sequence
  Description of Artificial Sequence: Synthetic oligonucleotide
  Target: FXN; (-) strand; PAM type: NRG; PAM sequence: AGG
gggattttgccatgttggcc

SEQ ID NO: 14746 - DNA, 20 bp, Artificial Sequence
  Description of Artificial Sequence: Synthetic oligonucleotide
  Target: FXN; (-) strand; PAM type: NRG; PAM sequence: CAG
cgggattttgccatgttggc

SEQ ID NO: 14747 - DNA, 20 bp, Artificial Sequence
  Description of Artificial Sequence: Synthetic oligonucleotide
  Target: FXN; (-) strand; PAM type: NRG; PAM sequence: TGG
gagacgggattttgccatgt

SEQ ID NO: 14748 - DNA, 20 bp, Artificial Sequence
  Description of Artificial Sequence: Synthetic oligonucleotide
  Target: FXN; (-) strand; PAM type: NRG; PAM sequence: GGG
ttaatatttttagtagagac

SEQ ID NO: 14749 - DNA, 20 bp, Artificial Sequence
  Description of Artificial Sequence: Synthetic oligonucleotide
  Target: FXN; (-) strand; PAM type: NRG; PAM sequence: CGG
tttaatatttttagtagaga

SEQ ID NO: 14750 - DNA, 20 bp, Artificial Sequence
  Description of Artificial Sequence: Synthetic oligonucleotide
  Target: FXN; (-) strand; PAM type: NRG; PAM sequence: GAG
attttttaatatttttagta

SEQ ID NO: 14751 - DNA, 20 bp, Artificial Sequence
  Description of Artificial Sequence: Synthetic oligonucleotide
  Target: FXN; (-) strand; PAM type: NRG; PAM sequence: TAG
caattttttaatatttttag

SEQ ID NO: 14752 - DNA, 20 bp, Artificial Sequence
  Description of Artificial Sequence: Synthetic oligonucleotide
  Target: FXN; (-) strand; PAM type: NRG; PAM sequence: TAG
agccaattttttaatatttt

SEQ ID NO: 14753 - DNA, 20 bp, Artificial Sequence
  Description of Artificial Sequence: Synthetic oligonucleotide
  Target: FXN; (-) strand; PAM type: NRG; PAM sequence: CAG
taggcacgaaccaccacgcc

SEQ ID NO: 14754 - DNA, 20 bp, Artificial Sequence
  Description of Artificial Sequence: Synthetic oligonucleotide
  Target: FXN; (-) strand; PAM type: NRG; PAM sequence: AGG
tcctgagtagctgaaattat

SEQ ID NO: 14755 - DNA, 20 bp, Artificial Sequence
  Description of Artificial Sequence: Synthetic oligonucleotide
  Target: FXN; (-) strand; PAM type: NRG; PAM sequence: TAG
ctcctgagtagctgaaatta

SEQ ID NO: 14756 - DNA, 20 bp, Artificial Sequence
  Description of Artificial Sequence: Synthetic oligonucleotide
  Target: FXN; (-) strand; PAM type: NRG; PAM sequence: TAG
tcctgcctcagcctcctgag

SEQ ID NO: 14757 - DNA, 20 bp, Artificial Sequence
  Description of Artificial Sequence: Synthetic oligonucleotide
  Target: FXN; (-) strand; PAM type: NRG; PAM sequence: GAG
ttctcctgcctcagcctcct

SEQ ID NO: 14758 - DNA, 20 bp, Artificial Sequence
  Description of Artificial Sequence: Synthetic oligonucleotide
  Target: FXN; (-) strand; PAM type: NRG; PAM sequence: CAG
ttacagcgattctcctgcct

SEQ ID NO: 14759 - DNA, 20 bp, Artificial Sequence
  Description of Artificial Sequence: Synthetic oligonucleotide
  Target: FXN; (-) strand; PAM type: NRG; PAM sequence: CAG
aacctccaccccccaggtta

SEQ ID NO: 14760 - DNA, 20 bp, Artificial Sequence
  Description of Artificial Sequence: Synthetic oligonucleotide
  Target: FXN; (-) strand; PAM type: NRG; PAM sequence: AGG
cactgcaacctccacccccc

SEQ ID NO: 14761 - DNA, 20 bp, Artificial Sequence
  Description of Artificial Sequence: Synthetic oligonucleotide
  Target: FXN; (-) strand; PAM type: NRG; PAM sequence: CAG
tcactgcaacctccaccccc

SEQ ID NO: 14762 - DNA, 20 bp, Artificial Sequence
  Description of Artificial Sequence: Synthetic oligonucleotide
  Target: FXN; (-) strand; PAM type: NRG; PAM sequence: TGG
ttggccaggctggagtgaag

SEQ ID NO: 14763 - DNA, 20 bp, Artificial Sequence
  Description of Artificial Sequence: Synthetic oligonucleotide
  Target: FXN; (-) strand; PAM type: NRG; PAM sequence: AAG
ctgttggccaggctggagtg

SEQ ID NO: 14764 - DNA, 20 bp, Artificial Sequence
  Description of Artificial Sequence: Synthetic oligonucleotide
  Target: FXN; (-) strand; PAM type: NRG; PAM sequence: GAG
tggctctgttggccaggctg

SEQ ID NO: 14765 - DNA, 20 bp, Artificial Sequence
  Description of Artificial Sequence: Synthetic oligonucleotide
  Target: FXN; (-) strand; PAM type: NRG; PAM sequence: TGG
tatggctctgttggccaggc

SEQ ID NO: 14766 - DNA, 20 bp, Artificial Sequence
  Description of Artificial Sequence: Synthetic oligonucleotide
  Target: FXN; (-) strand; PAM type: NRG; PAM sequence: AGG
ggagtatggctctgttggcc

SEQ ID NO: 14767 - DNA, 20 bp, Artificial Sequence
  Description of Artificial Sequence: Synthetic oligonucleotide
  Target: FXN; (-) strand; PAM type: NRG; PAM sequence: CAG
cggagtatggctctgttggc

SEQ ID NO: 14768 - DNA, 20 bp, Artificial Sequence
  Description of Artificial Sequence: Synthetic oligonucleotide
  Target: FXN; (-) strand; PAM type: NRG; PAM sequence: TGG
gagacggagtatggctctgt

SEQ ID NO: 14769 - DNA, 20 bp, Artificial Sequence
  Description of Artificial Sequence: Synthetic oligonucleotide
  Target: FXN; (-) strand; PAM type: NRG; PAM sequence: TGG
tatttatttgagacggagta

SEQ ID NO: 14770 - DNA, 20 bp, Artificial Sequence
  Description of Artificial Sequence: Synthetic oligonucleotide
  Target: FXN; (-) strand; PAM type: NRG; PAM sequence: GAG
ttatttatttatttgagacg

SEQ ID NO: 14771 - DNA, 20 bp, Artificial Sequence
  Description of Artificial Sequence: Synthetic oligonucleotide
  Target: FXN; (-) strand; PAM type: NRG; PAM sequence: CGG
atttatttatttatttgaga

SEQ ID NO: 14772 - DNA, 20 bp, Artificial Sequence
  Description of Artificial Sequence: Synthetic oligonucleotide
  Target: FXN; (-) strand; PAM type: NRG; PAM sequence: GAG
atttatttatttatttattt

SEQ ID NO: 14773 - DNA, 20 bp, Artificial Sequence
  Description of Artificial Sequence: Synthetic oligonucleotide
  Target: FXN; (-) strand; PAM type: NRG; PAM sequence: AAG
ggctgctgttcatgtgtttg

SEQ ID NO: 14774 - DNA, 20 bp, Artificial Sequence
  Description of Artificial Sequence: Synthetic oligonucleotide
  Target: FXN; (-) strand; PAM type: NRG; PAM sequence: TGG
tatgattttgattcttcccc

SEQ ID NO: 14775 - DNA, 20 bp, Artificial Sequence
  Description of Artificial Sequence: Synthetic oligonucleotide
  Target: FXN; (-) strand; PAM type: NRG; PAM sequence: CAG
tacttttccagtttgcttga

SEQ ID NO: 14776 - DNA, 20 bp, Artificial Sequence
  Description of Artificial Sequence: Synthetic oligonucleotide
  Target: FXN; (-) strand; PAM type: NRG; PAM sequence: CAG
tacacacagtggtacttttc

SEQ ID NO: 14777 - DNA, 20 bp, Artificial Sequence
  Description of Artificial Sequence: Synthetic oligonucleotide
  Target: FXN; (-) strand; PAM type: NRG; PAM sequence: TGG
gaggctattggtacacacag

SEQ ID NO: 14778 - DNA, 20 bp, Artificial Sequence
  Description of Artificial Sequence: Synthetic oligonucleotide
  Target: FXN; (-) strand; PAM type: NRG; PAM sequence: CAG
ggggaggctattggtacaca

SEQ ID NO: 14779 - DNA, 20 bp, Artificial Sequence
  Description of Artificial Sequence: Synthetic oligonucleotide
  Target: FXN; (-) strand; PAM type: NRG; PAM sequence: TGG
gtctgtggtggggaggctat

SEQ ID NO: 14780 - DNA, 20 bp, Artificial Sequence
  Description of Artificial Sequence: Synthetic oligonucleotide
  Target: FXN; (-) strand; PAM type: NRG; PAM sequence: AGG
tcccagggtctgtggtgggg

SEQ ID NO: 14781 - DNA, 20 bp, Artificial Sequence
  Description of Artificial Sequence: Synthetic oligonucleotide
  Target: FXN; (-) strand; PAM type: NRG; PAM sequence: GAG
ctcccagggtctgtggtggg

SEQ ID NO: 14782 - DNA, 20 bp, Artificial Sequence
  Description of Artificial Sequence: Synthetic oligonucleotide
  Target: FXN; (-) strand; PAM type: NRG; PAM sequence: GGG
tgctcccagggtctgtggtg

SEQ ID NO: 14783 - DNA, 20 bp, Artificial Sequence
  Description of Artificial Sequence: Synthetic oligonucleotide
  Target: FXN; (-) strand; PAM type: NRG; PAM sequence: GGG
atgctcccagggtctgtggt

SEQ ID NO: 14784 - DNA, 20 bp, Artificial Sequence
  Description of Artificial Sequence: Synthetic oligonucleotide
  Target: FXN; (-) strand; PAM type: NRG; PAM sequence: TGG
gatgctcccagggtctgtgg

SEQ ID NO: 14785 - DNA, 20 bp, Artificial Sequence
  Description of Artificial Sequence: Synthetic oligonucleotide
  Target: FXN; (-) strand; PAM type: NRG; PAM sequence: TGG
ggcgatgctcccagggtctg

SEQ ID NO: 14786 - DNA, 20 bp, Artificial Sequence
  Description of Artificial Sequence: Synthetic oligonucleotide
  Target: FXN; (-) strand; PAM type: NRG; PAM sequence: GGG
taaatgaggcgatgctccca

SEQ ID NO: 14787 - DNA, 20 bp, Artificial Sequence
  Description of Artificial Sequence: Synthetic oligonucleotide
  Target: FXN; (-) strand; PAM type: NRG; PAM sequence: AGG
ataaatgaggcgatgctccc

SEQ ID NO: 14788 - DNA, 20 bp, Artificial Sequence
  Description of Artificial Sequence: Synthetic oligonucleotide
  Target: FXN; (-) strand; PAM type: NRG; PAM sequence: CAG
cataaatgaggcgatgctcc

SEQ ID NO: 14789 - DNA, 20 bp, Artificial Sequence
  Description of Artificial Sequence: Synthetic oligonucleotide
  Target: FXN; (-) strand; PAM type: NRG; PAM sequence: AGG
actggaccacaccataaatg

SEQ ID NO: 14790 - DNA, 20 bp, Artificial Sequence
  Description of Artificial Sequence: Synthetic oligonucleotide
  Target: FXN; (-) strand; PAM type: NRG; PAM sequence: GAG
gactggaccacaccataaat

SEQ ID NO: 14791 - DNA, 20 bp, Artificial Sequence
  Description of Artificial Sequence: Synthetic oligonucleotide
  Target: FXN; (-) strand; PAM type: NRG; PAM sequence: TGG
tcatccttcacatggatgac

SEQ ID NO: 14792 - DNA, 20 bp, Artificial Sequence
  Description of Artificial Sequence: Synthetic oligonucleotide
  Target: FXN; (-) strand; PAM type: NRG; PAM sequence: TGG
ctggaaactcatccttcaca

SEQ ID NO: 14793 - DNA, 20 bp, Artificial Sequence
  Description of Artificial Sequence: Synthetic oligonucleotide
  Target: FXN; (-) strand; PAM type: NRG; PAM sequence: TGG
aatatttaataaccttttcc

SEQ ID NO: 14794 - DNA, 20 bp, Artificial Sequence
  Description of Artificial Sequence: Synthetic oligonucleotide
  Target: FXN; (-) strand; PAM type: NRG; PAM sequence: CAG
tcacctcctccagtatgtta

SEQ ID NO: 14795 - DNA, 20 bp, Artificial Sequence
  Description of Artificial Sequence: Synthetic oligonucleotide
  Target: FXN; (-) strand; PAM type: NRG; PAM sequence: CAG
atgcaattcctcacctcctc

SEQ ID NO: 14796 - DNA, 20 bp, Artificial Sequence
  Description of Artificial Sequence: Synthetic oligonucleotide
  Target: FXN; (-) strand; PAM type: NRG; PAM sequence: AAG
aggggaaaaaaaagttttct

SEQ ID NO: 14797 - DNA, 20 bp, Artificial Sequence
  Description of Artificial Sequence: Synthetic oligonucleotide
  Target: FXN; (-) strand; PAM type: NRG; PAM sequence: AAG
aaaatagaaaggggaaaaaa

SEQ ID NO: 14798 - DNA, 20 bp, Artificial Sequence
  Description of Artificial Sequence: Synthetic oligonucleotide
  Target: FXN; (-) strand; PAM type: NRG; PAM sequence: GGG
ctgtctcaaaaaatagaaag

SEQ ID NO: 14799 - DNA, 20 bp, Artificial Sequence
  Description of Artificial Sequence: Synthetic oligonucleotide
  Target: FXN; (-) strand; PAM type: NRG; PAM sequence: GGG
cctgtctcaaaaaatagaaa

SEQ ID NO: 14800 - DNA, 20 bp, Artificial Sequence
  Description of Artificial Sequence: Synthetic oligonucleotide
  Target: FXN; (-) strand; PAM type: NRG; PAM sequence: AGG
tcctgtctcaaaaaatagaa

SEQ ID NO: 14801 - DNA, 20 bp, Artificial Sequence
  Description of Artificial Sequence: Synthetic oligonucleotide
  Target: FXN; (-) strand; PAM type: NRG; PAM sequence: AAG
atcctgtctcaaaaaataga

SEQ ID NO: 14802 - DNA, 20 bp, Artificial Sequence
  Description of Artificial Sequence: Synthetic oligonucleotide
  Target: FXN; (-) strand; PAM type: NRG; PAM sequence: TAG
tgagatcctgtctcaaaaaa

SEQ ID NO: 14803 - DNA, 20 bp, Artificial Sequence
  Description of Artificial Sequence: Synthetic oligonucleotide
  Target: FXN; (-) strand; PAM type: NRG; PAM sequence: GAG
tccagcctgagtgccaaagt

SEQ ID NO: 14804 - DNA, 20 bp, Artificial Sequence
  Description of Artificial Sequence: Synthetic oligonucleotide
  Target: FXN; (-) strand; PAM type: NRG; PAM sequence: AAG
gtcctccagcctgagtgcca

SEQ ID NO: 14805 - DNA, 20 bp, Artificial Sequence
  Description of Artificial Sequence: Synthetic oligonucleotide
  Target: FXN; (-) strand; PAM type: NRG; PAM sequence: GAG
gtaccactgtcctccagcct

SEQ ID NO: 14806 - DNA, 20 bp, Artificial Sequence
  Description of Artificial Sequence: Synthetic oligonucleotide
  Target: FXN; (-) strand; PAM type: NRG; PAM sequence: CAG
ttgattgtaccactgtcctc

SEQ ID NO: 14807 - DNA, 20 bp, Artificial Sequence
  Description of Artificial Sequence: Synthetic oligonucleotide
  Target: FXN; (-) strand; PAM type: NRG; PAM sequence: GAG
agggaggtcgaggctgccat

SEQ ID NO: 14808 - DNA, 20 bp, Artificial Sequence
  Description of Artificial Sequence: Synthetic oligonucleotide
  Target: FXN; (-) strand; PAM type: NRG; PAM sequence: AGG
gcccaagcccagggaggtcg

SEQ ID NO: 14809 - DNA, 20 bp, Artificial Sequence
  Description of Artificial Sequence: Synthetic oligonucleotide
  Target: FXN; (-) strand; PAM type: NRG; PAM sequence: GAG
tgcccaagcccagggaggtc

SEQ ID NO: 14810 - DNA, 20 bp, Artificial Sequence
  Description of Artificial Sequence: Synthetic oligonucleotide
  Target: FXN; (-) strand; PAM type: NRG; PAM sequence: AGG
aggattgcccaagcccaggg

SEQ ID NO: 14811 - DNA, 20 bp, Artificial Sequence
  Description of Artificial Sequence: Synthetic oligonucleotide
  Target: FXN; (-) strand; PAM type: NRG; PAM sequence: GAG
gaggattgcccaagcccagg

SEQ ID NO: 14812 - DNA, 20 bp, Artificial Sequence
  Description of Artificial Sequence: Synthetic oligonucleotide
  Target: FXN; (-) strand; PAM type: NRG; PAM sequence: GGG
gggaggattgcccaagccca

SEQ ID NO: 14813 - DNA, 20 bp, Artificial Sequence
  Description of Artificial Sequence: Synthetic oligonucleotide
  Target: FXN; (-) strand; PAM type: NRG; PAM sequence: AGG
tgggaggattgcccaagccc

SEQ ID NO: 14814 - DNA, 20 bp, Artificial Sequence
  Description of Artificial Sequence: Synthetic oligonucleotide
  Target: FXN; (-) strand; PAM type: NRG; PAM sequence: CAG
gtgggaggattgcccaagcc

SEQ ID NO: 14815 - DNA, 20 bp, Artificial Sequence
  Description of Artificial Sequence: Synthetic oligonucleotide
  Target: FXN; (-) strand; PAM type: NRG; PAM sequence: AAG
cacctgtgggaggattgccc

SEQ ID NO: 14816 - DNA, 20 bp, Artificial Sequence
  Description of Artificial Sequence: Synthetic oligonucleotide
  Target: FXN; (-) strand; PAM type: NRG; PAM sequence: AGG
tggaggtgcacacctgtggg

SEQ ID NO: 14817 - DNA, 20 bp, Artificial Sequence
  Description of Artificial Sequence: Synthetic oligonucleotide
  Target: FXN; (-) strand; PAM type: NRG; PAM sequence: GAG
atggaggtgcacacctgtgg

SEQ ID NO: 14818 - DNA, 20 bp, Artificial Sequence
  Description of Artificial Sequence: Synthetic oligonucleotide
  Target: FXN; (-) strand; PAM type: NRG; PAM sequence: GGG
ctatggaggtgcacacctgt

SEQ ID NO: 14819 - DNA, 20 bp, Artificial Sequence
  Description of Artificial Sequence: Synthetic oligonucleotide
  Target: FXN; (-) strand; PAM type: NRG; PAM sequence: TGG
gctatggaggtgcacacctg

SEQ ID NO: 14820 - DNA, 20 bp, Artificial Sequence
  Description of Artificial Sequence: Synthetic oligonucleotide
  Target: FXN; (-) strand; PAM type: NRG; PAM sequence: AGG
cacaaattagccagctatgg

SEQ ID NO: 14821 - DNA, 20 bp, Artificial Sequence
  Description of Artificial Sequence: Synthetic oligonucleotide
  Target: FXN; (-) strand; PAM type: NRG; PAM sequence: GAG
acacaaattagccagctatg

SEQ ID NO: 14822 - DNA, 20 bp, Artificial Sequence
  Description of Artificial Sequence: Synthetic oligonucleotide
  Target: FXN; (-) strand; PAM type: NRG; PAM sequence: TGG
atacacaaattagccagcta

SEQ ID NO: 14823 - DNA, 20 bp, Artificial Sequence
  Description of Artificial Sequence: Synthetic oligonucleotide
  Target: FXN; (-) strand; PAM type: NRG; PAM sequence: CAG
caaaaaatacacaaattagc

SEQ ID NO: 14824 - DNA, 20 bp, Artificial Sequence
  Description of Artificial Sequence: Synthetic oligonucleotide
  Target: FXN; (-) strand; PAM type: NRG; PAM sequence: TAG
tctacaaaaaatacacaaat

SEQ ID NO: 14825 - DNA, 20 bp, Artificial Sequence
  Description of Artificial Sequence: Synthetic oligonucleotide
  Target: FXN; (-) strand; PAM type: NRG; PAM sequence: TGG
agagaccagcctgggcaaca

SEQ ID NO: 14826 - DNA, 20 bp, Artificial Sequence
  Description of Artificial Sequence: Synthetic oligonucleotide
  Target: FXN; (-) strand; PAM type: NRG; PAM sequence: GGG
taagtgttagagaccagcct

SEQ ID NO: 14827 - DNA, 20 bp, Artificial Sequence
  Description of Artificial Sequence: Synthetic oligonucleotide
  Target: FXN; (-) strand; PAM type: NRG; PAM sequence: TGG
ctaagtgttagagaccagcc

SEQ ID NO: 14828 - DNA, 20 bp, Artificial Sequence
  Description of Artificial Sequence: Synthetic oligonucleotide
  Target: FXN; (-) strand; PAM type: NRG; PAM sequence: CAG
tgagcctaagtgttagagac

SEQ ID NO: 14829 - DNA, 20 bp, Artificial Sequence
  Description of Artificial Sequence: Synthetic oligonucleotide
  Target: FXN; (-) strand; PAM type: NRG; PAM sequence: GAG
tcacttgagcctaagtgtta

SEQ ID NO: 14830 - DNA, 20 bp, Artificial Sequence
  Description of Artificial Sequence: Synthetic oligonucleotide
  Target: FXN; (-) strand; PAM type: NRG; PAM sequence: TAG
gatcacttgagcctaagtgt

SEQ ID NO: 14831 - DNA, 20 bp, Artificial Sequence
  Description of Artificial Sequence: Synthetic oligonucleotide
  Target: FXN; (-) strand; PAM type: NRG; PAM sequence: AAG
caggtggatcacttgagcct

SEQ ID NO: 14832 - DNA, 20 bp, Artificial Sequence
  Description of Artificial Sequence: Synthetic oligonucleotide
  Target: FXN; (-) strand; PAM type: NRG; PAM sequence: GAG
acgaggcaggtggatcactt

SEQ ID NO: 14833 - DNA, 20 bp, Artificial Sequence
  Description of Artificial Sequence: Synthetic oligonucleotide
  Target: FXN; (-) strand; PAM type: NRG; PAM sequence: TGG
tcttgggaggacgaggcagg

SEQ ID NO: 14834 - DNA, 20 bp, Artificial Sequence
  Description of Artificial Sequence: Synthetic oligonucleotide
  Target: FXN; (-) strand; PAM type: NRG; PAM sequence: AGG
gcatcttgggaggacgaggc

SEQ ID NO: 14835 - DNA, 20 bp, Artificial Sequence
  Description of Artificial Sequence: Synthetic oligonucleotide
  Target: FXN; (-) strand; PAM type: NRG; PAM sequence: CAG
agcatcttgggaggacgagg

SEQ ID NO: 14836 - DNA, 20 bp, Artificial Sequence
  Description of Artificial Sequence: Synthetic oligonucleotide
  Target: FXN; (-) strand; PAM type: NRG; PAM sequence: AGG
cccagcatcttgggaggacg

SEQ ID NO: 14837 - DNA, 20 bp, Artificial Sequence
  Description of Artificial Sequence: Synthetic oligonucleotide
  Target: FXN; (-) strand; PAM type: NRG; PAM sequence: GAG
tcccagcatcttgggaggac

SEQ ID NO: 14838 - DNA, 20 bp, Artificial Sequence
  Description of Artificial Sequence: Synthetic oligonucleotide
  Target: FXN; (-) strand; PAM type: NRG; PAM sequence: AGG
tgtaatcccagcatcttggg

SEQ ID NO: 14839 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagcatcttgg

SEQ ID NO: 14840 - DNA, 20 bp, Artificial Sequence
  Description of Artificial Sequence: Synthetic oligonucleotide
  Target: FXN; (-) strand; PAM type: NRG; PAM sequence: GGG
acctgtaatcccagcatctt

SEQ ID NO: 14841 - DNA, 20 bp, Artificial Sequence
  Description of Artificial Sequence: Synthetic oligonucleotide
  Target: FXN; (-) strand; PAM type: NRG; PAM sequence: TGG
cacctgtaatcccagcatct

SEQ ID NO: 14842 - DNA, 20 bp, Artificial Sequence
  Description of Artificial Sequence: Synthetic oligonucleotide
  Target: FXN; (-) strand; PAM type: NRG; PAM sequence: CAG
gtggcacacacctgtaatcc

SEQ ID NO: 14843 - DNA, 20 bp, Artificial Sequence
  Description of Artificial Sequence: Synthetic oligonucleotide
  Target: FXN; (-) strand; PAM type: NRG; PAM sequence: TGG
agctttctgatgaacacctg

SEQ ID NO: 14844 - DNA, 20 bp, Artificial Sequence
  Description of Artificial Sequence: Synthetic oligonucleotide
  Target: FXN; (-) strand; PAM type: NRG; PAM sequence: AAG
gaaggtaaaaataatagaaa

SEQ ID NO: 14845 - DNA, 20 bp, Artificial Sequence
  Description of Artificial Sequence: Synthetic oligonucleotide
  Target: FXN; (-) strand; PAM type: NRG; PAM sequence: TAG
actcaagaaggtaaaaataa

SEQ ID NO: 14846 - DNA, 20 bp, Artificial Sequence
  Description of Artificial Sequence: Synthetic oligonucleotide
  Target: FXN; (-) strand; PAM type: NRG; PAM sequence: AGG
gaggttctacccactcaaga

SEQ ID NO: 14847 - DNA, 20 bp, Artificial Sequence
  Description of Artificial Sequence: Synthetic oligonucleotide
  Target: FXN; (-) strand; PAM type: NRG; PAM sequence: AAG
tgaggttctacccactcaag

SEQ ID NO: 14848 - DNA, 20 bp, Artificial Sequence
  Description of Artificial Sequence: Synthetic oligonucleotide
  Target: FXN; (-) strand; PAM type: NRG; PAM sequence: AAG
ggctgaggttctacccactc

SEQ ID NO: 14849 - DNA, 20 bp, Artificial Sequence
  Description of Artificial Sequence: Synthetic oligonucleotide
  Target: FXN; (-) strand; PAM type: NRG; PAM sequence: AGG
ttttattttctatgtggctg

SEQ ID NO: 14850 - DNA, 20 bp, Artificial Sequence
  Description of Artificial Sequence: Synthetic oligonucleotide
  Target: FXN; (-) strand; PAM type: NRG; PAM sequence: GAG
attttattttctatgtggct

SEQ ID NO: 14851 - DNA, 20 bp, Artificial Sequence
  Description of Artificial Sequence: Synthetic oligonucleotide
  Target: FXN; (-) strand; PAM type: NRG; PAM sequence: TGG
agaacattttattttctatg

SEQ ID NO: 14852 - DNA, 20 bp, Artificial Sequence
  Description of Artificial Sequence: Synthetic oligonucleotide
  Target: FXN; (-) strand; PAM type: NRG; PAM sequence: CAG
gagagctaaataagtcatgc

SEQ ID NO: 14853 - DNA, 20 bp, Artificial Sequence
  Description of Artificial Sequence: Synthetic oligonucleotide
  Target: FXN; (-) strand; PAM type: NRG; PAM sequence: AAG
gtaattccagagagctaaat

SEQ ID NO: 14854 - DNA, 20 bp, Artificial Sequence
  Description of Artificial Sequence: Synthetic oligonucleotide
  Target: FXN; (-) strand; PAM type: NRG; PAM sequence: GAG
tccttctttgtaattccaga

SEQ ID NO: 14855 - DNA, 20 bp, Artificial Sequence
  Description of Artificial Sequence: Synthetic oligonucleotide
  Target: FXN; (-) strand; PAM type: NRG; PAM sequence: GAG
attccttctttgtaattcca

SEQ ID NO: 14856 - DNA, 20 bp, Artificial Sequence
  Description of Artificial Sequence: Synthetic oligonucleotide
  Target: FXN; (-) strand; PAM type: NRG; PAM sequence: CAG
tcattccttctttgtaattc

SEQ ID NO: 14857 - DNA, 20 bp, Artificial Sequence
  Description of Artificial Sequence: Synthetic oligonucleotide
  Target: FXN; (-) strand; PAM type: NRG; PAM sequence: AGG
aatttgtgattcaaaaaccc

SEQ ID NO: 14858 - DNA, 20 bp, Artificial Sequence
  Description of Artificial Sequence: Synthetic oligonucleotide
  Target: FXN; (-) strand; PAM type: NRG; PAM sequence: CAG
aaatttgtgattcaaaaacc

SEQ ID NO: 14859 - DNA, 20 bp, Artificial Sequence
  Description of Artificial Sequence: Synthetic oligonucleotide
  Target: FXN; (-) strand; PAM type: NRG; PAM sequence: GAG
ctacaaacaagtaagaggca

SEQ ID NO: 14860 - DNA, 20 bp, Artificial Sequence
  Description of Artificial Sequence: Synthetic oligonucleotide
  Target: FXN; (-) strand; PAM type: NRG; PAM sequence: CAG
gtctacaaacaagtaagagg

SEQ ID NO: 14861 - DNA, 20 bp, Artificial Sequence
  Description of Artificial Sequence: Synthetic oligonucleotide
  Target: FXN; (-) strand; PAM type: NRG; PAM sequence: AGG
agtgtctacaaacaagtaag

SEQ ID NO: 14862 - DNA, 20 bp, Artificial Sequence
  Description of Artificial Sequence: Synthetic oligonucleotide
  Target: FXN; (-) strand; PAM type: NRG; PAM sequence: GAG
cagtgtctacaaacaagtaa

SEQ ID NO: 14863 - DNA, 20 bp, Artificial Sequence
  Description of Artificial Sequence: Synthetic oligonucleotide
  Target: FXN; (-) strand; PAM type: NRG; PAM sequence: AAG
gtcagtgtctacaaacaagt

SEQ ID NO: 14864 - DNA, 20 bp, Artificial Sequence
  Description of Artificial Sequence: Synthetic oligonucleotide
  Target: FXN; (-) strand; PAM type: NRG; PAM sequence: AAG
cactgtcagtgtctacaaac

SEQ ID NO: 14865 - DNA, 20 bp, Artificial Sequence
  Description of Artificial Sequence: Synthetic oligonucleotide
  Target: FXN; (-) strand; PAM type: NRG; PAM sequence: CAG
aaaaaacatgaggccactgt

SEQ ID NO: 14866 - DNA, 20 bp, Artificial Sequence
  Description of Artificial Sequence: Synthetic oligonucleotide
  Target: FXN; (-) strand; PAM type: NRG; PAM sequence: AGG
ttaaaaaaaaaaaaaacatg

SEQ ID NO: 14867 - DNA, 20 bp, Artificial Sequence
  Description of Artificial Sequence: Synthetic oligonucleotide
  Target: FXN; (-) strand; PAM type: NRG; PAM sequence: GAG
attaaaaaaaaaaaaaacat

SEQ ID NO: 14868 - DNA, 20 bp, Artificial Sequence
  Description of Artificial Sequence: Synthetic oligonucleotide
  Target: FXN; (-) strand; PAM type: NRG; PAM sequence: TAG
tgttagatatctccatttta

SEQ ID NO: 14869 - DNA, 20 bp, Artificial Sequence
  Description of Artificial Sequence: Synthetic oligonucleotide
  Target: FXN; (-) strand; PAM type: NRG; PAM sequence: TAG
tgggcccaggctcaacatgt

SEQ ID NO: 14870 - DNA, 20 bp, Artificial Sequence
  Description of Artificial Sequence: Synthetic oligonucleotide
  Target: FXN; (-) strand; PAM type: NRG; PAM sequence: AGG
tgtgctttgcctgtgggccc

SEQ ID NO: 14871 - DNA, 20 bp, Artificial Sequence
  Description of Artificial Sequence: Synthetic oligonucleotide
  Target: FXN; (-) strand; PAM type: NRG; PAM sequence: CAG
ttgtgctttgcctgtgggcc

SEQ ID NO: 14872 - DNA, 20 bp, Artificial Sequence
  Description of Artificial Sequence: Synthetic oligonucleotide
  Target: FXN; (-) strand; PAM type: NRG; PAM sequence: GGG
caggattgtgctttgcctgt

SEQ ID NO: 14873 - DNA, 20 bp, Artificial Sequence
  Description of Artificial Sequence: Synthetic oligonucleotide
  Target: FXN; (-) strand; PAM type: NRG; PAM sequence: TGG
tcaggattgtgctttgcctg

SEQ ID NO: 14874 - DNA, 20 bp, Artificial Sequence
  Description of Artificial Sequence: Synthetic oligonucleotide
  Target: FXN; (-) strand; PAM type: NRG; PAM sequence: AGG
aactgagtacttctcacatc

SEQ ID NO: 14875 - DNA, 20 bp, Artificial Sequence
  Description of Artificial Sequence: Synthetic oligonucleotide
  Target: FXN; (-) strand; PAM type: NRG; PAM sequence: CAG
gaactgagtacttctcacat

SEQ ID NO: 14876 - DNA, 20 bp, Artificial Sequence
  Description of Artificial Sequence: Synthetic oligonucleotide
  Target: FXN; (-) strand; PAM type: NRG; PAM sequence: GAG
aacaacagttgtcatgaact

SEQ ID NO: 14877 - DNA, 20 bp, Artificial Sequence
  Description of Artificial Sequence: Synthetic oligonucleotide
  Target: FXN; (-) strand; PAM type: NRG; PAM sequence: CAG
tgctatgcatgtgagaacaa

SEQ ID NO: 14878 - DNA, 20 bp, Artificial Sequence
  Description of Artificial Sequence: Synthetic oligonucleotide
  Target: FXN; (-) strand; PAM type: NRG; PAM sequence: GAG
tgaaattatgctatgcatgt

SEQ ID NO: 14879 - DNA, 20 bp, Artificial Sequence
  Description of Artificial Sequence: Synthetic oligonucleotide
  Target: FXN; (-) strand; PAM type: NRG; PAM sequence: AAG
cgtcatccatattttgggag

SEQ ID NO: 14880 - DNA, 20 bp, Artificial Sequence
  Description of Artificial Sequence: Synthetic oligonucleotide
  Target: FXN; (-) strand; PAM type: NRG; PAM sequence: GAG
gaacgtcatccatattttgg

SEQ ID NO: 14881 - DNA, 20 bp, Artificial Sequence
  Description of Artificial Sequence: Synthetic oligonucleotide
  Target: FXN; (-) strand; PAM type: NRG; PAM sequence: GGG
gggaacgtcatccatatttt

SEQ ID NO: 14882 - DNA, 20 bp, Artificial Sequence
  Description of Artificial Sequence: Synthetic oligonucleotide
  Target: FXN; (-) strand; PAM type: NRG; PAM sequence: TGG
agggaacgtcatccatattt

SEQ ID NO: 14883 - DNA, 20 bp, Artificial Sequence
  Description of Artificial Sequence: Synthetic oligonucleotide
  Target: FXN; (-) strand; PAM type: NRG; PAM sequence: GGG
attaagttcaaggttgagta

SEQ ID NO: 14884 - DNA, 20 bp, Artificial Sequence
  Description of Artificial Sequence: Synthetic oligonucleotide
  Target: FXN; (-) strand; PAM type: NRG; PAM sequence: AGG
gattaagttcaaggttgagt

SEQ ID NO: 14885 - DNA, 20 bp, Artificial Sequence
  Description of Artificial Sequence: Synthetic oligonucleotide
  Target: FXN; (-) strand; PAM type: NRG; PAM sequence: TAG
tgattaagttcaaggttgag

SEQ ID NO: 14886 - DNA, 20 bp, Artificial Sequence
  Description of Artificial Sequence: Synthetic oligonucleotide
  Target: FXN; (-) strand; PAM type: NRG; PAM sequence: GAG
ttttgattaagttcaaggtt

SEQ ID NO: 14887 - DNA, 20 bp, Artificial Sequence
  Description of Artificial Sequence: Synthetic oligonucleotide
  Target: FXN; (-) strand; PAM type: NRG; PAM sequence: AGG
gagtattttgattaagttca

SEQ ID NO: 14888 - DNA, 20 bp, Artificial Sequence
  Description of Artificial Sequence: Synthetic oligonucleotide
  Target: FXN; (-) strand; PAM type: NRG; PAM sequence: AAG
tgagtattttgattaagttc

SEQ ID NO: 14889 - DNA, 20 bp, Artificial Sequence
  Description of Artificial Sequence: Synthetic oligonucleotide
  Target: FXN; (-) strand; PAM type: NRG; PAM sequence: AAG
gtaaactgagtattttgatt

SEQ ID NO: 14890 - DNA, 20 bp, Artificial Sequence
  Description of Artificial Sequence: Synthetic oligonucleotide
  Target: FXN; (-) strand; PAM type: NRG; PAM sequence: GAG
aatacgaagttaagtaaact

SEQ ID NO: 14891 - DNA, 20 bp, Artificial Sequence
  Description of Artificial Sequence: Synthetic oligonucleotide
  Target: FXN; (-) strand; PAM type: NRG; PAM sequence: AAG
tcagaatctaatacgaagtt

SEQ ID NO: 14892 - DNA, 20 bp, Artificial Sequence
  Description of Artificial Sequence: Synthetic oligonucleotide
  Target: FXN; (-) strand; PAM type: NRG; PAM sequence: AAG
gggaatcagaatctaatacg

SEQ ID NO: 14893 - DNA, 20 bp, Artificial Sequence
  Description of Artificial Sequence: Synthetic oligonucleotide
  Target: FXN; (-) strand; PAM type: NRG; PAM sequence: CAG
gataaatggttccagggaat

SEQ ID NO: 14894 - DNA, 20 bp, Artificial Sequence
  Description of Artificial Sequence: Synthetic oligonucleotide
  Target: FXN; (-) strand; PAM type: NRG; PAM sequence: GGG
gcacacgataaatggttcca

SEQ ID NO: 14895 - DNA, 20 bp, Artificial Sequence
  Description of Artificial Sequence: Synthetic oligonucleotide
  Target: FXN; (-) strand; PAM type: NRG; PAM sequence: AGG
ggcacacgataaatggttcc

SEQ ID NO: 14896 - DNA, 20 bp, Artificial Sequence
  Description of Artificial Sequence: Synthetic oligonucleotide
  Target: FXN; (-) strand; PAM type: NRG; PAM sequence: CAG
aggcacacgataaatggttc

SEQ ID NO: 14897 - DNA, 20 bp, Artificial Sequence
  Description of Artificial Sequence: Synthetic oligonucleotide
  Target: FXN; (-) strand; PAM type: NRG; PAM sequence: TGG
atggtaaggcacacgataaa

SEQ ID NO: 14898 - DNA, 20 bp, Artificial Sequence
  Description of Artificial Sequence: Synthetic oligonucleotide
  Target: FXN; (-) strand; PAM type: NRG; PAM sequence: AGG
agtaaaatataagcatggta

SEQ ID NO: 14899 - DNA, 20 bp, Artificial Sequence
  Description of Artificial Sequence: Synthetic oligonucleotide
  Target: FXN; (-) strand; PAM type: NRG; PAM sequence: AAG
aagtaaaatataagcatggt

SEQ ID NO: 14900 - DNA, 20 bp, Artificial Sequence
  Description of Artificial Sequence: Synthetic oligonucleotide
  Target: FXN; (-) strand; PAM type: NRG; PAM sequence: TGG
gatcaagtaaaatataagca

SEQ ID NO: 14901 - DNA, 20 bp, Artificial Sequence
  Description of Artificial Sequence: Synthetic oligonucleotide
  Target: FXN; (-) strand; PAM type: NRG; PAM sequence: AAG
caaaagatcaagtaaaatat

SEQ ID NO: 14902 - DNA, 20 bp, Artificial Sequence
  Description of Artificial Sequence: Synthetic oligonucleotide
  Target: FXN; (-) strand; PAM type: NRG; PAM sequence: AAG
tagaaggtatgcaaaagatc

SEQ ID NO: 14903 - DNA, 20 bp, Artificial Sequence
  Description of Artificial Sequence: Synthetic oligonucleotide
  Target: FXN; (-) strand; PAM type: NRG; PAM sequence: AAG
tagttttagaaggtatgcaa

SEQ ID NO: 14904 - DNA, 20 bp, Artificial Sequence
  Description of Artificial Sequence: Synthetic oligonucleotide
  Target: FXN; (-) strand; PAM type: NRG; PAM sequence: AGG
ttggctaaaatagttttaga

SEQ ID NO: 14905 - DNA, 20 bp, Artificial Sequence
  Description of Artificial Sequence: Synthetic oligonucleotide
  Target: FXN; (-) strand; PAM type: NRG; PAM sequence: AAG
attggctaaaatagttttag

SEQ ID NO: 14906 - DNA, 20 bp, Artificial Sequence
  Description of Artificial Sequence: Synthetic oligonucleotide
  Target: FXN; (-) strand; PAM type: NRG; PAM sequence: TAG
taaattggctaaaatagttt

SEQ ID NO: 14907 - DNA, 20 bp, Artificial Sequence
  Description of Artificial Sequence: Synthetic oligonucleotide
  Target: FXN; (-) strand; PAM type: NRG; PAM sequence: TAG
aaattttaaattggctaaaa

SEQ ID NO: 14908 - DNA, 20 bp, Artificial Sequence
  Description of Artificial Sequence: Synthetic oligonucleotide
  Target: FXN; (-) strand; PAM type: NRG; PAM sequence: TGG
caaactgtcaaattttaaat

SEQ ID NO: 14909 - DNA, 20 bp, Artificial Sequence
  Description of Artificial Sequence: Synthetic oligonucleotide
  Target: FXN; (-) strand; PAM type: NRG; PAM sequence: AAG
ggggcaggtatagctggata

SEQ ID NO: 14910 - DNA, 20 bp, Artificial Sequence
  Description of Artificial Sequence: Synthetic oligonucleotide
  Target: FXN; (-) strand; PAM type: NRG; PAM sequence: TGG
gaatttggggcaggtatagc

SEQ ID NO: 14911 - DNA, 20 bp, Artificial Sequence
  Description of Artificial Sequence: Synthetic oligonucleotide
  Target: FXN; (-) strand; PAM type: NRG; PAM sequence: TAG
gtcagaatttggggcaggta

SEQ ID NO: 14912 - DNA, 20 bp, Artificial Sequence
  Description of Artificial Sequence: Synthetic oligonucleotide
  Target: FXN; (-) strand; PAM type: NRG; PAM sequence: AGG
catctgtcagaatttggggc

SEQ ID NO: 14913 - DNA, 20 bp, Artificial Sequence
  Description of Artificial Sequence: Synthetic oligonucleotide
  Target: FXN; (-) strand; PAM type: NRG; PAM sequence: CAG
gcatctgtcagaatttgggg

SEQ ID NO: 14914 - DNA, 20 bp, Artificial Sequence
  Description of Artificial Sequence: Synthetic oligonucleotide
  Target: FXN; (-) strand; PAM type: NRG; PAM sequence: GGG
aaagcatctgtcagaatttg

SEQ ID NO: 14915 - DNA, 20 bp, Artificial Sequence
  Description of Artificial Sequence: Synthetic oligonucleotide
  Target: FXN; (-) strand; PAM type: NRG; PAM sequence: GGG
aaaagcatctgtcagaattt

SEQ ID NO: 14916 - DNA, 20 bp, Artificial Sequence
  Description of Artificial Sequence: Synthetic oligonucleotide
  Target: FXN; (-) strand; PAM type: NRG; PAM sequence: TGG
caaaagcatctgtcagaatt

SEQ ID NO: 14917 - DNA, 20 bp, Artificial Sequence
  Description of Artificial Sequence: Synthetic oligonucleotide
  Target: FXN; (-) strand; PAM type: NRG; PAM sequence: CAG
gaggtggcaaaagcatctgt

SEQ ID NO: 14918 - DNA, 20 bp, Artificial Sequence
  Description of Artificial Sequence: Synthetic oligonucleotide
  Target: FXN; (-) strand; PAM type: NRG; PAM sequence: AAG
tcttcctttagaggtggcaa

SEQ ID NO: 14919 - DNA, 20 bp, Artificial Sequence
  Description of Artificial Sequence: Synthetic oligonucleotide
  Target: FXN; (-) strand; PAM type: NRG; PAM sequence: TGG
catgggtcttcctttagagg

SEQ ID NO: 14920 - DNA, 20 bp, Artificial Sequence
  Description of Artificial Sequence: Synthetic oligonucleotide
  Target: FXN; (-) strand; PAM type: NRG; PAM sequence: AGG
gaacatgggtcttcctttag

SEQ ID NO: 14921 - DNA, 20 bp, Artificial Sequence
  Description of Artificial Sequence: Synthetic oligonucleotide
  Target: FXN; (-) strand; PAM type: NRG; PAM sequence: GAG
tgaacatgggtcttccttta

SEQ ID NO: 14922 - DNA, 20 bp, Artificial Sequence
  Description of Artificial Sequence: Synthetic oligonucleotide
  Target: FXN; (-) strand; PAM type: NRG; PAM sequence: TAG
tatgaacatgggtcttcctt

SEQ ID NO: 14923 - DNA, 20 bp, Artificial Sequence
  Description of Artificial Sequence: Synthetic oligonucleotide
  Target: FXN; (-) strand; PAM type: NRG; PAM sequence: GGG
aactccatcactatgaacat

SEQ ID NO: 14924 - DNA, 20 bp, Artificial Sequence
  Description of Artificial Sequence: Synthetic oligonucleotide
  Target: FXN; (-) strand; PAM type: NRG; PAM sequence: TGG
aaactccatcactatgaaca

SEQ ID NO: 14925 - DNA, 20 bp, Artificial Sequence
  Description of Artificial Sequence: Synthetic oligonucleotide
  Target: FXN; (-) strand; PAM type: NRG; PAM sequence: TAG
ccttggcaaccttgcatggt

SEQ ID NO: 14926 - DNA, 20 bp, Artificial Sequence
  Description of Artificial Sequence: Synthetic oligonucleotide
  Target: FXN; (-) strand; PAM type: NRG; PAM sequence: TGG
ttttccttggcaaccttgca

SEQ ID NO: 14927 - DNA, 20 bp, Artificial Sequence
  Description of Artificial Sequence: Synthetic oligonucleotide
  Target: FXN; (-) strand; PAM type: NRG; PAM sequence: TGG
agcgtaaagcgatttttcct

SEQ ID NO: 14928 - DNA, 20 bp, Artificial Sequence
  Description of Artificial Sequence: Synthetic oligonucleotide
  Target: FXN; (-) strand; PAM type: NRG; PAM sequence: AAG
gtgtgtaccttggaagcgta

SEQ ID NO: 14929 - DNA, 20 bp, Artificial Sequence
  Description of Artificial Sequence: Synthetic oligonucleotide
  Target: FXN; (-) strand; PAM type: NRG; PAM sequence: AAG
catcttagtgtgtaccttgg

SEQ ID NO: 14930 - DNA, 20 bp, Artificial Sequence
  Description of Artificial Sequence: Synthetic oligonucleotide
  Target: FXN; (-) strand; PAM type: NRG; PAM sequence: TGG
tttcatcttagtgtgtacct

SEQ ID NO: 14931 - DNA, 20 bp, Artificial Sequence
  Description of Artificial Sequence: Synthetic oligonucleotide
  Target: FXN; (-) strand; PAM type: NRG; PAM sequence: TAG
gactaaaattactttcatct

SEQ ID NO: 14932 - DNA, 20 bp, Artificial Sequence
  Description of Artificial Sequence: Synthetic oligonucleotide
  Target: FXN; (-) strand; PAM type: NRG; PAM sequence: CGG
gccaagaatccaactggaca

SEQ ID NO: 14933 - DNA, 20 bp, Artificial Sequence
  Description of Artificial Sequence: Synthetic oligonucleotide
  Target: FXN; (-) strand; PAM type: NRG; PAM sequence: TGG
ctatgtgccaagaatccaac

SEQ ID NO: 14934 - DNA, 20 bp, Artificial Sequence
  Description of Artificial Sequence: Synthetic oligonucleotide
  Target: FXN; (-) strand; PAM type: NRG; PAM sequence: AAG
gcagaagataactatgtgcc

SEQ ID NO: 14935 - DNA, 20 bp, Artificial Sequence
  Description of Artificial Sequence: Synthetic oligonucleotide
  Target: FXN; (-) strand; PAM type: NRG; PAM sequence: AAG
gttttagtttgttctagcag

SEQ ID NO: 14936 - DNA, 20 bp, Artificial Sequence
  Description of Artificial Sequence: Synthetic oligonucleotide
  Target: FXN; (-) strand; PAM type: NRG; PAM sequence: CAG
gctgttttagtttgttctag

SEQ ID NO: 14937 - DNA, 20 bp, Artificial Sequence
  Description of Artificial Sequence: Synthetic oligonucleotide
  Target: FXN; (-) strand; PAM type: NRG; PAM sequence: TAG
gtagctgttttagtttgttc

SEQ ID NO: 14938 - DNA, 20 bp, Artificial Sequence
  Description of Artificial Sequence: Synthetic oligonucleotide
  Target: FXN; (-) strand; PAM type: NRG; PAM sequence: TAG
ttgctggcatgtagctgttt

SEQ ID NO: 14939 - DNA, 20 bp, Artificial Sequence
  Description of Artificial Sequence: Synthetic oligonucleotide
  Target: FXN; (-) strand; PAM type: NRG; PAM sequence: TAG
ctttctcccttgctggcatg

SEQ ID NO: 14940 - DNA, 20 bp, Artificial Sequence
  Description of Artificial Sequence: Synthetic oligonucleotide
  Target: FXN; (-) strand; PAM type: NRG; PAM sequence: TGG
ccttcccctttctcccttgc

SEQ ID NO: 14941 - DNA, 20 bp, Artificial Sequence
  Description of Artificial Sequence: Synthetic oligonucleotide
  Target: FXN; (-) strand; PAM type: NRG; PAM sequence: CAG
catgaactcgtcgttttgaa

SEQ ID NO: 14942 - DNA, 20 bp, Artificial Sequence
  Description of Artificial Sequence: Synthetic oligonucleotide
  Target: FXN; (-) strand; PAM type: NRG; PAM sequence: AAG
catttcttactctatacaca

SEQ ID NO: 14943 - DNA, 20 bp, Artificial Sequence
  Description of Artificial Sequence: Synthetic oligonucleotide
  Target: FXN; (-) strand; PAM type: NRG; PAM sequence: AGG
actctgtctcaaaaaagaaa

SEQ ID NO: 14944 - DNA, 20 bp, Artificial Sequence
  Description of Artificial Sequence: Synthetic oligonucleotide
  Target: FXN; (-) strand; PAM type: NRG; PAM sequence: AAG
gactctgtctcaaaaaagaa

SEQ ID NO: 14945 - DNA, 20 bp, Artificial Sequence
  Description of Artificial Sequence: Synthetic oligonucleotide
  Target: FXN; (-) strand; PAM type: NRG; PAM sequence: AAG
agcaagactctgtctcaaaa

SEQ ID NO: 14946 - DNA, 20 bp, Artificial Sequence
  Description of Artificial Sequence: Synthetic oligonucleotide
  Target: FXN; (-) strand; PAM type: NRG; PAM sequence: AAG
tccagcctgggtgacagagc

SEQ ID NO: 14947 - DNA, 20 bp, Artificial Sequence
  Description of Artificial Sequence: Synthetic oligonucleotide
  Target: FXN; (-) strand; PAM type: NRG; PAM sequence: GAG
gcactccagcctgggtgaca

SEQ ID NO: 14948 - DNA, 20 bp, Artificial Sequence
  Description of Artificial Sequence: Synthetic oligonucleotide
  Target: FXN; (-) strand; PAM type: NRG; PAM sequence: CAG
ctgcactccagcctgggtga

SEQ ID NO: 14949 - DNA, 20 bp, Artificial Sequence
  Description of Artificial Sequence: Synthetic oligonucleotide
  Target: FXN; (-) strand; PAM type: NRG; PAM sequence: GGG
gtgccactgcactccagcct

SEQ ID NO: 14950 - DNA, 20 bp, Artificial Sequence
  Description of Artificial Sequence: Synthetic oligonucleotide
  Target: FXN; (-) strand; PAM type: NRG; PAM sequence: TGG
cgtgccactgcactccagcc

SEQ ID NO: 14951 - DNA, 20 bp, Artificial Sequence
  Description of Artificial Sequence: Synthetic oligonucleotide
  Target: FXN; (-) strand; PAM type: NRG; PAM sequence: CAG
cagatcgtgccactgcactc

SEQ ID NO: 14952 - DNA, 20 bp, Artificial Sequence
  Description of Artificial Sequence: Synthetic oligonucleotide
  Target: FXN; (-) strand; PAM type: NRG; PAM sequence: CAG
ggcggaggttgtagtgagcc

SEQ ID NO: 14953 - DNA, 20 bp, Artificial Sequence
  Description of Artificial Sequence: Synthetic oligonucleotide
  Target: FXN; (-) strand; PAM type: NRG; PAM sequence: GAG
caggaggcggaggttgtagt

SEQ ID NO: 14954 - DNA, 20 bp, Artificial Sequence
  Description of Artificial Sequence: Synthetic oligonucleotide
  Target: FXN; (-) strand; PAM type: NRG; PAM sequence: TAG
aacccaggaggcggaggttg

SEQ ID NO: 14955 - DNA, 20 bp, Artificial Sequence
  Description of Artificial Sequence: Synthetic oligonucleotide
  Target: FXN; (-) strand; PAM type: NRG; PAM sequence: AGG
tgcttgaacccaggaggcgg

SEQ ID NO: 14956 - DNA, 20 bp, Artificial Sequence
  Description of Artificial Sequence: Synthetic oligonucleotide
  Target: FXN; (-) strand; PAM type: NRG; PAM sequence: GAG
ttgcttgaacccaggaggcg

SEQ ID NO: 14957 - DNA, 20 bp, Artificial Sequence
  Description of Artificial Sequence: Synthetic oligonucleotide
  Target: FXN; (-) strand; PAM type: NRG; PAM sequence: CGG
aattgcttgaacccaggagg

SEQ ID NO: 14958 - DNA, 20 bp, Artificial Sequence
  Description of Artificial Sequence: Synthetic oligonucleotide
  Target: FXN; (-) strand; PAM type: NRG; PAM sequence: AGG
gagaattgcttgaacccagg

SEQ ID NO: 14959 - DNA, 20 bp, Artificial Sequence
  Description of Artificial Sequence: Synthetic oligonucleotide
  Target: FXN; (-) strand; PAM type: NRG; PAM sequence: GAG
agagaattgcttgaacccag

SEQ ID NO: 14960 - DNA, 20 bp, Artificial Sequence
  Description of Artificial Sequence: Synthetic oligonucleotide
  Target: FXN; (-) strand; PAM type: NRG; PAM sequence: AGG
gcagagaattgcttgaaccc

SEQ ID NO: 14961 - DNA, 20 bp, Artificial Sequence
  Description of Artificial Sequence: Synthetic oligonucleotide
  Target: FXN; (-) strand; PAM type: NRG; PAM sequence: CAG
ggcagagaattgcttgaacc

SEQ ID NO: 14962 - DNA, 20 bp, Artificial Sequence
  Description of Artificial Sequence: Synthetic oligonucleotide
  Target: FXN; (-) strand; PAM type: NRG; PAM sequence: GAG
ctactcgggaggctgaggca

SEQ ID NO: 14963 - DNA, 20 bp, Artificial Sequence
  Description of Artificial Sequence: Synthetic oligonucleotide
  Target: FXN; (-) strand; PAM type: NRG; PAM sequence: CAG
agctactcgggaggctgagg

SEQ ID NO: 14964 - DNA, 20 bp, Artificial Sequence
  Description of Artificial Sequence: Synthetic oligonucleotide
  Target: FXN; (-) strand; PAM type: NRG; PAM sequence: AGG
cccagctactcgggaggctg

SEQ ID NO: 14965 - DNA, 20 bp, Artificial Sequence
  Description of Artificial Sequence: Synthetic oligonucleotide
  Target: FXN; (-) strand; PAM type: NRG; PAM sequence: GAG
tcccagctactcgggaggct

SEQ ID NO: 14966 - DNA, 20 bp, Artificial Sequence
  Description of Artificial Sequence: Synthetic oligonucleotide
  Target: FXN; (-) strand; PAM type: NRG; PAM sequence: AGG
tgtaatcccagctactcggg

SEQ ID NO: 14967 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagctactcgg

SEQ ID NO: 14968 - DNA, 20 bp, Artificial Sequence
  Description of Artificial Sequence: Synthetic oligonucleotide
  Target: FXN; (-) strand; PAM type: NRG; PAM sequence: GGG
acctgtaatcccagctactc

SEQ ID NO: 14969 - DNA, 20 bp, Artificial Sequence
  Description of Artificial Sequence: Synthetic oligonucleotide
  Target: FXN; (-) strand; PAM type: NRG; PAM sequence: CGG
cacctgtaatcccagctact

SEQ ID NO: 14970 - DNA, 20 bp, Artificial Sequence
  Description of Artificial Sequence: Synthetic oligonucleotide
  Target: FXN; (-) strand; PAM type: NRG; PAM sequence: CAG
gtggcaggcacctgtaatcc

SEQ ID NO: 14971 - DNA, 20 bp, Artificial Sequence
  Description of Artificial Sequence: Synthetic oligonucleotide
  Target: FXN; (-) strand; PAM type: NRG; PAM sequence: AGG
aattagccgggtgtggtggc

SEQ ID NO: 14972 - DNA, 20 bp, Artificial Sequence
  Description of Artificial Sequence: Synthetic oligonucleotide
  Target: FXN; (-) strand; PAM type: NRG; PAM sequence: CAG
aaattagccgggtgtggtgg

SEQ ID NO: 14973 - DNA, 20 bp, Artificial Sequence
  Description of Artificial Sequence: Synthetic oligonucleotide
  Target: FXN; (-) strand; PAM type: NRG; PAM sequence: TGG
caaaaattagccgggtgtgg

SEQ ID NO: 14974 - DNA, 20 bp, Artificial Sequence
  Description of Artificial Sequence: Synthetic oligonucleotide
  Target: FXN; (-) strand; PAM type: NRG; PAM sequence: TGG
atacaaaaattagccgggtg

SEQ ID NO: 14975 - DNA, 20 bp, Artificial Sequence
  Description of Artificial Sequence: Synthetic oligonucleotide
  Target: FXN; (-) strand; PAM type: NRG; PAM sequence: GGG
taaaaatacaaaaattagcc

SEQ ID NO: 14976 - DNA, 20 bp, Artificial Sequence
  Description of Artificial Sequence: Synthetic oligonucleotide
  Target: FXN; (-) strand; PAM type: NRG; PAM sequence: CGG
ctaaaaatacaaaaattagc

SEQ ID NO: 14977 - DNA, 20 bp, Artificial Sequence
  Description of Artificial Sequence: Synthetic oligonucleotide
  Target: FXN; (-) strand; PAM type: NRG; PAM sequence: TAG
tctactaaaaatacaaaaat

SEQ ID NO: 14978 - DNA, 20 bp, Artificial Sequence
  Description of Artificial Sequence: Synthetic oligonucleotide
  Target: FXN; (-) strand; PAM type: NRG; PAM sequence: TGG
caagaccagcctggccatga

SEQ ID NO: 14979 - DNA, 20 bp, Artificial Sequence
  Description of Artificial Sequence: Synthetic oligonucleotide
  Target: FXN; (-) strand; PAM type: NRG; PAM sequence: TGG
tcaggagttcaagaccagcc

SEQ ID NO: 14980 - DNA, 20 bp, Artificial Sequence
  Description of Artificial Sequence: Synthetic oligonucleotide
  Target: FXN; (-) strand; PAM type: NRG; PAM sequence: CAG
ctaggtcaggagttcaagac

SEQ ID NO: 14981 - DNA, 20 bp, Artificial Sequence
  Description of Artificial Sequence: Synthetic oligonucleotide
  Target: FXN; (-) strand; PAM type: NRG; PAM sequence: AAG
gattactaggtcaggagttc

SEQ ID NO: 14982 - DNA, 20 bp, Artificial Sequence
  Description of Artificial Sequence: Synthetic oligonucleotide
  Target: FXN; (-) strand; PAM type: NRG; PAM sequence: GAG
caggtggattactaggtcag

SEQ ID NO: 14983 - DNA, 20 bp, Artificial Sequence
  Description of Artificial Sequence: Synthetic oligonucleotide
  Target: FXN; (-) strand; PAM type: NRG; PAM sequence: AGG
ggcaggtggattactaggtc

SEQ ID NO: 14984 - DNA, 20 bp, Artificial Sequence
  Description of Artificial Sequence: Synthetic oligonucleotide
  Target: FXN; (-) strand; PAM type: NRG; PAM sequence: CAG
aggcaggtggattactaggt

SEQ ID NO: 14985 - DNA, 20 bp, Artificial Sequence
  Description of Artificial Sequence: Synthetic oligonucleotide
  Target: FXN; (-) strand; PAM type: NRG; PAM sequence: AGG
gcggaggcaggtggattact

SEQ ID NO: 14986 - DNA, 20 bp, Artificial Sequence
  Description of Artificial Sequence: Synthetic oligonucleotide
  Target: FXN; (-) strand; PAM type: NRG; PAM sequence: TAG
ggcggaggcaggtggattac

SEQ ID NO: 14987 - DNA, 20 bp, Artificial Sequence
  Description of Artificial Sequence: Synthetic oligonucleotide
  Target: FXN; (-) strand; PAM type: NRG; PAM sequence: TGG
ctttgggaggcggaggcagg

SEQ ID NO: 14988 - DNA, 20 bp, Artificial Sequence
  Description of Artificial Sequence: Synthetic oligonucleotide
  Target: FXN; (-) strand; PAM type: NRG; PAM sequence: AGG
gcactttgggaggcggaggc

SEQ ID NO: 14989 - DNA, 20 bp, Artificial Sequence
  Description of Artificial Sequence: Synthetic oligonucleotide
  Target: FXN; (-) strand; PAM type: NRG; PAM sequence: CAG
agcactttgggaggcggagg

SEQ ID NO: 14990 - DNA, 20 bp, Artificial Sequence
  Description of Artificial Sequence: Synthetic oligonucleotide
  Target: FXN; (-) strand; PAM type: NRG; PAM sequence: AGG
cccagcactttgggaggcgg

SEQ ID NO: 14991 - DNA, 20 bp, Artificial Sequence
  Description of Artificial Sequence: Synthetic oligonucleotide
  Target: FXN; (-) strand; PAM type: NRG; PAM sequence: GAG
tcccagcactttgggaggcg

SEQ ID NO: 14992 - DNA, 20 bp, Artificial Sequence
  Description of Artificial Sequence: Synthetic oligonucleotide
  Target: FXN; (-) strand; PAM type: NRG; PAM sequence: CGG
aatcccagcactttgggagg

SEQ ID NO: 14993 - DNA, 20 bp, Artificial Sequence
  Description of Artificial Sequence: Synthetic oligonucleotide
  Target: FXN; (-) strand; PAM type: NRG; PAM sequence: AGG
tgtaatcccagcactttggg

SEQ ID NO: 14994 - DNA, 20 bp, Artificial Sequence
  Description of Artificial Sequence: Synthetic oligonucleotide
  Target: FXN; (-) strand; PAM type: NRG; PAM sequence: GAG
ctgtaatcccagcactttgg

SEQ ID NO: 14995 - DNA, 20 bp, Artificial Sequence
  Description of Artificial Sequence: Synthetic oligonucleotide
  Target: FXN; (-) strand; PAM type: NRG; PAM sequence: GGG
gcctgtaatcccagcacttt

SEQ ID NO: 14996 - DNA, 20 bp, Artificial Sequence
  Description of Artificial Sequence: Synthetic oligonucleotide
  Target: FXN; (-) strand; PAM type: NRG; PAM sequence: TGG
cgcctgtaatcccagcactt

SEQ ID NO: 14997 - DNA, 20 bp, Artificial Sequence
  Description of Artificial Sequence: Synthetic oligonucleotide
  Target: FXN; (-) strand; PAM type: NRG; PAM sequence: CAG
gtggctcacgcctgtaatcc

SEQ ID NO: 14998 - DNA, 20 bp, Artificial Sequence
  Description of Artificial Sequence: Synthetic oligonucleotide
  Target: FXN; (-) strand; PAM type: NRG; PAM sequence: TGG
gcatttctggctgggtgcag

SEQ ID NO: 14999 - DNA, 20 bp, Artificial Sequence
  Description of Artificial Sequence: Synthetic oligonucleotide
  Target: FXN; (-) strand; PAM type: NRG; PAM sequence: CAG
aaggcatttctggctgggtg

SEQ ID NO: 15000 - DNA, 20 bp, Artificial Sequence
  Description of Artificial Sequence: Synthetic oligonucleotide
  Target: FXN; (-) strand; PAM type: NRG; PAM sequence: GGG
attagaaggcatttctggct

SEQ ID NO: 15001 - DNA, 20 bp, Artificial Sequence
  Description of Artificial Sequence: Synthetic oligonucleotide
  Target: FXN; (-) strand; PAM type: NRG; PAM sequence: TGG
gattagaaggcatttctggc

SEQ ID NO: 15002 - DNA, 20 bp, Artificial Sequence
  Description of Artificial Sequence: Synthetic oligonucleotide
  Target: FXN; (-) strand; PAM type: NRG; PAM sequence: TGG
caaagattagaaggcatttc

SEQ ID NO: 15003 - DNA, 20 bp, Artificial Sequence
  Description of Artificial Sequence: Synthetic oligonucleotide
  Target: FXN; (-) strand; PAM type: NRG; PAM sequence: AGG
aagataaaccaaagattaga

SEQ ID NO: 15004 - DNA, 20 bp, Artificial Sequence
  Description of Artificial Sequence: Synthetic oligonucleotide
  Target: FXN; (-) strand; PAM type: NRG; PAM sequence: AAG
taagataaaccaaagattag

SEQ ID NO: 15005 - DNA, 20 bp, Artificial Sequence
  Description of Artificial Sequence: Synthetic oligonucleotide
  Target: FXN; (-) strand; PAM type: NRG; PAM sequence: TAG
aattaagataaaccaaagat

SEQ ID NO: 15006 - DNA, 20 bp, Artificial Sequence
  Description of Artificial Sequence: Synthetic oligonucleotide
  Target: FXN; (-) strand; PAM type: NRG; PAM sequence: AAG
tggctaattaagataaacca

SEQ ID NO: 15007 - DNA, 20 bp, Artificial Sequence
  Description of Artificial Sequence: Synthetic oligonucleotide
  Target: FXN; (-) strand; PAM type: NRG; PAM sequence: AAG
tccaagtgtcctggctaatt

SEQ ID NO: 15008 - DNA, 20 bp, Artificial Sequence
  Description of Artificial Sequence: Synthetic oligonucleotide
  Target: FXN; (-) strand; PAM type: NRG; PAM sequence: TGG
gggatgcactccaagtgtcc

SEQ ID NO: 15009 - DNA, 20 bp, Artificial Sequence
  Description of Artificial Sequence: Synthetic oligonucleotide
  Target: FXN; (-) strand; PAM type: NRG; PAM sequence: AAG
ggtacttcgggatgcactcc

SEQ ID NO: 15010 - DNA, 20 bp, Artificial Sequence
  Description of Artificial Sequence: Synthetic oligonucleotide
  Target: FXN; (-) strand; PAM type: NRG; PAM sequence: GGG
ggccactgatcaggtacttc

SEQ ID NO: 15011 - DNA, 20 bp, Artificial Sequence
  Description of Artificial Sequence: Synthetic oligonucleotide
  Target: FXN; (-) strand; PAM type: NRG; PAM sequence: CGG
gggccactgatcaggtactt

SEQ ID NO: 15012 - DNA, 20 bp, Artificial Sequence
  Description of Artificial Sequence: Synthetic oligonucleotide
  Target: FXN; (-) strand; PAM type: NRG; PAM sequence: AGG
ttccaaaggggccactgatc

SEQ ID NO: 15013 - DNA, 20 bp, Artificial Sequence
  Description of Artificial Sequence: Synthetic oligonucleotide
  Target: FXN; (-) strand; PAM type: NRG; PAM sequence: CAG
attccaaaggggccactgat

SEQ ID NO: 15014 - DNA, 20 bp, Artificial Sequence
  Description of Artificial Sequence: Synthetic oligonucleotide
  Target: FXN; (-) strand; PAM type: NRG; PAM sequence: GGG
gagttttacacattccaaag

SEQ ID NO: 15015 - DNA, 20 bp, Artificial Sequence
  Description of Artificial Sequence: Synthetic oligonucleotide
  Target: FXN; (-) strand; PAM type: NRG; PAM sequence: GGG
tgagttttacacattccaaa

SEQ ID NO: 15016 - DNA, 20 bp, Artificial Sequence
  Description of Artificial Sequence: Synthetic oligonucleotide
  Target: FXN; (-) strand; PAM type: NRG; PAM sequence: AGG
ctgagttttacacattccaa

SEQ ID NO: 15017 - DNA, 20 bp, Artificial Sequence
  Description of Artificial Sequence: Synthetic oligonucleotide
  Target: FXN; (-) strand; PAM type: NRG; PAM sequence: AAG
gctgagttttacacattcca

SEQ ID NO: 15018 - DNA, 20 bp, Artificial Sequence
  Description of Artificial Sequence: Synthetic oligonucleotide
  Target: FXN; (-) strand; PAM type: NRG; PAM sequence: GAG
tgcagggatataagtgagct

SEQ ID NO: 15019 - DNA, 20 bp, Artificial Sequence
  Description of Artificial Sequence: Synthetic oligonucleotide
  Target: FXN; (-) strand; PAM type: NRG; PAM sequence: GAG
gcggatgcagggatataagt

SEQ ID NO: 15020 - DNA, 20 bp, Artificial Sequence
  Description of Artificial Sequence: Synthetic oligonucleotide
  Target: FXN; (-) strand; PAM type: NRG; PAM sequence: AAG
tgtagcggatgcagggatat

SEQ ID NO: 15021 - DNA, 20 bp, Artificial Sequence
  Description of Artificial Sequence: Synthetic oligonucleotide
  Target: FXN; (-) strand; PAM type: NRG; PAM sequence: GGG
ctgtctctgtagcggatgca

SEQ ID NO: 15022 - DNA, 20 bp, Artificial Sequence
  Description of Artificial Sequence: Synthetic oligonucleotide
  Target: FXN; (-) strand; PAM type: NRG; PAM sequence: AGG
tctgtctctgtagcggatgc

SEQ ID NO: 15023 - DNA, 20 bp, Artificial Sequence
  Description of Artificial Sequence: Synthetic oligonucleotide
  Target: FXN; (-) strand; PAM type: NRG; PAM sequence: CAG
ttctgtctctgtagcggatg

SEQ ID NO: 15024 - DNA, 20 bp, Artificial Sequence
  Description of Artificial Sequence: Synthetic oligonucleotide
  Target: FXN; (-) strand; PAM type: NRG; PAM sequence: CGG
cttggattctgtctctgtag

SEQ ID NO: 15025 - DNA, 20 bp, Artificial Sequence
  Description of Artificial Sequence: Synthetic oligonucleotide
  Target: FXN; (-) strand; PAM type: NRG; PAM sequence: TAG
gagcttggattctgtctctg

SEQ ID NO: 15026 - DNA, 20 bp, Artificial Sequence
  Description of Artificial Sequence: Synthetic oligonucleotide
  Target: FXN; (-) strand; PAM type: NRG; PAM sequence: TGG
gaagatggaacatatgagct

SEQ ID NO: 15027 - DNA, 20 bp, Artificial Sequence
  Description of Artificial Sequence: Synthetic oligonucleotide
  Target: FXN; (-) strand; PAM type: NRG; PAM sequence: GAG
ccagagaagatggaacatat

SEQ ID NO: 15028 - DNA, 20 bp, Artificial Sequence
  Description of Artificial Sequence: Synthetic oligonucleotide
  Target: FXN; (-) strand; PAM type: NRG; PAM sequence: TGG
aactatacagccagagaaga

SEQ ID NO: 15029 - DNA, 20 bp, Artificial Sequence
  Description of Artificial Sequence: Synthetic oligonucleotide
  Target: FXN; (-) strand; PAM type: NRG; PAM sequence: AAG
cttaaactatacagccagag

SEQ ID NO: 15030 - DNA, 20 bp, Artificial Sequence
  Description of Artificial Sequence: Synthetic oligonucleotide
  Target: FXN; (-) strand; PAM type: NRG; PAM sequence: GAG
ttccttaaactatacagcca

SEQ ID NO: 15031 - DNA, 20 bp, Artificial Sequence
  Description of Artificial Sequence: Synthetic oligonucleotide
  Target: FXN; (-) strand; PAM type: NRG; PAM sequence: CAG
cattccttaaactatacagc

SEQ ID NO: 15032 - DNA, 20 bp, Artificial Sequence
  Description of Artificial Sequence: Synthetic oligonucleotide
  Target: FXN; (-) strand; PAM type: NRG; PAM sequence: CAG
cttccattccttaaactata

SEQ ID NO: 15033 - DNA, 20 bp, Artificial Sequence
  Description of Artificial Sequence: Synthetic oligonucleotide
  Target: FXN; (-) strand; PAM type: NRG; PAM sequence: TGG
acatttcaataaatctgttc

SEQ ID NO: 15034 - DNA, 20 bp, Artificial Sequence
  Description of Artificial Sequence: Synthetic oligonucleotide
  Target: FXN; (-) strand; PAM type: NRG; PAM sequence: CAG
caactgtctaaataaatctt

SEQ ID NO: 15035 - DNA, 20 bp, Artificial Sequence
  Description of Artificial Sequence: Synthetic oligonucleotide
  Target: FXN; (-) strand; PAM type: NRG; PAM sequence: GGG
tgagagccaattttactgct

SEQ ID NO: 15036 - DNA, 20 bp, Artificial Sequence
  Description of Artificial Sequence: Synthetic oligonucleotide
  Target: FXN; (-) strand; PAM type: NRG; PAM sequence: TGG
ttgagagccaattttactgc

SEQ ID NO: 15037 - DNA, 20 bp, Artificial Sequence
  Description of Artificial Sequence: Synthetic oligonucleotide
  Target: FXN; (-) strand; PAM type: NRG; PAM sequence: GAG
caggagaagaaaatctttga

SEQ ID NO: 15038 - DNA, 20 bp, Artificial Sequence
  Description of Artificial Sequence: Synthetic oligonucleotide
  Target: FXN; (-) strand; PAM type: NRG; PAM sequence: GAG
cacaggagaagaaaatcttt

SEQ ID NO: 15039 - DNA, 20 bp, Artificial Sequence
  Description of Artificial Sequence: Synthetic oligonucleotide
  Target: FXN; (-) strand; PAM type: NRG; PAM sequence: AAG
ggtctgactttccacaggag

SEQ ID NO: 15040 - DNA, 20 bp, Artificial Sequence
  Description of Artificial Sequence: Synthetic oligonucleotide
  Target: FXN; (-) strand; PAM type: NRG; PAM sequence: GAG
agaggtctgactttccacag

SEQ ID NO: 15041 - DNA, 20 bp, Artificial Sequence
  Description of Artificial Sequence: Synthetic oligonucleotide
  Target: FXN; (-) strand; PAM type: NRG; PAM sequence: AGG
tcagaggtctgactttccac

SEQ ID NO: 15042 - DNA, 20 bp, Artificial Sequence
  Description of Artificial Sequence: Synthetic oligonucleotide
  Target: FXN; (-) strand; PAM type: NRG; PAM sequence: CAG
ctcagaggtctgactttcca

SEQ ID NO: 15043 - DNA, 20 bp, Artificial Sequence
  Description of Artificial Sequence: Synthetic oligonucleotide
  Target: FXN; (-) strand; PAM type: NRG; PAM sequence: AGG
ctacctggatggggcctcag

SEQ ID NO: 15044 - DNA, 20 bp, Artificial Sequence
  Description of Artificial Sequence: Synthetic oligonucleotide
  Target: FXN; (-) strand; PAM type: NRG; PAM sequence: GAG
tctacctggatggggcctca

SEQ ID NO: 15045 - DNA, 20 bp, Artificial Sequence
  Description of Artificial Sequence: Synthetic oligonucleotide
  Target: FXN; (-) strand; PAM type: NRG; PAM sequence: CAG
cttctacctggatggggcct

SEQ ID NO: 15046 - DNA, 20 bp, Artificial Sequence
  Description of Artificial Sequence: Synthetic oligonucleotide
  Target: FXN; (-) strand; PAM type: NRG; PAM sequence: GGG
ctagtacttctacctggatg

SEQ ID NO: 15047 - DNA, 20 bp, Artificial Sequence
  Description of Artificial Sequence: Synthetic oligonucleotide
  Target: FXN; (-) strand; PAM type: NRG; PAM sequence: GGG
actagtacttctacctggat

SEQ ID NO: 15048 - DNA, 20 bp, Artificial Sequence
  Description of Artificial Sequence: Synthetic oligonucleotide
  Target: FXN; (-) strand; PAM type: NRG; PAM sequence: TGG
cactagtacttctacctgga

SEQ ID NO: 15049 - DNA, 20 bp, Artificial Sequence
  Description of Artificial Sequence: Synthetic oligonucleotide
  Target: FXN; (-) strand; PAM type: NRG; PAM sequence: TGG
cttgcactagtacttctacc

SEQ ID NO: 15050 - DNA, 20 bp, Artificial Sequence
  Description of Artificial Sequence: Synthetic oligonucleotide
  Target: FXN; (-) strand; PAM type: NRG; PAM sequence: TAG
agcagaggcccttcttgcac

SEQ ID NO: 15051 - DNA, 20 bp, Artificial Sequence
  Description of Artificial Sequence: Synthetic oligonucleotide
  Target: FXN; (-) strand; PAM type: NRG; PAM sequence: AGG
gaaacacaagtggacagcag

SEQ ID NO: 15052 - DNA, 20 bp, Artificial Sequence
  Description of Artificial Sequence: Synthetic oligonucleotide
  Target: FXN; (-) strand; PAM type: NRG; PAM sequence: GAG
agaaacacaagtggacagca

SEQ ID NO: 15053 - DNA, 20 bp, Artificial Sequence
  Description of Artificial Sequence: Synthetic oligonucleotide
  Target: FXN; (-) strand; PAM type: NRG; PAM sequence: CAG
acagaaacacaagtggacag

SEQ ID NO: 15054 - DNA, 20 bp, Artificial Sequence
  Description of Artificial Sequence: Synthetic oligonucleotide
  Target: FXN; (-) strand; PAM type: NRG; PAM sequence: CAG
atcacagaaacacaagtgga

SEQ ID NO: 15055 - DNA, 20 bp, Artificial Sequence
  Description of Artificial Sequence: Synthetic oligonucleotide
  Target: FXN; (-) strand; PAM type: NRG; PAM sequence: TGG
acagatcacagaaacacaag

SEQ ID NO: 15056 - DNA, 20 bp, Artificial Sequence
  Description of Artificial Sequence: Synthetic oligonucleotide
  Target: FXN; (-) strand; PAM type: NRG; PAM sequence: AAG
cccacagatcacagaaacac

SEQ ID NO: 15057 - DNA, 20 bp, Artificial Sequence
  Description of Artificial Sequence: Synthetic oligonucleotide
  Target: FXN; (-) strand; PAM type: NRG; PAM sequence: CAG
aacaatgttcccacagatca

SEQ ID NO: 15058 - DNA, 20 bp, Artificial Sequence
  Description of Artificial Sequence: Synthetic oligonucleotide
  Target: FXN; (-) strand; PAM type: NRG; PAM sequence: CAG
tggcgttaacaatgttccca

SEQ ID NO: 15059 - DNA, 20 bp, Artificial Sequence
  Description of Artificial Sequence: Synthetic oligonucleotide
  Target: FXN; (-) strand; PAM type: NRG; PAM sequence: TGG
aacaatttgaggtcaagatg

SEQ ID NO: 15060 - DNA, 20 bp, Artificial Sequence
  Description of Artificial Sequence: Synthetic oligonucleotide
  Target: FXN; (-) strand; PAM type: NRG; PAM sequence: AAG
gagctaaacaatttgaggtc

SEQ ID NO: 15061 - DNA, 20 bp, Artificial Sequence
  Description of Artificial Sequence: Synthetic oligonucleotide
  Target: FXN; (-) strand; PAM type: NRG; PAM sequence: AGG
gccaggagctaaacaatttg

SEQ ID NO: 15062 - DNA, 20 bp, Artificial Sequence
  Description of Artificial Sequence: Synthetic oligonucleotide
  Target: FXN; (-) strand; PAM type: NRG; PAM sequence: GAG
ggccaggagctaaacaattt

SEQ ID NO: 15063 - DNA, 20 bp, Artificial Sequence
  Description of Artificial Sequence: Synthetic oligonucleotide
  Target: FXN; (-) strand; PAM type: NRG; PAM sequence: GAG
gagccaccgtgtctggccag

SEQ ID NO: 15064 - DNA, 20 bp, Artificial Sequence
  Description of Artificial Sequence: Synthetic oligonucleotide
  Target: FXN; (-) strand; PAM type: NRG; PAM sequence: AGG
gtgagccaccgtgtctggcc

SEQ ID NO: 15065 - DNA, 20 bp, Artificial Sequence
  Description of Artificial Sequence: Synthetic oligonucleotide
  Target: FXN; (-) strand; PAM type: NRG; PAM sequence: CAG
tgtgagccaccgtgtctggc

SEQ ID NO: 15066 - DNA, 20 bp, Artificial Sequence
  Description of Artificial Sequence: Synthetic oligonucleotide
  Target: FXN; (-) strand; PAM type: NRG; PAM sequence: TGG
caggtgtgagccaccgtgtc

SEQ ID NO: 15067 - DNA, 20 bp, Artificial Sequence
  Description of Artificial Sequence: Synthetic oligonucleotide
  Target: FXN; (-) strand; PAM type: NRG; PAM sequence: GAG
agtgctgggattacaggtgt

SEQ ID NO: 15068 - DNA, 20 bp, Artificial Sequence
  Description of Artificial Sequence: Synthetic oligonucleotide
  Target: FXN; (-) strand; PAM type: NRG; PAM sequence: AGG
tctcaaagtgctgggattac

SEQ ID NO: 15069 - DNA, 20 bp, Artificial Sequence
  Description of Artificial Sequence: Synthetic oligonucleotide
  Target: FXN; (-) strand; PAM type: NRG; PAM sequence: CAG
ctctcaaagtgctgggatta

SEQ ID NO: 15070 - DNA, 20 bp, Artificial Sequence
  Description of Artificial Sequence: Synthetic oligonucleotide
  Target: FXN; (-) strand; PAM type: NRG; PAM sequence: GGG
cctcagcctctcaaagtgct

SEQ ID NO: 15071 - DNA, 20 bp, Artificial Sequence
  Description of Artificial Sequence: Synthetic oligonucleotide
  Target: FXN; (-) strand; PAM type: NRG; PAM sequence: TGG
gcctcagcctctcaaagtgc

SEQ ID NO: 15072 - DNA, 20 bp, Artificial Sequence
  Description of Artificial Sequence: Synthetic oligonucleotide
  Target: FXN; (-) strand; PAM type: NRG; PAM sequence: AAG
ccacctgcctcagcctctca

SEQ ID NO: 15073 - DNA, 20 bp, Artificial Sequence
  Description of Artificial Sequence: Synthetic oligonucleotide
  Target: FXN; (-) strand; PAM type: NRG; PAM sequence: CAG
ctcaggtgatccacctgcct

SEQ ID NO: 15074 - DNA, 20 bp, Artificial Sequence
  Description of Artificial Sequence: Synthetic oligonucleotide
  Target: FXN; (-) strand; PAM type: NRG; PAM sequence: AGG
ggcctcgaactcctaacctc

SEQ ID NO: 15075 - DNA, 20 bp, Artificial Sequence
  Description of Artificial Sequence: Synthetic oligonucleotide
  Target: FXN; (-) strand; PAM type: NRG; PAM sequence: CAG
tggcctcgaactcctaacct

SEQ ID NO: 15076 - DNA, 20 bp, Artificial Sequence
  Description of Artificial Sequence: Synthetic oligonucleotide
  Target: FXN; (-) strand; PAM type: NRG; PAM sequence: TGG
ttttaccatgttgaccaggc

SEQ ID NO: 15077 - DNA, 20 bp, Artificial Sequence
  Description of Artificial Sequence: Synthetic oligonucleotide
  Target: FXN; (-) strand; PAM type: NRG; PAM sequence: AGG
ggggttttaccatgttgacc

SEQ ID NO: 15078 - DNA, 20 bp, Artificial Sequence
  Description of Artificial Sequence: Synthetic oligonucleotide
  Target: FXN; (-) strand; PAM type: NRG; PAM sequence: CAG
cggggttttaccatgttgac

SEQ ID NO: 15079 - DNA, 20 bp, Artificial Sequence
  Description of Artificial Sequence: Synthetic oligonucleotide
  Target: FXN; (-) strand; PAM type: NRG; PAM sequence: GGG
ttgtatttttagtagaggcg

SEQ ID NO: 15080 - DNA, 20 bp, Artificial Sequence
  Description of Artificial Sequence: Synthetic oligonucleotide
  Target: FXN; (-) strand; PAM type: NRG; PAM sequence: GGG
tttgtatttttagtagaggc

SEQ ID NO: 15081 - DNA, 20 bp, Artificial Sequence
  Description of Artificial Sequence: Synthetic oligonucleotide
  Target: FXN; (-) strand; PAM type: NRG; PAM sequence: CGG
ttttgtatttttagtagagg

SEQ ID NO: 15082 - DNA, 20 bp, Artificial Sequence
  Description of Artificial Sequence: Synthetic oligonucleotide
  Target: FXN; (-) strand; PAM type: NRG; PAM sequence: AGG
aatttttgtatttttagtag

SEQ ID NO: 15083 - DNA, 20 bp, Artificial Sequence
  Description of Artificial Sequence: Synthetic oligonucleotide
  Target: FXN; (-) strand; PAM type: NRG; PAM sequence: GAG
taatttttgtatttttagta

SEQ ID NO: 15084 - DNA, 20 bp, Artificial Sequence
  Description of Artificial Sequence: Synthetic oligonucleotide
  Target: FXN; (-) strand; PAM type: NRG; PAM sequence: TAG
gctaatttttgtatttttag

SEQ ID NO: 15085 - DNA, 20 bp, Artificial Sequence
  Description of Artificial Sequence: Synthetic oligonucleotide
  Target: FXN; (-) strand; PAM type: NRG; PAM sequence: TAG
ccagctaatttttgtatttt

SEQ ID NO: 15086 - DNA, 20 bp, Artificial Sequence
  Description of Artificial Sequence: Synthetic oligonucleotide
  Target: FXN; (-) strand; PAM type: NRG; PAM sequence: CAG
caggcgtgcgccactacggc

SEQ ID NO: 15087 - DNA, 20 bp, Artificial Sequence
  Description of Artificial Sequence: Synthetic oligonucleotide
  Target: FXN; (-) strand; PAM type: NRG; PAM sequence: CGG
ataacaggcgtgcgccacta

SEQ ID NO: 15088 - DNA, 20 bp, Artificial Sequence
  Description of Artificial Sequence: Synthetic oligonucleotide
  Target: FXN; (-) strand; PAM type: NRG; PAM sequence: AGG
tcccgagtagctgggataac

SEQ ID NO: 15089 - DNA, 20 bp, Artificial Sequence
  Description of Artificial Sequence: Synthetic oligonucleotide
  Target: FXN; (-) strand; PAM type: NRG; PAM sequence: CAG
ctcccgagtagctgggataa

SEQ ID NO: 15090 - DNA, 20 bp, Artificial Sequence
  Description of Artificial Sequence: Synthetic oligonucleotide
  Target: FXN; (-) strand; PAM type: NRG; PAM sequence: GGG
cctcagcctcccgagtagct

SEQ ID NO: 15091 - DNA, 20 bp, Artificial Sequence
  Description of Artificial Sequence: Synthetic oligonucleotide
  Target: FXN; (-) strand; PAM type: NRG; PAM sequence: TGG
gcctcagcctcccgagtagc

SEQ ID NO: 15092 - DNA, 20 bp, Artificial Sequence
  Description of Artificial Sequence: Synthetic oligonucleotide
  Target: FXN; (-) strand; PAM type: NRG; PAM sequence: TAG
tcctgcctcagcctcccgag

SEQ ID NO: 15093 - DNA, 20 bp, Artificial Sequence
  Description of Artificial Sequence: Synthetic oligonucleotide
  Target: FXN; (-) strand; PAM type: NRG; PAM sequence: GAG
ttctcctgcctcagcctccc

SEQ ID NO: 15094 - DNA, 20 bp, Artificial Sequence
  Description of Artificial Sequence: Synthetic oligonucleotide
  Target: FXN; (-) strand; PAM type: NRG; PAM sequence: CAG
ttcaagcaattctcctgcct

SEQ ID NO: 15095 - DNA, 20 bp, Artificial Sequence
  Description of Artificial Sequence: Synthetic oligonucleotide
  Target: FXN; (-) strand; PAM type: NRG; PAM sequence: AAG
aacctccaccacccaggttc

SEQ ID NO: 15096 - DNA, 20 bp, Artificial Sequence
  Description of Artificial Sequence: Synthetic oligonucleotide
  Target: FXN; (-) strand; PAM type: NRG; PAM sequence: AGG
cactgcaacctccaccaccc

SEQ ID NO: 15097 - DNA, 20 bp, Artificial Sequence
  Description of Artificial Sequence: Synthetic oligonucleotide
  Target: FXN; (-) strand; PAM type: NRG; PAM sequence: CAG
tcactgcaacctccaccacc

SEQ ID NO: 15098 - DNA, 20 bp, Artificial Sequence
  Description of Artificial Sequence: Synthetic oligonucleotide
  Target: FXN; (-) strand; PAM type: NRG; PAM sequence: CGG
ggagtgcagtggtgtaatct

SEQ ID NO: 15099 - DNA, 20 bp, Artificial Sequence
  Description of Artificial Sequence: Synthetic oligonucleotide
  Target: FXN; (-) strand; PAM type: NRG; PAM sequence: TGG
tcacccaggctggagtgcag

SEQ ID NO: 15100 - DNA, 20 bp, Artificial Sequence
  Description of Artificial Sequence: Synthetic oligonucleotide
  Target: FXN; (-) strand; PAM type: NRG; PAM sequence: CAG
ttgtcacccaggctggagtg

SEQ ID NO: 15101 - DNA, 20 bp, Artificial Sequence
  Description of Artificial Sequence: Synthetic oligonucleotide
  Target: FXN; (-) strand; PAM type: NRG; PAM sequence: GAG
ccctcttgtcacccaggctg

SEQ ID NO: 15102 - DNA, 20 bp, Artificial Sequence
  Description of Artificial Sequence: Synthetic oligonucleotide
  Target: FXN; (-) strand; PAM type: NRG; PAM sequence: TGG
ttccctcttgtcacccaggc

SEQ ID NO: 15103 - DNA, 20 bp, Artificial Sequence
  Description of Artificial Sequence: Synthetic oligonucleotide
  Target: FXN; (-) strand; PAM type: NRG; PAM sequence: AGG
gagtttccctcttgtcaccc

SEQ ID NO: 15104 - DNA, 20 bp, Artificial Sequence
  Description of Artificial Sequence: Synthetic oligonucleotide
  Target: FXN; (-) strand; PAM type: NRG; PAM sequence: CAG
ggagtttccctcttgtcacc

SEQ ID NO: 15105 - DNA, 20 bp, Artificial Sequence
  Description of Artificial Sequence: Synthetic oligonucleotide
  Target: FXN; (-) strand; PAM type: NRG; PAM sequence: GAG
ggaattacatttttttaatg

SEQ ID NO: 15106 - DNA, 20 bp, Artificial Sequence
  Description of Artificial Sequence: Synthetic oligonucleotide
  Target: FXN; (-) strand; PAM type: NRG; PAM sequence: TGG
cgggaattacatttttttaa

SEQ ID NO: 15107 - DNA, 20 bp, Artificial Sequence
  Description of Artificial Sequence: Synthetic oligonucleotide
  Target: FXN; (-) strand; PAM type: NRG; PAM sequence: GGG
acacttaagatggcagacac

SEQ ID NO: 15108 - DNA, 20 bp, Artificial Sequence
  Description of Artificial Sequence: Synthetic oligonucleotide
  Target: FXN; (-) strand; PAM type: NRG; PAM sequence: CGG
tacacttaagatggcagaca

SEQ ID NO: 15109 - DNA, 20 bp, Artificial Sequence
  Description of Artificial Sequence: Synthetic oligonucleotide
  Target: FXN; (-) strand; PAM type: NRG; PAM sequence: CAG
cacctttacacttaagatgg

SEQ ID NO: 15110 - DNA, 20 bp, Artificial Sequence
  Description of Artificial Sequence: Synthetic oligonucleotide
  Target: FXN; (-) strand; PAM type: NRG; PAM sequence: TGG
agccacctttacacttaaga

SEQ ID NO: 15111 - DNA, 20 bp, Artificial Sequence
  Description of Artificial Sequence: Synthetic oligonucleotide
  Target: FXN; (-) strand; PAM type: NRG; PAM sequence: AAG
atttagccacctttacactt

SEQ ID NO: 15112 - DNA, 20 bp, Artificial Sequence
  Description of Artificial Sequence: Synthetic oligonucleotide
  Target: FXN; (-) strand; PAM type: NRG; PAM sequence: TAG
tcttatttttctatataatt

SEQ ID NO: 15113 - DNA, 20 bp, Artificial Sequence
  Description of Artificial Sequence: Synthetic oligonucleotide
  Target: FXN; (-) strand; PAM type: NRG; PAM sequence: GGG
ggtaggaaaggaatgtaatt

SEQ ID NO: 15114 - DNA, 20 bp, Artificial Sequence
  Description of Artificial Sequence: Synthetic oligonucleotide
  Target: FXN; (-) strand; PAM type: NRG; PAM sequence: TGG
cggtaggaaaggaatgtaat

SEQ ID NO: 15115 - DNA, 20 bp, Artificial Sequence
  Description of Artificial Sequence: Synthetic oligonucleotide
  Target: FXN; (-) strand; PAM type: NRG; PAM sequence: AGG
atcatagagtgcggtaggaa

SEQ ID NO: 15116 - DNA, 20 bp, Artificial Sequence
  Description of Artificial Sequence: Synthetic oligonucleotide
  Target: FXN; (-) strand; PAM type: NRG; PAM sequence: AAG
catcatagagtgcggtagga

SEQ ID NO: 15117 - DNA, 20 bp, Artificial Sequence
  Description of Artificial Sequence: Synthetic oligonucleotide
  Target: FXN; (-) strand; PAM type: NRG; PAM sequence: AGG
ctagcatcatagagtgcggt

SEQ ID NO: 15118 - DNA, 20 bp, Artificial Sequence
  Description of Artificial Sequence: Synthetic oligonucleotide
  Target: FXN; (-) strand; PAM type: NRG; PAM sequence: TAG
gctagcatcatagagtgcgg

SEQ ID NO: 15119 - DNA, 20 bp, Artificial Sequence
  Description of Artificial Sequence: Synthetic oligonucleotide
  Target: FXN; (-) strand; PAM type: NRG; PAM sequence: CGG
tcagctagcatcatagagtg

SEQ ID NO: 15120 - DNA, 20 bp, Artificial Sequence
  Description of Artificial Sequence: Synthetic oligonucleotide
  Target: FXN; (-) strand; PAM type: NRG; PAM sequence: GAG
aaatctcagctagcatcata

SEQ ID NO: 15121 - DNA, 20 bp, Artificial Sequence
  Description of Artificial Sequence: Synthetic oligonucleotide
  Target: FXN; (-) strand; PAM type: NRG; PAM sequence: TAG
aaaaatctcagctagcatca

SEQ ID NO: 15122 - DNA, 20 bp, Artificial Sequence
  Description of Artificial Sequence: Synthetic oligonucleotide
  Target: FXN; (-) strand; PAM type: NRG; PAM sequence: TAG
tcttttggaaaaatctcagc

SEQ ID NO: 15123 - DNA, 20 bp, Artificial Sequence
  Description of Artificial Sequence: Synthetic oligonucleotide
  Target: FXN; (-) strand; PAM type: NRG; PAM sequence: CAG
attttcttttggaaaaatct

SEQ ID NO: 15124 - DNA, 20 bp, Artificial Sequence
  Description of Artificial Sequence: Synthetic oligonucleotide
  Target: FXN; (-) strand; PAM type: NRG; PAM sequence: TGG
ttatttaagccattttcttt

SEQ ID NO: 15125 - DNA, 20 bp, Artificial Sequence
  Description of Artificial Sequence: Synthetic oligonucleotide
  Target: FXN; (-) strand; PAM type: NRG; PAM sequence: AAG
tttctcttagggttttattt

SEQ ID NO: 15126 - DNA, 20 bp, Artificial Sequence
  Description of Artificial Sequence: Synthetic oligonucleotide
  Target: FXN; (-) strand; PAM type: NRG; PAM sequence: GGG
taaagtttttctttctctta

SEQ ID NO: 15127 - DNA, 20 bp, Artificial Sequence
  Description of Artificial Sequence: Synthetic oligonucleotide
  Target: FXN; (-) strand; PAM type: NRG; PAM sequence: AGG
ttaaagtttttctttctctt

SEQ ID NO: 15128 - DNA, 20 bp, Artificial Sequence
  Description of Artificial Sequence: Synthetic oligonucleotide
  Target: FXN; (-) strand; PAM type: NRG; PAM sequence: TAG
tttaaagtttttctttctct

SEQ ID NO: 15129 - DNA, 20 bp, Artificial Sequence
  Description of Artificial Sequence: Synthetic oligonucleotide
  Target: FXN; (-) strand; PAM type: NRG; PAM sequence: AAG
ttgagctttggagggattta

SEQ ID NO: 15130 - DNA, 20 bp, Artificial Sequence
  Description of Artificial Sequence: Synthetic oligonucleotide
  Target: FXN; (-) strand; PAM type: NRG; PAM sequence: GGG
tattacttttgagctttgga

SEQ ID NO: 15131 - DNA, 20 bp, Artificial Sequence
  Description of Artificial Sequence: Synthetic oligonucleotide
  Target: FXN; (-) strand; PAM type: NRG; PAM sequence: AGG
ctattacttttgagctttgg

SEQ ID NO: 15132 - DNA, 20 bp, Artificial Sequence
  Description of Artificial Sequence: Synthetic oligonucleotide
  Target: FXN; (-) strand; PAM type: NRG; PAM sequence: GAG
tctattacttttgagctttg

SEQ ID NO: 15133 - DNA, 20 bp, Artificial Sequence
  Description of Artificial Sequence: Synthetic oligonucleotide
  Target: FXN; (-) strand; PAM type: NRG; PAM sequence: TGG
tttctattacttttgagctt

SEQ ID NO: 15134 - DNA, 20 bp, Artificial Sequence
  Description of Artificial Sequence: Synthetic oligonucleotide
  Target: FXN; (-) strand; PAM type: NRG; PAM sequence: GAG
catctgtttctattactttt

SEQ ID NO: 15135 - DNA, 20 bp, Artificial Sequence
  Description of Artificial Sequence: Synthetic oligonucleotide
  Target: FXN; (-) strand; PAM type: NRG; PAM sequence: GAG
acagcctaggcaatcttaca

SEQ ID NO: 15136 - DNA, 20 bp, Artificial Sequence
  Description of Artificial Sequence: Synthetic oligonucleotide
  Target: FXN; (-) strand; PAM type: NRG; PAM sequence: CAG
acacagcctaggcaatctta

SEQ ID NO: 15137 - DNA, 20 bp, Artificial Sequence
  Description of Artificial Sequence: Synthetic oligonucleotide
  Target: FXN; (-) strand; PAM type: NRG; PAM sequence: AGG
agatgtgcagtacacagcct

SEQ ID NO: 15138 - DNA, 20 bp, Artificial Sequence
  Description of Artificial Sequence: Synthetic oligonucleotide
  Target: FXN; (-) strand; PAM type: NRG; PAM sequence: TAG
gagatgtgcagtacacagcc

SEQ ID NO: 15139 - DNA, 20 bp, Artificial Sequence
  Description of Artificial Sequence: Synthetic oligonucleotide
  Target: FXN; (-) strand; PAM type: NRG; PAM sequence: CAG
acctggagatgtgcagtaca

SEQ ID NO: 15140 - DNA, 20 bp, Artificial Sequence
  Description of Artificial Sequence: Synthetic oligonucleotide
  Target: FXN; (-) strand; PAM type: NRG; PAM sequence: CAG
cagtggcacctggagatgtg

SEQ ID NO: 15141 - DNA, 20 bp, Artificial Sequence
  Description of Artificial Sequence: Synthetic oligonucleotide
  Target: FXN; (-) strand; PAM type: NRG; PAM sequence: GAG
tctgtcaacagtggcacctg

SEQ ID NO: 15142 - DNA, 20 bp, Artificial Sequence
  Description of Artificial Sequence: Synthetic oligonucleotide
  Target: FXN; (-) strand; PAM type: NRG; PAM sequence: TGG
tctctgtcaacagtggcacc

SEQ ID NO: 15143 - DNA, 20 bp, Artificial Sequence
  Description of Artificial Sequence: Synthetic oligonucleotide
  Target: FXN; (-) strand; PAM type: NRG; PAM sequence: TGG
gttataatctctgtcaacag

SEQ ID NO: 15144 - DNA, 20 bp, Artificial Sequence
  Description of Artificial Sequence: Synthetic oligonucleotide
  Target: FXN; (-) strand; PAM type: NRG; PAM sequence: CAG
gtagttataatctctgtcaa

SEQ ID NO: 15145 - DNA, 20 bp, Artificial Sequence
  Description of Artificial Sequence: Synthetic oligonucleotide
  Target: FXN; (-) strand; PAM type: NRG; PAM sequence: TAG
gcaccattcacttcacattg

SEQ ID NO: 15146 - DNA, 20 bp, Artificial Sequence
  Description of Artificial Sequence: Synthetic oligonucleotide
  Target: FXN; (-) strand; PAM type: NRG; PAM sequence: TGG
acggtttgcataactgtcag

SEQ ID NO: 15147 - DNA, 20 bp, Artificial Sequence
  Description of Artificial Sequence: Synthetic oligonucleotide
  Target: FXN; (-) strand; PAM type: NRG; PAM sequence: CAG
tggacggtttgcataactgt

SEQ ID NO: 15148 - DNA, 20 bp, Artificial Sequence
  Description of Artificial Sequence: Synthetic oligonucleotide
  Target: FXN; (-) strand; PAM type: NRG; PAM sequence: CGG
tcaggtggctatgctctgga

SEQ ID NO: 15149 - DNA, 20 bp, Artificial Sequence
  Description of Artificial Sequence: Synthetic oligonucleotide
  Target: FXN; (-) strand; PAM type: NRG; PAM sequence: TGG
aggatcaggtggctatgctc

SEQ ID NO: 15150 - DNA, 20 bp, Artificial Sequence
  Description of Artificial Sequence: Synthetic oligonucleotide
  Target: FXN; (-) strand; PAM type: NRG; PAM sequence: TGG
ggaatcccagcaggatcagg

SEQ ID NO: 15151 - DNA, 20 bp, Artificial Sequence
  Description of Artificial Sequence: Synthetic oligonucleotide
  Target: FXN; (-) strand; PAM type: NRG; PAM sequence: AGG
agaggaatcccagcaggatc

SEQ ID NO: 15152 - DNA, 20 bp, Artificial Sequence
  Description of Artificial Sequence: Synthetic oligonucleotide
  Target: FXN; (-) strand; PAM type: NRG; PAM sequence: CAG
aagaggaatcccagcaggat

SEQ ID NO: 15153 - DNA, 20 bp, Artificial Sequence
  Description of Artificial Sequence: Synthetic oligonucleotide
  Target: FXN; (-) strand; PAM type: NRG; PAM sequence: AGG
ctggcaagaggaatcccagc

SEQ ID NO: 15154 - DNA, 20 bp, Artificial Sequence
  Description of Artificial Sequence: Synthetic oligonucleotide
  Target: FXN; (-) strand; PAM type: NRG; PAM sequence: CAG
actggcaagaggaatcccag

SEQ ID NO: 15155 - DNA, 20 bp, Artificial Sequence
  Description of Artificial Sequence: Synthetic oligonucleotide
  Target: FXN; (-) strand; PAM type: NRG; PAM sequence: CAG
tggactggcaagaggaatcc

SEQ ID NO: 15156 - DNA, 20 bp, Artificial Sequence
  Description of Artificial Sequence: Synthetic oligonucleotide
  Target: FXN; (-) strand; PAM type: NRG; PAM sequence: AGG
actgctgatggactggcaag

SEQ ID NO: 15157 - DNA, 20 bp, Artificial Sequence
  Description of Artificial Sequence: Synthetic oligonucleotide
  Target: FXN; (-) strand; PAM type: NRG; PAM sequence: GAG
aactgctgatggactggcaa

SEQ ID NO: 15158 - DNA, 20 bp, Artificial Sequence
  Description of Artificial Sequence: Synthetic oligonucleotide
  Target: FXN; (-) strand; PAM type: NRG; PAM sequence: AAG
ggaactgctgatggactggc

SEQ ID NO: 15159 - DNA, 20 bp, Artificial Sequence
  Description of Artificial Sequence: Synthetic oligonucleotide
  Target: FXN; (-) strand; PAM type: NRG; PAM sequence: TGG
aaggggaactgctgatggac

SEQ ID NO: 15160 - DNA, 20 bp, Artificial Sequence
  Description of Artificial Sequence: Synthetic oligonucleotide
  Target: FXN; (-) strand; PAM type: NRG; PAM sequence: TGG
ctttcaaggggaactgctga

SEQ ID NO: 15161 - DNA, 20 bp, Artificial Sequence
  Description of Artificial Sequence: Synthetic oligonucleotide
  Target: FXN; (-) strand; PAM type: NRG; PAM sequence: GGG
tgtttggtgaaactttcaag

SEQ ID NO: 15162 - DNA, 20 bp, Artificial Sequence
  Description of Artificial Sequence: Synthetic oligonucleotide
  Target: FXN; (-) strand; PAM type: NRG; PAM sequence: GGG
atgtttggtgaaactttcaa

SEQ ID NO: 15163 - DNA, 20 bp, Artificial Sequence
  Description of Artificial Sequence: Synthetic oligonucleotide
  Target: FXN; (-) strand; PAM type: NRG; PAM sequence: AGG
gatgtttggtgaaactttca

SEQ ID NO: 15164 - DNA, 20 bp, Artificial Sequence
  Description of Artificial Sequence: Synthetic oligonucleotide
  Target: FXN; (-) strand; PAM type: NRG; PAM sequence: AAG
ggatgtttggtgaaactttc

SEQ ID NO: 15165 - DNA, 20 bp, Artificial Sequence
  Description of Artificial Sequence: Synthetic oligonucleotide
  Target: FXN; (-) strand; PAM type: NRG; PAM sequence: TGG
gggcagatttaagggatgtt

SEQ ID NO: 15166 - DNA, 20 bp, Artificial Sequence
  Description of Artificial Sequence: Synthetic oligonucleotide
  Target: FXN; (-) strand; PAM type: NRG; PAM sequence: GGG
gcaggagagggcagatttaa

SEQ ID NO: 15167 - DNA, 20 bp, Artificial Sequence
  Description of Artificial Sequence: Synthetic oligonucleotide
  Target: FXN; (-) strand; PAM type: NRG; PAM sequence: AGG
ggcaggagagggcagattta

SEQ ID NO: 15168 - DNA, 20 bp, Artificial Sequence
  Description of Artificial Sequence: Synthetic oligonucleotide
  Target: FXN; (-) strand; PAM type: NRG; PAM sequence: AAG
gggcaggagagggcagattt

SEQ ID NO: 15169 - DNA, 20 bp, Artificial Sequence
  Description of Artificial Sequence: Synthetic oligonucleotide
  Target: FXN; (-) strand; PAM type: NRG; PAM sequence: CAG
tggggacgggcaggagaggg

SEQ ID NO: 15170 - DNA, 20 bp, Artificial Sequence
  Description of Artificial Sequence: Synthetic oligonucleotide
  Target: FXN; (-) strand; PAM type: NRG; PAM sequence: GGG
cactggggacgggcaggaga

SEQ ID NO: 15171 - DNA, 20 bp, Artificial Sequence
  Description of Artificial Sequence: Synthetic oligonucleotide
  Target: FXN; (-) strand; PAM type: NRG; PAM sequence: AGG
ccactggggacgggcaggag

SEQ ID NO: 15172 - DNA, 20 bp, Artificial Sequence
  Description of Artificial Sequence: Synthetic oligonucleotide
  Target: FXN; (-) strand; PAM type: NRG; PAM sequence: GAG
tccactggggacgggcagga

SEQ ID NO: 15173 - DNA, 20 bp, Artificial Sequence
  Description of Artificial Sequence: Synthetic oligonucleotide
  Target: FXN; (-) strand; PAM type: NRG; PAM sequence: GAG
cctccactggggacgggcag

SEQ ID NO: 15174 - DNA, 20 bp, Artificial Sequence
  Description of Artificial Sequence: Synthetic oligonucleotide
  Target: FXN; (-) strand; PAM type: NRG; PAM sequence: AGG
gacctccactggggacgggc

SEQ ID NO: 15175 - DNA, 20 bp, Artificial Sequence
  Description of Artificial Sequence: Synthetic oligonucleotide
  Target: FXN; (-) strand; PAM type: NRG; PAM sequence: CAG
ggacctccactggggacggg

SEQ ID NO: 15176 - DNA, 20 bp, Artificial Sequence
  Description of Artificial Sequence: Synthetic oligonucleotide
  Target: FXN; (-) strand; PAM type: NRG; PAM sequence: GGG
tgaggacctccactggggac

SEQ ID NO: 15177 - DNA, 20 bp, Artificial Sequence
  Description of Artificial Sequence: Synthetic oligonucleotide
  Target: FXN; (-) strand; PAM type: NRG; PAM sequence: CGG
atgaggacctccactgggga

SEQ ID NO: 15178 - DNA, 20 bp, Artificial Sequence
  Description of Artificial Sequence: Synthetic oligonucleotide
  Target: FXN; (-) strand; PAM type: NRG; PAM sequence: GGG
aatgatgaggacctccactg

SEQ ID NO: 15179 - DNA, 20 bp, Artificial Sequence
  Description of Artificial Sequence: Synthetic oligonucleotide
  Target: FXN; (-) strand; PAM type: NRG; PAM sequence: GGG
aaatgatgaggacctccact

SEQ ID NO: 15180 - DNA, 20 bp, Artificial Sequence
  Description of Artificial Sequence: Synthetic oligonucleotide
  Target: FXN; (-) strand; PAM type: NRG; PAM sequence: TGG
aaaatgatgaggacctccac

SEQ ID NO: 15181 - DNA, 20 bp, Artificial Sequence
  Description of Artificial Sequence: Synthetic oligonucleotide
  Target: FXN; (-) strand; PAM type: NRG; PAM sequence: AGG
aatgcaggtgaaaaatgatg

SEQ ID NO: 15182 - DNA, 20 bp, Artificial Sequence
  Description of Artificial Sequence: Synthetic oligonucleotide
  Target: FXN; (-) strand; PAM type: NRG; PAM sequence: GAG
aaatgcaggtgaaaaatgat

SEQ ID NO: 15183 - DNA, 20 bp, Artificial Sequence
  Description of Artificial Sequence: Synthetic oligonucleotide
  Target: FXN; (-) strand; PAM type: NRG; PAM sequence: AGG
gaaagctcctgcaaaaatgc

SEQ ID NO: 15184 - DNA, 20 bp, Artificial Sequence
  Description of Artificial Sequence: Synthetic oligonucleotide
  Target: FXN; (-) strand; PAM type: NRG; PAM sequence: CAG
agaaagctcctgcaaaaatg

SEQ ID NO: 15185 - DNA, 20 bp, Artificial Sequence
  Description of Artificial Sequence: Synthetic oligonucleotide
  Target: FXN; (-) strand; PAM type: NRG; PAM sequence: AAG
ggaggaaggtggatataaga

SEQ ID NO: 15186 - DNA, 20 bp, Artificial Sequence
  Description of Artificial Sequence: Synthetic oligonucleotide
  Target: FXN; (-) strand; PAM type: NRG; PAM sequence: AAG
aaaaggaggaaggtggatat

SEQ ID NO: 15187 - DNA, 20 bp, Artificial Sequence
  Description of Artificial Sequence: Synthetic oligonucleotide
  Target: FXN; (-) strand; PAM type: NRG; PAM sequence: TGG
ctgagagaaaaggaggaagg

SEQ ID NO: 15188 - DNA, 20 bp, Artificial Sequence
  Description of Artificial Sequence: Synthetic oligonucleotide
  Target: FXN; (-) strand; PAM type: NRG; PAM sequence: AGG
gggctgagagaaaaggagga

SEQ ID NO: 15189 - DNA, 20 bp, Artificial Sequence
  Description of Artificial Sequence: Synthetic oligonucleotide
  Target: FXN; (-) strand; PAM type: NRG; PAM sequence: AAG
tgggctgagagaaaaggagg

SEQ ID NO: 15190 - DNA, 20 bp, Artificial Sequence
  Description of Artificial Sequence: Synthetic oligonucleotide
  Target: FXN; (-) strand; PAM type: NRG; PAM sequence: AGG
tgatgggctgagagaaaagg

SEQ ID NO: 15191 - DNA, 20 bp, Artificial Sequence
  Description of Artificial Sequence: Synthetic oligonucleotide
  Target: FXN; (-) strand; PAM type: NRG; PAM sequence: GAG
atgatgggctgagagaaaag

SEQ ID NO: 15192 - DNA, 20 bp, Artificial Sequence
  Description of Artificial Sequence: Synthetic oligonucleotide
  Target: FXN; (-) strand; PAM type: NRG; PAM sequence: AGG
agatgatgggctgagagaaa

SEQ ID NO: 15193 - DNA, 20 bp, Artificial Sequence
  Description of Artificial Sequence: Synthetic oligonucleotide
  Target: FXN; (-) strand; PAM type: NRG; PAM sequence: AAG
tagatgatgggctgagagaa

SEQ ID NO: 15194 - DNA, 20 bp, Artificial Sequence
  Description of Artificial Sequence: Synthetic oligonucleotide
  Target: FXN; (-) strand; PAM type: NRG; PAM sequence: GAG
gtagctagatgatgggctga

SEQ ID NO: 15195 - DNA, 20 bp, Artificial Sequence
  Description of Artificial Sequence: Synthetic oligonucleotide
  Target: FXN; (-) strand; PAM type: NRG; PAM sequence: GAG
gtgtagctagatgatgggct

SEQ ID NO: 15196 - DNA, 20 bp, Artificial Sequence
  Description of Artificial Sequence: Synthetic oligonucleotide
  Target: FXN; (-) strand; PAM type: NRG; PAM sequence: GGG
agactgtgtagctagatgat

SEQ ID NO: 15197 - DNA, 20 bp, Artificial Sequence
  Description of Artificial Sequence: Synthetic oligonucleotide
  Target: FXN; (-) strand; PAM type: NRG; PAM sequence: TGG
gagactgtgtagctagatga

SEQ ID NO: 15198 - DNA, 20 bp, Artificial Sequence
  Description of Artificial Sequence: Synthetic oligonucleotide
  Target: FXN; (-) strand; PAM type: NRG; PAM sequence: TAG
taccctggagactgtgtagc

SEQ ID NO: 15199 - DNA, 20 bp, Artificial Sequence
  Description of Artificial Sequence: Synthetic oligonucleotide
  Target: FXN; (-) strand; PAM type: NRG; PAM sequence: TAG
agcttaccctggagactgtg

SEQ ID NO: 15200 - DNA, 20 bp, Artificial Sequence
  Description of Artificial Sequence: Synthetic oligonucleotide
  Target: FXN; (-) strand; PAM type: NRG; PAM sequence: GAG
ctttctgaaagcttaccctg

SEQ ID NO: 15201 - DNA, 20 bp, Artificial Sequence
  Description of Artificial Sequence: Synthetic oligonucleotide
  Target: FXN; (-) strand; PAM type: NRG; PAM sequence: TGG
gcctttctgaaagcttaccc

SEQ ID NO: 15202 - DNA, 20 bp, Artificial Sequence
  Description of Artificial Sequence: Synthetic oligonucleotide
  Target: FXN; (-) strand; PAM type: NRG; PAM sequence: AAG
acaagagattgcctttctga

SEQ ID NO: 15203 - DNA, 20 bp, Artificial Sequence
  Description of Artificial Sequence: Synthetic oligonucleotide
  Target: FXN; (-) strand; PAM type: NRG; PAM sequence: GAG
tgcttaggttttacagacaa

SEQ ID NO: 15204 - DNA, 20 bp, Artificial Sequence
  Description of Artificial Sequence: Synthetic oligonucleotide
  Target: FXN; (-) strand; PAM type: NRG; PAM sequence: AAG
cctgcttaggttttacagac

SEQ ID NO: 15205 - DNA, 20 bp, Artificial Sequence
  Description of Artificial Sequence: Synthetic oligonucleotide
  Target: FXN; (-) strand; PAM type: NRG; PAM sequence: CAG
ttggtcctgcttaggtttta

SEQ ID NO: 15206 - DNA, 20 bp, Artificial Sequence
  Description of Artificial Sequence: Synthetic oligonucleotide
  Target: FXN; (-) strand; PAM type: NRG; PAM sequence: AGG
acttggccttggtcctgctt

SEQ ID NO: 15207 - DNA, 20 bp, Artificial Sequence
  Description of Artificial Sequence: Synthetic oligonucleotide
  Target: FXN; (-) strand; PAM type: NRG; PAM sequence: TAG
aacttggccttggtcctgct

SEQ ID NO: 15208 - DNA, 20 bp, Artificial Sequence
  Description of Artificial Sequence: Synthetic oligonucleotide
  Target: FXN; (-) strand; PAM type: NRG; PAM sequence: TGG
caggctaagaaacttggcct

SEQ ID NO: 15209 - DNA, 20 bp, Artificial Sequence
  Description of Artificial Sequence: Synthetic oligonucleotide
  Target: FXN; (-) strand; PAM type: NRG; PAM sequence: TGG
atttttcaggctaagaaact

SEQ ID NO: 15210 - DNA, 20 bp, Artificial Sequence
  Description of Artificial Sequence: Synthetic oligonucleotide
  Target: FXN; (-) strand; PAM type: NRG; PAM sequence: AAG
aaaagcacatttttcaggct

SEQ ID NO: 15211 - DNA, 20 bp, Artificial Sequence
  Description of Artificial Sequence: Synthetic oligonucleotide
  Target: FXN; (-) strand; PAM type: NRG; PAM sequence: AGG
gtcagaaaagcacatttttc

SEQ ID NO: 15212 - DNA, 20 bp, Artificial Sequence
  Description of Artificial Sequence: Synthetic oligonucleotide
  Target: FXN; (-) strand; PAM type: NRG; PAM sequence: CAG
agtcagaaaagcacattttt

SEQ ID NO: 15213 - DNA, 20 bp, Artificial Sequence
  Description of Artificial Sequence: Synthetic oligonucleotide
  Target: FXN; (-) strand; PAM type: NRG; PAM sequence: AAG
cctgaacagttcagtcagaa

SEQ ID NO: 15214 - DNA, 20 bp, Artificial Sequence
  Description of Artificial Sequence: Synthetic oligonucleotide
  Target: FXN; (-) strand; PAM type: NRG; PAM sequence: CAG
cagtgcctgaacagttcagt

SEQ ID NO: 15215 - DNA, 20 bp, Artificial Sequence
  Description of Artificial Sequence: Synthetic oligonucleotide
  Target: FXN; (-) strand; PAM type: NRG; PAM sequence: CAG
gagtcagtgcctgaacagtt

SEQ ID NO: 15216 - DNA, 20 bp, Artificial Sequence
  Description of Artificial Sequence: Synthetic oligonucleotide
  Target: FXN; (-) strand; PAM type: NRG; PAM sequence: CAG
atgtagagtcagtgcctgaa

SEQ ID NO: 15217 - DNA, 20 bp, Artificial Sequence
  Description of Artificial Sequence: Synthetic oligonucleotide
  Target: FXN; (-) strand; PAM type: NRG; PAM sequence: CAG
agcataattatatgtagagt

SEQ ID NO: 15218 - DNA, 20 bp, Artificial Sequence
  Description of Artificial Sequence: Synthetic oligonucleotide
  Target: FXN; (-) strand; PAM type: NRG; PAM sequence: GAG
gaaaagcataattatatgta

SEQ ID NO: 15219 - DNA, 20 bp, Artificial Sequence
  Description of Artificial Sequence: Synthetic oligonucleotide
  Target: FXN; (-) strand; PAM type: NRG; PAM sequence: TAG
tagaaaagcataattatatg

SEQ ID NO: 15220 - DNA, 20 bp, Artificial Sequence
  Description of Artificial Sequence: Synthetic oligonucleotide
  Target: FXN; (-) strand; PAM type: NRG; PAM sequence: AAG
ttgagtgtgagggggtagaa

SEQ ID NO: 15221 - DNA, 20 bp, Artificial Sequence
  Description of Artificial Sequence: Synthetic oligonucleotide
  Target: FXN; (-) strand; PAM type: NRG; PAM sequence: TAG
aagtgttgagtgtgaggggg

SEQ ID NO: 15222 - DNA, 20 bp, Artificial Sequence
  Description of Artificial Sequence: Synthetic oligonucleotide
  Target: FXN; (-) strand; PAM type: NRG; PAM sequence: GGG
tcaaagtgttgagtgtgagg

SEQ ID NO: 15223 - DNA, 20 bp, Artificial Sequence
  Description of Artificial Sequence: Synthetic oligonucleotide
  Target: FXN; (-) strand; PAM type: NRG; PAM sequence: GGG
gtcaaagtgttgagtgtgag

SEQ ID NO: 15224 - DNA, 20 bp, Artificial Sequence
  Description of Artificial Sequence: Synthetic oligonucleotide
  Target: FXN; (-) strand; PAM type: NRG; PAM sequence: GGG
agtcaaagtgttgagtgtga

SEQ ID NO: 15225 - DNA, 20 bp, Artificial Sequence
  Description of Artificial Sequence: Synthetic oligonucleotide
  Target: FXN; (-) strand; PAM type: NRG; PAM sequence: AGG
gagtcaaagtgttgagtgtg

SEQ ID NO: 15226 - DNA, 20 bp, Artificial Sequence
  Description of Artificial Sequence: Synthetic oligonucleotide
  Target: FXN; (-) strand; PAM type: NRG; PAM sequence: GAG
ggagtcaaagtgttgagtgt

SEQ ID NO: 15227 - DNA, 20 bp, Artificial Sequence
  Description of Artificial Sequence: Synthetic oligonucleotide
  Target: FXN; (-) strand; PAM type: NRG; PAM sequence: GAG
attgctggagtcaaagtgtt

SEQ ID NO: 15228 - DNA, 20 bp, Artificial Sequence
  Description of Artificial Sequence: Synthetic oligonucleotide
  Target: FXN; (-) strand; PAM type: NRG; PAM sequence: AAG
atttgggattgctggagtca

SEQ ID NO: 15229 - DNA, 20 bp, Artificial Sequence
  Description of Artificial Sequence: Synthetic oligonucleotide
  Target: FXN; (-) strand; PAM type: NRG; PAM sequence: GAG
ctggggatttgggattgctg

SEQ ID NO: 15230 - DNA, 20 bp, Artificial Sequence
  Description of Artificial Sequence: Synthetic oligonucleotide
  Target: FXN; (-) strand; PAM type: NRG; PAM sequence: TGG
atctggggatttgggattgc

SEQ ID NO: 15231 - DNA, 20 bp, Artificial Sequence
  Description of Artificial Sequence: Synthetic oligonucleotide
  Target: FXN; (-) strand; PAM type: NRG; PAM sequence: GGG
acttagggatctggggattt

SEQ ID NO: 15232 - DNA, 20 bp, Artificial Sequence
  Description of Artificial Sequence: Synthetic oligonucleotide
  Target: FXN; (-) strand; PAM type: NRG; PAM sequence: TGG
cacttagggatctggggatt

SEQ ID NO: 15233 - DNA, 20 bp, Artificial Sequence
  Description of Artificial Sequence: Synthetic oligonucleotide
  Target: FXN; (-) strand; PAM type: NRG; PAM sequence: GGG
acagcacacttagggatctg

SEQ ID NO: 15234 - DNA, 20 bp, Artificial Sequence
  Description of Artificial Sequence: Synthetic oligonucleotide
  Target: FXN; (-) strand; PAM type: NRG; PAM sequence: GGG
cacagcacacttagggatct

SEQ ID NO: 15235 - DNA, 20 bp, Artificial Sequence
  Description of Artificial Sequence: Synthetic oligonucleotide
  Target: FXN; (-) strand; PAM type: NRG; PAM sequence: TGG
gcacagcacacttagggatc

SEQ ID NO: 15236 - DNA, 20 bp, Artificial Sequence
  Description of Artificial Sequence: Synthetic oligonucleotide
  Target: FXN; (-) strand; PAM type: NRG; PAM sequence: GGG
aaaatagcacagcacactta

SEQ ID NO: 15237 - DNA, 20 bp, Artificial Sequence
  Description of Artificial Sequence: Synthetic oligonucleotide
  Target: FXN; (-) strand; PAM type: NRG; PAM sequence: AGG
gaaaatagcacagcacactt

SEQ ID NO: 15238 - DNA, 20 bp, Artificial Sequence
  Description of Artificial Sequence: Synthetic oligonucleotide
  Target: FXN; (-) strand; PAM type: NRG; PAM sequence: TAG
tgaaaatagcacagcacact

SEQ ID NO: 15239 - DNA, 20 bp, Artificial Sequence
  Description of Artificial Sequence: Synthetic oligonucleotide
  Target: FXN; (-) strand; PAM type: NRG; PAM sequence: CAG
agagccacgtgaaaatagca

SEQ ID NO: 15240 - DNA, 20 bp, Artificial Sequence
  Description of Artificial Sequence: Synthetic oligonucleotide
  Target: FXN; (-) strand; PAM type: NRG; PAM sequence: TAG
gtctgagagccacgtgaaaa

SEQ ID NO: 15241 - DNA, 20 bp, Artificial Sequence
  Description of Artificial Sequence: Synthetic oligonucleotide
  Target: FXN; (-) strand; PAM type: NRG; PAM sequence: GAG
acagcactggccaagtctga

SEQ ID NO: 15242 - DNA, 20 bp, Artificial Sequence
  Description of Artificial Sequence: Synthetic oligonucleotide
  Target: FXN; (-) strand; PAM type: NRG; PAM sequence: GAG
aaacagcactggccaagtct

SEQ ID NO: 15243 - DNA, 20 bp, Artificial Sequence
  Description of Artificial Sequence: Synthetic oligonucleotide
  Target: FXN; (-) strand; PAM type: NRG; PAM sequence: AAG
aaatggaaacagcactggcc

SEQ ID NO: 15244 - DNA, 20 bp, Artificial Sequence
  Description of Artificial Sequence: Synthetic oligonucleotide
  Target: FXN; (-) strand; PAM type: NRG; PAM sequence: TGG
gaccaaaatggaaacagcac

SEQ ID NO: 15245 - DNA, 20 bp, Artificial Sequence
  Description of Artificial Sequence: Synthetic oligonucleotide
  Target: FXN; (-) strand; PAM type: NRG; PAM sequence: CAG
aataaagaccaaaatggaaa

SEQ ID NO: 15246 - DNA, 20 bp, Artificial Sequence
  Description of Artificial Sequence: Synthetic oligonucleotide
  Target: FXN; (-) strand; PAM type: NRG; PAM sequence: TGG
gtggggaataaagaccaaaa

SEQ ID NO: 15247 - DNA, 20 bp, Artificial Sequence
  Description of Artificial Sequence: Synthetic oligonucleotide
  Target: FXN; (-) strand; PAM type: NRG; PAM sequence: AAG
aggcagagatgtggggaata

SEQ ID NO: 15248 - DNA, 20 bp, Artificial Sequence
  Description of Artificial Sequence: Synthetic oligonucleotide
  Target: FXN; (-) strand; PAM type: NRG; PAM sequence: GGG
accccccaggcagagatgtg

SEQ ID NO: 15249 - DNA, 20 bp, Artificial Sequence
  Description of Artificial Sequence: Synthetic oligonucleotide
  Target: FXN; (-) strand; PAM type: NRG; PAM sequence: GGG
taccccccaggcagagatgt

SEQ ID NO: 15250 - DNA, 20 bp, Artificial Sequence
  Description of Artificial Sequence: Synthetic oligonucleotide
  Target: FXN; (-) strand; PAM type: NRG; PAM sequence: TGG
ctaccccccaggcagagatg

SEQ ID NO: 15251 - DNA, 20 bp, Artificial Sequence
  Description of Artificial Sequence: Synthetic oligonucleotide
  Target: FXN; (-) strand; PAM type: NRG; PAM sequence: GAG
tagaatctaccccccaggca

SEQ ID NO: 15252 - DNA, 20 bp, Artificial Sequence
  Description of Artificial Sequence: Synthetic oligonucleotide
  Target: FXN; (-) strand; PAM type: NRG; PAM sequence: CAG
ggtagaatctaccccccagg

SEQ ID NO: 15253 - DNA, 20 bp, Artificial Sequence
  Description of Artificial Sequence: Synthetic oligonucleotide
  Target: FXN; (-) strand; PAM type: NRG; PAM sequence: AGG
cagggtagaatctacccccc

SEQ ID NO: 15254 - DNA, 20 bp, Artificial Sequence
  Description of Artificial Sequence: Synthetic oligonucleotide
  Target: FXN; (-) strand; PAM type: NRG; PAM sequence: CAG
tcagggtagaatctaccccc

SEQ ID NO: 15255 - DNA, 20 bp, Artificial Sequence
  Description of Artificial Sequence: Synthetic oligonucleotide
  Target: FXN; (-) strand; PAM type: NRG; PAM sequence: TAG
gccaagaacatttttcaggg

SEQ ID NO: 15256 - DNA, 20 bp, Artificial Sequence
  Description of Artificial Sequence: Synthetic oligonucleotide
  Target: FXN; (-) strand; PAM type: NRG; PAM sequence: GGG
tgtgccaagaacatttttca

SEQ ID NO: 15257 - DNA, 20 bp, Artificial Sequence
  Description of Artificial Sequence: Synthetic oligonucleotide
  Target: FXN; (-) strand; PAM type: NRG; PAM sequence: AGG
ctgtgccaagaacatttttc

SEQ ID NO: 15258 - DNA, 20 bp, Artificial Sequence
  Description of Artificial Sequence: Synthetic oligonucleotide
  Target: FXN; (-) strand; PAM type: NRG; PAM sequence: CAG
gctgtgccaagaacattttt

SEQ ID NO: 15259 - DNA, 20 bp, Artificial Sequence
  Description of Artificial Sequence: Synthetic oligonucleotide
  Target: FXN; (-) strand; PAM type: NRG; PAM sequence: AAG
ggagtttgcaaggctgtgcc

SEQ ID NO: 15260 - DNA, 20 bp, Artificial Sequence
  Description of Artificial Sequence: Synthetic oligonucleotide
  Target: FXN; (-) strand; PAM type: NRG; PAM sequence: AGG
gagtggaggaggagtttgca

SEQ ID NO: 15261 - DNA, 20 bp, Artificial Sequence
  Description of Artificial Sequence: Synthetic oligonucleotide
  Target: FXN; (-) strand; PAM type: NRG; PAM sequence: AAG
tgagtggaggaggagtttgc

SEQ ID NO: 15262 - DNA, 20 bp, Artificial Sequence
  Description of Artificial Sequence: Synthetic oligonucleotide
  Target: FXN; (-) strand; PAM type: NRG; PAM sequence: GAG
gcagaggctgagtggaggag

SEQ ID NO: 15263 - DNA, 20 bp, Artificial Sequence
  Description of Artificial Sequence: Synthetic oligonucleotide
  Target: FXN; (-) strand; PAM type: NRG; PAM sequence: AGG
aggcagaggctgagtggagg

SEQ ID NO: 15264 - DNA, 20 bp, Artificial Sequence
  Description of Artificial Sequence: Synthetic oligonucleotide
  Target: FXN; (-) strand; PAM type: NRG; PAM sequence: GAG
caggcagaggctgagtggag

SEQ ID NO: 15265 - DNA, 20 bp, Artificial Sequence
  Description of Artificial Sequence: Synthetic oligonucleotide
  Target: FXN; (-) strand; PAM type: NRG; PAM sequence: AGG
tccaggcagaggctgagtgg

SEQ ID NO: 15266 - DNA, 20 bp, Artificial Sequence
  Description of Artificial Sequence: Synthetic oligonucleotide
  Target: FXN; (-) strand; PAM type: NRG; PAM sequence: GAG
atccaggcagaggctgagtg

SEQ ID NO: 15267 - DNA, 20 bp, Artificial Sequence
  Description of Artificial Sequence: Synthetic oligonucleotide
  Target: FXN; (-) strand; PAM type: NRG; PAM sequence: TGG
gcatccaggcagaggctgag

SEQ ID NO: 15268 - DNA, 20 bp, Artificial Sequence
  Description of Artificial Sequence: Synthetic oligonucleotide
  Target: FXN; (-) strand; PAM type: NRG; PAM sequence: GAG
agggcatccaggcagaggct

SEQ ID NO: 15269 - DNA, 20 bp, Artificial Sequence
  Description of Artificial Sequence: Synthetic oligonucleotide
  Target: FXN; (-) strand; PAM type: NRG; PAM sequence: AGG
aatcaagggcatccaggcag

SEQ ID NO: 15270 - DNA, 20 bp, Artificial Sequence
  Description of Artificial Sequence: Synthetic oligonucleotide
  Target: FXN; (-) strand; PAM type: NRG; PAM sequence: GAG
caatcaagggcatccaggca

SEQ ID NO: 15271 - DNA, 20 bp, Artificial Sequence
  Description of Artificial Sequence: Synthetic oligonucleotide
  Target: FXN; (-) strand; PAM type: NRG; PAM sequence: CAG
aacaatcaagggcatccagg

SEQ ID NO: 15272 - DNA, 20 bp, Artificial Sequence
  Description of Artificial Sequence: Synthetic oligonucleotide
  Target: FXN; (-) strand; PAM type: NRG; PAM sequence: AGG
tggaacaatcaagggcatcc

SEQ ID NO: 15273 - DNA, 20 bp, Artificial Sequence
  Description of Artificial Sequence: Synthetic oligonucleotide
  Target: FXN; (-) strand; PAM type: NRG; PAM sequence: CAG
atggaacaatcaagggcatc

SEQ ID NO: 15274 - DNA, 20 bp, Artificial Sequence
  Description of Artificial Sequence: Synthetic oligonucleotide
  Target: FXN; (-) strand; PAM type: NRG; PAM sequence: GGG
tgaggacatggaacaatcaa

SEQ ID NO: 15275 - DNA, 20 bp, Artificial Sequence
  Description of Artificial Sequence: Synthetic oligonucleotide
  Target: FXN; (-) strand; PAM type: NRG; PAM sequence: AGG
ctgaggacatggaacaatca

SEQ ID NO: 15276 - DNA, 20 bp, Artificial Sequence
  Description of Artificial Sequence: Synthetic oligonucleotide
  Target: FXN; (-) strand; PAM type: NRG; PAM sequence: AAG
gctgaggacatggaacaatc

SEQ ID NO: 15277 - DNA, 20 bp, Artificial Sequence
  Description of Artificial Sequence: Synthetic oligonucleotide
  Target: FXN; (-) strand; PAM type: NRG; PAM sequence: TGG
aacatggtatgctgaggaca

SEQ ID NO: 15278 - DNA, 20 bp, Artificial Sequence
  Description of Artificial Sequence: Synthetic oligonucleotide
  Target: FXN; (-) strand; PAM type: NRG; PAM sequence: AGG
aagacaaacatggtatgctg

SEQ ID NO: 15279 - DNA, 20 bp, Artificial Sequence
  Description of Artificial Sequence: Synthetic oligonucleotide
  Target: FXN; (-) strand; PAM type: NRG; PAM sequence: GAG
aaagacaaacatggtatgct

SEQ ID NO: 15280 - DNA, 20 bp, Artificial Sequence
  Description of Artificial Sequence: Synthetic oligonucleotide
  Target: FXN; (-) strand; PAM type: NRG; PAM sequence: TGG
agtgctgggaaagacaaaca

SEQ ID NO: 15281 - DNA, 20 bp, Artificial Sequence
  Description of Artificial Sequence: Synthetic oligonucleotide
  Target: FXN; (-) strand; PAM type: NRG; PAM sequence: AAG
atggtaggtcagtgctggga

SEQ ID NO: 15282 - DNA, 20 bp, Artificial Sequence
  Description of Artificial Sequence: Synthetic oligonucleotide
  Target: FXN; (-) strand; PAM type: NRG; PAM sequence: GGG
acacatggtaggtcagtgct

SEQ ID NO: 15283 - DNA, 20 bp, Artificial Sequence
  Description of Artificial Sequence: Synthetic oligonucleotide
  Target: FXN; (-) strand; PAM type: NRG; PAM sequence: TGG
gacacatggtaggtcagtgc

SEQ ID NO: 15284 - DNA, 20 bp, Artificial Sequence
  Description of Artificial Sequence: Synthetic oligonucleotide
  Target: FXN; (-) strand; PAM type: NRG; PAM sequence: CAG
aggggtgacacatggtaggt

SEQ ID NO: 15285 - DNA, 20 bp, Artificial Sequence
  Description of Artificial Sequence: Synthetic oligonucleotide
  Target: FXN; (-) strand; PAM type: NRG; PAM sequence: AGG
aagcaggggtgacacatggt

SEQ ID NO: 15286 - DNA, 20 bp, Artificial Sequence
  Description of Artificial Sequence: Synthetic oligonucleotide
  Target: FXN; (-) strand; PAM type: NRG; PAM sequence: TAG
caagcaggggtgacacatgg

SEQ ID NO: 15287 - DNA, 20 bp, Artificial Sequence
  Description of Artificial Sequence: Synthetic oligonucleotide
  Target: FXN; (-) strand; PAM type: NRG; PAM sequence: TGG
agccaagcaggggtgacaca

SEQ ID NO: 15288 - DNA, 20 bp, Artificial Sequence
  Description of Artificial Sequence: Synthetic oligonucleotide
  Target: FXN; (-) strand; PAM type: NRG; PAM sequence: GGG
tggaaggtacagccaagcag

SEQ ID NO: 15289 - DNA, 20 bp, Artificial Sequence
  Description of Artificial Sequence: Synthetic oligonucleotide
  Target: FXN; (-) strand; PAM type: NRG; PAM sequence: GGG
atggaaggtacagccaagca

SEQ ID NO: 15290 - DNA, 20 bp, Artificial Sequence
  Description of Artificial Sequence: Synthetic oligonucleotide
  Target: FXN; (-) strand; PAM type: NRG; PAM sequence: AGG
catggaaggtacagccaagc

SEQ ID NO: 15291 - DNA, 20 bp, Artificial Sequence
  Description of Artificial Sequence: Synthetic oligonucleotide
  Target: FXN; (-) strand; PAM type: NRG; PAM sequence: CAG
tcatggaaggtacagccaag

SEQ ID NO: 15292 - DNA, 20 bp, Artificial Sequence
  Description of Artificial Sequence: Synthetic oligonucleotide
  Target: FXN; (-) strand; PAM type: NRG; PAM sequence: AAG
gcctcatggaaggtacagcc

SEQ ID NO: 15293 - DNA, 20 bp, Artificial Sequence
  Description of Artificial Sequence: Synthetic oligonucleotide
  Target: FXN; (-) strand; PAM type: NRG; PAM sequence: CAG
tcctagcctcatggaaggta

SEQ ID NO: 15294 - DNA, 20 bp, Artificial Sequence
  Description of Artificial Sequence: Synthetic oligonucleotide
  Target: FXN; (-) strand; PAM type: NRG; PAM sequence: AGG
catagtcctagcctcatgga

SEQ ID NO: 15295 - DNA, 20 bp, Artificial Sequence
  Description of Artificial Sequence: Synthetic oligonucleotide
  Target: FXN; (-) strand; PAM type: NRG; PAM sequence: AAG
acatagtcctagcctcatgg

SEQ ID NO: 15296 - DNA, 20 bp, Artificial Sequence
  Description of Artificial Sequence: Synthetic oligonucleotide
  Target: FXN; (-) strand; PAM type: NRG; PAM sequence: TGG
gacacatagtcctagcctca

SEQ ID NO: 15297 - DNA, 20 bp, Artificial Sequence
  Description of Artificial Sequence: Synthetic oligonucleotide
  Target: FXN; (-) strand; PAM type: NRG; PAM sequence: TAG
acaaaggagacacatagtcc

SEQ ID NO: 15298 - DNA, 20 bp, Artificial Sequence
  Description of Artificial Sequence: Synthetic oligonucleotide
  Target: FXN; (-) strand; PAM type: NRG; PAM sequence: TAG
cagtcaacaaaggagacaca

SEQ ID NO: 15299 - DNA, 20 bp, Artificial Sequence
  Description of Artificial Sequence: Synthetic oligonucleotide
  Target: FXN; (-) strand; PAM type: NRG; PAM sequence: GAG
ggcaacagcagtcaacaaag

SEQ ID NO: 15300 - DNA, 20 bp, Artificial Sequence
  Description of Artificial Sequence: Synthetic oligonucleotide
  Target: FXN; (-) strand; PAM type: NRG; PAM sequence: AGG
agggcaacagcagtcaacaa

SEQ ID NO: 15301 - DNA, 20 bp, Artificial Sequence
  Description of Artificial Sequence: Synthetic oligonucleotide
  Target: FXN; (-) strand; PAM type: NRG; PAM sequence: AAG
tagggcaacagcagtcaaca

SEQ ID NO: 15302 - DNA, 20 bp, Artificial Sequence
  Description of Artificial Sequence: Synthetic oligonucleotide
  Target: FXN; (-) strand; PAM type: NRG; PAM sequence: CAG
gcaagatgctagggcaacag

SEQ ID NO: 15303 - DNA, 20 bp, Artificial Sequence
  Description of Artificial Sequence: Synthetic oligonucleotide
  Target: FXN; (-) strand; PAM type: NRG; PAM sequence: CAG
tgtgcaagatgctagggcaa

SEQ ID NO: 15304 - DNA, 20 bp, Artificial Sequence
  Description of Artificial Sequence: Synthetic oligonucleotide
  Target: FXN; (-) strand; PAM type: NRG; PAM sequence: GGG
aggaactgtgcaagatgcta

SEQ ID NO: 15305 - DNA, 20 bp, Artificial Sequence
  Description of Artificial Sequence: Synthetic oligonucleotide
  Target: FXN; (-) strand; PAM type: NRG; PAM sequence: AGG
aaggaactgtgcaagatgct

SEQ ID NO: 15306 - DNA, 20 bp, Artificial Sequence
  Description of Artificial Sequence: Synthetic oligonucleotide
  Target: FXN; (-) strand; PAM type: NRG; PAM sequence: TAG
caaggaactgtgcaagatgc

SEQ ID NO: 15307 - DNA, 20 bp, Artificial Sequence
  Description of Artificial Sequence: Synthetic oligonucleotide
  Target: FXN; (-) strand; PAM type: NRG; PAM sequence: AAG
ttgtgtgcaaggaactgtgc

SEQ ID NO: 15308 - DNA, 20 bp, Artificial Sequence
  Description of Artificial Sequence: Synthetic oligonucleotide
  Target: FXN; (-) strand; PAM type: NRG; PAM sequence: AGG
tagagctctaattgtgtgca

SEQ ID NO: 15309 - DNA, 20 bp, Artificial Sequence
  Description of Artificial Sequence: Synthetic oligonucleotide
  Target: FXN; (-) strand; PAM type: NRG; PAM sequence: AAG
atagagctctaattgtgtgc

SEQ ID NO: 15310 - DNA, 20 bp, Artificial Sequence
  Description of Artificial Sequence: Synthetic oligonucleotide
  Target: FXN; (-) strand; PAM type: NRG; PAM sequence: GAG
acatttatttgacatttata

SEQ ID NO: 15311 - DNA, 20 bp, Artificial Sequence
  Description of Artificial Sequence: Synthetic oligonucleotide
  Target: FXN; (-) strand; PAM type: NRG; PAM sequence: TAG
acacatttatttgacattta

SEQ ID NO: 15312 - DNA, 20 bp, Artificial Sequence
  Description of Artificial Sequence: Synthetic oligonucleotide
  Target: FXN; (-) strand; PAM type: NRG; PAM sequence: GAG
cttggagttggggttattta

SEQ ID NO: 15313 - DNA, 20 bp, Artificial Sequence
  Description of Artificial Sequence: Synthetic oligonucleotide
  Target: FXN; (-) strand; PAM type: NRG; PAM sequence: TAG
ctcttggagttggggttatt

SEQ ID NO: 15314 - DNA, 20 bp, Artificial Sequence
  Description of Artificial Sequence: Synthetic oligonucleotide
  Target: FXN; (-) strand; PAM type: NRG; PAM sequence: GGG
tgctaacactcttggagttg

SEQ ID NO: 15315 - DNA, 20 bp, Artificial Sequence
  Description of Artificial Sequence: Synthetic oligonucleotide
  Target: FXN; (-) strand; PAM type: NRG; PAM sequence: GGG
ttgctaacactcttggagtt

SEQ ID NO: 15316 - DNA, 20 bp, Artificial Sequence
  Description of Artificial Sequence: Synthetic oligonucleotide
  Target: FXN; (-) strand; PAM type: NRG; PAM sequence: TGG
cttgctaacactcttggagt

SEQ ID NO: 15317 - DNA, 20 bp, Artificial Sequence
  Description of Artificial Sequence: Synthetic oligonucleotide
  Target: FXN; (-) strand; PAM type: NRG; PAM sequence: GAG
atttcttgctaacactcttg

SEQ ID NO: 15318 - DNA, 20 bp, Artificial Sequence
  Description of Artificial Sequence: Synthetic oligonucleotide
  Target: FXN; (-) strand; PAM type: NRG; PAM sequence: TGG
atatttcttgctaacactct

SEQ ID NO: 15319 - DNA, 20 bp, Artificial Sequence
  Description of Artificial Sequence: Synthetic oligonucleotide
  Target: FXN; (-) strand; PAM type: NRG; PAM sequence: TGG
gtgtgaggtaactcactccg

SEQ ID NO: 15320 - DNA, 20 bp, Artificial Sequence
  Description of Artificial Sequence: Synthetic oligonucleotide
  Target: FXN; (-) strand; PAM type: NRG; PAM sequence: AGG
agtttttccgtgcctgtgtg

SEQ ID NO: 15321 - DNA, 20 bp, Artificial Sequence
  Description of Artificial Sequence: Synthetic oligonucleotide
  Target: FXN; (-) strand; PAM type: NRG; PAM sequence: GAG
aagtttttccgtgcctgtgt

SEQ ID NO: 15322 - DNA, 20 bp, Artificial Sequence
  Description of Artificial Sequence: Synthetic oligonucleotide
  Target: FXN; (-) strand; PAM type: NRG; PAM sequence: AAG
aaaatgtccttaggaggttc

SEQ ID NO: 15323 - DNA, 20 bp, Artificial Sequence
  Description of Artificial Sequence: Synthetic oligonucleotide
  Target: FXN; (-) strand; PAM type: NRG; PAM sequence: AGG
agcttaaaaatgtccttagg

SEQ ID NO: 15324 - DNA, 20 bp, Artificial Sequence
  Description of Artificial Sequence: Synthetic oligonucleotide
  Target: FXN; (-) strand; PAM type: NRG; PAM sequence: GAG
gagcttaaaaatgtccttag

SEQ ID NO: 15325 - DNA, 20 bp, Artificial Sequence
  Description of Artificial Sequence: Synthetic oligonucleotide
  Target: FXN; (-) strand; PAM type: NRG; PAM sequence: AGG
gagagcttaaaaatgtcctt

SEQ ID NO: 15326 - DNA, 20 bp, Artificial Sequence
  Description of Artificial Sequence: Synthetic oligonucleotide
  Target: FXN; (-) strand; PAM type: NRG; PAM sequence: TAG
agagagcttaaaaatgtcct

SEQ ID NO: 15327 - DNA, 20 bp, Artificial Sequence
  Description of Artificial Sequence: Synthetic oligonucleotide
  Target: FXN; (+) strand; PAM type: NRG; PAM sequence: CAG
tatacactaaattcctccca

SEQ ID NO: 15328 - DNA, 20 bp, Artificial Sequence
  Description of Artificial Sequence: Synthetic oligonucleotide
  Target: FXN; (+) strand; PAM type: NRG; PAM sequence: TAG
cactaaattcctcccacagt

SEQ ID NO: 15329 - DNA, 20 bp, Artificial Sequence
  Description of Artificial Sequence: Synthetic oligonucleotide
  Target: FXN; (+) strand; PAM type: NRG; PAM sequence: TGG
aattcctcccacagttagct

SEQ ID NO: 15330 - DNA, 20 bp, Artificial Sequence
  Description of Artificial Sequence: Synthetic oligonucleotide
  Target: FXN; (+) strand; PAM type: NRG; PAM sequence: TGG
ctcccacagttagcttggcg

SEQ ID NO: 15331 - DNA, 20 bp, Artificial Sequence
  Description of Artificial Sequence: Synthetic oligonucleotide
  Target: FXN; (+) strand; PAM type: NRG; PAM sequence: CAG
cgtggcctttgttatatgcc

SEQ ID NO: 15332 - DNA, 20 bp, Artificial Sequence
  Description of Artificial Sequence: Synthetic oligonucleotide
  Target: FXN; (+) strand; PAM type: NRG; PAM sequence: AGG
gtggcctttgttatatgccc

SEQ ID NO: 15333 - DNA, 20 bp, Artificial Sequence
  Description of Artificial Sequence: Synthetic oligonucleotide
  Target: FXN; (+) strand; PAM type: NRG; PAM sequence: AAG
tttgttatatgcccaggaat

SEQ ID NO: 15334 - DNA, 20 bp, Artificial Sequence
  Description of Artificial Sequence: Synthetic oligonucleotide
  Target: FXN; (+) strand; PAM type: NRG; PAM sequence: GAG
ttatatgcccaggaataagt

SEQ ID NO: 15335 - DNA, 20 bp, Artificial Sequence
  Description of Artificial Sequence: Synthetic oligonucleotide
  Target: FXN; (+) strand; PAM type: NRG; PAM sequence: AGG
tatatgcccaggaataagtg

SEQ ID NO: 15336 - DNA, 20 bp, Artificial Sequence
  Description of Artificial Sequence: Synthetic oligonucleotide
  Target: FXN; (+) strand; PAM type: NRG; PAM sequence: CAG
tgcccaggaataagtgagga

SEQ ID NO: 15337 - DNA, 20 bp, Artificial Sequence
  Description of Artificial Sequence: Synthetic oligonucleotide
  Target: FXN; (+) strand; PAM type: NRG; PAM sequence: CAG
caggaataagtgaggacagc

SEQ ID NO: 15338 - DNA, 20 bp, Artificial Sequence
  Description of Artificial Sequence: Synthetic oligonucleotide
  Target: FXN; (+) strand; PAM type: NRG; PAM sequence: GAG
agtgaggacagccagcctat

SEQ ID NO: 15339 - DNA, 20 bp, Artificial Sequence
  Description of Artificial Sequence: Synthetic oligonucleotide
  Target: FXN; (+) strand; PAM type: NRG; PAM sequence: TAG
ggacagccagcctatgagac

SEQ ID NO: 15340 - DNA, 20 bp, Artificial Sequence
  Description of Artificial Sequence: Synthetic oligonucleotide
  Target: FXN; (+) strand; PAM type: NRG; PAM sequence: AAG
cagccagcctatgagactag

SEQ ID NO: 15341 - DNA, 20 bp, Artificial Sequence
  Description of Artificial Sequence: Synthetic oligonucleotide
  Target: FXN; (+) strand; PAM type: NRG; PAM sequence: AAG
cagcctatgagactagaagc

SEQ ID NO: 15342 - DNA, 20 bp, Artificial Sequence
  Description of Artificial Sequence: Synthetic oligonucleotide
  Target: FXN; (+) strand; PAM type: NRG; PAM sequence: TGG
ctatgagactagaagcaaga

SEQ ID NO: 15343 - DNA, 20 bp, Artificial Sequence
  Description of Artificial Sequence: Synthetic oligonucleotide
  Target: FXN; (+) strand; PAM type: NRG; PAM sequence: GAG
atgagactagaagcaagatg

SEQ ID NO: 15344 - DNA, 20 bp, Artificial Sequence
  Description of Artificial Sequence: Synthetic oligonucleotide
  Target: FXN; (+) strand; PAM type: NRG; PAM sequence: CAG
gactagaagcaagatggagt

SEQ ID NO: 15345 - DNA, 20 bp, Artificial Sequence
  Description of Artificial Sequence: Synthetic oligonucleotide
  Target: FXN; (+) strand; PAM type: NRG; PAM sequence: AAG
gaagcaagatggagtcagcc

SEQ ID NO: 15346 - DNA, 20 bp, Artificial Sequence
  Description of Artificial Sequence: Synthetic oligonucleotide
  Target: FXN; (+) strand; PAM type: NRG; PAM sequence: AAG
tcactgtcataacctttaca

SEQ ID NO: 15347 - DNA, 20 bp, Artificial Sequence
  Description of Artificial Sequence: Synthetic oligonucleotide
  Target: FXN; (+) strand; PAM type: NRG; PAM sequence: AGG
cactgtcataacctttacaa

SEQ ID NO: 15348 - DNA, 20 bp, Artificial Sequence
  Description of Artificial Sequence: Synthetic oligonucleotide
  Target: FXN; (+) strand; PAM type: NRG; PAM sequence: TGG
tgtcataacctttacaaagg

SEQ ID NO: 15349 - DNA, 20 bp, Artificial Sequence
  Description of Artificial Sequence: Synthetic oligonucleotide
  Target: FXN; (+) strand; PAM type: NRG; PAM sequence: TAG
ctttacaaaggtggtttcat

SEQ ID NO: 15350 - DNA, 20 bp, Artificial Sequence
  Description of Artificial Sequence: Synthetic oligonucleotide
  Target: FXN; (+) strand; PAM type: NRG; PAM sequence: AGG
tttacaaaggtggtttcatt

SEQ ID NO: 15351 - DNA, 20 bp, Artificial Sequence
  Description of Artificial Sequence: Synthetic oligonucleotide
  Target: FXN; (+) strand; PAM type: NRG; PAM sequence: TAG
gcatattaatgcaaattcct

SEQ ID NO: 15352 - DNA, 20 bp, Artificial Sequence
  Description of Artificial Sequence: Synthetic oligonucleotide
  Target: FXN; (+) strand; PAM type: NRG; PAM sequence: AAG
gcaaattccttagttaaaac

SEQ ID NO: 15353 - DNA, 20 bp, Artificial Sequence
  Description of Artificial Sequence: Synthetic oligonucleotide
  Target: FXN; (+) strand; PAM type: NRG; PAM sequence: AAG
aaaacaagaatgactctcta

SEQ ID NO: 15354 - DNA, 20 bp, Artificial Sequence
  Description of Artificial Sequence: Synthetic oligonucleotide
  Target: FXN; (+) strand; PAM type: NRG; PAM sequence: AGG
aaacaagaatgactctctaa

SEQ ID NO: 15355 - DNA, 20 bp, Artificial Sequence
  Description of Artificial Sequence: Synthetic oligonucleotide
  Target: FXN; (+) strand; PAM type: NRG; PAM sequence: CAG
actctctaaaggctatattt

SEQ ID NO: 15356 - DNA, 20 bp, Artificial Sequence
  Description of Artificial Sequence: Synthetic oligonucleotide
  Target: FXN; (+) strand; PAM type: NRG; PAM sequence: CAG
ctttcctcttgtcccctcaa

SEQ ID NO: 15357 - DNA, 20 bp, Artificial Sequence
  Description of Artificial Sequence: Synthetic oligonucleotide
  Target: FXN; (+) strand; PAM type: NRG; PAM sequence: AAG
cctcttgtcccctcaacagt

SEQ ID NO: 15358 - DNA, 20 bp, Artificial Sequence
  Description of Artificial Sequence: Synthetic oligonucleotide
  Target: FXN; (+) strand; PAM type: NRG; PAM sequence: AAG
ttgtcccctcaacagtaagc

SEQ ID NO: 15359 - DNA, 20 bp, Artificial Sequence
  Description of Artificial Sequence: Synthetic oligonucleotide
  Target: FXN; (+) strand; PAM type: NRG; PAM sequence: AAG
tcccctcaacagtaagcaag

SEQ ID NO: 15360 - DNA, 20 bp, Artificial Sequence
  Description of Artificial Sequence: Synthetic oligonucleotide
  Target: FXN; (+) strand; PAM type: NRG; PAM sequence: GAG
ccctcaacagtaagcaagaa

SEQ ID NO: 15361 - DNA, 20 bp, Artificial Sequence
  Description of Artificial Sequence: Synthetic oligonucleotide
  Target: FXN; (+) strand; PAM type: NRG; PAM sequence: AAG
caagaagagtatttttgtac

SEQ ID NO: 15362 - DNA, 20 bp, Artificial Sequence
  Description of Artificial Sequence: Synthetic oligonucleotide
  Target: FXN; (+) strand; PAM type: NRG; PAM sequence: GAG
agaagagtatttttgtacaa

SEQ ID NO: 15363 - DNA, 20 bp, Artificial Sequence
  Description of Artificial Sequence: Synthetic oligonucleotide
  Target: FXN; (+) strand; PAM type: NRG; PAM sequence: GAG
aagagtatttttgtacaaga

SEQ ID NO: 15364 - DNA, 20 bp, Artificial Sequence
  Description of Artificial Sequence: Synthetic oligonucleotide
  Target: FXN; (+) strand; PAM type: NRG; PAM sequence: GAG
gagtatttttgtacaagaga

SEQ ID NO: 15365 - DNA, 20 bp, Artificial Sequence
  Description of Artificial Sequence: Synthetic oligonucleotide
  Target: FXN; (+) strand; PAM type: NRG; PAM sequence: AGG
agtatttttgtacaagagag

SEQ ID NO: 15366 - DNA, 20 bp, Artificial Sequence
  Description of Artificial Sequence: Synthetic oligonucleotide
  Target: FXN; (+) strand; PAM type: NRG; PAM sequence: AAG
aagagagaggcctctgcctg

SEQ ID NO: 15367 - DNA, 20 bp, Artificial Sequence
  Description of Artificial Sequence: Synthetic oligonucleotide
  Target: FXN; (+) strand; PAM type: NRG; PAM sequence: CAG
ctgaagctcccttaatctgt

SEQ ID NO: 15368 - DNA, 20 bp, Artificial Sequence
  Description of Artificial Sequence: Synthetic oligonucleotide
  Target: FXN; (+) strand; PAM type: NRG; PAM sequence: CAG
tcccttaatctgtcagatca

SEQ ID NO: 15369 - DNA, 20 bp, Artificial Sequence
  Description of Artificial Sequence: Synthetic oligonucleotide
  Target: FXN; (+) strand; PAM type: NRG; PAM sequence: AAG
tctgtcagatcacagatcaa

SEQ ID NO: 15370 - DNA, 20 bp, Artificial Sequence
  Description of Artificial Sequence: Synthetic oligonucleotide
  Target: FXN; (+) strand; PAM type: NRG; PAM sequence: AAG
aaagctatcacacactgccc

SEQ ID NO: 15371 - DNA, 20 bp, Artificial Sequence
  Description of Artificial Sequence: Synthetic oligonucleotide
  Target: FXN; (+) strand; PAM type: NRG; PAM sequence: AGG
aagctatcacacactgccca

SEQ ID NO: 15372 - DNA, 20 bp, Artificial Sequence
  Description of Artificial Sequence: Synthetic oligonucleotide
  Target: FXN; (+) strand; PAM type: NRG; PAM sequence: GGG
agctatcacacactgcccaa

SEQ ID NO: 15373 - DNA, 20 bp, Artificial Sequence
  Description of Artificial Sequence: Synthetic oligonucleotide
  Target: FXN; (+) strand; PAM type: NRG; PAM sequence: AAG
acactgcccaagggacccta

SEQ ID NO: 15374 - DNA, 20 bp, Artificial Sequence
  Description of Artificial Sequence: Synthetic oligonucleotide
  Target: FXN; (+) strand; PAM type: NRG; PAM sequence: AGG
cactgcccaagggaccctaa

SEQ ID NO: 15375 - DNA, 20 bp, Artificial Sequence
  Description of Artificial Sequence: Synthetic oligonucleotide
  Target: FXN; (+) strand; PAM type: NRG; PAM sequence: GGG
actgcccaagggaccctaaa

SEQ ID NO: 15376 - DNA, 20 bp, Artificial Sequence
  Description of Artificial Sequence: Synthetic oligonucleotide
  Target: FXN; (+) strand; PAM type: NRG; PAM sequence: GAG
tgcccaagggaccctaaagg

SEQ ID NO: 15377 - DNA, 20 bp, Artificial Sequence
  Description of Artificial Sequence: Synthetic oligonucleotide
  Target: FXN; (+) strand; PAM type: NRG; PAM sequence: CAG
accctaaagggagccactct

SEQ ID NO: 15378 - DNA, 20 bp, Artificial Sequence
  Description of Artificial Sequence: Synthetic oligonucleotide
  Target: FXN; (+) strand; PAM type: NRG; PAM sequence: TGG
aatccaaacctccttttttc

SEQ ID NO: 15379 - DNA, 20 bp, Artificial Sequence
  Description of Artificial Sequence: Synthetic oligonucleotide
  Target: FXN; (+) strand; PAM type: NRG; PAM sequence: TAG
ccactgaaacgttcaataat

SEQ ID NO: 15380 - DNA, 20 bp, Artificial Sequence
  Description of Artificial Sequence: Synthetic oligonucleotide
  Target: FXN; (+) strand; PAM type: NRG; PAM sequence: TGG
tgtttaatatttattgactt

SEQ ID NO: 15381 - DNA, 20 bp, Artificial Sequence
  Description of Artificial Sequence: Synthetic oligonucleotide
  Target: FXN; (+) strand; PAM type: NRG; PAM sequence: GAG
gaattattgattactttgct

SEQ ID NO: 15382 - DNA, 20 bp, Artificial Sequence
  Description of Artificial Sequence: Synthetic oligonucleotide
  Target: FXN; (+) strand; PAM type: NRG; PAM sequence: AAG
atttaatctatattaatatt

SEQ ID NO: 15383 - DNA, 20 bp, Artificial Sequence
  Description of Artificial Sequence: Synthetic oligonucleotide
  Target: FXN; (+) strand; PAM type: NRG; PAM sequence: AGG
tttaatctatattaatatta

SEQ ID NO: 15384 - DNA, 20 bp, Artificial Sequence
  Description of Artificial Sequence: Synthetic oligonucleotide
  Target: FXN; (+) strand; PAM type: NRG; PAM sequence: CAG
tgatgtatcaaattgcattc

SEQ ID NO: 15385 - DNA, 20 bp, Artificial Sequence
  Description of Artificial Sequence: Synthetic oligonucleotide
  Target: FXN; (+) strand; PAM type: NRG; PAM sequence: GAG
atgtatcaaattgcattcca

SEQ ID NO: 15386 - DNA, 20 bp, Artificial Sequence
  Description of Artificial Sequence: Synthetic oligonucleotide
  Target: FXN; (+) strand; PAM type: NRG; PAM sequence: TGG
tcaaattgcattccagagtg

SEQ ID NO: 15387 - DNA, 20 bp, Artificial Sequence
  Description of Artificial Sequence: Synthetic oligonucleotide
  Target: FXN; (+) strand; PAM type: NRG; PAM sequence: TAG
ccagagtgtggatttgactc

SEQ ID NO: 15388 - DNA, 20 bp, Artificial Sequence
  Description of Artificial Sequence: Synthetic oligonucleotide
  Target: FXN; (+) strand; PAM type: NRG; PAM sequence: CAG
tttgactctagtgccataat

SEQ ID NO: 15389 - DNA, 20 bp, Artificial Sequence
  Description of Artificial Sequence: Synthetic oligonucleotide
  Target: FXN; (+) strand; PAM type: NRG; PAM sequence: TGG
tagtgccataatcagtctcc

SEQ ID NO: 15390 - DNA, 20 bp, Artificial Sequence
  Description of Artificial Sequence: Synthetic oligonucleotide
  Target: FXN; (+) strand; PAM type: NRG; PAM sequence: GGG
agtgccataatcagtctcct

SEQ ID NO: 15391 - DNA, 20 bp, Artificial Sequence
  Description of Artificial Sequence: Synthetic oligonucleotide
  Target: FXN; (+) strand; PAM type: NRG; PAM sequence: CAG
aatcagtctcctgggacaaa

SEQ ID NO: 15392 - DNA, 20 bp, Artificial Sequence
  Description of Artificial Sequence: Synthetic oligonucleotide
  Target: FXN; (+) strand; PAM type: NRG; PAM sequence: TAG
ctgtttctcttccctcatta

SEQ ID NO: 15393 - DNA, 20 bp, Artificial Sequence
  Description of Artificial Sequence: Synthetic oligonucleotide
  Target: FXN; (+) strand; PAM type: NRG; PAM sequence: TGG
ttatagaaaaaaattgccct

SEQ ID NO: 15394 - DNA, 20 bp, Artificial Sequence
  Description of Artificial Sequence: Synthetic oligonucleotide
  Target: FXN; (+) strand; PAM type: NRG; PAM sequence: AAG
attgcccttggcaaatgtca

SEQ ID NO: 15395 - DNA, 20 bp, Artificial Sequence
  Description of Artificial Sequence: Synthetic oligonucleotide
  Target: FXN; (+) strand; PAM type: NRG; PAM sequence: AAG
tctctcttaccaatcaatcc

SEQ ID NO: 15396 - DNA, 20 bp, Artificial Sequence
  Description of Artificial Sequence: Synthetic oligonucleotide
  Target: FXN; (+) strand; PAM type: NRG; PAM sequence: CAG
ccaatcaatccaagcaaatg

SEQ ID NO: 15397 - DNA, 20 bp, Artificial Sequence
  Description of Artificial Sequence: Synthetic oligonucleotide
  Target: FXN; (+) strand; PAM type: NRG; PAM sequence: TGG
atcaatccaagcaaatgcag

SEQ ID NO: 15398 - DNA, 20 bp, Artificial Sequence
  Description of Artificial Sequence: Synthetic oligonucleotide
  Target: FXN; (+) strand; PAM type: NRG; PAM sequence: GGG
tcaatccaagcaaatgcagt

SEQ ID NO: 15399 - DNA, 20 bp, Artificial Sequence
  Description of Artificial Sequence: Synthetic oligonucleotide
  Target: FXN; (+) strand; PAM type: NRG; PAM sequence: CAG
gcagtgggatttcttttccc

SEQ ID NO: 15400 - DNA, 20 bp, Artificial Sequence
  Description of Artificial Sequence: Synthetic oligonucleotide
  Target: FXN; (+) strand; PAM type: NRG; PAM sequence: GAG
agtgggatttcttttcccca

SEQ ID NO: 15401 - DNA, 20 bp, Artificial Sequence
  Description of Artificial Sequence: Synthetic oligonucleotide
  Target: FXN; (+) strand; PAM type: NRG; PAM sequence: AAG
atttcttttccccagagttg

SEQ ID NO: 15402 - DNA, 20 bp, Artificial Sequence
  Description of Artificial Sequence: Synthetic oligonucleotide
  Target: FXN; (+) strand; PAM type: NRG; PAM sequence: CAG
gagttgaagtcacctcctga

SEQ ID NO: 15403 - DNA, 20 bp, Artificial Sequence
  Description of Artificial Sequence: Synthetic oligonucleotide
  Target: FXN; (+) strand; PAM type: NRG; PAM sequence: AGG
agttgaagtcacctcctgac

SEQ ID NO: 15404 - DNA, 20 bp, Artificial Sequence
  Description of Artificial Sequence: Synthetic oligonucleotide
  Target: FXN; (+) strand; PAM type: NRG; PAM sequence: AAG
tgaagtcacctcctgacagg

SEQ ID NO: 15405 - DNA, 20 bp, Artificial Sequence
  Description of Artificial Sequence: Synthetic oligonucleotide
  Target: FXN; (+) strand; PAM type: NRG; PAM sequence: AAG
tcacctcctgacaggaagtt

SEQ ID NO: 15406 - DNA, 20 bp, Artificial Sequence
  Description of Artificial Sequence: Synthetic oligonucleotide
  Target: FXN; (+) strand; PAM type: NRG; PAM sequence: TAG
ctgacaggaagttaagtctt

SEQ ID NO: 15407 - DNA, 20 bp, Artificial Sequence
  Description of Artificial Sequence: Synthetic oligonucleotide
  Target: FXN; (+) strand; PAM type: NRG; PAM sequence: AGG
tgacaggaagttaagtcttt

SEQ ID NO: 15408 - DNA, 20 bp, Artificial Sequence
  Description of Artificial Sequence: Synthetic oligonucleotide
  Target: FXN; (+) strand; PAM type: NRG; PAM sequence: TAG
agtctttaggcactgaatca

SEQ ID NO: 15409 - DNA, 20 bp, Artificial Sequence
  Description of Artificial Sequence: Synthetic oligonucleotide
  Target: FXN; (+) strand; PAM type: NRG; PAM sequence: GAG
aggcactgaatcatagcact

SEQ ID NO: 15410 - DNA, 20 bp, Artificial Sequence
  Description of Artificial Sequence: Synthetic oligonucleotide
  Target: FXN; (+) strand; PAM type: NRG; PAM sequence: AAG
tgaatcatagcactgagctg

SEQ ID NO: 15411 - DNA, 20 bp, Artificial Sequence
  Description of Artificial Sequence: Synthetic oligonucleotide
  Target: FXN; (+) strand; PAM type: NRG; PAM sequence: CAG
catagcactgagctgaagcc

SEQ ID NO: 15412 - DNA, 20 bp, Artificial Sequence
  Description of Artificial Sequence: Synthetic oligonucleotide
  Target: FXN; (+) strand; PAM type: NRG; PAM sequence: AGG
atagcactgagctgaagccc

SEQ ID NO: 15413 - DNA, 20 bp, Artificial Sequence
  Description of Artificial Sequence: Synthetic oligonucleotide
  Target: FXN; (+) strand; PAM type: NRG; PAM sequence: AAG
ctgagctgaagcccaggact

SEQ ID NO: 15414 - DNA, 20 bp, Artificial Sequence
  Description of Artificial Sequence: Synthetic oligonucleotide
  Target: FXN; (+) strand; PAM type: NRG; PAM sequence: AAG
gctgaagcccaggactaagc

SEQ ID NO: 15415 - DNA, 20 bp, Artificial Sequence
  Description of Artificial Sequence: Synthetic oligonucleotide
  Target: FXN; (+) strand; PAM type: NRG; PAM sequence: GAG
gcccaggactaagcaagaat

SEQ ID NO: 15416 - DNA, 20 bp, Artificial Sequence
  Description of Artificial Sequence: Synthetic oligonucleotide
  Target: FXN; (+) strand; PAM type: NRG; PAM sequence: GAG
aggactaagcaagaatgagt

SEQ ID NO: 15417 - DNA, 20 bp, Artificial Sequence
  Description of Artificial Sequence: Synthetic oligonucleotide
  Target: FXN; (+) strand; PAM type: NRG; PAM sequence: TGG
agcaagaatgagtgagaatt

SEQ ID NO: 15418 - DNA, 20 bp, Artificial Sequence
  Description of Artificial Sequence: Synthetic oligonucleotide
  Target: FXN; (+) strand; PAM type: NRG; PAM sequence: GAG
caagaatgagtgagaatttg

SEQ ID NO: 15419 - DNA, 20 bp, Artificial Sequence
  Description of Artificial Sequence: Synthetic oligonucleotide
  Target: FXN; (+) strand; PAM type: NRG; PAM sequence: AAG
gagtgagaatttggagactt

SEQ ID NO: 15420 - DNA, 20 bp, Artificial Sequence
  Description of Artificial Sequence: Synthetic oligonucleotide
  Target: FXN; (+) strand; PAM type: NRG; PAM sequence: AGG
agtgagaatttggagactta

SEQ ID NO: 15421 - DNA, 20 bp, Artificial Sequence
  Description of Artificial Sequence: Synthetic oligonucleotide
  Target: FXN; (+) strand; PAM type: NRG; PAM sequence: TGG
gaatttggagacttaaggtt

SEQ ID NO: 15422 - DNA, 20 bp, Artificial Sequence
  Description of Artificial Sequence: Synthetic oligonucleotide
  Target: FXN; (+) strand; PAM type: NRG; PAM sequence: TAG
acttaaggtttggtcatctg

SEQ ID NO: 15423 - DNA, 20 bp, Artificial Sequence
  Description of Artificial Sequence: Synthetic oligonucleotide
  Target: FXN; (+) strand; PAM type: NRG; PAM sequence: GAG
ttaaggtttggtcatctgta

SEQ ID NO: 15424 - DNA, 20 bp, Artificial Sequence
  Description of Artificial Sequence: Synthetic oligonucleotide
  Target: FXN; (+) strand; PAM type: NRG; PAM sequence: AGG
taaggtttggtcatctgtag

SEQ ID NO: 15425 - DNA, 20 bp, Artificial Sequence
  Description of Artificial Sequence: Synthetic oligonucleotide
  Target: FXN; (+) strand; PAM type: NRG; PAM sequence: TGG
tttggtcatctgtagaggat

SEQ ID NO: 15426 - DNA, 20 bp, Artificial Sequence
  Description of Artificial Sequence: Synthetic oligonucleotide
  Target: FXN; (+) strand; PAM type: NRG; PAM sequence: GGG
ttggtcatctgtagaggatt

SEQ ID NO: 15427 - DNA, 20 bp, Artificial Sequence
  Description of Artificial Sequence: Synthetic oligonucleotide
  Target: FXN; (+) strand; PAM type: NRG; PAM sequence: TGG
gtcttgttttgtttttgttt

SEQ ID NO: 15428 - DNA, 20 bp, Artificial Sequence
  Description of Artificial Sequence: Synthetic oligonucleotide
  Target: FXN; (+) strand; PAM type: NRG; PAM sequence: AAG
tttttgttttggtgtcctgc

SEQ ID NO: 15429 - DNA, 20 bp, Artificial Sequence
  Description of Artificial Sequence: Synthetic oligonucleotide
  Target: FXN; (+) strand; PAM type: NRG; PAM sequence: AGG
ttttgttttggtgtcctgca

SEQ ID NO: 15430 - DNA, 20 bp, Artificial Sequence
  Description of Artificial Sequence: Synthetic oligonucleotide
  Target: FXN; (+) strand; PAM type: NRG; PAM sequence: CAG
ggtttctcactgcccttcat

SEQ ID NO: 15431 - DNA, 20 bp, Artificial Sequence
  Description of Artificial Sequence: Synthetic oligonucleotide
  Target: FXN; (+) strand; PAM type: NRG; PAM sequence: AGG
gtttctcactgcccttcatc

SEQ ID NO: 15432 - DNA, 20 bp, Artificial Sequence
  Description of Artificial Sequence: Synthetic oligonucleotide
  Target: FXN; (+) strand; PAM type: NRG; PAM sequence: TGG
aatatgccctgtccctgaac

SEQ ID NO: 15433 - DNA, 20 bp, Artificial Sequence
  Description of Artificial Sequence: Synthetic oligonucleotide
  Target: FXN; (+) strand; PAM type: NRG; PAM sequence: TAG
attgtgttaccccattccct

SEQ ID NO: 15434 - DNA, 20 bp, Artificial Sequence
  Description of Artificial Sequence: Synthetic oligonucleotide
  Target: FXN; (+) strand; PAM type: NRG; PAM sequence: CAG
ttaccccattcccttagcaa

SEQ ID NO: 15435 - DNA, 20 bp, Artificial Sequence
  Description of Artificial Sequence: Synthetic oligonucleotide
  Target: FXN; (+) strand; PAM type: NRG; PAM sequence: AAG
agcaacagtgattgctactg

SEQ ID NO: 15436 - DNA, 20 bp, Artificial Sequence
  Description of Artificial Sequence: Synthetic oligonucleotide
  Target: FXN; (+) strand; PAM type: NRG; PAM sequence: CAG
agtgattgctactgaagaaa

SEQ ID NO: 15437 - DNA, 20 bp, Artificial Sequence
  Description of Artificial Sequence: Synthetic oligonucleotide
  Target: FXN; (+) strand; PAM type: NRG; PAM sequence: AGG
gtgattgctactgaagaaac

SEQ ID NO: 15438 - DNA, 20 bp, Artificial Sequence
  Description of Artificial Sequence: Synthetic oligonucleotide
  Target: FXN; (+) strand; PAM type: NRG; PAM sequence: GAG
gattgctactgaagaaacag

SEQ ID NO: 15439 - DNA, 20 bp, Artificial Sequence
  Description of Artificial Sequence: Synthetic oligonucleotide
  Target: FXN; (+) strand; PAM type: NRG; PAM sequence: AGG
attgctactgaagaaacagg

SEQ ID NO: 15440 - DNA, 20 bp, Artificial Sequence
  Description of Artificial Sequence: Synthetic oligonucleotide
  Target: FXN; (+) strand; PAM type: NRG; PAM sequence: AAG
gaagaaacaggaggccaaca

SEQ ID NO: 15441 - DNA, 20 bp, Artificial Sequence
  Description of Artificial Sequence: Synthetic oligonucleotide
  Target: FXN; (+) strand; PAM type: NRG; PAM sequence: CAG
aaagaatatcactcattcac

SEQ ID NO: 15442 - DNA, 20 bp, Artificial Sequence
  Description of Artificial Sequence: Synthetic oligonucleotide
  Target: FXN; (+) strand; PAM type: NRG; PAM sequence: TAG
gaatatcactcattcaccag

SEQ ID NO: 15443 - DNA, 20 bp, Artificial Sequence
  Description of Artificial Sequence: Synthetic oligonucleotide
  Target: FXN; (+) strand; PAM type: NRG; PAM sequence: GAG
atatcactcattcaccagta

SEQ ID NO: 15444 - DNA, 20 bp, Artificial Sequence
  Description of Artificial Sequence: Synthetic oligonucleotide
  Target: FXN; (+) strand; PAM type: NRG; PAM sequence: CAG
caccagtagagtgtctatgt

SEQ ID NO: 15445 - DNA, 20 bp, Artificial Sequence
  Description of Artificial Sequence: Synthetic oligonucleotide
  Target: FXN; (+) strand; PAM type: NRG; PAM sequence: GAG
ccagtagagtgtctatgtca

SEQ ID NO: 15446 - DNA, 20 bp, Artificial Sequence
  Description of Artificial Sequence: Synthetic oligonucleotide
  Target: FXN; (+) strand; PAM type: NRG; PAM sequence: TAG
agtgtctatgtcagagatat

SEQ ID NO: 15447 - DNA, 20 bp, Artificial Sequence
  Description of Artificial Sequence: Synthetic oligonucleotide
  Target: FXN; (+) strand; PAM type: NRG; PAM sequence: CAG
tgtcagagatattagataaa

SEQ ID NO: 15448 - DNA, 20 bp, Artificial Sequence
  Description of Artificial Sequence: Synthetic oligonucleotide
  Target: FXN; (+) strand; PAM type: NRG; PAM sequence: AGG
gtcagagatattagataaac

SEQ ID NO: 15449 - DNA, 20 bp, Artificial Sequence
  Description of Artificial Sequence: Synthetic oligonucleotide
  Target: FXN; (+) strand; PAM type: NRG; PAM sequence: CAG
gaaaactaacaattacattg

SEQ ID NO: 15450 - DNA, 20 bp, Artificial Sequence
  Description of Artificial Sequence: Synthetic oligonucleotide
  Target: FXN; (+) strand; PAM type: NRG; PAM sequence: AGG
aaaactaacaattacattgc

SEQ ID NO: 15451 - DNA, 20 bp, Artificial Sequence
  Description of Artificial Sequence: Synthetic oligonucleotide
  Target: FXN; (+) strand; PAM type: NRG; PAM sequence: TGG
aacaattacattgcaggctg

SEQ ID NO: 15452 - DNA, 20 bp, Artificial Sequence
  Description of Artificial Sequence: Synthetic oligonucleotide
  Target: FXN; (+) strand; PAM type: NRG; PAM sequence: CAG
tacattgcaggctgtggaaa

SEQ ID NO: 15453 - DNA, 20 bp, Artificial Sequence
  Description of Artificial Sequence: Synthetic oligonucleotide
  Target: FXN; (+) strand; PAM type: NRG; PAM sequence: GAG
cattgcaggctgtggaaaca

SEQ ID NO: 15454 - DNA, 20 bp, Artificial Sequence
  Description of Artificial Sequence: Synthetic oligonucleotide
  Target: FXN; (+) strand; PAM type: NRG; PAM sequence: GAG
ttgcaggctgtggaaacaga

SEQ ID NO: 15455 - DNA, 20 bp, Artificial Sequence
  Description of Artificial Sequence: Synthetic oligonucleotide
  Target: FXN; (+) strand; PAM type: NRG; PAM sequence: GAG
gcaggctgtggaaacagaga

SEQ ID NO: 15456 - DNA, 20 bp, Artificial Sequence
  Description of Artificial Sequence: Synthetic oligonucleotide
  Target: FXN; (+) strand; PAM type: NRG; PAM sequence: AGG
caggctgtggaaacagagag

SEQ ID NO: 15457 - DNA, 20 bp, Artificial Sequence
  Description of Artificial Sequence: Synthetic oligonucleotide
  Target: FXN; (+) strand; PAM type: NRG; PAM sequence: AAG
ggaaacagagagaggtacct

SEQ ID NO: 15458 - DNA, 20 bp, Artificial Sequence
  Description of Artificial Sequence: Synthetic oligonucleotide
  Target: FXN; (+) strand; PAM type: NRG; PAM sequence: AGG
gaaacagagagaggtaccta

SEQ ID NO: 15459 - DNA, 20 bp, Artificial Sequence
  Description of Artificial Sequence: Synthetic oligonucleotide
  Target: FXN; (+) strand; PAM type: NRG; PAM sequence: TGG
aggtacctaaggcacacctg

SEQ ID NO: 15460 - DNA, 20 bp, Artificial Sequence
  Description of Artificial Sequence: Synthetic oligonucleotide
  Target: FXN; (+) strand; PAM type: NRG; PAM sequence: GGG
ggtacctaaggcacacctgt

SEQ ID NO: 15461 - DNA, 20 bp, Artificial Sequence
  Description of Artificial Sequence: Synthetic oligonucleotide
  Target: FXN; (+) strand; PAM type: NRG; PAM sequence: AAG
gcacacctgtgggaatatga

SEQ ID NO: 15462 - DNA, 20 bp, Artificial Sequence
  Description of Artificial Sequence: Synthetic oligonucleotide
  Target: FXN; (+) strand; PAM type: NRG; PAM sequence: TGG
cctgtgggaatatgaaagtt

SEQ ID NO: 15463 - DNA, 20 bp, Artificial Sequence
  Description of Artificial Sequence: Synthetic oligonucleotide
  Target: FXN; (+) strand; PAM type: NRG; PAM sequence: AAG
atgaaagtttggtttcataa

SEQ ID NO: 15464 - DNA, 20 bp, Artificial Sequence
  Description of Artificial Sequence: Synthetic oligonucleotide
  Target: FXN; (+) strand; PAM type: NRG; PAM sequence: AGG
tgaaagtttggtttcataaa

SEQ ID NO: 15465 - DNA, 20 bp, Artificial Sequence
  Description of Artificial Sequence: Synthetic oligonucleotide
  Target: FXN; (+) strand; PAM type: NRG; PAM sequence: TGG
ttggtttcataaaaggattc

SEQ ID NO: 15466 - DNA, 20 bp, Artificial Sequence
  Description of Artificial Sequence: Synthetic oligonucleotide
  Target: FXN; (+) strand; PAM type: NRG; PAM sequence: GAG
ggtttcataaaaggattctg

SEQ ID NO: 15467 - DNA, 20 bp, Artificial Sequence
  Description of Artificial Sequence: Synthetic oligonucleotide
  Target: FXN; (+) strand; PAM type: NRG; PAM sequence: AGG
gtttcataaaaggattctgg

SEQ ID NO: 15468 - DNA, 20 bp, Artificial Sequence
  Description of Artificial Sequence: Synthetic oligonucleotide
  Target: FXN; (+) strand; PAM type: NRG; PAM sequence: AAG
tcataaaaggattctggagg

SEQ ID NO: 15469 - DNA, 20 bp, Artificial Sequence
  Description of Artificial Sequence: Synthetic oligonucleotide
  Target: FXN; (+) strand; PAM type: NRG; PAM sequence: GAG
ggaagtcacctctgacattt

SEQ ID NO: 15470 - DNA, 20 bp, Artificial Sequence
  Description of Artificial Sequence: Synthetic oligonucleotide
  Target: FXN; (+) strand; PAM type: NRG; PAM sequence: GAG
tcacctctgacatttgagtt

SEQ ID NO: 15471 - DNA, 20 bp, Artificial Sequence
  Description of Artificial Sequence: Synthetic oligonucleotide
  Target: FXN; (+) strand; PAM type: NRG; PAM sequence: CAG
gacatttgagttgagtccta

SEQ ID NO: 15472 - DNA, 20 bp, Artificial Sequence
  Description of Artificial Sequence: Synthetic oligonucleotide
  Target: FXN; (+) strand; PAM type: NRG; PAM sequence: AGG
acatttgagttgagtcctac

SEQ ID NO: 15473 - DNA, 20 bp, Artificial Sequence
  Description of Artificial Sequence: Synthetic oligonucleotide
  Target: FXN; (+) strand; PAM type: NRG; PAM sequence: AAG
gttgagtcctacaggatatg

SEQ ID NO: 15474 - DNA, 20 bp, Artificial Sequence
  Description of Artificial Sequence: Synthetic oligonucleotide
  Target: FXN; (+) strand; PAM type: NRG; PAM sequence: AAG
agtcctacaggatatgaaga

SEQ ID NO: 15475 - DNA, 20 bp, Artificial Sequence
  Description of Artificial Sequence: Synthetic oligonucleotide
  Target: FXN; (+) strand; PAM type: NRG; PAM sequence: TAG
cctacaggatatgaagaaag

SEQ ID NO: 15476 - DNA, 20 bp, Artificial Sequence
  Description of Artificial Sequence: Synthetic oligonucleotide
  Target: FXN; (+) strand; PAM type: NRG; PAM sequence: CGG
aagaaagtagccccatgttc

SEQ ID NO: 15477 - DNA, 20 bp, Artificial Sequence
  Description of Artificial Sequence: Synthetic oligonucleotide
  Target: FXN; (+) strand; PAM type: NRG; PAM sequence: TGG
gccccatgttccggttacta

SEQ ID NO: 15478 - DNA, 20 bp, Artificial Sequence
  Description of Artificial Sequence: Synthetic oligonucleotide
  Target: FXN; (+) strand; PAM type: NRG; PAM sequence: TGG
ataaattacctaaaacatac

SEQ ID NO: 15479 - DNA, 20 bp, Artificial Sequence
  Description of Artificial Sequence: Synthetic oligonucleotide
  Target: FXN; (+) strand; PAM type: NRG; PAM sequence: AAG
acctaaaacatactggatta

SEQ ID NO: 15480 - DNA, 20 bp, Artificial Sequence
  Description of Artificial Sequence: Synthetic oligonucleotide
  Target: FXN; (+) strand; PAM type: NRG; PAM sequence: CAG
atgaaaacatcttttctgcc

SEQ ID NO: 15481 - DNA, 20 bp, Artificial Sequence
  Description of Artificial Sequence: Synthetic oligonucleotide
  Target: FXN; (+) strand; PAM type: NRG; PAM sequence: GAG
gaaaacatcttttctgccca

SEQ ID NO: 15482 - DNA, 20 bp, Artificial Sequence
  Description of Artificial Sequence: Synthetic oligonucleotide
  Target: FXN; (+) strand; PAM type: NRG; PAM sequence: TGG
ttttctgcccagagattctg

SEQ ID NO: 15483 - DNA, 20 bp, Artificial Sequence
  Description of Artificial Sequence: Synthetic oligonucleotide
  Target: FXN; (+) strand; PAM type: NRG; PAM sequence: GGG
tttctgcccagagattctgt

SEQ ID NO: 15484 - DNA, 20 bp, Artificial Sequence
  Description of Artificial Sequence: Synthetic oligonucleotide
  Target: FXN; (+) strand; PAM type: NRG; PAM sequence: TGG
ctgtgggcctgaaattcaca

SEQ ID NO: 15485 - DNA, 20 bp, Artificial Sequence
  Description of Artificial Sequence: Synthetic oligonucleotide
  Target: FXN; (+) strand; PAM type: NRG; PAM sequence: AAG
gaaattcacatggaacacat

SEQ ID NO: 15486 - DNA, 20 bp, Artificial Sequence
  Description of Artificial Sequence: Synthetic oligonucleotide
  Target: FXN; (+) strand; PAM type: NRG; PAM sequence: AGG
aaattcacatggaacacata

SEQ ID NO: 15487 - DNA, 20 bp, Artificial Sequence
  Description of Artificial Sequence: Synthetic oligonucleotide
  Target: FXN; (+) strand; PAM type: NRG; PAM sequence: AAG
gtttctgctccatgatgtct

SEQ ID NO: 15488 - DNA, 20 bp, Artificial Sequence
  Description of Artificial Sequence: Synthetic oligonucleotide
  Target: FXN; (+) strand; PAM type: NRG; PAM sequence: AGG
tttctgctccatgatgtcta

SEQ ID NO: 15489 - DNA, 20 bp, Artificial Sequence
  Description of Artificial Sequence: Synthetic oligonucleotide
  Target: FXN; (+) strand; PAM type: NRG; PAM sequence: CAG
ctccatgatgtctaaggatt

SEQ ID NO: 15490 - DNA, 20 bp, Artificial Sequence
  Description of Artificial Sequence: Synthetic oligonucleotide
  Target: FXN; (+) strand; PAM type: NRG; PAM sequence: TGG
atgatgtctaaggattcagc

SEQ ID NO: 15491 - DNA, 20 bp, Artificial Sequence
  Description of Artificial Sequence: Synthetic oligonucleotide
  Target: FXN; (+) strand; PAM type: NRG; PAM sequence: AAG
atgtctaaggattcagctgg

SEQ ID NO: 15492 - DNA, 20 bp, Artificial Sequence
  Description of Artificial Sequence: Synthetic oligonucleotide
  Target: FXN; (+) strand; PAM type: NRG; PAM sequence: TGG
taaggattcagctggaagac

SEQ ID NO: 15493 - DNA, 20 bp, Artificial Sequence
  Description of Artificial Sequence: Synthetic oligonucleotide
  Target: FXN; (+) strand; PAM type: NRG; PAM sequence: GGG
aaggattcagctggaagact

SEQ ID NO: 15494 - DNA, 20 bp, Artificial Sequence
  Description of Artificial Sequence: Synthetic oligonucleotide
  Target: FXN; (+) strand; PAM type: NRG; PAM sequence: GAG
ggattcagctggaagactgg

SEQ ID NO: 15495 - DNA, 20 bp, Artificial Sequence
  Description of Artificial Sequence: Synthetic oligonucleotide
  Target: FXN; (+) strand; PAM type: NRG; PAM sequence: AGG
gattcagctggaagactggg

SEQ ID NO: 15496 - DNA, 20 bp, Artificial Sequence
  Description of Artificial Sequence: Synthetic oligonucleotide
  Target: FXN; (+) strand; PAM type: NRG; PAM sequence: TGG
cagctggaagactgggaggc

SEQ ID NO: 15497 - DNA, 20 bp, Artificial Sequence
  Description of Artificial Sequence: Synthetic oligonucleotide
  Target: FXN; (+) strand; PAM type: NRG; PAM sequence: GGG
agctggaagactgggaggct

SEQ ID NO: 15498 - DNA, 20 bp, Artificial Sequence
  Description of Artificial Sequence: Synthetic oligonucleotide
  Target: FXN; (+) strand; PAM type: NRG; PAM sequence: GGG
gctggaagactgggaggctg

SEQ ID NO: 15499 - DNA, 20 bp, Artificial Sequence
  Description of Artificial Sequence: Synthetic oligonucleotide
  Target: FXN; (+) strand; PAM type: NRG; PAM sequence: GGG
ctggaagactgggaggctgg

SEQ ID NO: 15500 - DNA, 20 bp, Artificial Sequence
  Description of Artificial Sequence: Synthetic oligonucleotide
  Target: FXN; (+) strand; PAM type: NRG; PAM sequence: TGG
aagactgggaggctgggggc

SEQ ID NO: 15501 - DNA, 20 bp, Artificial Sequence
  Description of Artificial Sequence: Synthetic oligonucleotide
  Target: FXN; (+) strand; PAM type: NRG; PAM sequence: AAG
tgggggctggaatttatctg

SEQ ID NO: 15502 - DNA, 20 bp, Artificial Sequence
  Description of Artificial Sequence: Synthetic oligonucleotide
  Target: FXN; (+) strand; PAM type: NRG; PAM sequence: TGG
tgactcatttacatgtctac

SEQ ID NO: 15503 - DNA, 20 bp, Artificial Sequence
  Description of Artificial Sequence: Synthetic oligonucleotide
  Target: FXN; (+) strand; PAM type: NRG; PAM sequence: TGG
acatgtctactggttgaccc

SEQ ID NO: 15504 - DNA, 20 bp, Artificial Sequence
  Description of Artificial Sequence: Synthetic oligonucleotide
  Target: FXN; (+) strand; PAM type: NRG; PAM sequence: TGG
tactggttgaccctggctgt

SEQ ID NO: 15505 - DNA, 20 bp, Artificial Sequence
  Description of Artificial Sequence: Synthetic oligonucleotide
  Target: FXN; (+) strand; PAM type: NRG; PAM sequence: GAG
gttgaccctggctgttggct

SEQ ID NO: 15506 - DNA, 20 bp, Artificial Sequence
  Description of Artificial Sequence: Synthetic oligonucleotide
  Target: FXN; (+) strand; PAM type: NRG; PAM sequence: AGG
ttgaccctggctgttggctg

SEQ ID NO: 15507 - DNA, 20 bp, Artificial Sequence
  Description of Artificial Sequence: Synthetic oligonucleotide
  Target: FXN; (+) strand; PAM type: NRG; PAM sequence: GGG
tgaccctggctgttggctga

SEQ ID NO: 15508 - DNA, 20 bp, Artificial Sequence
  Description of Artificial Sequence: Synthetic oligonucleotide
  Target: FXN; (+) strand; PAM type: NRG; PAM sequence: GGG
gaccctggctgttggctgag

SEQ ID NO: 15509 - DNA, 20 bp, Artificial Sequence
  Description of Artificial Sequence: Synthetic oligonucleotide
  Target: FXN; (+) strand; PAM type: NRG; PAM sequence: GGG
accctggctgttggctgagg

SEQ ID NO: 15510 - DNA, 20 bp, Artificial Sequence
  Description of Artificial Sequence: Synthetic oligonucleotide
  Target: FXN; (+) strand; PAM type: NRG; PAM sequence: CAG
gctgttggctgagggggcct

SEQ ID NO: 15511 - DNA, 20 bp, Artificial Sequence
  Description of Artificial Sequence: Synthetic oligonucleotide
  Target: FXN; (+) strand; PAM type: NRG; PAM sequence: TGG
tctacattgtttctctactt

SEQ ID NO: 15512 - DNA, 20 bp, Artificial Sequence
  Description of Artificial Sequence: Synthetic oligonucleotide
  Target: FXN; (+) strand; PAM type: NRG; PAM sequence: TAG
cattgtttctctactttggc

SEQ ID NO: 15513 - DNA, 20 bp, Artificial Sequence
  Description of Artificial Sequence: Synthetic oligonucleotide
  Target: FXN; (+) strand; PAM type: NRG; PAM sequence: TGG
tttctctactttggctagtt

SEQ ID NO: 15514 - DNA, 20 bp, Artificial Sequence
  Description of Artificial Sequence: Synthetic oligonucleotide
  Target: FXN; (+) strand; PAM type: NRG; PAM sequence: TGG
tggatttcctcaaaacatga

SEQ ID NO: 15515 - DNA, 20 bp, Artificial Sequence
  Description of Artificial Sequence: Synthetic oligonucleotide
  Target: FXN; (+) strand; PAM type: NRG; PAM sequence: TGG
tttcctcaaaacatgatggc

SEQ ID NO: 15516 - DNA, 20 bp, Artificial Sequence
  Description of Artificial Sequence: Synthetic oligonucleotide
  Target: FXN; (+) strand; PAM type: NRG; PAM sequence: CAG
aaaacatgatggctggtcct

SEQ ID NO: 15517 - DNA, 20 bp, Artificial Sequence
  Description of Artificial Sequence: Synthetic oligonucleotide
  Target: FXN; (+) strand; PAM type: NRG; PAM sequence: CAG
tgatggctggtcctcagtgt

SEQ ID NO: 15518 - DNA, 20 bp, Artificial Sequence
  Description of Artificial Sequence: Synthetic oligonucleotide
  Target: FXN; (+) strand; PAM type: NRG; PAM sequence: AAG
ctcagtgtcagcatcccaaa

SEQ ID NO: 15519 - DNA, 20 bp, Artificial Sequence
  Description of Artificial Sequence: Synthetic oligonucleotide
  Target: FXN; (+) strand; PAM type: NRG; PAM sequence: GAG
cagtgtcagcatcccaaaaa

SEQ ID NO: 15520 - DNA, 20 bp, Artificial Sequence
  Description of Artificial Sequence: Synthetic oligonucleotide
  Target: FXN; (+) strand; PAM type: NRG; PAM sequence: CGG
gcatcccaaaaagagaatgc

SEQ ID NO: 15521 - DNA, 20 bp, Artificial Sequence
  Description of Artificial Sequence: Synthetic oligonucleotide
  Target: FXN; (+) strand; PAM type: NRG; PAM sequence: CAG
caaaaagagaatgccggaca

SEQ ID NO: 15522 - DNA, 20 bp, Artificial Sequence
  Description of Artificial Sequence: Synthetic oligonucleotide
  Target: FXN; (+) strand; PAM type: NRG; PAM sequence: TGG
aaagagaatgccggacacag

SEQ ID NO: 15523 - DNA, 20 bp, Artificial Sequence
  Description of Artificial Sequence: Synthetic oligonucleotide
  Target: FXN; (+) strand; PAM type: NRG; PAM sequence: CAG
gtggctcacacctgtaacct

SEQ ID NO: 15524 - DNA, 20 bp, Artificial Sequence
  Description of Artificial Sequence: Synthetic oligonucleotide
  Target: FXN; (+) strand; PAM type: NRG; PAM sequence: TGG
cacctgtaacctcagcaatt

SEQ ID NO: 15525 - DNA, 20 bp, Artificial Sequence
  Description of Artificial Sequence: Synthetic oligonucleotide
  Target: FXN; (+) strand; PAM type: NRG; PAM sequence: GGG
acctgtaacctcagcaattt

SEQ ID NO: 15526 - DNA, 20 bp, Artificial Sequence
  Description of Artificial Sequence: Synthetic oligonucleotide
  Target: FXN; (+) strand; PAM type: NRG; PAM sequence: GAG
ctgtaacctcagcaatttgg

SEQ ID NO: 15527 - DNA, 20 bp, Artificial Sequence
  Description of Artificial Sequence: Synthetic oligonucleotide
  Target: FXN; (+) strand; PAM type: NRG; PAM sequence: AGG
tgtaacctcagcaatttggg

SEQ ID NO: 15528 - DNA, 20 bp, Artificial Sequence
  Description of Artificial Sequence: Synthetic oligonucleotide
  Target: FXN; (+) strand; PAM type: NRG; PAM sequence: GAG
cctcagcaatttgggaggct

SEQ ID NO: 15529 - DNA, 20 bp, Artificial Sequence
  Description of Artificial Sequence: Synthetic oligonucleotide
  Target: FXN; (+) strand; PAM type: NRG; PAM sequence: AGG
ctcagcaatttgggaggctg

SEQ ID NO: 15530 - DNA, 20 bp, Artificial Sequence
  Description of Artificial Sequence: Synthetic oligonucleotide
  Target: FXN; (+) strand; PAM type: NRG; PAM sequence: TGG
agcaatttgggaggctgagg

SEQ ID NO: 15531 - DNA, 20 bp, Artificial Sequence
  Description of Artificial Sequence: Synthetic oligonucleotide
  Target: FXN; (+) strand; PAM type: NRG; PAM sequence: GGG
gcaatttgggaggctgaggt

SEQ ID NO: 15532 - DNA, 20 bp, Artificial Sequence
  Description of Artificial Sequence: Synthetic oligonucleotide
  Target: FXN; (+) strand; PAM type: NRG; PAM sequence: GAG
aatttgggaggctgaggtgg

SEQ ID NO: 15533 - DNA, 20 bp, Artificial Sequence
  Description of Artificial Sequence: Synthetic oligonucleotide
  Target: FXN; (+) strand; PAM type: NRG; PAM sequence: AGG
atttgggaggctgaggtggg

SEQ ID NO: 15534 - DNA, 20 bp, Artificial Sequence
  Description of Artificial Sequence: Synthetic oligonucleotide
  Target: FXN; (+) strand; PAM type: NRG; PAM sequence: GAG
gctgaggtgggaggttgctt

SEQ ID NO: 15535 - DNA, 20 bp, Artificial Sequence
  Description of Artificial Sequence: Synthetic oligonucleotide
  Target: FXN; (+) strand; PAM type: NRG; PAM sequence: CAG
ggtgggaggttgcttgagtt

SEQ ID NO: 15536 - DNA, 20 bp, Artificial Sequence
  Description of Artificial Sequence: Synthetic oligonucleotide
  Target: FXN; (+) strand; PAM type: NRG; PAM sequence: AGG
gtgggaggttgcttgagttc

SEQ ID NO: 15537 - DNA, 20 bp, Artificial Sequence
  Description of Artificial Sequence: Synthetic oligonucleotide
  Target: FXN; (+) strand; PAM type: NRG; PAM sequence: GAG
gggaggttgcttgagttcag

SEQ ID NO: 15538 - DNA, 20 bp, Artificial Sequence
  Description of Artificial Sequence: Synthetic oligonucleotide
  Target: FXN; (+) strand; PAM type: NRG; PAM sequence: AAG
ttgcttgagttcaggagttc

SEQ ID NO: 15539 - DNA, 20 bp, Artificial Sequence
  Description of Artificial Sequence: Synthetic oligonucleotide
  Target: FXN; (+) strand; PAM type: NRG; PAM sequence: CAG
tgagttcaggagttcaagac

SEQ ID NO: 15540 - DNA, 20 bp, Artificial Sequence
  Description of Artificial Sequence: Synthetic oligonucleotide
  Target: FXN; (+) strand; PAM type: NRG; PAM sequence: TGG
tcaggagttcaagaccagcc

SEQ ID NO: 15541 - DNA, 20 bp, Artificial Sequence
  Description of Artificial Sequence: Synthetic oligonucleotide
  Target: FXN; (+) strand; PAM type: NRG; PAM sequence: GGG
caggagttcaagaccagcct

SEQ ID NO: 15542 - DNA, 20 bp, Artificial Sequence
  Description of Artificial Sequence: Synthetic oligonucleotide
  Target: FXN; (+) strand; PAM type: NRG; PAM sequence: TAG
caagaccagcctgggcaaca

SEQ ID NO: 15543 - DNA, 20 bp, Artificial Sequence
  Description of Artificial Sequence: Synthetic oligonucleotide
  Target: FXN; (+) strand; PAM type: NRG; PAM sequence: GAG
accagcctgggcaacatagt

SEQ ID NO: 15544 - DNA, 20 bp, Artificial Sequence
  Description of Artificial Sequence: Synthetic oligonucleotide
  Target: FXN; (+) strand; PAM type: NRG; PAM sequence: CAG
atttttaaaattttaaaaat

SEQ ID NO: 15545 - DNA, 20 bp, Artificial Sequence
  Description of Artificial Sequence: Synthetic oligonucleotide
  Target: FXN; (+) strand; PAM type: NRG; PAM sequence: CAG
ttaaaattttaaaaatcagc

SEQ ID NO: 15546 - DNA, 20 bp, Artificial Sequence
  Description of Artificial Sequence: Synthetic oligonucleotide
  Target: FXN; (+) strand; PAM type: NRG; PAM sequence: AGG
taaaattttaaaaatcagcc

SEQ ID NO: 15547 - DNA, 20 bp, Artificial Sequence
  Description of Artificial Sequence: Synthetic oligonucleotide
  Target: FXN; (+) strand; PAM type: NRG; PAM sequence: TGG
ttttaaaaatcagccaggtg

SEQ ID NO: 15548 - DNA, 20 bp, Artificial Sequence
  Description of Artificial Sequence: Synthetic oligonucleotide
  Target: FXN; (+) strand; PAM type: NRG; PAM sequence: TAG
ggtgtggttatgcacaccta

SEQ ID NO: 15549 - DNA, 20 bp, Artificial Sequence
  Description of Artificial Sequence: Synthetic oligonucleotide
  Target: FXN; (+) strand; PAM type: NRG; PAM sequence: CAG
gttatgcacacctatagtcc

SEQ ID NO: 15550 - DNA, 20 bp, Artificial Sequence
  Description of Artificial Sequence: Synthetic oligonucleotide
  Target: FXN; (+) strand; PAM type: NRG; PAM sequence: TAG
cacctatagtcccagttact

SEQ ID NO: 15551 - DNA, 20 bp, Artificial Sequence
  Description of Artificial Sequence: Synthetic oligonucleotide
  Target: FXN; (+) strand; PAM type: NRG; PAM sequence: AGG
acctatagtcccagttactt

SEQ ID NO: 15552 - DNA, 20 bp, Artificial Sequence
  Description of Artificial Sequence: Synthetic oligonucleotide
  Target: FXN; (+) strand; PAM type: NRG; PAM sequence: GAG
ctatagtcccagttacttag

SEQ ID NO: 15553 - DNA, 20 bp, Artificial Sequence
  Description of Artificial Sequence: Synthetic oligonucleotide
  Target: FXN; (+) strand; PAM type: NRG; PAM sequence: AGG
tatagtcccagttacttagg

SEQ ID NO: 15554 - DNA, 20 bp, Artificial Sequence
  Description of Artificial Sequence: Synthetic oligonucleotide
  Target: FXN; (+) strand; PAM type: NRG; PAM sequence: GAG
tcccagttacttaggaggct

SEQ ID NO: 15555 - DNA, 20 bp, Artificial Sequence
  Description of Artificial Sequence: Synthetic oligonucleotide
  Target: FXN; (+) strand; PAM type: NRG; PAM sequence: AGG
cccagttacttaggaggctg

SEQ ID NO: 15556 - DNA, 20 bp, Artificial Sequence
  Description of Artificial Sequence: Synthetic oligonucleotide
  Target: FXN; (+) strand; PAM type: NRG; PAM sequence: CAG
agttacttaggaggctgagg

SEQ ID NO: 15557 - DNA, 20 bp, Artificial Sequence
  Description of Artificial Sequence: Synthetic oligonucleotide
  Target: FXN; (+) strand; PAM type: NRG; PAM sequence: AGG
gttacttaggaggctgaggc

SEQ ID NO: 15558 - DNA, 20 bp, Artificial Sequence
  Description of Artificial Sequence: Synthetic oligonucleotide
  Target: FXN; (+) strand; PAM type: NRG; PAM sequence: GAG
tacttaggaggctgaggcag

SEQ ID NO: 15559 - DNA, 20 bp, Artificial Sequence
  Description of Artificial Sequence: Synthetic oligonucleotide
  Target: FXN; (+) strand; PAM type: NRG; PAM sequence: AGG
acttaggaggctgaggcagg

SEQ ID NO: 15560 - DNA, 20 bp, Artificial Sequence
  Description of Artificial Sequence: Synthetic oligonucleotide
  Target: FXN; (+) strand; PAM type: NRG; PAM sequence: CAG
gcaggaggatcacttgattc

SEQ ID NO: 15561 - DNA, 20 bp, Artificial Sequence
  Description of Artificial Sequence: Synthetic oligonucleotide
  Target: FXN; (+) strand; PAM type: NRG; PAM sequence: AGG
caggaggatcacttgattcc

SEQ ID NO: 15562 - DNA, 20 bp, Artificial Sequence
  Description of Artificial Sequence: Synthetic oligonucleotide
  Target: FXN; (+) strand; PAM type: NRG; PAM sequence: GAG
ggaggatcacttgattccag

SEQ ID NO: 15563 - DNA, 20 bp, Artificial Sequence
  Description of Artificial Sequence: Synthetic oligonucleotide
  Target: FXN; (+) strand; PAM type: NRG; PAM sequence: AGG
gaggatcacttgattccagg

SEQ ID NO: 15564 - DNA, 20 bp, Artificial Sequence
  Description of Artificial Sequence: Synthetic oligonucleotide
  Target: FXN; (+) strand; PAM type: NRG; PAM sequence: AAG
tcacttgattccaggaggtc

SEQ ID NO: 15565 - DNA, 20 bp, Artificial Sequence
  Description of Artificial Sequence: Synthetic oligonucleotide
  Target: FXN; (+) strand; PAM type: NRG; PAM sequence: AGG
cacttgattccaggaggtca

SEQ ID NO: 15566 - DNA, 20 bp, Artificial Sequence
  Description of Artificial Sequence: Synthetic oligonucleotide
  Target: FXN; (+) strand; PAM type: NRG; PAM sequence: GAG
caggaggtcaaggctgctgt

SEQ ID NO: 15567 - DNA, 20 bp, Artificial Sequence
  Description of Artificial Sequence: Synthetic oligonucleotide
  Target: FXN; (+) strand; PAM type: NRG; PAM sequence: CAG
atgaccacaccactgcattt

SEQ ID NO: 15568 - DNA, 20 bp, Artificial Sequence
  Description of Artificial Sequence: Synthetic oligonucleotide
  Target: FXN; (+) strand; PAM type: NRG; PAM sequence: TGG
cacaccactgcatttcagcc

SEQ ID NO: 15569 - DNA, 20 bp, Artificial Sequence
  Description of Artificial Sequence: Synthetic oligonucleotide
  Target: FXN; (+) strand; PAM type: NRG; PAM sequence: GGG
acaccactgcatttcagcct

SEQ ID NO: 15570 - DNA, 20 bp, Artificial Sequence
  Description of Artificial Sequence: Synthetic oligonucleotide
  Target: FXN; (+) strand; PAM type: NRG; PAM sequence: CAG
ctgcatttcagcctgggtaa

SEQ ID NO: 15571 - DNA, 20 bp, Artificial Sequence
  Description of Artificial Sequence: Synthetic oligonucleotide
  Target: FXN; (+) strand; PAM type: NRG; PAM sequence: GAG
ttcagcctgggtaacagaat

SEQ ID NO: 15572 - DNA, 20 bp, Artificial Sequence
  Description of Artificial Sequence: Synthetic oligonucleotide
  Target: FXN; (+) strand; PAM type: NRG; PAM sequence: AAG
aaaaacccaaaaaaaaaaaa

SEQ ID NO: 15573 - DNA, 20 bp, Artificial Sequence
  Description of Artificial Sequence: Synthetic oligonucleotide
  Target: FXN; (+) strand; PAM type: NRG; PAM sequence: GAG
aaacccaaaaaaaaaaaaaa

SEQ ID NO: 15574 - DNA, 20 bp, Artificial Sequence
  Description of Artificial Sequence: Synthetic oligonucleotide
  Target: FXN; (+) strand; PAM type: NRG; PAM sequence: GAG
acccaaaaaaaaaaaaaaga

SEQ ID NO: 15575 - DNA, 20 bp, Artificial Sequence
  Description of Artificial Sequence: Synthetic oligonucleotide
  Target: FXN; (+) strand; PAM type: NRG; PAM sequence: GAG
ccaaaaaaaaaaaaaagaga

SEQ ID NO: 15576 - DNA, 20 bp, Artificial Sequence
  Description of Artificial Sequence: Synthetic oligonucleotide
  Target: FXN; (+) strand; PAM type: NRG; PAM sequence: GAG
aaaaaaaaaaaaaagagaga

SEQ ID NO: 15577 - DNA, 20 bp, Artificial Sequence
  Description of Artificial Sequence: Synthetic oligonucleotide
  Target: FXN; (+) strand; PAM type: NRG; PAM sequence: GAG
aaaaaaaaaaaagagagaga

SEQ ID NO: 15578 - DNA, 20 bp, Artificial Sequence
  Description of Artificial Sequence: Synthetic oligonucleotide
  Target: FXN; (+) strand; PAM type: NRG; PAM sequence: AGG
aaaaaaaaaaagagagagag

SEQ ID NO: 15579 - DNA, 20 bp, Artificial Sequence
  Description of Artificial Sequence: Synthetic oligonucleotide
  Target: FXN; (+) strand; PAM type: NRG; PAM sequence: GGG
aaaaaaaaaagagagagaga

SEQ ID NO: 15580 - DNA, 20 bp, Artificial Sequence
  Description of Artificial Sequence: Synthetic oligonucleotide
  Target: FXN; (+) strand; PAM type: NRG; PAM sequence: GAG
aaaaaaaagagagagagagg

SEQ ID NO: 15581 - DNA, 20 bp, Artificial Sequence
  Description of Artificial Sequence: Synthetic oligonucleotide
  Target: FXN; (+) strand; PAM type: NRG; PAM sequence: TAG
aaaagagagagagagggagt

SEQ ID NO: 15582 - DNA, 20 bp, Artificial Sequence
  Description of Artificial Sequence: Synthetic oligonucleotide
  Target: FXN; (+) strand; PAM type: NRG; PAM sequence: AAG
agagagagagagggagttag

SEQ ID NO: 15583 - DNA, 20 bp, Artificial Sequence
  Description of Artificial Sequence: Synthetic oligonucleotide
  Target: FXN; (+) strand; PAM type: NRG; PAM sequence: AGG
gagagagagagggagttaga

SEQ ID NO: 15584 - DNA, 20 bp, Artificial Sequence
  Description of Artificial Sequence: Synthetic oligonucleotide
  Target: FXN; (+) strand; PAM type: NRG; PAM sequence: AAG
agagagagggagttagaagg

SEQ ID NO: 15585 - DNA, 20 bp, Artificial Sequence
  Description of Artificial Sequence: Synthetic oligonucleotide
  Target: FXN; (+) strand; PAM type: NRG; PAM sequence: TGG
gatgcatcatttttatgacc

SEQ ID NO: 15586 - DNA, 20 bp, Artificial Sequence
  Description of Artificial Sequence: Synthetic oligonucleotide
  Target: FXN; (+) strand; PAM type: NRG; PAM sequence: TGG
tcatttttatgacctggact

SEQ ID NO: 15587 - DNA, 20 bp, Artificial Sequence
  Description of Artificial Sequence: Synthetic oligonucleotide
  Target: FXN; (+) strand; PAM type: NRG; PAM sequence: AAG
tttttatgacctggacttgg

SEQ ID NO: 15588 - DNA, 20 bp, Artificial Sequence
  Description of Artificial Sequence: Synthetic oligonucleotide
  Target: FXN; (+) strand; PAM type: NRG; PAM sequence: AAG
acctggacttggaagtcacc

SEQ ID NO: 15589 - DNA, 20 bp, Artificial Sequence
  Description of Artificial Sequence: Synthetic oligonucleotide
  Target: FXN; (+) strand; PAM type: NRG; PAM sequence: CAG
tggacttggaagtcaccaag

SEQ ID NO: 15590 - DNA, 20 bp, Artificial Sequence
  Description of Artificial Sequence: Synthetic oligonucleotide
  Target: FXN; (+) strand; PAM type: NRG; PAM sequence: CAG
gtcaccaagcagcacttctg

SEQ ID NO: 15591 - DNA, 20 bp, Artificial Sequence
  Description of Artificial Sequence: Synthetic oligonucleotide
  Target: FXN; (+) strand; PAM type: NRG; PAM sequence: TGG
gcacttctgcagtaccctgt

SEQ ID NO: 15592 - DNA, 20 bp, Artificial Sequence
  Description of Artificial Sequence: Synthetic oligonucleotide
  Target: FXN; (+) strand; PAM type: NRG; PAM sequence: TGG
ttctgcagtaccctgttggt

SEQ ID NO: 15593 - DNA, 20 bp, Artificial Sequence
  Description of Artificial Sequence: Synthetic oligonucleotide
  Target: FXN; (+) strand; PAM type: NRG; PAM sequence: TAG
cagtaccctgttggttggaa

SEQ ID NO: 15594 - DNA, 20 bp, Artificial Sequence
  Description of Artificial Sequence: Synthetic oligonucleotide
  Target: FXN; (+) strand; PAM type: NRG; PAM sequence: TAG
cctgttggttggaatagttg

SEQ ID NO: 15595 - DNA, 20 bp, Artificial Sequence
  Description of Artificial Sequence: Synthetic oligonucleotide
  Target: FXN; (+) strand; PAM type: NRG; PAM sequence: AAG
gtagcccaaacccgaattcg

SEQ ID NO: 15596 - DNA, 20 bp, Artificial Sequence
  Description of Artificial Sequence: Synthetic oligonucleotide
  Target: FXN; (+) strand; PAM type: NRG; PAM sequence: AGG
tagcccaaacccgaattcga

SEQ ID NO: 15597 - DNA, 20 bp, Artificial Sequence
  Description of Artificial Sequence: Synthetic oligonucleotide
  Target: FXN; (+) strand; PAM type: NRG; PAM sequence: GGG
agcccaaacccgaattcgaa

SEQ ID NO: 15598 - DNA, 20 bp, Artificial Sequence
  Description of Artificial Sequence: Synthetic oligonucleotide
  Target: FXN; (+) strand; PAM type: NRG; PAM sequence: GAG
cccaaacccgaattcgaagg

SEQ ID NO: 15599 - DNA, 20 bp, Artificial Sequence
  Description of Artificial Sequence: Synthetic oligonucleotide
  Target: FXN; (+) strand; PAM type: NRG; PAM sequence: AGG
ccaaacccgaattcgaaggg

SEQ ID NO: 15600 - DNA, 20 bp, Artificial Sequence
  Description of Artificial Sequence: Synthetic oligonucleotide
  Target: FXN; (+) strand; PAM type: NRG; PAM sequence: GAG
aaacccgaattcgaagggag

SEQ ID NO: 15601 - DNA, 20 bp, Artificial Sequence
  Description of Artificial Sequence: Synthetic oligonucleotide
  Target: FXN; (+) strand; PAM type: NRG; PAM sequence: TAG
cgaattcgaagggaggagaa

SEQ ID NO: 15602 - DNA, 20 bp, Artificial Sequence
  Description of Artificial Sequence: Synthetic oligonucleotide
  Target: FXN; (+) strand; PAM type: NRG; PAM sequence: TGG
aggagaatagataacatccc

SEQ ID NO: 15603 - DNA, 20 bp, Artificial Sequence
  Description of Artificial Sequence: Synthetic oligonucleotide
  Target: FXN; (+) strand; PAM type: NRG; PAM sequence: GGG
ggagaatagataacatccct

SEQ ID NO: 15604 - DNA, 20 bp, Artificial Sequence
  Description of Artificial Sequence: Synthetic oligonucleotide
  Target: FXN; (+) strand; PAM type: NRG; PAM sequence: CAG
tagataacatccctgggtga

SEQ ID NO: 15605 - DNA, 20 bp, Artificial Sequence
  Description of Artificial Sequence: Synthetic oligonucleotide
  Target: FXN; (+) strand; PAM type: NRG; PAM sequence: AGG
agataacatccctgggtgac

SEQ ID NO: 15606 - DNA, 20 bp, Artificial Sequence
  Description of Artificial Sequence: Synthetic oligonucleotide
  Target: FXN; (+) strand; PAM type: NRG; PAM sequence: AAG
cctgggtgacaggaatgtca

SEQ ID NO: 15607 - DNA, 20 bp, Artificial Sequence
  Description of Artificial Sequence: Synthetic oligonucleotide
  Target: FXN; (+) strand; PAM type: NRG; PAM sequence: CAG
aggaatgtcaaagtcccaaa

SEQ ID NO: 15608 - DNA, 20 bp, Artificial Sequence
  Description of Artificial Sequence: Synthetic oligonucleotide
  Target: FXN; (+) strand; PAM type: NRG; PAM sequence: TGG
atatgacatgtgacaaatat

SEQ ID NO: 15609 - DNA, 20 bp, Artificial Sequence
  Description of Artificial Sequence: Synthetic oligonucleotide
  Target: FXN; (+) strand; PAM type: NRG; PAM sequence: TGG
acatgtgacaaatattggtg

SEQ ID NO: 15610 - DNA, 20 bp, Artificial Sequence
  Description of Artificial Sequence: Synthetic oligonucleotide
  Target: FXN; (+) strand; PAM type: NRG; PAM sequence: TGG
aatattggtgtggccttctt

SEQ ID NO: 15611 - DNA, 20 bp, Artificial Sequence
  Description of Artificial Sequence: Synthetic oligonucleotide
  Target: FXN; (+) strand; PAM type: NRG; PAM sequence: AAG
attggtgtggccttctttgg

SEQ ID NO: 15612 - DNA, 20 bp, Artificial Sequence
  Description of Artificial Sequence: Synthetic oligonucleotide
  Target: FXN; (+) strand; PAM type: NRG; PAM sequence: CAG
gaagatccaatcttccatac

SEQ ID NO: 15613 - DNA, 20 bp, Artificial Sequence
  Description of Artificial Sequence: Synthetic oligonucleotide
  Target: FXN; (+) strand; PAM type: NRG; PAM sequence: AGG
aagatccaatcttccatacc

SEQ ID NO: 15614 - DNA, 20 bp, Artificial Sequence
  Description of Artificial Sequence: Synthetic oligonucleotide
  Target: FXN; (+) strand; PAM type: NRG; PAM sequence: AAG
ccaatcttccataccaggca

SEQ ID NO: 15615 - DNA, 20 bp, Artificial Sequence
  Description of Artificial Sequence: Synthetic oligonucleotide
  Target: FXN; (+) strand; PAM type: NRG; PAM sequence: AGG
caatcttccataccaggcaa

SEQ ID NO: 15616 - DNA, 20 bp, Artificial Sequence
  Description of Artificial Sequence: Synthetic oligonucleotide
  Target: FXN; (+) strand; PAM type: NRG; PAM sequence: GGG
aatcttccataccaggcaaa

SEQ ID NO: 15617 - DNA, 20 bp, Artificial Sequence
  Description of Artificial Sequence: Synthetic oligonucleotide
  Target: FXN; (+) strand; PAM type: NRG; PAM sequence: TGG
ttccataccaggcaaaggga

SEQ ID NO: 15618 - DNA, 20 bp, Artificial Sequence
  Description of Artificial Sequence: Synthetic oligonucleotide
  Target: FXN; (+) strand; PAM type: NRG; PAM sequence: AAG
cataccaggcaaagggatgg

SEQ ID NO: 15619 - DNA, 20 bp, Artificial Sequence
  Description of Artificial Sequence: Synthetic oligonucleotide
  Target: FXN; (+) strand; PAM type: NRG; PAM sequence: AAG
aggcaaagggatggaagact

SEQ ID NO: 15620 - DNA, 20 bp, Artificial Sequence
  Description of Artificial Sequence: Synthetic oligonucleotide
  Target: FXN; (+) strand; PAM type: NRG; PAM sequence: AGG
ggcaaagggatggaagacta

SEQ ID NO: 15621 - DNA, 20 bp, Artificial Sequence
  Description of Artificial Sequence: Synthetic oligonucleotide
  Target: FXN; (+) strand; PAM type: NRG; PAM sequence: GAG
ggaagactaaggaacaacat

SEQ ID NO: 15622 - DNA, 20 bp, Artificial Sequence
  Description of Artificial Sequence: Synthetic oligonucleotide
  Target: FXN; (+) strand; PAM type: NRG; PAM sequence: AGG
gaagactaaggaacaacatg

SEQ ID NO: 15623 - DNA, 20 bp, Artificial Sequence
  Description of Artificial Sequence: Synthetic oligonucleotide
  Target: FXN; (+) strand; PAM type: NRG; PAM sequence: GGG
aagactaaggaacaacatga

SEQ ID NO: 15624 - DNA, 20 bp, Artificial Sequence
  Description of Artificial Sequence: Synthetic oligonucleotide
  Target: FXN; (+) strand; PAM type: NRG; PAM sequence: TAG
ctaaggaacaacatgaggga

SEQ ID NO: 15625 - DNA, 20 bp, Artificial Sequence
  Description of Artificial Sequence: Synthetic oligonucleotide
  Target: FXN; (+) strand; PAM type: NRG; PAM sequence: CAG
ggaacaacatgagggatagc

SEQ ID NO: 15626 - DNA, 20 bp, Artificial Sequence
  Description of Artificial Sequence: Synthetic oligonucleotide
  Target: FXN; (+) strand; PAM type: NRG; PAM sequence: GAG
aacaacatgagggatagcca

SEQ ID NO: 15627 - DNA, 20 bp, Artificial Sequence
  Description of Artificial Sequence: Synthetic oligonucleotide
  Target: FXN; (+) strand; PAM type: NRG; PAM sequence: GAG
caacatgagggatagccaga

SEQ ID NO: 15628 - DNA, 20 bp, Artificial Sequence
  Description of Artificial Sequence: Synthetic oligonucleotide
  Target: FXN; (+) strand; PAM type: NRG; PAM sequence: AGG
aacatgagggatagccagag

SEQ ID NO: 15629 - DNA, 20 bp, Artificial Sequence
  Description of Artificial Sequence: Synthetic oligonucleotide
  Target: FXN; (+) strand; PAM type: NRG; PAM sequence: GGG
acatgagggatagccagaga

SEQ ID NO: 15630 - DNA, 20 bp, Artificial Sequence
  Description of Artificial Sequence: Synthetic oligonucleotide
  Target: FXN; (+) strand; PAM type: NRG; PAM sequence: AAG
gggatagccagagagggaaa

SEQ ID NO: 15631 - DNA, 20 bp, Artificial Sequence
  Description of Artificial Sequence: Synthetic oligonucleotide
  Target: FXN; (+) strand; PAM type: NRG; PAM sequence: TAG
ggaaaaagcatcacttgttc

SEQ ID NO: 15632 - DNA, 20 bp, Artificial Sequence
  Description of Artificial Sequence: Synthetic oligonucleotide
  Target: FXN; (+) strand; PAM type: NRG; PAM sequence: AGG
gaaaaagcatcacttgttct

SEQ ID NO: 15633 - DNA, 20 bp, Artificial Sequence
  Description of Artificial Sequence: Synthetic oligonucleotide
  Target: FXN; (+) strand; PAM type: NRG; PAM sequence: TAG
cttgttctaggaactacaaa

SEQ ID NO: 15634 - DNA, 20 bp, Artificial Sequence
  Description of Artificial Sequence: Synthetic oligonucleotide
  Target: FXN; (+) strand; PAM type: NRG; PAM sequence: AAG
taggaactacaaatagcttg

SEQ ID NO: 15635 - DNA, 20 bp, Artificial Sequence
  Description of Artificial Sequence: Synthetic oligonucleotide
  Target: FXN; (+) strand; PAM type: NRG; PAM sequence: AAG
gaactacaaatagcttgaag

SEQ ID NO: 15636 - DNA, 20 bp, Artificial Sequence
  Description of Artificial Sequence: Synthetic oligonucleotide
  Target: FXN; (+) strand; PAM type: NRG; PAM sequence: AAG
acaaatagcttgaagaagca

SEQ ID NO: 15637 - DNA, 20 bp, Artificial Sequence
  Description of Artificial Sequence: Synthetic oligonucleotide
  Target: FXN; (+) strand; PAM type: NRG; PAM sequence: TAG
cttgaagaagcaaagatgtc

SEQ ID NO: 15638 - DNA, 20 bp, Artificial Sequence
  Description of Artificial Sequence: Synthetic oligonucleotide
  Target: FXN; (+) strand; PAM type: NRG; PAM sequence: CAG
tctagatgcctcccaatatg

SEQ ID NO: 15639 - DNA, 20 bp, Artificial Sequence
  Description of Artificial Sequence: Synthetic oligonucleotide
  Target: FXN; (+) strand; PAM type: NRG; PAM sequence: GAG
tagatgcctcccaatatgca

SEQ ID NO: 15640 - DNA, 20 bp, Artificial Sequence
  Description of Artificial Sequence: Synthetic oligonucleotide
  Target: FXN; (+) strand; PAM type: NRG; PAM sequence: TGG
atgcctcccaatatgcagag

SEQ ID NO: 15641 - DNA, 20 bp, Artificial Sequence
  Description of Artificial Sequence: Synthetic oligonucleotide
  Target: FXN; (+) strand; PAM type: NRG; PAM sequence: GGG
tgcctcccaatatgcagagt

SEQ ID NO: 15642 - DNA, 20 bp, Artificial Sequence
  Description of Artificial Sequence: Synthetic oligonucleotide
  Target: FXN; (+) strand; PAM type: NRG; PAM sequence: GGG
gcctcccaatatgcagagtg

SEQ ID NO: 15643 - DNA, 20 bp, Artificial Sequence
  Description of Artificial Sequence: Synthetic oligonucleotide
  Target: FXN; (+) strand; PAM type: NRG; PAM sequence: CAG
aatatgcagagtggggtgta

SEQ ID NO: 15644 - DNA, 20 bp, Artificial Sequence
  Description of Artificial Sequence: Synthetic oligonucleotide
  Target: FXN; (+) strand; PAM type: NRG; PAM sequence: AAG
atgcagagtggggtgtacag

SEQ ID NO: 15645 - DNA, 20 bp, Artificial Sequence
  Description of Artificial Sequence: Synthetic oligonucleotide
  Target: FXN; (+) strand; PAM type: NRG; PAM sequence: GAG
gcagagtggggtgtacagaa

SEQ ID NO: 15646 - DNA, 20 bp, Artificial Sequence
  Description of Artificial Sequence: Synthetic oligonucleotide
  Target: FXN; (+) strand; PAM type: NRG; PAM sequence: GAG
agagtggggtgtacagaaga

SEQ ID NO: 15647 - DNA, 20 bp, Artificial Sequence
  Description of Artificial Sequence: Synthetic oligonucleotide
  Target: FXN; (+) strand; PAM type: NRG; PAM sequence: TGG
gtggggtgtacagaagagag

SEQ ID NO: 15648 - DNA, 20 bp, Artificial Sequence
  Description of Artificial Sequence: Synthetic oligonucleotide
  Target: FXN; (+) strand; PAM type: NRG; PAM sequence: AAG
ggtgtacagaagagagtggt

SEQ ID NO: 15649 - DNA, 20 bp, Artificial Sequence
  Description of Artificial Sequence: Synthetic oligonucleotide
  Target: FXN; (+) strand; PAM type: NRG; PAM sequence: AGG
gtgtacagaagagagtggta

SEQ ID NO: 15650 - DNA, 20 bp, Artificial Sequence
  Description of Artificial Sequence: Synthetic oligonucleotide
  Target: FXN; (+) strand; PAM type: NRG; PAM sequence: GGG
tgtacagaagagagtggtaa

SEQ ID NO: 15651 - DNA, 20 bp, Artificial Sequence
  Description of Artificial Sequence: Synthetic oligonucleotide
  Target: FXN; (+) strand; PAM type: NRG; PAM sequence: TGG
gaagagagtggtaagggcgc

SEQ ID NO: 15652 - DNA, 20 bp, Artificial Sequence
  Description of Artificial Sequence: Synthetic oligonucleotide
  Target: FXN; (+) strand; PAM type: NRG; PAM sequence: GGG
aagagagtggtaagggcgct

SEQ ID NO: 15653 - DNA, 20 bp, Artificial Sequence
  Description of Artificial Sequence: Synthetic oligonucleotide
  Target: FXN; (+) strand; PAM type: NRG; PAM sequence: GAG
gagagtggtaagggcgctgg

SEQ ID NO: 15654 - DNA, 20 bp, Artificial Sequence
  Description of Artificial Sequence: Synthetic oligonucleotide
  Target: FXN; (+) strand; PAM type: NRG; PAM sequence: GAG
gagtggtaagggcgctggga

SEQ ID NO: 15655 - DNA, 20 bp, Artificial Sequence
  Description of Artificial Sequence: Synthetic oligonucleotide
  Target: FXN; (+) strand; PAM type: NRG; PAM sequence: AAG
gtaagggcgctgggagagct

SEQ ID NO: 15656 - DNA, 20 bp, Artificial Sequence
  Description of Artificial Sequence: Synthetic oligonucleotide
  Target: FXN; (+) strand; PAM type: NRG; PAM sequence: AGG
taagggcgctgggagagcta

SEQ ID NO: 15657 - DNA, 20 bp, Artificial Sequence
  Description of Artificial Sequence: Synthetic oligonucleotide
  Target: FXN; (+) strand; PAM type: NRG; PAM sequence: TGG
gggcgctgggagagctaagg

SEQ ID NO: 15658 - DNA, 20 bp, Artificial Sequence
  Description of Artificial Sequence: Synthetic oligonucleotide
  Target: FXN; (+) strand; PAM type: NRG; PAM sequence: GGG
ggcgctgggagagctaaggt

SEQ ID NO: 15659 - DNA, 20 bp, Artificial Sequence
  Description of Artificial Sequence: Synthetic oligonucleotide
  Target: FXN; (+) strand; PAM type: NRG; PAM sequence: AAG
ctgggagagctaaggtgggc

SEQ ID NO: 15660 - DNA, 20 bp, Artificial Sequence
  Description of Artificial Sequence: Synthetic oligonucleotide
  Target: FXN; (+) strand; PAM type: NRG; PAM sequence: GAG
gggagagctaaggtgggcaa

SEQ ID NO: 15661 - DNA, 20 bp, Artificial Sequence
  Description of Artificial Sequence: Synthetic oligonucleotide
  Target: FXN; (+) strand; PAM type: NRG; PAM sequence: GAG
gagagctaaggtgggcaaga

SEQ ID NO: 15662 - DNA, 20 bp, Artificial Sequence
  Description of Artificial Sequence: Synthetic oligonucleotide
  Target: FXN; (+) strand; PAM type: NRG; PAM sequence: AAG
agagcttcctctgtcatgct

SEQ ID NO: 15663 - DNA, 20 bp, Artificial Sequence
  Description of Artificial Sequence: Synthetic oligonucleotide
  Target: FXN; (+) strand; PAM type: NRG; PAM sequence: AAG
cttcctctgtcatgctaaga

SEQ ID NO: 15664 - DNA, 20 bp, Artificial Sequence
  Description of Artificial Sequence: Synthetic oligonucleotide
  Target: FXN; (+) strand; PAM type: NRG; PAM sequence: TGG
ctctgtcatgctaagaaagt

SEQ ID NO: 15665 - DNA, 20 bp, Artificial Sequence
  Description of Artificial Sequence: Synthetic oligonucleotide
  Target: FXN; (+) strand; PAM type: NRG; PAM sequence: TGG
aaagttggaatttatcttga

SEQ ID NO: 15666 - DNA, 20 bp, Artificial Sequence
  Description of Artificial Sequence: Synthetic oligonucleotide
  Target: FXN; (+) strand; PAM type: NRG; PAM sequence: TGG
gttggaatttatcttgatgg

SEQ ID NO: 15667 - DNA, 20 bp, Artificial Sequence
  Description of Artificial Sequence: Synthetic oligonucleotide
  Target: FXN; (+) strand; PAM type: NRG; PAM sequence: AAG
atttatcttgatggtggtga

SEQ ID NO: 15668 - DNA, 20 bp, Artificial Sequence
  Description of Artificial Sequence: Synthetic oligonucleotide
  Target: FXN; (+) strand; PAM type: NRG; PAM sequence: CAG
tatcttgatggtggtgaaag

SEQ ID NO: 15669 - DNA, 20 bp, Artificial Sequence
  Description of Artificial Sequence: Synthetic oligonucleotide
  Target: FXN; (+) strand; PAM type: NRG; PAM sequence: GAG
tcttgatggtggtgaaagca

SEQ ID NO: 15670 - DNA, 20 bp, Artificial Sequence
  Description of Artificial Sequence: Synthetic oligonucleotide
  Target: FXN; (+) strand; PAM type: NRG; PAM sequence: AGG
cttgatggtggtgaaagcag

SEQ ID NO: 15671 - DNA, 20 bp, Artificial Sequence
  Description of Artificial Sequence: Synthetic oligonucleotide
  Target: FXN; (+) strand; PAM type: NRG; PAM sequence: GGG
ttgatggtggtgaaagcaga

SEQ ID NO: 15672 - DNA, 20 bp, Artificial Sequence
  Description of Artificial Sequence: Synthetic oligonucleotide
  Target: FXN; (+) strand; PAM type: NRG; PAM sequence: TGG
gtggtgaaagcagagggcta

SEQ ID NO: 15673 - DNA, 20 bp, Artificial Sequence
  Description of Artificial Sequence: Synthetic oligonucleotide
  Target: FXN; (+) strand; PAM type: NRG; PAM sequence: TAG
tgaaagcagagggctatggt

SEQ ID NO: 15674 - DNA, 20 bp, Artificial Sequence
  Description of Artificial Sequence: Synthetic oligonucleotide
  Target: FXN; (+) strand; PAM type: NRG; PAM sequence: GAG
ctatggttagattcacattt

SEQ ID NO: 15675 - DNA, 20 bp, Artificial Sequence
  Description of Artificial Sequence: Synthetic oligonucleotide
  Target: FXN; (+) strand; PAM type: NRG; PAM sequence: TAG
ttagattcacatttgagatt

SEQ ID NO: 15676 - DNA, 20 bp, Artificial Sequence
  Description of Artificial Sequence: Synthetic oligonucleotide
  Target: FXN; (+) strand; PAM type: NRG; PAM sequence: TAG
acatttgagatttagatttt

SEQ ID NO: 15677 - DNA, 20 bp, Artificial Sequence
  Description of Artificial Sequence: Synthetic oligonucleotide
  Target: FXN; (+) strand; PAM type: NRG; PAM sequence: TGG
tagatttaaaatgatcaccc

SEQ ID NO: 15678 - DNA, 20 bp, Artificial Sequence
  Description of Artificial Sequence: Synthetic oligonucleotide
  Target: FXN; (+) strand; PAM type: NRG; PAM sequence: TGG
aatgatcaccctggtgacac

SEQ ID NO: 15679 - DNA, 20 bp, Artificial Sequence
  Description of Artificial Sequence: Synthetic oligonucleotide
  Target: FXN; (+) strand; PAM type: NRG; PAM sequence: AAG
cttaactcacaattttgccc

SEQ ID NO: 15680 - DNA, 20 bp, Artificial Sequence
  Description of Artificial Sequence: Synthetic oligonucleotide
  Target: FXN; (+) strand; PAM type: NRG; PAM sequence: AGG
ttaactcacaattttgccca

SEQ ID NO: 15681 - DNA, 20 bp, Artificial Sequence
  Description of Artificial Sequence: Synthetic oligonucleotide
  Target: FXN; (+) strand; PAM type: NRG; PAM sequence: CAG
gcccaaggcctatgctacca

SEQ ID NO: 15682 - DNA, 20 bp, Artificial Sequence
  Description of Artificial Sequence: Synthetic oligonucleotide
  Target: FXN; (+) strand; PAM type: NRG; PAM sequence: AAG
acagtgcttctgaaacttta

SEQ ID NO: 15683 - DNA, 20 bp, Artificial Sequence
  Description of Artificial Sequence: Synthetic oligonucleotide
  Target: FXN; (+) strand; PAM type: NRG; PAM sequence: TAG
tctgaaactttaaagcacat

SEQ ID NO: 15684 - DNA, 20 bp, Artificial Sequence
  Description of Artificial Sequence: Synthetic oligonucleotide
  Target: FXN; (+) strand; PAM type: NRG; PAM sequence: TGG
taaagcacattagaatcacc

SEQ ID NO: 15685 - DNA, 20 bp, Artificial Sequence
  Description of Artificial Sequence: Synthetic oligonucleotide
  Target: FXN; (+) strand; PAM type: NRG; PAM sequence: GAG
aagcacattagaatcacctg

SEQ ID NO: 15686 - DNA, 20 bp, Artificial Sequence
  Description of Artificial Sequence: Synthetic oligonucleotide
  Target: FXN; (+) strand; PAM type: NRG; PAM sequence: AGG
agcacattagaatcacctgg

SEQ ID NO: 15687 - DNA, 20 bp, Artificial Sequence
  Description of Artificial Sequence: Synthetic oligonucleotide
  Target: FXN; (+) strand; PAM type: NRG; PAM sequence: TGG
ctggaggtcttgttaaacca

SEQ ID NO: 15688 - DNA, 20 bp, Artificial Sequence
  Description of Artificial Sequence: Synthetic oligonucleotide
  Target: FXN; (+) strand; PAM type: NRG; PAM sequence: TGG
cttgttaaaccatggattgc

SEQ ID NO: 15689 - DNA, 20 bp, Artificial Sequence
  Description of Artificial Sequence: Synthetic oligonucleotide
  Target: FXN; (+) strand; PAM type: NRG; PAM sequence: GGG
ttgttaaaccatggattgct

SEQ ID NO: 15690 - DNA, 20 bp, Artificial Sequence
  Description of Artificial Sequence: Synthetic oligonucleotide
  Target: FXN; (+) strand; PAM type: NRG; PAM sequence: CAG
attgctgggccttgaaaccc

SEQ ID NO: 15691 - DNA, 20 bp, Artificial Sequence
  Description of Artificial Sequence: Synthetic oligonucleotide
  Target: FXN; (+) strand; PAM type: NRG; PAM sequence: GAG
tgctgggccttgaaacccca

SEQ ID NO: 15692 - DNA, 20 bp, Artificial Sequence
  Description of Artificial Sequence: Synthetic oligonucleotide
  Target: FXN; (+) strand; PAM type: NRG; PAM sequence: CAG
aaaccccagagattctgatt

SEQ ID NO: 15693 - DNA, 20 bp, Artificial Sequence
  Description of Artificial Sequence: Synthetic oligonucleotide
  Target: FXN; (+) strand; PAM type: NRG; PAM sequence: TAG
ccccagagattctgattcag

SEQ ID NO: 15694 - DNA, 20 bp, Artificial Sequence
  Description of Artificial Sequence: Synthetic oligonucleotide
  Target: FXN; (+) strand; PAM type: NRG; PAM sequence: GAG
agattctgattcagtagatc

SEQ ID NO: 15695 - DNA, 20 bp, Artificial Sequence
  Description of Artificial Sequence: Synthetic oligonucleotide
  Target: FXN; (+) strand; PAM type: NRG; PAM sequence: TAG
ctgattcagtagatcgagaa

SEQ ID NO: 15696 - DNA, 20 bp, Artificial Sequence
  Description of Artificial Sequence: Synthetic oligonucleotide
  Target: FXN; (+) strand; PAM type: NRG; PAM sequence: AGG
tgattcagtagatcgagaat

SEQ ID NO: 15697 - DNA, 20 bp, Artificial Sequence
  Description of Artificial Sequence: Synthetic oligonucleotide
  Target: FXN; (+) strand; PAM type: NRG; PAM sequence: GGG
gattcagtagatcgagaata

SEQ ID NO: 15698 - DNA, 20 bp, Artificial Sequence
  Description of Artificial Sequence: Synthetic oligonucleotide
  Target: FXN; (+) strand; PAM type: NRG; PAM sequence: GAG
gtagatcgagaatagggcct

SEQ ID NO: 15699 - DNA, 20 bp, Artificial Sequence
  Description of Artificial Sequence: Synthetic oligonucleotide
  Target: FXN; (+) strand; PAM type: NRG; PAM sequence: AAG
tgagaatttgtatttctaac

SEQ ID NO: 15700 - DNA, 20 bp, Artificial Sequence
  Description of Artificial Sequence: Synthetic oligonucleotide
  Target: FXN; (+) strand; PAM type: NRG; PAM sequence: CAG
ttgtatttctaacaagtttc

SEQ ID NO: 15701 - DNA, 20 bp, Artificial Sequence
  Description of Artificial Sequence: Synthetic oligonucleotide
  Target: FXN; (+) strand; PAM type: NRG; PAM sequence: AGG
tgtatttctaacaagtttcc

SEQ ID NO: 15702 - DNA, 20 bp, Artificial Sequence
  Description of Artificial Sequence: Synthetic oligonucleotide
  Target: FXN; (+) strand; PAM type: NRG; PAM sequence: GAG
acaagtttccaggtgatgct

SEQ ID NO: 15703 - DNA, 20 bp, Artificial Sequence
  Description of Artificial Sequence: Synthetic oligonucleotide
  Target: FXN; (+) strand; PAM type: NRG; PAM sequence: AGG
caagtttccaggtgatgctg

SEQ ID NO: 15704 - DNA, 20 bp, Artificial Sequence
  Description of Artificial Sequence: Synthetic oligonucleotide
  Target: FXN; (+) strand; PAM type: NRG; PAM sequence: TGG
ccaggtgatgctgaggctgc

SEQ ID NO: 15705 - DNA, 20 bp, Artificial Sequence
  Description of Artificial Sequence: Synthetic oligonucleotide
  Target: FXN; (+) strand; PAM type: NRG; PAM sequence: CAG
tgatgctgaggctgctggcc

SEQ ID NO: 15706 - DNA, 20 bp, Artificial Sequence
  Description of Artificial Sequence: Synthetic oligonucleotide
  Target: FXN; (+) strand; PAM type: NRG; PAM sequence: TAG
gcgaccacatttgataatca

SEQ ID NO: 15707 - DNA, 20 bp, Artificial Sequence
  Description of Artificial Sequence: Synthetic oligonucleotide
  Target: FXN; (+) strand; PAM type: NRG; PAM sequence: TGG
atcctatcaaaatatcctaa

SEQ ID NO: 15708 - DNA, 20 bp, Artificial Sequence
  Description of Artificial Sequence: Synthetic oligonucleotide
  Target: FXN; (+) strand; PAM type: NRG; PAM sequence: CAG
ctatcaaaatatcctaatgg

SEQ ID NO: 15709 - DNA, 20 bp, Artificial Sequence
  Description of Artificial Sequence: Synthetic oligonucleotide
  Target: FXN; (+) strand; PAM type: NRG; PAM sequence: GAG
atcaaaatatcctaatggca

SEQ ID NO: 15710 - DNA, 20 bp, Artificial Sequence
  Description of Artificial Sequence: Synthetic oligonucleotide
  Target: FXN; (+) strand; PAM type: NRG; PAM sequence: AAG
aaatatcctaatggcagagc

SEQ ID NO: 15711 - DNA, 20 bp, Artificial Sequence
  Description of Artificial Sequence: Synthetic oligonucleotide
  Target: FXN; (+) strand; PAM type: NRG; PAM sequence: AGG
aatatcctaatggcagagca

SEQ ID NO: 15712 - DNA, 20 bp, Artificial Sequence
  Description of Artificial Sequence: Synthetic oligonucleotide
  Target: FXN; (+) strand; PAM type: NRG; PAM sequence: GGG
atatcctaatggcagagcaa

SEQ ID NO: 15713 - DNA, 20 bp, Artificial Sequence
  Description of Artificial Sequence: Synthetic oligonucleotide
  Target: FXN; (+) strand; PAM type: NRG; PAM sequence: TGG
atggcagagcaagggaattc

SEQ ID NO: 15714 - DNA, 20 bp, Artificial Sequence
  Description of Artificial Sequence: Synthetic oligonucleotide
  Target: FXN; (+) strand; PAM type: NRG; PAM sequence: CAG
ctcccctacccataacctga

SEQ ID NO: 15715 - DNA, 20 bp, Artificial Sequence
  Description of Artificial Sequence: Synthetic oligonucleotide
  Target: FXN; (+) strand; PAM type: NRG; PAM sequence: TAG
acccataacctgacagctat

SEQ ID NO: 15716 - DNA, 20 bp, Artificial Sequence
  Description of Artificial Sequence: Synthetic oligonucleotide
  Target: FXN; (+) strand; PAM type: NRG; PAM sequence: AGG
cccataacctgacagctatt

SEQ ID NO: 15717 - DNA, 20 bp, Artificial Sequence
  Description of Artificial Sequence: Synthetic oligonucleotide
  Target: FXN; (+) strand; PAM type: NRG; PAM sequence: GAG
ctattaggatctgcctactt

SEQ ID NO: 15718 - DNA, 20 bp, Artificial Sequence
  Description of Artificial Sequence: Synthetic oligonucleotide
  Target: FXN; (+) strand; PAM type: NRG; PAM sequence: AGG
tattaggatctgcctacttg

SEQ ID NO: 15719 - DNA, 20 bp, Artificial Sequence
  Description of Artificial Sequence: Synthetic oligonucleotide
  Target: FXN; (+) strand; PAM type: NRG; PAM sequence: AAG
atctgcctacttgaggctaa

SEQ ID NO: 15720 - DNA, 20 bp, Artificial Sequence
  Description of Artificial Sequence: Synthetic oligonucleotide
  Target: FXN; (+) strand; PAM type: NRG; PAM sequence: AAG
acttgaggctaaaagcaacc

SEQ ID NO: 15721 - DNA, 20 bp, Artificial Sequence
  Description of Artificial Sequence: Synthetic oligonucleotide
  Target: FXN; (+) strand; PAM type: NRG; PAM sequence: GAG
ttgaggctaaaagcaaccaa

SEQ ID NO: 15722 - DNA, 20 bp, Artificial Sequence
  Description of Artificial Sequence: Synthetic oligonucleotide
  Target: FXN; (+) strand; PAM type: NRG; PAM sequence: GAG
gaggctaaaagcaaccaaga

SEQ ID NO: 15723 - DNA, 20 bp, Artificial Sequence
  Description of Artificial Sequence: Synthetic oligonucleotide
  Target: FXN; (+) strand; PAM type: NRG; PAM sequence: AGG
aggctaaaagcaaccaagag

SEQ ID NO: 15724 - DNA, 20 bp, Artificial Sequence
  Description of Artificial Sequence: Synthetic oligonucleotide
  Target: FXN; (+) strand; PAM type: NRG; PAM sequence: CAG
aaaagcaaccaagagaggaa

SEQ ID NO: 15725 - DNA, 20 bp, Artificial Sequence
  Description of Artificial Sequence: Synthetic oligonucleotide
  Target: FXN; (+) strand; PAM type: NRG; PAM sequence: CAG
aaccaagagaggaacagcta

SEQ ID NO: 15726 - DNA, 20 bp, Artificial Sequence
  Description of Artificial Sequence: Synthetic oligonucleotide
  Target: FXN; (+) strand; PAM type: NRG; PAM sequence: CAG
ggaacagctacagtgtacca

SEQ ID NO: 15727 - DNA, 20 bp, Artificial Sequence
  Description of Artificial Sequence: Synthetic oligonucleotide
  Target: FXN; (+) strand; PAM type: NRG; PAM sequence: GAG
aacagctacagtgtaccaca

SEQ ID NO: 15728 - DNA, 20 bp, Artificial Sequence
  Description of Artificial Sequence: Synthetic oligonucleotide
  Target: FXN; (+) strand; PAM type: NRG; PAM sequence: CGG
caacatctttgcccacgcca

SEQ ID NO: 15729 - DNA, 20 bp, Artificial Sequence
  Description of Artificial Sequence: Synthetic oligonucleotide
  Target: FXN; (+) strand; PAM type: NRG; PAM sequence: CAG
ttgcccacgccacggtgccc

SEQ ID NO: 15730 - DNA, 20 bp, Artificial Sequence
  Description of Artificial Sequence: Synthetic oligonucleotide
  Target: FXN; (+) strand; PAM type: NRG; PAM sequence: AAG
cggtgccccagcttcttacc

SEQ ID NO: 15731 - DNA, 20 bp, Artificial Sequence
  Description of Artificial Sequence: Synthetic oligonucleotide
  Target: FXN; (+) strand; PAM type: NRG; PAM sequence: AAG
gattcctcttgactacctcc

SEQ ID NO: 15732 - DNA, 20 bp, Artificial Sequence
  Description of Artificial Sequence: Synthetic oligonucleotide
  Target: FXN; (+) strand; PAM type: NRG; PAM sequence: AGG
attcctcttgactacctcca

SEQ ID NO: 15733 - DNA, 20 bp, Artificial Sequence
  Description of Artificial Sequence: Synthetic oligonucleotide
  Target: FXN; (+) strand; PAM type: NRG; PAM sequence: AAG
cctcttgactacctccaagg

SEQ ID NO: 15734 - DNA, 20 bp, Artificial Sequence
  Description of Artificial Sequence: Synthetic oligonucleotide
  Target: FXN; (+) strand; PAM type: NRG; PAM sequence: TGG
cttgactacctccaaggaag

SEQ ID NO: 15735 - DNA, 20 bp, Artificial Sequence
  Description of Artificial Sequence: Synthetic oligonucleotide
  Target: FXN; (+) strand; PAM type: NRG; PAM sequence: GAG
tgactacctccaaggaagtg

SEQ ID NO: 15736 - DNA, 20 bp, Artificial Sequence
  Description of Artificial Sequence: Synthetic oligonucleotide
  Target: FXN; (+) strand; PAM type: NRG; PAM sequence: AAG
tacctccaaggaagtggaga

SEQ ID NO: 15737 - DNA, 20 bp, Artificial Sequence
  Description of Artificial Sequence: Synthetic oligonucleotide
  Target: FXN; (+) strand; PAM type: NRG; PAM sequence: AAG
ccaaggaagtggagaaagac

SEQ ID NO: 15738 - DNA, 20 bp, Artificial Sequence
  Description of Artificial Sequence: Synthetic oligonucleotide
  Target: FXN; (+) strand; PAM type: NRG; PAM sequence: AAG
gagaaagacaagttcttgcg

SEQ ID NO: 15739 - DNA, 20 bp, Artificial Sequence
  Description of Artificial Sequence: Synthetic oligonucleotide
  Target: FXN; (+) strand; PAM type: NRG; PAM sequence: TGG
ctattctatgtctatttctt

SEQ ID NO: 15740 - DNA, 20 bp, Artificial Sequence
  Description of Artificial Sequence: Synthetic oligonucleotide
  Target: FXN; (+) strand; PAM type: NRG; PAM sequence: AAG
tgtctatttctttggccaaa

SEQ ID NO: 15741 - DNA, 20 bp, Artificial Sequence
  Description of Artificial Sequence: Synthetic oligonucleotide
  Target: FXN; (+) strand; PAM type: NRG; PAM sequence: TGG
tatttctttggccaaaaaga

SEQ ID NO: 15742 - DNA, 20 bp, Artificial Sequence
  Description of Artificial Sequence: Synthetic oligonucleotide
  Target: FXN; (+) strand; PAM type: NRG; PAM sequence: GGG
atttctttggccaaaaagat

SEQ ID NO: 15743 - DNA, 20 bp, Artificial Sequence
  Description of Artificial Sequence: Synthetic oligonucleotide
  Target: FXN; (+) strand; PAM type: NRG; PAM sequence: GGG
tttctttggccaaaaagatg

SEQ ID NO: 15744 - DNA, 20 bp, Artificial Sequence
  Description of Artificial Sequence: Synthetic oligonucleotide
  Target: FXN; (+) strand; PAM type: NRG; PAM sequence: CAG
gggcaatgatatcaactttg

SEQ ID NO: 15745 - DNA, 20 bp, Artificial Sequence
  Description of Artificial Sequence: Synthetic oligonucleotide
  Target: FXN; (+) strand; PAM type: NRG; PAM sequence: AGG
ggcaatgatatcaactttgc

SEQ ID NO: 15746 - DNA, 20 bp, Artificial Sequence
  Description of Artificial Sequence: Synthetic oligonucleotide
  Target: FXN; (+) strand; PAM type: NRG; PAM sequence: GGG
gcaatgatatcaactttgca

SEQ ID NO: 15747 - DNA, 20 bp, Artificial Sequence
  Description of Artificial Sequence: Synthetic oligonucleotide
  Target: FXN; (+) strand; PAM type: NRG; PAM sequence: GAG
aatgatatcaactttgcagg

SEQ ID NO: 15748 - DNA, 20 bp, Artificial Sequence
  Description of Artificial Sequence: Synthetic oligonucleotide
  Target: FXN; (+) strand; PAM type: NRG; PAM sequence: TGG
atatcaactttgcagggagc

SEQ ID NO: 15749 - DNA, 20 bp, Artificial Sequence
  Description of Artificial Sequence: Synthetic oligonucleotide
  Target: FXN; (+) strand; PAM type: NRG; PAM sequence: GAG
atcaactttgcagggagctg

SEQ ID NO: 15750 - DNA, 20 bp, Artificial Sequence
  Description of Artificial Sequence: Synthetic oligonucleotide
  Target: FXN; (+) strand; PAM type: NRG; PAM sequence: TAG
cagggagctggagcatttgc

SEQ ID NO: 15751 - DNA, 20 bp, Artificial Sequence
  Description of Artificial Sequence: Synthetic oligonucleotide
  Target: FXN; (+) strand; PAM type: NRG; PAM sequence: CAG
tgctagtgacctttctatgc

SEQ ID NO: 15752 - DNA, 20 bp, Artificial Sequence
  Description of Artificial Sequence: Synthetic oligonucleotide
  Target: FXN; (+) strand; PAM type: NRG; PAM sequence: AAG
tttctatgccagaacttgct

SEQ ID NO: 15753 - DNA, 20 bp, Artificial Sequence
  Description of Artificial Sequence: Synthetic oligonucleotide
  Target: FXN; (+) strand; PAM type: NRG; PAM sequence: TAG
ccagaacttgctaagcatgc

SEQ ID NO: 15754 - DNA, 20 bp, Artificial Sequence
  Description of Artificial Sequence: Synthetic oligonucleotide
  Target: FXN; (+) strand; PAM type: NRG; PAM sequence: TAG
catgctagctaataatgatg

SEQ ID NO: 15755 - DNA, 20 bp, Artificial Sequence
  Description of Artificial Sequence: Synthetic oligonucleotide
  Target: FXN; (+) strand; PAM type: NRG; PAM sequence: CAG
tagctaataatgatgtagca

SEQ ID NO: 15756 - DNA, 20 bp, Artificial Sequence
  Description of Artificial Sequence: Synthetic oligonucleotide
  Target: FXN; (+) strand; PAM type: NRG; PAM sequence: AGG
agctaataatgatgtagcac

SEQ ID NO: 15757 - DNA, 20 bp, Artificial Sequence
  Description of Artificial Sequence: Synthetic oligonucleotide
  Target: FXN; (+) strand; PAM type: NRG; PAM sequence: GGG
gctaataatgatgtagcaca

SEQ ID NO: 15758 - DNA, 20 bp, Artificial Sequence
  Description of Artificial Sequence: Synthetic oligonucleotide
  Target: FXN; (+) strand; PAM type: NRG; PAM sequence: CGG
taatgatgtagcacagggtg

SEQ ID NO: 15759 - DNA, 20 bp, Artificial Sequence
  Description of Artificial Sequence: Synthetic oligonucleotide
  Target: FXN; (+) strand; PAM type: NRG; PAM sequence: TGG
tgatgtagcacagggtgcgg

SEQ ID NO: 15760 - DNA, 20 bp, Artificial Sequence
  Description of Artificial Sequence: Synthetic oligonucleotide
  Target: FXN; (+) strand; PAM type: NRG; PAM sequence: CAG
gtggctcacgcctgtaatct

SEQ ID NO: 15761 - DNA, 20 bp, Artificial Sequence
  Description of Artificial Sequence: Synthetic oligonucleotide
  Target: FXN; (+) strand; PAM type: NRG; PAM sequence: TGG
cgcctgtaatctcagcactt

SEQ ID NO: 15762 - DNA, 20 bp, Artificial Sequence
  Description of Artificial Sequence: Synthetic oligonucleotide
  Target: FXN; (+) strand; PAM type: NRG; PAM sequence: GGG
gcctgtaatctcagcacttt

SEQ ID NO: 15763 - DNA, 20 bp, Artificial Sequence
  Description of Artificial Sequence: Synthetic oligonucleotide
  Target: FXN; (+) strand; PAM type: NRG; PAM sequence: CGG
tgtaatctcagcactttggg

SEQ ID NO: 15764 - DNA, 20 bp, Artificial Sequence
  Description of Artificial Sequence: Synthetic oligonucleotide
  Target: FXN; (+) strand; PAM type: NRG; PAM sequence: GAG
tctcagcactttgggcggcc

SEQ ID NO: 15765 - DNA, 20 bp, Artificial Sequence
  Description of Artificial Sequence: Synthetic oligonucleotide
  Target: FXN; (+) strand; PAM type: NRG; PAM sequence: AGG
ctcagcactttgggcggccg

SEQ ID NO: 15766 - DNA, 20 bp, Artificial Sequence
  Description of Artificial Sequence: Synthetic oligonucleotide
  Target: FXN; (+) strand; PAM type: NRG; PAM sequence: CGG
agcactttgggcggccgagg

SEQ ID NO: 15767 - DNA, 20 bp, Artificial Sequence
  Description of Artificial Sequence: Synthetic oligonucleotide
  Target: FXN; (+) strand; PAM type: NRG; PAM sequence: GGG
gcactttgggcggccgaggc

SEQ ID NO: 15768 - DNA, 20 bp, Artificial Sequence
  Description of Artificial Sequence: Synthetic oligonucleotide
  Target: FXN; (+) strand; PAM type: NRG; PAM sequence: CGG
ctttgggcggccgaggcggg

SEQ ID NO: 15769 - DNA, 20 bp, Artificial Sequence
  Description of Artificial Sequence: Synthetic oligonucleotide
  Target: FXN; (+) strand; PAM type: NRG; PAM sequence: GAG
ccgaggcgggcggatcacct

SEQ ID NO: 15770 - DNA, 20 bp, Artificial Sequence
  Description of Artificial Sequence: Synthetic oligonucleotide
  Target: FXN; (+) strand; PAM type: NRG; PAM sequence: AGG
cgaggcgggcggatcacctg

SEQ ID NO: 15771 - DNA, 20 bp, Artificial Sequence
  Description of Artificial Sequence: Synthetic oligonucleotide
  Target: FXN; (+) strand; PAM type: NRG; PAM sequence: CAG
gcgggcggatcacctgaggt

SEQ ID NO: 15772 - DNA, 20 bp, Artificial Sequence
  Description of Artificial Sequence: Synthetic oligonucleotide
  Target: FXN; (+) strand; PAM type: NRG; PAM sequence: AGG
cgggcggatcacctgaggtc

SEQ ID NO: 15773 - DNA, 20 bp, Artificial Sequence
  Description of Artificial Sequence: Synthetic oligonucleotide
  Target: FXN; (+) strand; PAM type: NRG; PAM sequence: GAG
ggcggatcacctgaggtcag

SEQ ID NO: 15774 - DNA, 20 bp, Artificial Sequence
  Description of Artificial Sequence: Synthetic oligonucleotide
  Target: FXN; (+) strand; PAM type: NRG; PAM sequence: GAG
tcacctgaggtcaggagttc

SEQ ID NO: 15775 - DNA, 20 bp, Artificial Sequence
  Description of Artificial Sequence: Synthetic oligonucleotide
  Target: FXN; (+) strand; PAM type: NRG; PAM sequence: CAG
tgaggtcaggagttcgagac

SEQ ID NO: 15776 - DNA, 20 bp, Artificial Sequence
  Description of Artificial Sequence: Synthetic oligonucleotide
  Target: FXN; (+) strand; PAM type: NRG; PAM sequence: TGG
tcaggagttcgagaccagcc

SEQ ID NO: 15777 - DNA, 20 bp, Artificial Sequence
  Description of Artificial Sequence: Synthetic oligonucleotide
  Target: FXN; (+) strand; PAM type: NRG; PAM sequence: TAG
tctactaaaaatacaaaaat

SEQ ID NO: 15778 - DNA, 20 bp, Artificial Sequence
  Description of Artificial Sequence: Synthetic oligonucleotide
  Target: FXN; (+) strand; PAM type: NRG; PAM sequence: CAG
ctaaaaatacaaaaattagc

SEQ ID NO: 15779 - DNA, 20 bp, Artificial Sequence
  Description of Artificial Sequence: Synthetic oligonucleotide
  Target: FXN; (+) strand; PAM type: NRG; PAM sequence: AGG
taaaaatacaaaaattagcc

SEQ ID NO: 15780 - DNA, 20 bp, Artificial Sequence
  Description of Artificial Sequence: Synthetic oligonucleotide
  Target: FXN; (+) strand; PAM type: NRG; PAM sequence: TGG
atacaaaaattagccaggcg

SEQ ID NO: 15781 - DNA, 20 bp, Artificial Sequence
  Description of Artificial Sequence: Synthetic oligonucleotide
  Target: FXN; (+) strand; PAM type: NRG; PAM sequence: TGG
caaaaattagccaggcgtgg

SEQ ID NO: 15782 - DNA, 20 bp, Artificial Sequence
  Description of Artificial Sequence: Synthetic oligonucleotide
  Target: FXN; (+) strand; PAM type: NRG; PAM sequence: TGG
aaattagccaggcgtggtgg

SEQ ID NO: 15783 - DNA, 20 bp, Artificial Sequence
  Description of Artificial Sequence: Synthetic oligonucleotide
  Target: FXN; (+) strand; PAM type: NRG; PAM sequence: GGG
aattagccaggcgtggtggt

SEQ ID NO: 15784 - DNA, 20 bp, Artificial Sequence
  Description of Artificial Sequence: Synthetic oligonucleotide
  Target: FXN; (+) strand; PAM type: NRG; PAM sequence: CAG
gtggtgggcacctgcaatcc

SEQ ID NO: 15785 - DNA, 20 bp, Artificial Sequence
  Description of Artificial Sequence: Synthetic oligonucleotide
  Target: FXN; (+) strand; PAM type: NRG; PAM sequence: TGG
acctgcaatcccagctactc

SEQ ID NO: 15786 - DNA, 20 bp, Artificial Sequence
  Description of Artificial Sequence: Synthetic oligonucleotide
  Target: FXN; (+) strand; PAM type: NRG; PAM sequence: GAG
ctgcaatcccagctactctg

SEQ ID NO: 15787 - DNA, 20 bp, Artificial Sequence
  Description of Artificial Sequence: Synthetic oligonucleotide
  Target: FXN; (+) strand; PAM type: NRG; PAM sequence: AGG
tgcaatcccagctactctgg

SEQ ID NO: 15788 - DNA, 20 bp, Artificial Sequence
  Description of Artificial Sequence: Synthetic oligonucleotide
  Target: FXN; (+) strand; PAM type: NRG; PAM sequence: GAG
tcccagctactctggaggct

SEQ ID NO: 15789 - DNA, 20 bp, Artificial Sequence
  Description of Artificial Sequence: Synthetic oligonucleotide
  Target: FXN; (+) strand; PAM type: NRG; PAM sequence: CAG
agctactctggaggctgaga

SEQ ID NO: 15790 - DNA, 20 bp, Artificial Sequence
  Description of Artificial Sequence: Synthetic oligonucleotide
  Target: FXN; (+) strand; PAM type: NRG; PAM sequence: CAG
gagacagaatctcttgaacc

SEQ ID NO: 15791 - DNA, 20 bp, Artificial Sequence
  Description of Artificial Sequence: Synthetic oligonucleotide
  Target: FXN; (+) strand; PAM type: NRG; PAM sequence: AGG
agacagaatctcttgaaccc

SEQ ID NO: 15792 - DNA, 20 bp, Artificial Sequence
  Description of Artificial Sequence: Synthetic oligonucleotide
  Target: FXN; (+) strand; PAM type: NRG; PAM sequence: GAG
acagaatctcttgaacccag

SEQ ID NO: 15793 - DNA, 20 bp, Artificial Sequence
  Description of Artificial Sequence: Synthetic oligonucleotide
  Target: FXN; (+) strand; PAM type: NRG; PAM sequence: AGG
cagaatctcttgaacccagg

SEQ ID NO: 15794 - DNA, 20 bp, Artificial Sequence
  Description of Artificial Sequence: Synthetic oligonucleotide
  Target: FXN; (+) strand; PAM type: NRG; PAM sequence: TGG
aatctcttgaacccaggagg

SEQ ID NO: 15795 - DNA, 20 bp, Artificial Sequence
  Description of Artificial Sequence: Synthetic oligonucleotide
  Target: FXN; (+) strand; PAM type: NRG; PAM sequence: GAG
tctcttgaacccaggaggtg

SEQ ID NO: 15796 - DNA, 20 bp, Artificial Sequence
  Description of Artificial Sequence: Synthetic oligonucleotide
  Target: FXN; (+) strand; PAM type: NRG; PAM sequence: CAG
aacccaggaggtggagattg

SEQ ID NO: 15797 - DNA, 20 bp, Artificial Sequence
  Description of Artificial Sequence: Synthetic oligonucleotide
  Target: FXN; (+) strand; PAM type: NRG; PAM sequence: GAG
caggaggtggagattgcagt

SEQ ID NO: 15798 - DNA, 20 bp, Artificial Sequence
  Description of Artificial Sequence: Synthetic oligonucleotide
  Target: FXN; (+) strand; PAM type: NRG; PAM sequence: CAG
gaggtggagattgcagtgag

SEQ ID NO: 15799 - DNA, 20 bp, Artificial Sequence
  Description of Artificial Sequence: Synthetic oligonucleotide
  Target: FXN; (+) strand; PAM type: NRG; PAM sequence: GAG
ggtggagattgcagtgagca

SEQ ID NO: 15800 - DNA, 20 bp, Artificial Sequence
  Description of Artificial Sequence: Synthetic oligonucleotide
  Target: FXN; (+) strand; PAM type: NRG; PAM sequence: TGG
gagattgcagtgagcagaga

SEQ ID NO: 15801 - DNA, 20 bp, Artificial Sequence
  Description of Artificial Sequence: Synthetic oligonucleotide
  Target: FXN; (+) strand; PAM type: NRG; PAM sequence: CAG
gagatggcaccactgcattc

SEQ ID NO: 15802 - DNA, 20 bp, Artificial Sequence
  Description of Artificial Sequence: Synthetic oligonucleotide
  Target: FXN; (+) strand; PAM type: NRG; PAM sequence: TGG
ggcaccactgcattccagcc

SEQ ID NO: 15803 - DNA, 20 bp, Artificial Sequence
  Description of Artificial Sequence: Synthetic oligonucleotide
  Target: FXN; (+) strand; PAM type: NRG; PAM sequence: GGG
gcaccactgcattccagcct

SEQ ID NO: 15804 - DNA, 20 bp, Artificial Sequence
  Description of Artificial Sequence: Synthetic oligonucleotide
  Target: FXN; (+) strand; PAM type: NRG; PAM sequence: AAG
gcattccagcctgggcaaca

SEQ ID NO: 15805 - DNA, 20 bp, Artificial Sequence
  Description of Artificial Sequence: Synthetic oligonucleotide
  Target: FXN; (+) strand; PAM type: NRG; PAM sequence: AAG
tccagcctgggcaacaaagc

SEQ ID NO: 15806 - DNA, 20 bp, Artificial Sequence
  Description of Artificial Sequence: Synthetic oligonucleotide
  Target: FXN; (+) strand; PAM type: NRG; PAM sequence: CAG
aataataataactaatgatg

SEQ ID NO: 15807 - DNA, 20 bp, Artificial Sequence
  Description of Artificial Sequence: Synthetic oligonucleotide
  Target: FXN; (+) strand; PAM type: NRG; PAM sequence: GAG
tgatgcagctttctctctct

SEQ ID NO: 15808 - DNA, 20 bp, Artificial Sequence
  Description of Artificial Sequence: Synthetic oligonucleotide
  Target: FXN; (+) strand; PAM type: NRG; PAM sequence: CAG
ctctctctgagtatataatg

SEQ ID NO: 15809 - DNA, 20 bp, Artificial Sequence
  Description of Artificial Sequence: Synthetic oligonucleotide
  Target: FXN; (+) strand; PAM type: NRG; PAM sequence: GAG
taatgcagttctgatgatgt

SEQ ID NO: 15810 - DNA, 20 bp, Artificial Sequence
  Description of Artificial Sequence: Synthetic oligonucleotide
  Target: FXN; (+) strand; PAM type: NRG; PAM sequence: AGG
aatgcagttctgatgatgtg

SEQ ID NO: 15811 - DNA, 20 bp, Artificial Sequence
  Description of Artificial Sequence: Synthetic oligonucleotide
  Target: FXN; (+) strand; PAM type: NRG; PAM sequence: AAG
gcagttctgatgatgtgagg

SEQ ID NO: 15812 - DNA, 20 bp, Artificial Sequence
  Description of Artificial Sequence: Synthetic oligonucleotide
  Target: FXN; (+) strand; PAM type: NRG; PAM sequence: AGG
cagttctgatgatgtgagga

SEQ ID NO: 15813 - DNA, 20 bp, Artificial Sequence
  Description of Artificial Sequence: Synthetic oligonucleotide
  Target: FXN; (+) strand; PAM type: NRG; PAM sequence: GGG
agttctgatgatgtgaggaa

SEQ ID NO: 15814 - DNA, 20 bp, Artificial Sequence
  Description of Artificial Sequence: Synthetic oligonucleotide
  Target: FXN; (+) strand; PAM type: NRG; PAM sequence: TGG
gtgaggaagggcctcactgt

SEQ ID NO: 15815 - DNA, 20 bp, Artificial Sequence
  Description of Artificial Sequence: Synthetic oligonucleotide
  Target: FXN; (+) strand; PAM type: NRG; PAM sequence: TGG
gaagggcctcactgttggtg

SEQ ID NO: 15816 - DNA, 20 bp, Artificial Sequence
  Description of Artificial Sequence: Synthetic oligonucleotide
  Target: FXN; (+) strand; PAM type: NRG; PAM sequence: CAG
gggcctcactgttggtgtgg

SEQ ID NO: 15817 - DNA, 20 bp, Artificial Sequence
  Description of Artificial Sequence: Synthetic oligonucleotide
  Target: FXN; (+) strand; PAM type: NRG; PAM sequence: GAG
gcctcactgttggtgtggca

SEQ ID NO: 15818 - DNA, 20 bp, Artificial Sequence
  Description of Artificial Sequence: Synthetic oligonucleotide
  Target: FXN; (+) strand; PAM type: NRG; PAM sequence: GAG
ctgttggtgtggcagagtct

SEQ ID NO: 15819 - DNA, 20 bp, Artificial Sequence
  Description of Artificial Sequence: Synthetic oligonucleotide
  Target: FXN; (+) strand; PAM type: NRG; PAM sequence: TGG
tgtggcagagtctgagacca

SEQ ID NO: 15820 - DNA, 20 bp, Artificial Sequence
  Description of Artificial Sequence: Synthetic oligonucleotide
  Target: FXN; (+) strand; PAM type: NRG; PAM sequence: TGG
gcagagtctgagaccatggc

SEQ ID NO: 15821 - DNA, 20 bp, Artificial Sequence
  Description of Artificial Sequence: Synthetic oligonucleotide
  Target: FXN; (+) strand; PAM type: NRG; PAM sequence: TGG
acactaccctttgatgccta

SEQ ID NO: 15822 - DNA, 20 bp, Artificial Sequence
  Description of Artificial Sequence: Synthetic oligonucleotide
  Target: FXN; (+) strand; PAM type: NRG; PAM sequence: GGG
cactaccctttgatgcctat

SEQ ID NO: 15823 - DNA, 20 bp, Artificial Sequence
  Description of Artificial Sequence: Synthetic oligonucleotide
  Target: FXN; (+) strand; PAM type: NRG; PAM sequence: TGG
gcctatgggctctcccttta

SEQ ID NO: 15824 - DNA, 20 bp, Artificial Sequence
  Description of Artificial Sequence: Synthetic oligonucleotide
  Target: FXN; (+) strand; PAM type: NRG; PAM sequence: AAG
ggctctccctttatggtttc

SEQ ID NO: 15825 - DNA, 20 bp, Artificial Sequence
  Description of Artificial Sequence: Synthetic oligonucleotide
  Target: FXN; (+) strand; PAM type: NRG; PAM sequence: AGG
gctctccctttatggtttca

SEQ ID NO: 15826 - DNA, 20 bp, Artificial Sequence
  Description of Artificial Sequence: Synthetic oligonucleotide
  Target: FXN; (+) strand; PAM type: NRG; PAM sequence: GAG
tctccctttatggtttcaag

SEQ ID NO: 15827 - DNA, 20 bp, Artificial Sequence
  Description of Artificial Sequence: Synthetic oligonucleotide
  Target: FXN; (+) strand; PAM type: NRG; PAM sequence: AGG
ctccctttatggtttcaagg

SEQ ID NO: 15828 - DNA, 20 bp, Artificial Sequence
  Description of Artificial Sequence: Synthetic oligonucleotide
  Target: FXN; (+) strand; PAM type: NRG; PAM sequence: GGG
tccctttatggtttcaagga

SEQ ID NO: 15829 - DNA, 20 bp, Artificial Sequence
  Description of Artificial Sequence: Synthetic oligonucleotide
  Target: FXN; (+) strand; PAM type: NRG; PAM sequence: TGG
caaggagggcttctcaatct

SEQ ID NO: 15830 - DNA, 20 bp, Artificial Sequence
  Description of Artificial Sequence: Synthetic oligonucleotide
  Target: FXN; (+) strand; PAM type: NRG; PAM sequence: CAG
ggagggcttctcaatcttgg

SEQ ID NO: 15831 - DNA, 20 bp, Artificial Sequence
  Description of Artificial Sequence: Synthetic oligonucleotide
  Target: FXN; (+) strand; PAM type: NRG; PAM sequence: TGG
tctcaatcttggcagaattt

SEQ ID NO: 15832 - DNA, 20 bp, Artificial Sequence
  Description of Artificial Sequence: Synthetic oligonucleotide
  Target: FXN; (+) strand; PAM type: NRG; PAM sequence: TGG
atcttggcagaattttggac

SEQ ID NO: 15833 - DNA, 20 bp, Artificial Sequence
  Description of Artificial Sequence: Synthetic oligonucleotide
  Target: FXN; (+) strand; PAM type: NRG; PAM sequence: TAG
tggcagaattttggactgga

SEQ ID NO: 15834 - DNA, 20 bp, Artificial Sequence
  Description of Artificial Sequence: Synthetic oligonucleotide
  Target: FXN; (+) strand; PAM type: NRG; PAM sequence: CAG
ctggatagttctttgttgca

SEQ ID NO: 15835 - DNA, 20 bp, Artificial Sequence
  Description of Artificial Sequence: Synthetic oligonucleotide
  Target: FXN; (+) strand; PAM type: NRG; PAM sequence: AGG
tggatagttctttgttgcac

SEQ ID NO: 15836 - DNA, 20 bp, Artificial Sequence
  Description of Artificial Sequence: Synthetic oligonucleotide
  Target: FXN; (+) strand; PAM type: NRG; PAM sequence: TGG
atagttctttgttgcacagg

SEQ ID NO: 15837 - DNA, 20 bp, Artificial Sequence
  Description of Artificial Sequence: Synthetic oligonucleotide
  Target: FXN; (+) strand; PAM type: NRG; PAM sequence: GGG
tagttctttgttgcacaggt

SEQ ID NO: 15838 - DNA, 20 bp, Artificial Sequence
  Description of Artificial Sequence: Synthetic oligonucleotide
  Target: FXN; (+) strand; PAM type: NRG; PAM sequence: GGG
agttctttgttgcacaggtg

SEQ ID NO: 15839 - DNA, 20 bp, Artificial Sequence
  Description of Artificial Sequence: Synthetic oligonucleotide
  Target: FXN; (+) strand; PAM type: NRG; PAM sequence: GGG
gttctttgttgcacaggtgg

SEQ ID NO: 15840 - DNA, 20 bp, Artificial Sequence
  Description of Artificial Sequence: Synthetic oligonucleotide
  Target: FXN; (+) strand; PAM type: NRG; PAM sequence: GGG
ttctttgttgcacaggtggg

SEQ ID NO: 15841 - DNA, 20 bp, Artificial Sequence
  Description of Artificial Sequence: Synthetic oligonucleotide
  Target: FXN; (+) strand; PAM type: NRG; PAM sequence: CAG
gggggctgtcctgcacatca

SEQ ID NO: 15842 - DNA, 20 bp, Artificial Sequence
  Description of Artificial Sequence: Synthetic oligonucleotide
  Target: FXN; (+) strand; PAM type: NRG; PAM sequence: AGG
ggggctgtcctgcacatcac

SEQ ID NO: 15843 - DNA, 20 bp, Artificial Sequence
  Description of Artificial Sequence: Synthetic oligonucleotide
  Target: FXN; (+) strand; PAM type: NRG; PAM sequence: TGG
atcacaggatgtttcatccc

SEQ ID NO: 15844 - DNA, 20 bp, Artificial Sequence
  Description of Artificial Sequence: Synthetic oligonucleotide
  Target: FXN; (+) strand; PAM type: NRG; PAM sequence: TAG
catccctggcctctacctac

SEQ ID NO: 15845 - DNA, 20 bp, Artificial Sequence
  Description of Artificial Sequence: Synthetic oligonucleotide
  Target: FXN; (+) strand; PAM type: NRG; PAM sequence: CAG
ggcctctacctactagatgc

SEQ ID NO: 15846 - DNA, 20 bp, Artificial Sequence
  Description of Artificial Sequence: Synthetic oligonucleotide
  Target: FXN; (+) strand; PAM type: NRG; PAM sequence: TAG
ctctacctactagatgccag

SEQ ID NO: 15847 - DNA, 20 bp, Artificial Sequence
  Description of Artificial Sequence: Synthetic oligonucleotide
  Target: FXN; (+) strand; PAM type: NRG; PAM sequence: CAG
agtagaacatacccacccca

SEQ ID NO: 15848 - DNA, 20 bp, Artificial Sequence
  Description of Artificial Sequence: Synthetic oligonucleotide
  Target: FXN; (+) strand; PAM type: NRG; PAM sequence: AAG
ctgcctgttgtgacaatcaa

SEQ ID NO: 15849 - DNA, 20 bp, Artificial Sequence
  Description of Artificial Sequence: Synthetic oligonucleotide
  Target: FXN; (+) strand; PAM type: NRG; PAM sequence: CAG
gtgacaatcaaaagcatctc

SEQ ID NO: 15850 - DNA, 20 bp, Artificial Sequence
  Description of Artificial Sequence: Synthetic oligonucleotide
  Target: FXN; (+) strand; PAM type: NRG; PAM sequence: CAG
aagcatctccagatactttg

SEQ ID NO: 15851 - DNA, 20 bp, Artificial Sequence
  Description of Artificial Sequence: Synthetic oligonucleotide
  Target: FXN; (+) strand; PAM type: NRG; PAM sequence: AGG
agcatctccagatactttgc

SEQ ID NO: 15852 - DNA, 20 bp, Artificial Sequence
  Description of Artificial Sequence: Synthetic oligonucleotide
  Target: FXN; (+) strand; PAM type: NRG; PAM sequence: GGG
gcatctccagatactttgca

SEQ ID NO: 15853 - DNA, 20 bp, Artificial Sequence
  Description of Artificial Sequence: Synthetic oligonucleotide
  Target: FXN; (+) strand; PAM type: NRG; PAM sequence: GGG
catctccagatactttgcag

SEQ ID NO: 15854 - DNA, 20 bp, Artificial Sequence
  Description of Artificial Sequence: Synthetic oligonucleotide
  Target: FXN; (+) strand; PAM type: NRG; PAM sequence: GGG
atctccagatactttgcagg

SEQ ID NO: 15855 - DNA, 20 bp, Artificial Sequence
  Description of Artificial Sequence: Synthetic oligonucleotide
  Target: FXN; (+) strand; PAM type: NRG; PAM sequence: CAG
cagggggaaaatgatttctc

SEQ ID NO: 15856 - DNA, 20 bp, Artificial Sequence
  Description of Artificial Sequence: Synthetic oligonucleotide
  Target: FXN; (+) strand; PAM type: NRG; PAM sequence: AGG
agggggaaaatgatttctcc

SEQ ID NO: 15857 - DNA, 20 bp, Artificial Sequence
  Description of Artificial Sequence: Synthetic oligonucleotide
  Target: FXN; (+) strand; PAM type: NRG; PAM sequence: TGG
gaaaatgatttctccaggcc

SEQ ID NO: 15858 - DNA, 20 bp, Artificial Sequence
  Description of Artificial Sequence: Synthetic oligonucleotide
  Target: FXN; (+) strand; PAM type: NRG; PAM sequence: CAG
caggcctggcatatacataa

SEQ ID NO: 15859 - DNA, 20 bp, Artificial Sequence
  Description of Artificial Sequence: Synthetic oligonucleotide
  Target: FXN; (+) strand; PAM type: NRG; PAM sequence: AAG
gcatatacataacagtattt

SEQ ID NO: 15860 - DNA, 20 bp, Artificial Sequence
  Description of Artificial Sequence: Synthetic oligonucleotide
  Target: FXN; (+) strand; PAM type: NRG; PAM sequence: CAG
tatacataacagtatttaag

SEQ ID NO: 15861 - DNA, 20 bp, Artificial Sequence
  Description of Artificial Sequence: Synthetic oligonucleotide
  Target: FXN; (+) strand; PAM type: NRG; PAM sequence: TAG
acagtatttaagcagctgcc

SEQ ID NO: 15862 - DNA, 20 bp, Artificial Sequence
  Description of Artificial Sequence: Synthetic oligonucleotide
  Target: FXN; (+) strand; PAM type: NRG; PAM sequence: CAG
tgcctagaattaattaaaca

SEQ ID NO: 15863 - DNA, 20 bp, Artificial Sequence
  Description of Artificial Sequence: Synthetic oligonucleotide
  Target: FXN; (+) strand; PAM type: NRG; PAM sequence: AAG
ctagaattaattaaacacag

SEQ ID NO: 15864 - DNA, 20 bp, Artificial Sequence
  Description of Artificial Sequence: Synthetic oligonucleotide
  Target: FXN; (+) strand; PAM type: NRG; PAM sequence: AGG
tagaattaattaaacacaga

SEQ ID NO: 15865 - DNA, 20 bp, Artificial Sequence
  Description of Artificial Sequence: Synthetic oligonucleotide
  Target: FXN; (+) strand; PAM type: NRG; PAM sequence: CAG
acagaaggatgtctctcatc

SEQ ID NO: 15866 - DNA, 20 bp, Artificial Sequence
  Description of Artificial Sequence: Synthetic oligonucleotide
  Target: FXN; (+) strand; PAM type: NRG; PAM sequence: TGG
gtctctcatccagaatgccc

SEQ ID NO: 15867 - DNA, 20 bp, Artificial Sequence
  Description of Artificial Sequence: Synthetic oligonucleotide
  Target: FXN; (+) strand; PAM type: NRG; PAM sequence: TAG
gccctggaccacctctttga

SEQ ID NO: 15868 - DNA, 20 bp, Artificial Sequence
  Description of Artificial Sequence: Synthetic oligonucleotide
  Target: FXN; (+) strand; PAM type: NRG; PAM sequence: AGG
ccctggaccacctctttgat

SEQ ID NO: 15869 - DNA, 20 bp, Artificial Sequence
  Description of Artificial Sequence: Synthetic oligonucleotide
  Target: FXN; (+) strand; PAM type: NRG; PAM sequence: CAG
ccacctctttgataggcaat

SEQ ID NO: 15870 - DNA, 20 bp, Artificial Sequence
  Description of Artificial Sequence: Synthetic oligonucleotide
  Target: FXN; (+) strand; PAM type: NRG; PAM sequence: AAG
cctcctccaccctatttttg

SEQ ID NO: 15871 - DNA, 20 bp, Artificial Sequence
  Description of Artificial Sequence: Synthetic oligonucleotide
  Target: FXN; (+) strand; PAM type: NRG; PAM sequence: AGG
ctcctccaccctatttttga

SEQ ID NO: 15872 - DNA, 20 bp, Artificial Sequence
  Description of Artificial Sequence: Synthetic oligonucleotide
  Target: FXN; (+) strand; PAM type: NRG; PAM sequence: TAG
ttccttgattcccccatccc

SEQ ID NO: 15873 - DNA, 20 bp, Artificial Sequence
  Description of Artificial Sequence: Synthetic oligonucleotide
  Target: FXN; (+) strand; PAM type: NRG; PAM sequence: TAG
cactcaacactcacacctgt

SEQ ID NO: 15874 - DNA, 20 bp, Artificial Sequence
  Description of Artificial Sequence: Synthetic oligonucleotide
  Target: FXN; (+) strand; PAM type: NRG; PAM sequence: TAG
tcctcttgacacttgtcatt

SEQ ID NO: 15875 - DNA, 20 bp, Artificial Sequence
  Description of Artificial Sequence: Synthetic oligonucleotide
  Target: FXN; (+) strand; PAM type: NRG; PAM sequence: AAG
cacttgtcatttagcatcct

SEQ ID NO: 15876 - DNA, 20 bp, Artificial Sequence
  Description of Artificial Sequence: Synthetic oligonucleotide
  Target: FXN; (+) strand; PAM type: NRG; PAM sequence: AAG
gtctctcttcacgattcaca

SEQ ID NO: 15877 - DNA, 20 bp, Artificial Sequence
  Description of Artificial Sequence: Synthetic oligonucleotide
  Target: FXN; (+) strand; PAM type: NRG; PAM sequence: TGG
tctcttcacgattcacaaag

SEQ ID NO: 15878 - DNA, 20 bp, Artificial Sequence
  Description of Artificial Sequence: Synthetic oligonucleotide
  Target: FXN; (+) strand; PAM type: NRG; PAM sequence: TGG
cacgattcacaaagtggctt

SEQ ID NO: 15879 - DNA, 20 bp, Artificial Sequence
  Description of Artificial Sequence: Synthetic oligonucleotide
  Target: FXN; (+) strand; PAM type: NRG; PAM sequence: AAG
gattcacaaagtggctttgg

SEQ ID NO: 15880 - DNA, 20 bp, Artificial Sequence
  Description of Artificial Sequence: Synthetic oligonucleotide
  Target: FXN; (+) strand; PAM type: NRG; PAM sequence: TAG
aagtggctttggaagaactt

SEQ ID NO: 15881 - DNA, 20 bp, Artificial Sequence
  Description of Artificial Sequence: Synthetic oligonucleotide
  Target: FXN; (+) strand; PAM type: NRG; PAM sequence: TGG
ccttcccatcttctctgcca

SEQ ID NO: 15882 - DNA, 20 bp, Artificial Sequence
  Description of Artificial Sequence: Synthetic oligonucleotide
  Target: FXN; (+) strand; PAM type: NRG; PAM sequence: AAG
cccatcttctctgccatgga

SEQ ID NO: 15883 - DNA, 20 bp, Artificial Sequence
  Description of Artificial Sequence: Synthetic oligonucleotide
  Target: FXN; (+) strand; PAM type: NRG; PAM sequence: AAG
ctgacattttcttttttttt

SEQ ID NO: 15884 - DNA, 20 bp, Artificial Sequence
  Description of Artificial Sequence: Synthetic oligonucleotide
  Target: FXN; (+) strand; PAM type: NRG; PAM sequence: CAG
cattttctttttttttaaga

SEQ ID NO: 15885 - DNA, 20 bp, Artificial Sequence
  Description of Artificial Sequence: Synthetic oligonucleotide
  Target: FXN; (+) strand; PAM type: NRG; PAM sequence: TGG
aagacagtatcttgctatga

SEQ ID NO: 15886 - DNA, 20 bp, Artificial Sequence
  Description of Artificial Sequence: Synthetic oligonucleotide
  Target: FXN; (+) strand; PAM type: NRG; PAM sequence: CGG
cagtatcttgctatgatggc

SEQ ID NO: 15887 - DNA, 20 bp, Artificial Sequence
  Description of Artificial Sequence: Synthetic oligonucleotide
  Target: FXN; (+) strand; PAM type: NRG; PAM sequence: GGG
agtatcttgctatgatggcc

SEQ ID NO: 15888 - DNA, 20 bp, Artificial Sequence
  Description of Artificial Sequence: Synthetic oligonucleotide
  Target: FXN; (+) strand; PAM type: NRG; PAM sequence: TGG
tcttgctatgatggccgggc

SEQ ID NO: 15889 - DNA, 20 bp, Artificial Sequence
  Description of Artificial Sequence: Synthetic oligonucleotide
  Target: FXN; (+) strand; PAM type: NRG; PAM sequence: TGG
atggccgggctggaatgctg

SEQ ID NO: 15890 - DNA, 20 bp, Artificial Sequence
  Description of Artificial Sequence: Synthetic oligonucleotide
  Target: FXN; (+) strand; PAM type: NRG; PAM sequence: CAG
tggaatgctgtggctattca

SEQ ID NO: 15891 - DNA, 20 bp, Artificial Sequence
  Description of Artificial Sequence: Synthetic oligonucleotide
  Target: FXN; (+) strand; PAM type: NRG; PAM sequence: AGG
ggaatgctgtggctattcac

SEQ ID NO: 15892 - DNA, 20 bp, Artificial Sequence
  Description of Artificial Sequence: Synthetic oligonucleotide
  Target: FXN; (+) strand; PAM type: NRG; PAM sequence: TAG
gctattcacaggcacaatca

SEQ ID NO: 15893 - DNA, 20 bp, Artificial Sequence
  Description of Artificial Sequence: Synthetic oligonucleotide
  Target: FXN; (+) strand; PAM type: NRG; PAM sequence: CAG
ggcacaatcatagctcactg

SEQ ID NO: 15894 - DNA, 20 bp, Artificial Sequence
  Description of Artificial Sequence: Synthetic oligonucleotide
  Target: FXN; (+) strand; PAM type: NRG; PAM sequence: GAG
tcatagctcactgcagcctt

SEQ ID NO: 15895 - DNA, 20 bp, Artificial Sequence
  Description of Artificial Sequence: Synthetic oligonucleotide
  Target: FXN; (+) strand; PAM type: NRG; PAM sequence: CAG
tcactgcagccttgagctcc

SEQ ID NO: 15896 - DNA, 20 bp, Artificial Sequence
  Description of Artificial Sequence: Synthetic oligonucleotide
  Target: FXN; (+) strand; PAM type: NRG; PAM sequence: AGG
cactgcagccttgagctccc

SEQ ID NO: 15897 - DNA, 20 bp, Artificial Sequence
  Description of Artificial Sequence: Synthetic oligonucleotide
  Target: FXN; (+) strand; PAM type: NRG; PAM sequence: AAG
agccttgagctcccaggctc

SEQ ID NO: 15898 - DNA, 20 bp, Artificial Sequence
  Description of Artificial Sequence: Synthetic oligonucleotide
  Target: FXN; (+) strand; PAM type: NRG; PAM sequence: CAG
ctcaagtgatcctcccgcct

SEQ ID NO: 15899 - DNA, 20 bp, Artificial Sequence
  Description of Artificial Sequence: Synthetic oligonucleotide
  Target: FXN; (+) strand; PAM type: NRG; PAM sequence: GAG
tcctcccgcctcagcctcct

SEQ ID NO: 15900 - DNA, 20 bp, Artificial Sequence
  Description of Artificial Sequence: Synthetic oligonucleotide
  Target: FXN; (+) strand; PAM type: NRG; PAM sequence: TAG
tcccgcctcagcctcctgag

SEQ ID NO: 15901 - DNA, 20 bp, Artificial Sequence
  Description of Artificial Sequence: Synthetic oligonucleotide
  Target: FXN; (+) strand; PAM type: NRG; PAM sequence: GAG
cctcagcctcctgagtagct

SEQ ID NO: 15902 - DNA, 20 bp, Artificial Sequence
  Description of Artificial Sequence: Synthetic oligonucleotide
  Target: FXN; (+) strand; PAM type: NRG; PAM sequence: CAG
ctcctgagtagctgagatca

SEQ ID NO: 15903 - DNA, 20 bp, Artificial Sequence
  Description of Artificial Sequence: Synthetic oligonucleotide
  Target: FXN; (+) strand; PAM type: NRG; PAM sequence: AGG
tcctgagtagctgagatcac

SEQ ID NO: 15904 - DNA, 20 bp, Artificial Sequence
  Description of Artificial Sequence: Synthetic oligonucleotide
  Target: FXN; (+) strand; PAM type: NRG; PAM sequence: CGG
caggcatgcactaccacact

SEQ ID NO: 15905 - DNA, 20 bp, Artificial Sequence
  Description of Artificial Sequence: Synthetic oligonucleotide
  Target: FXN; (+) strand; PAM type: NRG; PAM sequence: AAG
ctcacatttgacatcctcta

SEQ ID NO: 15906 - DNA, 20 bp, Artificial Sequence
  Description of Artificial Sequence: Synthetic oligonucleotide
  Target: FXN; (+) strand; PAM type: NRG; PAM sequence: AAG
taaagcatatataaaatgtg

SEQ ID NO: 15907 - DNA, 20 bp, Artificial Sequence
  Description of Artificial Sequence: Synthetic oligonucleotide
  Target: FXN; (+) strand; PAM type: NRG; PAM sequence: CAG
catccctttgtaatatgtaa

SEQ ID NO: 15908 - DNA, 20 bp, Artificial Sequence
  Description of Artificial Sequence: Synthetic oligonucleotide
  Target: FXN; (+) strand; PAM type: NRG; PAM sequence: TAG
cttttaaaatctatcaacaa

SEQ ID NO: 15909 - DNA, 20 bp, Artificial Sequence
  Description of Artificial Sequence: Synthetic oligonucleotide
  Target: FXN; (+) strand; PAM type: NRG; PAM sequence: AGG
ttttaaaatctatcaacaat

SEQ ID NO: 15910 - DNA, 20 bp, Artificial Sequence
  Description of Artificial Sequence: Synthetic oligonucleotide
  Target: FXN; (+) strand; PAM type: NRG; PAM sequence: AAG
aaaatctatcaacaataggc

SEQ ID NO: 15911 - DNA, 20 bp, Artificial Sequence
  Description of Artificial Sequence: Synthetic oligonucleotide
  Target: FXN; (+) strand; PAM type: NRG; PAM sequence: AGG
aaatctatcaacaataggca

SEQ ID NO: 15912 - DNA, 20 bp, Artificial Sequence
  Description of Artificial Sequence: Synthetic oligonucleotide
  Target: FXN; (+) strand; PAM type: NRG; PAM sequence: CGG
tatcaacaataggcaaggca

SEQ ID NO: 15913 - DNA, 20 bp, Artificial Sequence
  Description of Artificial Sequence: Synthetic oligonucleotide
  Target: FXN; (+) strand; PAM type: NRG; PAM sequence: TGG
caacaataggcaaggcacgg

SEQ ID NO: 15914 - DNA, 20 bp, Artificial Sequence
  Description of Artificial Sequence: Synthetic oligonucleotide
  Target: FXN; (+) strand; PAM type: NRG; PAM sequence: CAG
gtggctcacgcctgtcgtct

SEQ ID NO: 15915 - DNA, 20 bp, Artificial Sequence
  Description of Artificial Sequence: Synthetic oligonucleotide
  Target: FXN; (+) strand; PAM type: NRG; PAM sequence: GAG
ctgtcgtctcagcactttgt

SEQ ID NO: 15916 - DNA, 20 bp, Artificial Sequence
  Description of Artificial Sequence: Synthetic oligonucleotide
  Target: FXN; (+) strand; PAM type: NRG; PAM sequence: AGG
tgtcgtctcagcactttgtg

SEQ ID NO: 15917 - DNA, 20 bp, Artificial Sequence
  Description of Artificial Sequence: Synthetic oligonucleotide
  Target: FXN; (+) strand; PAM type: NRG; PAM sequence: CAG
tctcagcactttgtgaggcc

SEQ ID NO: 15918 - DNA, 20 bp, Artificial Sequence
  Description of Artificial Sequence: Synthetic oligonucleotide
  Target: FXN; (+) strand; PAM type: NRG; PAM sequence: AGG
ctcagcactttgtgaggccc

SEQ ID NO: 15919 - DNA, 20 bp, Artificial Sequence
  Description of Artificial Sequence: Synthetic oligonucleotide
  Target: FXN; (+) strand; PAM type: NRG; PAM sequence: CGG
agcactttgtgaggcccagg

SEQ ID NO: 15920 - DNA, 20 bp, Artificial Sequence
  Description of Artificial Sequence: Synthetic oligonucleotide
  Target: FXN; (+) strand; PAM type: NRG; PAM sequence: GGG
gcactttgtgaggcccaggc

SEQ ID NO: 15921 - DNA, 20 bp, Artificial Sequence
  Description of Artificial Sequence: Synthetic oligonucleotide
  Target: FXN; (+) strand; PAM type: NRG; PAM sequence: CAG
ctttgtgaggcccaggcggg

SEQ ID NO: 15922 - DNA, 20 bp, Artificial Sequence
  Description of Artificial Sequence: Synthetic oligonucleotide
  Target: FXN; (+) strand; PAM type: NRG; PAM sequence: GAG
cccaggcgggcagatcgttt

SEQ ID NO: 15923 - DNA, 20 bp, Artificial Sequence
  Description of Artificial Sequence: Synthetic oligonucleotide
  Target: FXN; (+) strand; PAM type: NRG; PAM sequence: TAG
gcgggcagatcgtttgagcc

SEQ ID NO: 15924 - DNA, 20 bp, Artificial Sequence
  Description of Artificial Sequence: Synthetic oligonucleotide
  Target: FXN; (+) strand; PAM type: NRG; PAM sequence: AAG
ggcagatcgtttgagcctag

SEQ ID NO: 15925 - DNA, 20 bp, Artificial Sequence
  Description of Artificial Sequence: Synthetic oligonucleotide
  Target: FXN; (+) strand; PAM type: NRG; PAM sequence: AAG
tcgtttgagcctagaagttc

SEQ ID NO: 15926 - DNA, 20 bp, Artificial Sequence
  Description of Artificial Sequence: Synthetic oligonucleotide
  Target: FXN; (+) strand; PAM type: NRG; PAM sequence: TGG
ctagaagttcaagaccaccc

SEQ ID NO: 15927 - DNA, 20 bp, Artificial Sequence
  Description of Artificial Sequence: Synthetic oligonucleotide
  Target: FXN; (+) strand; PAM type: NRG; PAM sequence: GGG
tagaagttcaagaccaccct

SEQ ID NO: 15928 - DNA, 20 bp, Artificial Sequence
  Description of Artificial Sequence: Synthetic oligonucleotide
  Target: FXN; (+) strand; PAM type: NRG; PAM sequence: TAG
caagaccaccctgggcaaca

SEQ ID NO: 15929 - DNA, 20 bp, Artificial Sequence
  Description of Artificial Sequence: Synthetic oligonucleotide
  Target: FXN; (+) strand; PAM type: NRG; PAM sequence: TAG
tctacaaaaaatacaaaaac

SEQ ID NO: 15930 - DNA, 20 bp, Artificial Sequence
  Description of Artificial Sequence: Synthetic oligonucleotide
  Target: FXN; (+) strand; PAM type: NRG; PAM sequence: TGG
caaaaaatacaaaaactagc

SEQ ID NO: 15931 - DNA, 20 bp, Artificial Sequence
  Description of Artificial Sequence: Synthetic oligonucleotide
  Target: FXN; (+) strand; PAM type: NRG; PAM sequence: GGG
aaaaaatacaaaaactagct

SEQ ID NO: 15932 - DNA, 20 bp, Artificial Sequence
  Description of Artificial Sequence: Synthetic oligonucleotide
  Target: FXN; (+) strand; PAM type: NRG; PAM sequence: TGG
atacaaaaactagctgggtg

SEQ ID NO: 15933 - DNA, 20 bp, Artificial Sequence
  Description of Artificial Sequence: Synthetic oligonucleotide
  Target: FXN; (+) strand; PAM type: NRG; PAM sequence: TGG
caaaaactagctgggtgtgg

SEQ ID NO: 15934 - DNA, 20 bp, Artificial Sequence
  Description of Artificial Sequence: Synthetic oligonucleotide
  Target: FXN; (+) strand; PAM type: NRG; PAM sequence: TAG
ggtgtggtggtgcacacctg

SEQ ID NO: 15935 - DNA, 20 bp, Artificial Sequence
  Description of Artificial Sequence: Synthetic oligonucleotide
  Target: FXN; (+) strand; PAM type: NRG; PAM sequence: CAG
gtggtgcacacctgtagtcc

SEQ ID NO: 15936 - DNA, 20 bp, Artificial Sequence
  Description of Artificial Sequence: Synthetic oligonucleotide
  Target: FXN; (+) strand; PAM type: NRG; PAM sequence: TGG
cacctgtagtcccagctact

SEQ ID NO: 15937 - DNA, 20 bp, Artificial Sequence
  Description of Artificial Sequence: Synthetic oligonucleotide
  Target: FXN; (+) strand; PAM type: NRG; PAM sequence: AAG
ctgtagtcccagctacttgg

SEQ ID NO: 15938 - DNA, 20 bp, Artificial Sequence
  Description of Artificial Sequence: Synthetic oligonucleotide
  Target: FXN; (+) strand; PAM type: NRG; PAM sequence: AGG
tgtagtcccagctacttgga

SEQ ID NO: 15939 - DNA, 20 bp, Artificial Sequence
  Description of Artificial Sequence: Synthetic oligonucleotide
  Target: FXN; (+) strand; PAM type: NRG; PAM sequence: TGG
agctacttggaaggctgaaa

SEQ ID NO: 15940 - DNA, 20 bp, Artificial Sequence
  Description of Artificial Sequence: Synthetic oligonucleotide
  Target: FXN; (+) strand; PAM type: NRG; PAM sequence: GGG
gctacttggaaggctgaaat

SEQ ID NO: 15941 - DNA, 20 bp, Artificial Sequence
  Description of Artificial Sequence: Synthetic oligonucleotide
  Target: FXN; (+) strand; PAM type: NRG; PAM sequence: AAG
acttggaaggctgaaatggg

SEQ ID NO: 15942 - DNA, 20 bp, Artificial Sequence
  Description of Artificial Sequence: Synthetic oligonucleotide
  Target: FXN; (+) strand; PAM type: NRG; PAM sequence: GAG
ctgaaatgggaagactgctt

SEQ ID NO: 15943 - DNA, 20 bp, Artificial Sequence
  Description of Artificial Sequence: Synthetic oligonucleotide
  Target: FXN; (+) strand; PAM type: NRG; PAM sequence: CGG
atgggaagactgcttgagcc

SEQ ID NO: 15944 - DNA, 20 bp, Artificial Sequence
  Description of Artificial Sequence: Synthetic oligonucleotide
  Target: FXN; (+) strand; PAM type: NRG; PAM sequence: GGG
tgggaagactgcttgagccc

SEQ ID NO: 15945 - DNA, 20 bp, Artificial Sequence
  Description of Artificial Sequence: Synthetic oligonucleotide
  Target: FXN; (+) strand; PAM type: NRG; PAM sequence: GAG
ggaagactgcttgagcccgg

SEQ ID NO: 15946 - DNA, 20 bp, Artificial Sequence
  Description of Artificial Sequence: Synthetic oligonucleotide
  Target: FXN; (+) strand; PAM type: NRG; PAM sequence: AGG
gaagactgcttgagcccggg

SEQ ID NO: 15947 - DNA, 20 bp, Artificial Sequence
  Description of Artificial Sequence: Synthetic oligonucleotide
  Target: FXN; (+) strand; PAM type: NRG; PAM sequence: GGG
aagactgcttgagcccggga

SEQ ID NO: 15948 - DNA, 20 bp, Artificial Sequence
  Description of Artificial Sequence: Synthetic oligonucleotide
  Target: FXN; (+) strand; PAM type: NRG; PAM sequence: GAG
gactgcttgagcccgggagg

SEQ ID NO: 15949 - DNA, 20 bp, Artificial Sequence
  Description of Artificial Sequence: Synthetic oligonucleotide
  Target: FXN; (+) strand; PAM type: NRG; PAM sequence: AAG
tgcttgagcccgggagggag

SEQ ID NO: 15950 - DNA, 20 bp, Artificial Sequence
  Description of Artificial Sequence: Synthetic oligonucleotide
  Target: FXN; (+) strand; PAM type: NRG; PAM sequence: CAG
agcccgggagggagaagttg

SEQ ID NO: 15951 - DNA, 20 bp, Artificial Sequence
  Description of Artificial Sequence: Synthetic oligonucleotide
  Target: FXN; (+) strand; PAM type: NRG; PAM sequence: AAG
cgggagggagaagttgcagt

SEQ ID NO: 15952 - DNA, 20 bp, Artificial Sequence
  Description of Artificial Sequence: Synthetic oligonucleotide
  Target: FXN; (+) strand; PAM type: NRG; PAM sequence: CAG
agggagaagttgcagtaagc

SEQ ID NO: 15953 - DNA, 20 bp, Artificial Sequence
  Description of Artificial Sequence: Synthetic oligonucleotide
  Target: FXN; (+) strand; PAM type: NRG; PAM sequence: AGG
gggagaagttgcagtaagcc

SEQ ID NO: 15954 - DNA, 20 bp, Artificial Sequence
  Description of Artificial Sequence: Synthetic oligonucleotide
  Target: FXN; (+) strand; PAM type: NRG; PAM sequence: CAG
aggaccacaccactgcactc

SEQ ID NO: 15955 - DNA, 20 bp, Artificial Sequence
  Description of Artificial Sequence: Synthetic oligonucleotide
  Target: FXN; (+) strand; PAM type: NRG; PAM sequence: TGG
cacaccactgcactccagcc

SEQ ID NO: 15956 - DNA, 20 bp, Artificial Sequence
  Description of Artificial Sequence: Synthetic oligonucleotide
  Target: FXN; (+) strand; PAM type: NRG; PAM sequence: GGG
acaccactgcactccagcct

SEQ ID NO: 15957 - DNA, 20 bp, Artificial Sequence
  Description of Artificial Sequence: Synthetic oligonucleotide
  Target: FXN; (+) strand; PAM type: NRG; PAM sequence: CAG
ctgcactccagcctgggcaa

SEQ ID NO: 15958 - DNA, 20 bp, Artificial Sequence
  Description of Artificial Sequence: Synthetic oligonucleotide
  Target: FXN; (+) strand; PAM type: NRG; PAM sequence: GAG
gcactccagcctgggcaaca

SEQ ID NO: 15959 - DNA, 20 bp, Artificial Sequence
  Description of Artificial Sequence: Synthetic oligonucleotide
  Target: FXN; (+) strand; PAM type: NRG; PAM sequence: GAG
tccagcctgggcaacagagt

SEQ ID NO: 15960 - DNA, 20 bp, Artificial Sequence
  Description of Artificial Sequence: Synthetic oligonucleotide
  Target: FXN; (+) strand; PAM type: NRG; PAM sequence: GAG
tctcaaacaaacaaataaat

SEQ ID NO: 15961 - DNA, 20 bp, Artificial Sequence
  Description of Artificial Sequence: Synthetic oligonucleotide
  Target: FXN; (+) strand; PAM type: NRG; PAM sequence: AGG
ctcaaacaaacaaataaatg

SEQ ID NO: 15962 - DNA, 20 bp, Artificial Sequence
  Description of Artificial Sequence: Synthetic oligonucleotide
  Target: FXN; (+) strand; PAM type: NRG; PAM sequence: CGG
aaacaaacaaataaatgagg

SEQ ID NO: 15963 - DNA, 20 bp, Artificial Sequence
  Description of Artificial Sequence: Synthetic oligonucleotide
  Target: FXN; (+) strand; PAM type: NRG; PAM sequence: GGG
aacaaacaaataaatgaggc

SEQ ID NO: 15964 - DNA, 20 bp, Artificial Sequence
  Description of Artificial Sequence: Synthetic oligonucleotide
  Target: FXN; (+) strand; PAM type: NRG; PAM sequence: TGG
aaacaaataaatgaggcggg

SEQ ID NO: 15965 - DNA, 20 bp, Artificial Sequence
  Description of Artificial Sequence: Synthetic oligonucleotide
  Target: FXN; (+) strand; PAM type: NRG; PAM sequence: GAG
aaatgaggcgggtggatcac

SEQ ID NO: 15966 - DNA, 20 bp, Artificial Sequence
  Description of Artificial Sequence: Synthetic oligonucleotide
  Target: FXN; (+) strand; PAM type: NRG; PAM sequence: AGG
aatgaggcgggtggatcacg

SEQ ID NO: 15967 - DNA, 20 bp, Artificial Sequence
  Description of Artificial Sequence: Synthetic oligonucleotide
  Target: FXN; (+) strand; PAM type: NRG; PAM sequence: CAG
aggcgggtggatcacgaggt

SEQ ID NO: 15968 - DNA, 20 bp, Artificial Sequence
  Description of Artificial Sequence: Synthetic oligonucleotide
  Target: FXN; (+) strand; PAM type: NRG; PAM sequence: TAG
cgggtggatcacgaggtcag

SEQ ID NO: 15969 - DNA, 20 bp, Artificial Sequence
  Description of Artificial Sequence: Synthetic oligonucleotide
  Target: FXN; (+) strand; PAM type: NRG; PAM sequence: GAG
gatcacgaggtcagtagatc

SEQ ID NO: 15970 - DNA, 20 bp, Artificial Sequence
  Description of Artificial Sequence: Synthetic oligonucleotide
  Target: FXN; (+) strand; PAM type: NRG; PAM sequence: TGG
tcagtagatcgagaccatcc

SEQ ID NO: 15971 - DNA, 20 bp, Artificial Sequence
  Description of Artificial Sequence: Synthetic oligonucleotide
  Target: FXN; (+) strand; PAM type: NRG; PAM sequence: CGG
cgagaccatcctggctaaca

SEQ ID NO: 15972 - DNA, 20 bp, Artificial Sequence
  Description of Artificial Sequence: Synthetic oligonucleotide
  Target: FXN; (+) strand; PAM type: NRG; PAM sequence: TAG
aaaaaaaaaatacaaaaaat

SEQ ID NO: 15973 - DNA, 20 bp, Artificial Sequence
  Description of Artificial Sequence: Synthetic oligonucleotide
  Target: FXN; (+) strand; PAM type: NRG; PAM sequence: CAG
aaaaaatacaaaaaattagc

SEQ ID NO: 15974 - DNA, 20 bp, Artificial Sequence
  Description of Artificial Sequence: Synthetic oligonucleotide
  Target: FXN; (+) strand; PAM type: NRG; PAM sequence: AGG
aaaaatacaaaaaattagcc

SEQ ID NO: 15975 - DNA, 20 bp, Artificial Sequence
  Description of Artificial Sequence: Synthetic oligonucleotide
  Target: FXN; (+) strand; PAM type: NRG; PAM sequence: TGG
tacaaaaaattagccaggca

SEQ ID NO: 15976 - DNA, 20 bp, Artificial Sequence
  Description of Artificial Sequence: Synthetic oligonucleotide
  Target: FXN; (+) strand; PAM type: NRG; PAM sequence: TGG
aaaaaattagccaggcatgg

SEQ ID NO: 15977 - DNA, 20 bp, Artificial Sequence
  Description of Artificial Sequence: Synthetic oligonucleotide
  Target: FXN; (+) strand; PAM type: NRG; PAM sequence: CGG
aaattagccaggcatggtgg

SEQ ID NO: 15978 - DNA, 20 bp, Artificial Sequence
  Description of Artificial Sequence: Synthetic oligonucleotide
  Target: FXN; (+) strand; PAM type: NRG; PAM sequence: GGG
aattagccaggcatggtggc

SEQ ID NO: 15979 - DNA, 20 bp, Artificial Sequence
  Description of Artificial Sequence: Synthetic oligonucleotide
  Target: FXN; (+) strand; PAM type: NRG; PAM sequence: TAG
ggcatggtggcgggcgcctg

SEQ ID NO: 15980 - DNA, 20 bp, Artificial Sequence
  Description of Artificial Sequence: Synthetic oligonucleotide
  Target: FXN; (+) strand; PAM type: NRG; PAM sequence: CAG
gtggcgggcgcctgtagtcc

SEQ ID NO: 15981 - DNA, 20 bp, Artificial Sequence
  Description of Artificial Sequence: Synthetic oligonucleotide
  Target: FXN; (+) strand; PAM type: NRG; PAM sequence: CGG
cgcctgtagtcccagttact

SEQ ID NO: 15982 - DNA, 20 bp, Artificial Sequence
  Description of Artificial Sequence: Synthetic oligonucleotide
  Target: FXN; (+) strand; PAM type: NRG; PAM sequence: GGG
gcctgtagtcccagttactc

SEQ ID NO: 15983 - DNA, 20 bp, Artificial Sequence
  Description of Artificial Sequence: Synthetic oligonucleotide
  Target: FXN; (+) strand; PAM type: NRG; PAM sequence: GAG
ctgtagtcccagttactcgg

SEQ ID NO: 15984 - DNA, 20 bp, Artificial Sequence
  Description of Artificial Sequence: Synthetic oligonucleotide
  Target: FXN; (+) strand; PAM type: NRG; PAM sequence: AGG
tgtagtcccagttactcggg

SEQ ID NO: 15985 - DNA, 20 bp, Artificial Sequence
  Description of Artificial Sequence: Synthetic oligonucleotide
  Target: FXN; (+) strand; PAM type: NRG; PAM sequence: GAG
tcccagttactcgggaggct

SEQ ID NO: 15986 - DNA, 20 bp, Artificial Sequence
  Description of Artificial Sequence: Synthetic oligonucleotide
  Target: FXN; (+) strand; PAM type: NRG; PAM sequence: AGG
cccagttactcgggaggctg

SEQ ID NO: 15987 - DNA, 20 bp, Artificial Sequence
  Description of Artificial Sequence: Synthetic oligonucleotide
  Target: FXN; (+) strand; PAM type: NRG; PAM sequence: CAG
agttactcgggaggctgagg

SEQ ID NO: 15988 - DNA, 20 bp, Artificial Sequence
  Description of Artificial Sequence: Synthetic oligonucleotide
  Target: FXN; (+) strand; PAM type: NRG; PAM sequence: AGG
gttactcgggaggctgaggc

SEQ ID NO: 15989 - DNA, 20 bp, Artificial Sequence
  Description of Artificial Sequence: Synthetic oligonucleotide
  Target: FXN; (+) strand; PAM type: NRG; PAM sequence: GAG
tactcgggaggctgaggcag

SEQ ID NO: 15990 - DNA, 20 bp, Artificial Sequence
  Description of Artificial Sequence: Synthetic oligonucleotide
  Target: FXN; (+) strand; PAM type: NRG; PAM sequence: TGG
gggaggctgaggcaggagaa

SEQ ID NO: 15991 - DNA, 20 bp, Artificial Sequence
  Description of Artificial Sequence: Synthetic oligonucleotide
  Target: FXN; (+) strand; PAM type: NRG; PAM sequence: CGG
gcaggagaatggcgtgaaac

SEQ ID NO: 15992 - DNA, 20 bp, Artificial Sequence
  Description of Artificial Sequence: Synthetic oligonucleotide
  Target: FXN; (+) strand; PAM type: NRG; PAM sequence: GGG
caggagaatggcgtgaaacc

SEQ ID NO: 15993 - DNA, 20 bp, Artificial Sequence
  Description of Artificial Sequence: Synthetic oligonucleotide
  Target: FXN; (+) strand; PAM type: NRG; PAM sequence: GAG
ggagaatggcgtgaaaccgg

SEQ ID NO: 15994 - DNA, 20 bp, Artificial Sequence
  Description of Artificial Sequence: Synthetic oligonucleotide
  Target: FXN; (+) strand; PAM type: NRG; PAM sequence: AGG
gagaatggcgtgaaaccggg

SEQ ID NO: 15995 - DNA, 20 bp, Artificial Sequence
  Description of Artificial Sequence: Synthetic oligonucleotide
  Target: FXN; (+) strand; PAM type: NRG; PAM sequence: CAG
aatggcgtgaaaccgggagg

SEQ ID NO: 15996 - DNA, 20 bp, Artificial Sequence
  Description of Artificial Sequence: Synthetic oligonucleotide
  Target: FXN; (+) strand; PAM type: NRG; PAM sequence: GAG
tggcgtgaaaccgggaggca

SEQ ID NO: 15997 - DNA, 20 bp, Artificial Sequence
  Description of Artificial Sequence: Synthetic oligonucleotide
  Target: FXN; (+) strand; PAM type: NRG; PAM sequence: CAG
aaaccgggaggcagagcttg

SEQ ID NO: 15998 - DNA, 20 bp, Artificial Sequence
  Description of Artificial Sequence: Synthetic oligonucleotide
  Target: FXN; (+) strand; PAM type: NRG; PAM sequence: GAG
cgggaggcagagcttgcagt

SEQ ID NO: 15999 - DNA, 20 bp, Artificial Sequence
  Description of Artificial Sequence: Synthetic oligonucleotide
  Target: FXN; (+) strand; PAM type: NRG; PAM sequence: GAG
ggcagagcttgcagtgagcc

SEQ ID NO: 16000 - DNA, 20 bp, Artificial Sequence
  Description of Artificial Sequence: Synthetic oligonucleotide
  Target: FXN; (+) strand; PAM type: NRG; PAM sequence: CAG
gagatcgcaccactgccctc

SEQ ID NO: 16001 - DNA, 20 bp, Artificial Sequence
  Description of Artificial Sequence: Synthetic oligonucleotide
  Target: FXN; (+) strand; PAM type: NRG; PAM sequence: TGG
cgcaccactgccctccagcc

SEQ ID NO: 16002 - DNA, 20 bp, Artificial Sequence
  Description of Artificial Sequence: Synthetic oligonucleotide
  Target: FXN; (+) strand; PAM type: NRG; PAM sequence: GGG
gcaccactgccctccagcct

SEQ ID NO: 16003 - DNA, 20 bp, Artificial Sequence
  Description of Artificial Sequence: Synthetic oligonucleotide
  Target: FXN; (+) strand; PAM type: NRG; PAM sequence: CAG
ctgccctccagcctgggcga

SEQ ID NO: 16004 - DNA, 20 bp, Artificial Sequence
  Description of Artificial Sequence: Synthetic oligonucleotide
  Target: FXN; (+) strand; PAM type: NRG; PAM sequence: GAG
gccctccagcctgggcgaca

SEQ ID NO: 16005 - DNA, 20 bp, Artificial Sequence
  Description of Artificial Sequence: Synthetic oligonucleotide
  Target: FXN; (+) strand; PAM type: NRG; PAM sequence: GAG
tccagcctgggcgacagagc

SEQ ID NO: 16006 - DNA, 20 bp, Artificial Sequence
  Description of Artificial Sequence: Synthetic oligonucleotide
  Target: FXN; (+) strand; PAM type: NRG; PAM sequence: CAG
aatatttattgtgcacttaa

SEQ ID NO: 16007 - DNA, 20 bp, Artificial Sequence
  Description of Artificial Sequence: Synthetic oligonucleotide
  Target: FXN; (+) strand; PAM type: NRG; PAM sequence: AGG
atatttattgtgcacttaac

SEQ ID NO: 16008 - DNA, 20 bp, Artificial Sequence
  Description of Artificial Sequence: Synthetic oligonucleotide
  Target: FXN; (+) strand; PAM type: NRG; PAM sequence: CAG
cctgtccaaaaaaaacttta

SEQ ID NO: 16009 - DNA, 20 bp, Artificial Sequence
  Description of Artificial Sequence: Synthetic oligonucleotide
  Target: FXN; (+) strand; PAM type: NRG; PAM sequence: AGG
ctgtccaaaaaaaactttac

SEQ ID NO: 16010 - DNA, 20 bp, Artificial Sequence
  Description of Artificial Sequence: Synthetic oligonucleotide
  Target: FXN; (+) strand; PAM type: NRG; PAM sequence: GGG
tgtccaaaaaaaactttaca

SEQ ID NO: 16011 - DNA, 20 bp, Artificial Sequence
  Description of Artificial Sequence: Synthetic oligonucleotide
  Target: FXN; (+) strand; PAM type: NRG; PAM sequence: AAG
atccttaccacaatcctatg

SEQ ID NO: 16012 - DNA, 20 bp, Artificial Sequence
  Description of Artificial Sequence: Synthetic oligonucleotide
  Target: FXN; (+) strand; PAM type: NRG; PAM sequence: TAG
cttaccacaatcctatgaag

SEQ ID NO: 16013 - DNA, 20 bp, Artificial Sequence
  Description of Artificial Sequence: Synthetic oligonucleotide
  Target: FXN; (+) strand; PAM type: NRG; PAM sequence: AGG
ttaccacaatcctatgaagt

SEQ ID NO: 16014 - DNA, 20 bp, Artificial Sequence
  Description of Artificial Sequence: Synthetic oligonucleotide
  Target: FXN; (+) strand; PAM type: NRG; PAM sequence: AAG
ataaaacgcattttataaac

SEQ ID NO: 16015 - DNA, 20 bp, Artificial Sequence
  Description of Artificial Sequence: Synthetic oligonucleotide
  Target: FXN; (+) strand; PAM type: NRG; PAM sequence: AGG
taaaacgcattttataaaca

SEQ ID NO: 16016 - DNA, 20 bp, Artificial Sequence
  Description of Artificial Sequence: Synthetic oligonucleotide
  Target: FXN; (+) strand; PAM type: NRG; PAM sequence: CAG
cgcattttataaacaaggca

SEQ ID NO: 16017 - DNA, 20 bp, Artificial Sequence
  Description of Artificial Sequence: Synthetic oligonucleotide
  Target: FXN; (+) strand; PAM type: NRG; PAM sequence: GAG
cattttataaacaaggcaca

SEQ ID NO: 16018 - DNA, 20 bp, Artificial Sequence
  Description of Artificial Sequence: Synthetic oligonucleotide
  Target: FXN; (+) strand; PAM type: NRG; PAM sequence: GAG
ttttataaacaaggcacaga

SEQ ID NO: 16019 - DNA, 20 bp, Artificial Sequence
  Description of Artificial Sequence: Synthetic oligonucleotide
  Target: FXN; (+) strand; PAM type: NRG; PAM sequence: AGG
tttataaacaaggcacagag

SEQ ID NO: 16020 - DNA, 20 bp, Artificial Sequence
  Description of Artificial Sequence: Synthetic oligonucleotide
  Target: FXN; (+) strand; PAM type: NRG; PAM sequence: TGG
aggttaattaacttgccctc

SEQ ID NO: 16021 - DNA, 20 bp, Artificial Sequence
  Description of Artificial Sequence: Synthetic oligonucleotide
  Target: FXN; (+) strand; PAM type: NRG; PAM sequence: CAG
taacttgccctctggtcaca

SEQ ID NO: 16022 - DNA, 20 bp, Artificial Sequence
  Description of Artificial Sequence: Synthetic oligonucleotide
  Target: FXN; (+) strand; PAM type: NRG; PAM sequence: TAG
ttgccctctggtcacacagc

SEQ ID NO: 16023 - DNA, 20 bp, Artificial Sequence
  Description of Artificial Sequence: Synthetic oligonucleotide
  Target: FXN; (+) strand; PAM type: NRG; PAM sequence: AGG
tgccctctggtcacacagct

SEQ ID NO: 16024 - DNA, 20 bp, Artificial Sequence
  Description of Artificial Sequence: Synthetic oligonucleotide
  Target: FXN; (+) strand; PAM type: NRG; PAM sequence: AAG
cctctggtcacacagctagg

SEQ ID NO: 16025 - DNA, 20 bp, Artificial Sequence
  Description of Artificial Sequence: Synthetic oligonucleotide
  Target: FXN; (+) strand; PAM type: NRG; PAM sequence: TGG
ctggtcacacagctaggaag

SEQ ID NO: 16026 - DNA, 20 bp, Artificial Sequence
  Description of Artificial Sequence: Synthetic oligonucleotide
  Target: FXN; (+) strand; PAM type: NRG; PAM sequence: GGG
tggtcacacagctaggaagt

SEQ ID NO: 16027 - DNA, 20 bp, Artificial Sequence
  Description of Artificial Sequence: Synthetic oligonucleotide
  Target: FXN; (+) strand; PAM type: NRG; PAM sequence: CAG
tcacacagctaggaagtggg

SEQ ID NO: 16028 - DNA, 20 bp, Artificial Sequence
  Description of Artificial Sequence: Synthetic oligonucleotide
  Target: FXN; (+) strand; PAM type: NRG; PAM sequence: GAG
acacagctaggaagtgggca

SEQ ID NO: 16029 - DNA, 20 bp, Artificial Sequence
  Description of Artificial Sequence: Synthetic oligonucleotide
  Target: FXN; (+) strand; PAM type: NRG; PAM sequence: CAG
gctaggaagtgggcagagta

SEQ ID NO: 16030 - DNA, 20 bp, Artificial Sequence
  Description of Artificial Sequence: Synthetic oligonucleotide
  Target: FXN; (+) strand; PAM type: NRG; PAM sequence: AAG
ggcagagtacagatttacac

SEQ ID NO: 16031 - DNA, 20 bp, Artificial Sequence
  Description of Artificial Sequence: Synthetic oligonucleotide
  Target: FXN; (+) strand; PAM type: NRG; PAM sequence: AGG
gcagagtacagatttacaca

SEQ ID NO: 16032 - DNA, 20 bp, Artificial Sequence
  Description of Artificial Sequence: Synthetic oligonucleotide
  Target: FXN; (+) strand; PAM type: NRG; PAM sequence: TGG
tacacaaggcatccgtctcc

SEQ ID NO: 16033 - DNA, 20 bp, Artificial Sequence
  Description of Artificial Sequence: Synthetic oligonucleotide
  Target: FXN; (+) strand; PAM type: NRG; PAM sequence: CGG
caactgctgtaaacccatac

SEQ ID NO: 16034 - DNA, 20 bp, Artificial Sequence
  Description of Artificial Sequence: Synthetic oligonucleotide
  Target: FXN; (+) strand; PAM type: NRG; PAM sequence: CGG
ctgctgtaaacccataccgg

SEQ ID NO: 16035 - DNA, 20 bp, Artificial Sequence
  Description of Artificial Sequence: Synthetic oligonucleotide
  Target: FXN; (+) strand; PAM type: NRG; PAM sequence: AAG
gtaaacccataccggcggcc

SEQ ID NO: 16036 - DNA, 20 bp, Artificial Sequence
  Description of Artificial Sequence: Synthetic oligonucleotide
  Target: FXN; (+) strand; PAM type: NRG; PAM sequence: CAG
aacccataccggcggccaag

SEQ ID NO: 16037 - DNA, 20 bp, Artificial Sequence
  Description of Artificial Sequence: Synthetic oligonucleotide
  Target: FXN; (+) strand; PAM type: NRG; PAM sequence: CAG
ttgtgcatgcacccacttcc

SEQ ID NO: 16038 - DNA, 20 bp, Artificial Sequence
  Description of Artificial Sequence: Synthetic oligonucleotide
  Target: FXN; (+) strand; PAM type: NRG; PAM sequence: AAG
gcatgcacccacttcccagc

SEQ ID NO: 16039 - DNA, 20 bp, Artificial Sequence
  Description of Artificial Sequence: Synthetic oligonucleotide
  Target: FXN; (+) strand; PAM type: NRG; PAM sequence: CAG
gcacccacttcccagcaaga

SEQ ID NO: 16040 - DNA, 20 bp, Artificial Sequence
  Description of Artificial Sequence: Synthetic oligonucleotide
  Target: FXN; (+) strand; PAM type: NRG; PAM sequence: CAG
cccacttcccagcaagacag

SEQ ID NO: 16041 - DNA, 20 bp, Artificial Sequence
  Description of Artificial Sequence: Synthetic oligonucleotide
  Target: FXN; (+) strand; PAM type: NRG; PAM sequence: AAG
ccagcaagacagcagctccc

SEQ ID NO: 16042 - DNA, 20 bp, Artificial Sequence
  Description of Artificial Sequence: Synthetic oligonucleotide
  Target: FXN; (+) strand; PAM type: NRG; PAM sequence: TAG
gctcccaagttcctcctgtt

SEQ ID NO: 16043 - DNA, 20 bp, Artificial Sequence
  Description of Artificial Sequence: Synthetic oligonucleotide
  Target: FXN; (+) strand; PAM type: NRG; PAM sequence: TAG
gttcctcctgtttagaattt

SEQ ID NO: 16044 - DNA, 20 bp, Artificial Sequence
  Description of Artificial Sequence: Synthetic oligonucleotide
  Target: FXN; (+) strand; PAM type: NRG; PAM sequence: AAG
cctcctgtttagaattttag

SEQ ID NO: 16045 - DNA, 20 bp, Artificial Sequence
  Description of Artificial Sequence: Synthetic oligonucleotide
  Target: FXN; (+) strand; PAM type: NRG; PAM sequence: CGG
cctgtttagaattttagaag

SEQ ID NO: 16046 - DNA, 20 bp, Artificial Sequence
  Description of Artificial Sequence: Synthetic oligonucleotide
  Target: FXN; (+) strand; PAM type: NRG; PAM sequence: CGG
gtttagaattttagaagcgg

SEQ ID NO: 16047 - DNA, 20 bp, Artificial Sequence
  Description of Artificial Sequence: Synthetic oligonucleotide
  Target: FXN; (+) strand; PAM type: NRG; PAM sequence: GGG
tttagaattttagaagcggc

SEQ ID NO: 16048 - DNA, 20 bp, Artificial Sequence
  Description of Artificial Sequence: Synthetic oligonucleotide
  Target: FXN; (+) strand; PAM type: NRG; PAM sequence: CAG
ttttagaagcggcgggccac

SEQ ID NO: 16049 - DNA, 20 bp, Artificial Sequence
  Description of Artificial Sequence: Synthetic oligonucleotide
  Target: FXN; (+) strand; PAM type: NRG; PAM sequence: AGG
tttagaagcggcgggccacc

SEQ ID NO: 16050 - DNA, 20 bp, Artificial Sequence
  Description of Artificial Sequence: Synthetic oligonucleotide
  Target: FXN; (+) strand; PAM type: NRG; PAM sequence: CAG
agcggcgggccaccaggctg

SEQ ID NO: 16051 - DNA, 20 bp, Artificial Sequence
  Description of Artificial Sequence: Synthetic oligonucleotide
  Target: FXN; (+) strand; PAM type: NRG; PAM sequence: TGG
caccaggctgcagtctccct

SEQ ID NO: 16052 - DNA, 20 bp, Artificial Sequence
  Description of Artificial Sequence: Synthetic oligonucleotide
  Target: FXN; (+) strand; PAM type: NRG; PAM sequence: GGG
accaggctgcagtctccctt

SEQ ID NO: 16053 - DNA, 20 bp, Artificial Sequence
  Description of Artificial Sequence: Synthetic oligonucleotide
  Target: FXN; (+) strand; PAM type: NRG; PAM sequence: CAG
ggctgcagtctcccttgggt

SEQ ID NO: 16054 - DNA, 20 bp, Artificial Sequence
  Description of Artificial Sequence: Synthetic oligonucleotide
  Target: FXN; (+) strand; PAM type: NRG; PAM sequence: AGG
gctgcagtctcccttgggtc

SEQ ID NO: 16055 - DNA, 20 bp, Artificial Sequence
  Description of Artificial Sequence: Synthetic oligonucleotide
  Target: FXN; (+) strand; PAM type: NRG; PAM sequence: GGG
ctgcagtctcccttgggtca

SEQ ID NO: 16056 - DNA, 20 bp, Artificial Sequence
  Description of Artificial Sequence: Synthetic oligonucleotide
  Target: FXN; (+) strand; PAM type: NRG; PAM sequence: GGG
tgcagtctcccttgggtcag

SEQ ID NO: 16057 - DNA, 20 bp, Artificial Sequence
  Description of Artificial Sequence: Synthetic oligonucleotide
  Target: FXN; (+) strand; PAM type: NRG; PAM sequence: TGG
ctcccttgggtcaggggtcc

SEQ ID NO: 16058 - DNA, 20 bp, Artificial Sequence
  Description of Artificial Sequence: Synthetic oligonucleotide
  Target: FXN; (+) strand; PAM type: NRG; PAM sequence: AAG
tgcactccgtgctttgcaca

SEQ ID NO: 16059 - DNA, 20 bp, Artificial Sequence
  Description of Artificial Sequence: Synthetic oligonucleotide
  Target: FXN; (+) strand; PAM type: NRG; PAM sequence: CAG
actccgtgctttgcacaaag

SEQ ID NO: 16060 - DNA, 20 bp, Artificial Sequence
  Description of Artificial Sequence: Synthetic oligonucleotide
  Target: FXN; (+) strand; PAM type: NRG; PAM sequence: AGG
ctccgtgctttgcacaaagc

SEQ ID NO: 16061 - DNA, 20 bp, Artificial Sequence
  Description of Artificial Sequence: Synthetic oligonucleotide
  Target: FXN; (+) strand; PAM type: NRG; PAM sequence: TAG
atttttgttaaatgcacgaa

SEQ ID NO: 16062 - DNA, 20 bp, Artificial Sequence
  Description of Artificial Sequence: Synthetic oligonucleotide
  Target: FXN; (+) strand; PAM type: NRG; PAM sequence: AAG
ttaaatgcacgaatagtgct

SEQ ID NO: 16063 - DNA, 20 bp, Artificial Sequence
  Description of Artificial Sequence: Synthetic oligonucleotide
  Target: FXN; (+) strand; PAM type: NRG; PAM sequence: TGG
atgcacgaatagtgctaagc

SEQ ID NO: 16064 - DNA, 20 bp, Artificial Sequence
  Description of Artificial Sequence: Synthetic oligonucleotide
  Target: FXN; (+) strand; PAM type: NRG; PAM sequence: GGG
tgcacgaatagtgctaagct

SEQ ID NO: 16065 - DNA, 20 bp, Artificial Sequence
  Description of Artificial Sequence: Synthetic oligonucleotide
  Target: FXN; (+) strand; PAM type: NRG; PAM sequence: AAG
acgaatagtgctaagctggg

SEQ ID NO: 16066 - DNA, 20 bp, Artificial Sequence
  Description of Artificial Sequence: Synthetic oligonucleotide
  Target: FXN; (+) strand; PAM type: NRG; PAM sequence: GAG
taagctgggaagttcttcct

SEQ ID NO: 16067 - DNA, 20 bp, Artificial Sequence
  Description of Artificial Sequence: Synthetic oligonucleotide
  Target: FXN; (+) strand; PAM type: NRG; PAM sequence: AGG
aagctgggaagttcttcctg

SEQ ID NO: 16068 - DNA, 20 bp, Artificial Sequence
  Description of Artificial Sequence: Synthetic oligonucleotide
  Target: FXN; (+) strand; PAM type: NRG; PAM sequence: TAG
tcttcctgaggtctaacctc

SEQ ID NO: 16069 - DNA, 20 bp, Artificial Sequence
  Description of Artificial Sequence: Synthetic oligonucleotide
  Target: FXN; (+) strand; PAM type: NRG; PAM sequence: CAG
aacctctagctgctccccca

SEQ ID NO: 16070 - DNA, 20 bp, Artificial Sequence
  Description of Artificial Sequence: Synthetic oligonucleotide
  Target: FXN; (+) strand; PAM type: NRG; PAM sequence: AAG
ctctagctgctcccccacag

SEQ ID NO: 16071 - DNA, 20 bp, Artificial Sequence
  Description of Artificial Sequence: Synthetic oligonucleotide
  Target: FXN; (+) strand; PAM type: NRG; PAM sequence: GAG
ctagctgctcccccacagaa

SEQ ID NO: 16072 - DNA, 20 bp, Artificial Sequence
  Description of Artificial Sequence: Synthetic oligonucleotide
  Target: FXN; (+) strand; PAM type: NRG; PAM sequence: CGG
cccccacagaagagtgcctg

SEQ ID NO: 16073 - DNA, 20 bp, Artificial Sequence
  Description of Artificial Sequence: Synthetic oligonucleotide
  Target: FXN; (+) strand; PAM type: NRG; PAM sequence: CAG
cacagaagagtgcctgcggc

SEQ ID NO: 16074 - DNA, 20 bp, Artificial Sequence
  Description of Artificial Sequence: Synthetic oligonucleotide
  Target: FXN; (+) strand; PAM type: NRG; PAM sequence: TGG
agaagagtgcctgcggccag

SEQ ID NO: 16075 - DNA, 20 bp, Artificial Sequence
  Description of Artificial Sequence: Synthetic oligonucleotide
  Target: FXN; (+) strand; PAM type: NRG; PAM sequence: CAG
tgcctgcggccagtggccac

SEQ ID NO: 16076 - DNA, 20 bp, Artificial Sequence
  Description of Artificial Sequence: Synthetic oligonucleotide
  Target: FXN; (+) strand; PAM type: NRG; PAM sequence: AGG
gcctgcggccagtggccacc

SEQ ID NO: 16077 - DNA, 20 bp, Artificial Sequence
  Description of Artificial Sequence: Synthetic oligonucleotide
  Target: FXN; (+) strand; PAM type: NRG; PAM sequence: GGG
cctgcggccagtggccacca

SEQ ID NO: 16078 - DNA, 20 bp, Artificial Sequence
  Description of Artificial Sequence: Synthetic oligonucleotide
  Target: FXN; (+) strand; PAM type: NRG; PAM sequence: GGG
ctgcggccagtggccaccag

SEQ ID NO: 16079 - DNA, 20 bp, Artificial Sequence
  Description of Artificial Sequence: Synthetic oligonucleotide
  Target: FXN; (+) strand; PAM type: NRG; PAM sequence: CAG
gtggccaccaggggtcgccg

SEQ ID NO: 16080 - DNA, 20 bp, Artificial Sequence
  Description of Artificial Sequence: Synthetic oligonucleotide
  Target: FXN; (+) strand; PAM type: NRG; PAM sequence: CAG
ccaggggtcgccgcagcacc

SEQ ID NO: 16081 - DNA, 20 bp, Artificial Sequence
  Description of Artificial Sequence: Synthetic oligonucleotide
  Target: FXN; (+) strand; PAM type: NRG; PAM sequence: TGG
gtcgccgcagcacccagcgc

SEQ ID NO: 16082 - DNA, 20 bp, Artificial Sequence
  Description of Artificial Sequence: Synthetic oligonucleotide
  Target: FXN; (+) strand; PAM type: NRG; PAM sequence: GAG
cgccgcagcacccagcgctg

SEQ ID NO: 16083 - DNA, 20 bp, Artificial Sequence
  Description of Artificial Sequence: Synthetic oligonucleotide
  Target: FXN; (+) strand; PAM type: NRG; PAM sequence: AGG
gccgcagcacccagcgctgg

SEQ ID NO: 16084 - DNA, 20 bp, Artificial Sequence
  Description of Artificial Sequence: Synthetic oligonucleotide
  Target: FXN; (+) strand; PAM type: NRG; PAM sequence: GGG
ccgcagcacccagcgctgga

SEQ ID NO: 16085 - DNA, 20 bp, Artificial Sequence
  Description of Artificial Sequence: Synthetic oligonucleotide
  Target: FXN; (+) strand; PAM type: NRG; PAM sequence: CGG
cagcacccagcgctggaggg

SEQ ID NO: 16086 - DNA, 20 bp, Artificial Sequence
  Description of Artificial Sequence: Synthetic oligonucleotide
  Target: FXN; (+) strand; PAM type: NRG; PAM sequence: GAG
gcacccagcgctggagggcg

SEQ ID NO: 16087 - DNA, 20 bp, Artificial Sequence
  Description of Artificial Sequence: Synthetic oligonucleotide
  Target: FXN; (+) strand; PAM type: NRG; PAM sequence: CGG
cccagcgctggagggcggag

SEQ ID NO: 16088 - DNA, 20 bp, Artificial Sequence
  Description of Artificial Sequence: Synthetic oligonucleotide
  Target: FXN; (+) strand; PAM type: NRG; PAM sequence: GGG
ccagcgctggagggcggagc

SEQ ID NO: 16089 - DNA, 20 bp, Artificial Sequence
  Description of Artificial Sequence: Synthetic oligonucleotide
  Target: FXN; (+) strand; PAM type: NRG; PAM sequence: CGG
gcgctggagggcggagcggg

SEQ ID NO: 16090 - DNA, 20 bp, Artificial Sequence
  Description of Artificial Sequence: Synthetic oligonucleotide
  Target: FXN; (+) strand; PAM type: NRG; PAM sequence: CAG
ctggagggcggagcgggcgg

SEQ ID NO: 16091 - DNA, 20 bp, Artificial Sequence
  Description of Artificial Sequence: Synthetic oligonucleotide
  Target: FXN; (+) strand; PAM type: NRG; PAM sequence: CGG
ggcggagcgggcggcagacc

SEQ ID NO: 16092 - DNA, 20 bp, Artificial Sequence
  Description of Artificial Sequence: Synthetic oligonucleotide
  Target: FXN; (+) strand; PAM type: NRG; PAM sequence: GAG
cggagcgggcggcagacccg

SEQ ID NO: 16093 - DNA, 20 bp, Artificial Sequence
  Description of Artificial Sequence: Synthetic oligonucleotide
  Target: FXN; (+) strand; PAM type: NRG; PAM sequence: CAG
agcgggcggcagacccggag

SEQ ID NO: 16094 - DNA, 20 bp, Artificial Sequence
  Description of Artificial Sequence: Synthetic oligonucleotide
  Target: FXN; (+) strand; PAM type: NRG; PAM sequence: TGG
ggcagacccggagcagcatg

SEQ ID NO: 16095 - DNA, 20 bp, Artificial Sequence
  Description of Artificial Sequence: Synthetic oligonucleotide
  Target: FXN; (+) strand; PAM type: NRG; PAM sequence: CGG
cggagcagcatgtggactct

SEQ ID NO: 16096 - DNA, 20 bp, Artificial Sequence
  Description of Artificial Sequence: Synthetic oligonucleotide
  Target: FXN; (+) strand; PAM type: NRG; PAM sequence: GGG
ggagcagcatgtggactctc

SEQ ID NO: 16097 - DNA, 20 bp, Artificial Sequence
  Description of Artificial Sequence: Synthetic oligonucleotide
  Target: FXN; (+) strand; PAM type: NRG; PAM sequence: CAG
gtggactctcgggcgccgcg

SEQ ID NO: 16098 - DNA, 20 bp, Artificial Sequence
  Description of Artificial Sequence: Synthetic oligonucleotide
  Target: FXN; (+) strand; PAM type: NRG; PAM sequence: TAG
gactctcgggcgccgcgcag

SEQ ID NO: 16099 - DNA, 20 bp, Artificial Sequence
  Description of Artificial Sequence: Synthetic oligonucleotide
  Target: FXN; (+) strand; PAM type: NRG; PAM sequence: CGG
ctcgggcgccgcgcagtagc

SEQ ID NO: 16100 - DNA, 20 bp, Artificial Sequence
  Description of Artificial Sequence: Synthetic oligonucleotide
  Target: FXN; (+) strand; PAM type: NRG; PAM sequence: TGG
ccgcgcagtagccggcctcc

SEQ ID NO: 16101 - DNA, 20 bp, Artificial Sequence
  Description of Artificial Sequence: Synthetic oligonucleotide
  Target: FXN; (+) strand; PAM type: NRG; PAM sequence: CAG
gccggcctcctggcgtcacc

SEQ ID NO: 16102 - DNA, 20 bp, Artificial Sequence
  Description of Artificial Sequence: Synthetic oligonucleotide
  Target: FXN; (+) strand; PAM type: NRG; PAM sequence: CAG
cctcctggcgtcacccagcc

SEQ ID NO: 16103 - DNA, 20 bp, Artificial Sequence
  Description of Artificial Sequence: Synthetic oligonucleotide
  Target: FXN; (+) strand; PAM type: NRG; PAM sequence: CAG
tggcgtcacccagcccagcc

SEQ ID NO: 16104 - DNA, 20 bp, Artificial Sequence
  Description of Artificial Sequence: Synthetic oligonucleotide
  Target: FXN; (+) strand; PAM type: NRG; PAM sequence: AGG
ggcgtcacccagcccagccc

SEQ ID NO: 16105 - DNA, 20 bp, Artificial Sequence
  Description of Artificial Sequence: Synthetic oligonucleotide
  Target: FXN; (+) strand; PAM type: NRG; PAM sequence: CAG
cacccagcccagcccaggcc

SEQ ID NO: 16106 - DNA, 20 bp, Artificial Sequence
  Description of Artificial Sequence: Synthetic oligonucleotide
  Target: FXN; (+) strand; PAM type: NRG; PAM sequence: CGG
cccaggcccagaccctcacc

SEQ ID NO: 16107 - DNA, 20 bp, Artificial Sequence
  Description of Artificial Sequence: Synthetic oligonucleotide
  Target: FXN; (+) strand; PAM type: NRG; PAM sequence: GGG
ccaggcccagaccctcaccc

SEQ ID NO: 16108 - DNA, 20 bp, Artificial Sequence
  Description of Artificial Sequence: Synthetic oligonucleotide
  Target: FXN; (+) strand; PAM type: NRG; PAM sequence: CGG
agaccctcacccgggtcccg

SEQ ID NO: 16109 - DNA, 20 bp, Artificial Sequence
  Description of Artificial Sequence: Synthetic oligonucleotide
  Target: FXN; (+) strand; PAM type: NRG; PAM sequence: CGG
cctcacccgggtcccgcggc

SEQ ID NO: 16110 - DNA, 20 bp, Artificial Sequence
  Description of Artificial Sequence: Synthetic oligonucleotide
  Target: FXN; (+) strand; PAM type: NRG; PAM sequence: CAG
cacccgggtcccgcggccgg

SEQ ID NO: 16111 - DNA, 20 bp, Artificial Sequence
  Description of Artificial Sequence: Synthetic oligonucleotide
  Target: FXN; (+) strand; PAM type: NRG; PAM sequence: GAG
cccgggtcccgcggccggca

SEQ ID NO: 16112 - DNA, 20 bp, Artificial Sequence
  Description of Artificial Sequence: Synthetic oligonucleotide
  Target: FXN; (+) strand; PAM type: NRG; PAM sequence: TGG
ggtcccgcggccggcagagt

SEQ ID NO: 16113 - DNA, 20 bp, Artificial Sequence
  Description of Artificial Sequence: Synthetic oligonucleotide
  Target: FXN; (+) strand; PAM type: NRG; PAM sequence: CGG
gcagagttggccccactctg

SEQ ID NO: 16114 - DNA, 20 bp, Artificial Sequence
  Description of Artificial Sequence: Synthetic oligonucleotide
  Target: FXN; (+) strand; PAM type: NRG; PAM sequence: TGG
gccccactctgcggccgccg

SEQ ID NO: 16115 - DNA, 20 bp, Artificial Sequence
  Description of Artificial Sequence: Synthetic oligonucleotide
  Target: FXN; (+) strand; PAM type: NRG; PAM sequence: CAG
gacctgcacgccccgccgcg

SEQ ID NO: 16116 - DNA, 20 bp, Artificial Sequence
  Description of Artificial Sequence: Synthetic oligonucleotide
  Target: FXN; (+) strand; PAM type: NRG; PAM sequence: AAG
tgcacgccccgccgcgcagt

SEQ ID NO: 16117 - DNA, 20 bp, Artificial Sequence
  Description of Artificial Sequence: Synthetic oligonucleotide
  Target: FXN; (+) strand; PAM type: NRG; PAM sequence: CGG
cgcgcagtaagtatccgcgc

SEQ ID NO: 16118 - DNA, 20 bp, Artificial Sequence
  Description of Artificial Sequence: Synthetic oligonucleotide
  Target: FXN; (+) strand; PAM type: NRG; PAM sequence: GGG
gcgcagtaagtatccgcgcc

SEQ ID NO: 16119 - DNA, 20 bp, Artificial Sequence
  Description of Artificial Sequence: Synthetic oligonucleotide
  Target: FXN; (+) strand; PAM type: NRG; PAM sequence: CAG
gtaagtatccgcgccgggaa

SEQ ID NO: 16120 - DNA, 20 bp, Artificial Sequence
  Description of Artificial Sequence: Synthetic oligonucleotide
  Target: FXN; (+) strand; PAM type: NRG; PAM sequence: CGG
atccgcgccgggaacagccg

SEQ ID NO: 16121 - DNA, 20 bp, Artificial Sequence
  Description of Artificial Sequence: Synthetic oligonucleotide
  Target: FXN; (+) strand; PAM type: NRG; PAM sequence: GGG
tccgcgccgggaacagccgc

SEQ ID NO: 16122 - DNA, 20 bp, Artificial Sequence
  Description of Artificial Sequence: Synthetic oligonucleotide
  Target: FXN; (+) strand; PAM type: NRG; PAM sequence: CGG
cagccgcgggccgcacgccg

SEQ ID NO: 16123 - DNA, 20 bp, Artificial Sequence
  Description of Artificial Sequence: Synthetic oligonucleotide
  Target: FXN; (+) strand; PAM type: NRG; PAM sequence: GGG
agccgcgggccgcacgccgc

SEQ ID NO: 16124 - DNA, 20 bp, Artificial Sequence
  Description of Artificial Sequence: Synthetic oligonucleotide
  Target: FXN; (+) strand; PAM type: NRG; PAM sequence: CAG
ccgcacgccgcacgcctgcg

SEQ ID NO: 16125 - DNA, 20 bp, Artificial Sequence
  Description of Artificial Sequence: Synthetic oligonucleotide
  Target: FXN; (+) strand; PAM type: NRG; PAM sequence: AGG
cgcacgccgcacgcctgcgc

SEQ ID NO: 16126 - DNA, 20 bp, Artificial Sequence
  Description of Artificial Sequence: Synthetic oligonucleotide
  Target: FXN; (+) strand; PAM type: NRG; PAM sequence: GGG
gcacgccgcacgcctgcgca

SEQ ID NO: 16127 - DNA, 20 bp, Artificial Sequence
  Description of Artificial Sequence: Synthetic oligonucleotide
  Target: FXN; (+) strand; PAM type: NRG; PAM sequence: GAG
acgccgcacgcctgcgcagg

SEQ ID NO: 16128 - DNA, 20 bp, Artificial Sequence
  Description of Artificial Sequence: Synthetic oligonucleotide
  Target: FXN; (+) strand; PAM type: NRG; PAM sequence: AGG
cgccgcacgcctgcgcaggg

SEQ ID NO: 16129 - DNA, 20 bp, Artificial Sequence
  Description of Artificial Sequence: Synthetic oligonucleotide
  Target: FXN; (+) strand; PAM type: NRG; PAM sequence: CGG
cagggaggcgccgcgcacgc

SEQ ID NO: 16130 - DNA, 20 bp, Artificial Sequence
  Description of Artificial Sequence: Synthetic oligonucleotide
  Target: FXN; (+) strand; PAM type: NRG; PAM sequence: GGG
agggaggcgccgcgcacgcc

SEQ ID NO: 16131 - DNA, 20 bp, Artificial Sequence
  Description of Artificial Sequence: Synthetic oligonucleotide
  Target: FXN; (+) strand; PAM type: NRG; PAM sequence: GGG
gggaggcgccgcgcacgccg

SEQ ID NO: 16132 - DNA, 20 bp, Artificial Sequence
  Description of Artificial Sequence: Synthetic oligonucleotide
  Target: FXN; (+) strand; PAM type: NRG; PAM sequence: CGG
cgcgcacgccggggtcgctc

SEQ ID NO: 16133 - DNA, 20 bp, Artificial Sequence
  Description of Artificial Sequence: Synthetic oligonucleotide
  Target: FXN; (+) strand; PAM type: NRG; PAM sequence: GGG
gcgcacgccggggtcgctcc

SEQ ID NO: 16134 - DNA, 20 bp, Artificial Sequence
  Description of Artificial Sequence: Synthetic oligonucleotide
  Target: FXN; (+) strand; PAM type: NRG; PAM sequence: TGG
gtcgctccgggtacgcgcgc

SEQ ID NO: 16135 - DNA, 20 bp, Artificial Sequence
  Description of Artificial Sequence: Synthetic oligonucleotide
  Target: FXN; (+) strand; PAM type: NRG; PAM sequence: TAG
tccgggtacgcgcgctggac

SEQ ID NO: 16136 - DNA, 20 bp, Artificial Sequence
  Description of Artificial Sequence: Synthetic oligonucleotide
  Target: FXN; (+) strand; PAM type: NRG; PAM sequence: CAG
tagctcaccccgctccttct

SEQ ID NO: 16137 - DNA, 20 bp, Artificial Sequence
  Description of Artificial Sequence: Synthetic oligonucleotide
  Target: FXN; (+) strand; PAM type: NRG; PAM sequence: AGG
agctcaccccgctccttctc

SEQ ID NO: 16138 - DNA, 20 bp, Artificial Sequence
  Description of Artificial Sequence: Synthetic oligonucleotide
  Target: FXN; (+) strand; PAM type: NRG; PAM sequence: GGG
gctcaccccgctccttctca

SEQ ID NO: 16139 - DNA, 20 bp, Artificial Sequence
  Description of Artificial Sequence: Synthetic oligonucleotide
  Target: FXN; (+) strand; PAM type: NRG; PAM sequence: CGG
caccccgctccttctcaggg

SEQ ID NO: 16140 - DNA, 20 bp, Artificial Sequence
  Description of Artificial Sequence: Synthetic oligonucleotide
  Target: FXN; (+) strand; PAM type: NRG; PAM sequence: CGG
cgctccttctcagggcggcc

SEQ ID NO: 16141 - DNA, 20 bp, Artificial Sequence
  Description of Artificial Sequence: Synthetic oligonucleotide
  Target: FXN; (+) strand; PAM type: NRG; PAM sequence: CGG
tccttctcagggcggcccgg

SEQ ID NO: 16142 - DNA, 20 bp, Artificial Sequence
  Description of Artificial Sequence: Synthetic oligonucleotide
  Target: FXN; (+) strand; PAM type: NRG; PAM sequence: AAG
ttctcagggcggcccggcgg

SEQ ID NO: 16143 - DNA, 20 bp, Artificial Sequence
  Description of Artificial Sequence: Synthetic oligonucleotide
  Target: FXN; (+) strand; PAM type: NRG; PAM sequence: CGG
tcagggcggcccggcggaag

SEQ ID NO: 16144 - DNA, 20 bp, Artificial Sequence
  Description of Artificial Sequence: Synthetic oligonucleotide
  Target: FXN; (+) strand; PAM type: NRG; PAM sequence: TGG
ggccttgcaactcccttctc

SEQ ID NO: 16145 - DNA, 20 bp, Artificial Sequence
  Description of Artificial Sequence: Synthetic oligonucleotide
  Target: FXN; (+) strand; PAM type: NRG; PAM sequence: CGG
actcccttctctggttctcc

SEQ ID NO: 16146 - DNA, 20 bp, Artificial Sequence
  Description of Artificial Sequence: Synthetic oligonucleotide
  Target: FXN; (+) strand; PAM type: NRG; PAM sequence: TGG
tctcccggttgcatttacac

SEQ ID NO: 16147 - DNA, 20 bp, Artificial Sequence
  Description of Artificial Sequence: Synthetic oligonucleotide
  Target: FXN; (+) strand; PAM type: NRG; PAM sequence: AAG
acactggcttctgctttccg

SEQ ID NO: 16148 - DNA, 20 bp, Artificial Sequence
  Description of Artificial Sequence: Synthetic oligonucleotide
  Target: FXN; (+) strand; PAM type: NRG; PAM sequence: AGG
cactggcttctgctttccga

SEQ ID NO: 16149 - DNA, 20 bp, Artificial Sequence
  Description of Artificial Sequence: Synthetic oligonucleotide
  Target: FXN; (+) strand; PAM type: NRG; PAM sequence: AAG
gcttctgctttccgaaggaa

SEQ ID NO: 16150 - DNA, 20 bp, Artificial Sequence
  Description of Artificial Sequence: Synthetic oligonucleotide
  Target: FXN; (+) strand; PAM type: NRG; PAM sequence: AGG
cttctgctttccgaaggaaa

SEQ ID NO: 16151 - DNA, 20 bp, Artificial Sequence
  Description of Artificial Sequence: Synthetic oligonucleotide
  Target: FXN; (+) strand; PAM type: NRG; PAM sequence: GGG
ttctgctttccgaaggaaaa

SEQ ID NO: 16152 - DNA, 20 bp, Artificial Sequence
  Description of Artificial Sequence: Synthetic oligonucleotide
  Target: FXN; (+) strand; PAM type: NRG; PAM sequence: GGG
tctgctttccgaaggaaaag

SEQ ID NO: 16153 - DNA, 20 bp, Artificial Sequence
  Description of Artificial Sequence: Synthetic oligonucleotide
  Target: FXN; (+) strand; PAM type: NRG; PAM sequence: CGG
aaaggggacattttgtcctg

SEQ ID NO: 16154 - DNA, 20 bp, Artificial Sequence
  Description of Artificial Sequence: Synthetic oligonucleotide
  Target: FXN; (+) strand; PAM type: NRG; PAM sequence: CGG
tttgtcctgcggtgcgactg

SEQ ID NO: 16155 - DNA, 20 bp, Artificial Sequence
  Description of Artificial Sequence: Synthetic oligonucleotide
  Target: FXN; (+) strand; PAM type: NRG; PAM sequence: GGG
ttgtcctgcggtgcgactgc

SEQ ID NO: 16156 - DNA, 20 bp, Artificial Sequence
  Description of Artificial Sequence: Synthetic oligonucleotide
  Target: FXN; (+) strand; PAM type: NRG; PAM sequence: AAG
ctgcggtgcgactgcgggtc

SEQ ID NO: 16157 - DNA, 20 bp, Artificial Sequence
  Description of Artificial Sequence: Synthetic oligonucleotide
  Target: FXN; (+) strand; PAM type: NRG; PAM sequence: AGG
tgcggtgcgactgcgggtca

SEQ ID NO: 16158 - DNA, 20 bp, Artificial Sequence
  Description of Artificial Sequence: Synthetic oligonucleotide
  Target: FXN; (+) strand; PAM type: NRG; PAM sequence: CGG
tgcgactgcgggtcaaggca

SEQ ID NO: 16159 - DNA, 20 bp, Artificial Sequence
  Description of Artificial Sequence: Synthetic oligonucleotide
  Target: FXN; (+) strand; PAM type: NRG; PAM sequence: GGG
gcgactgcgggtcaaggcac

SEQ ID NO: 16160 - DNA, 20 bp, Artificial Sequence
  Description of Artificial Sequence: Synthetic oligonucleotide
  Target: FXN; (+) strand; PAM type: NRG; PAM sequence: AAG
tgcgggtcaaggcacgggcg

SEQ ID NO: 16161 - DNA, 20 bp, Artificial Sequence
  Description of Artificial Sequence: Synthetic oligonucleotide
  Target: FXN; (+) strand; PAM type: NRG; PAM sequence: AGG
gcgggtcaaggcacgggcga

SEQ ID NO: 16162 - DNA, 20 bp, Artificial Sequence
  Description of Artificial Sequence: Synthetic oligonucleotide
  Target: FXN; (+) strand; PAM type: NRG; PAM sequence: CAG
ggtcaaggcacgggcgaagg

SEQ ID NO: 16163 - DNA, 20 bp, Artificial Sequence
  Description of Artificial Sequence: Synthetic oligonucleotide
  Target: FXN; (+) strand; PAM type: NRG; PAM sequence: AGG
gtcaaggcacgggcgaaggc

SEQ ID NO: 16164 - DNA, 20 bp, Artificial Sequence
  Description of Artificial Sequence: Synthetic oligonucleotide
  Target: FXN; (+) strand; PAM type: NRG; PAM sequence: GGG
tcaaggcacgggcgaaggca

SEQ ID NO: 16165 - DNA, 20 bp, Artificial Sequence
  Description of Artificial Sequence: Synthetic oligonucleotide
  Target: FXN; (+) strand; PAM type: NRG; PAM sequence: CAG
aggcacgggcgaaggcaggg

SEQ ID NO: 16166 - DNA, 20 bp, Artificial Sequence
  Description of Artificial Sequence: Synthetic oligonucleotide
  Target: FXN; (+) strand; PAM type: NRG; PAM sequence: AGG
ggcacgggcgaaggcagggc

SEQ ID NO: 16167 - DNA, 20 bp, Artificial Sequence
  Description of Artificial Sequence: Synthetic oligonucleotide
  Target: FXN; (+) strand; PAM type: NRG; PAM sequence: TGG
cgggcgaaggcagggcaggc

SEQ ID NO: 16168 - DNA, 20 bp, Artificial Sequence
  Description of Artificial Sequence: Synthetic oligonucleotide
  Target: FXN; (+) strand; PAM type: NRG; PAM sequence: TGG
gcgaaggcagggcaggctgg

SEQ ID NO: 16169 - DNA, 20 bp, Artificial Sequence
  Description of Artificial Sequence: Synthetic oligonucleotide
  Target: FXN; (+) strand; PAM type: NRG; PAM sequence: GAG
gaaggcagggcaggctggtg

SEQ ID NO: 16170 - DNA, 20 bp, Artificial Sequence
  Description of Artificial Sequence: Synthetic oligonucleotide
  Target: FXN; (+) strand; PAM type: NRG; PAM sequence: AGG
aaggcagggcaggctggtgg

SEQ ID NO: 16171 - DNA, 20 bp, Artificial Sequence
  Description of Artificial Sequence: Synthetic oligonucleotide
  Target: FXN; (+) strand; PAM type: NRG; PAM sequence: GGG
aggcagggcaggctggtgga

SEQ ID NO: 16172 - DNA, 20 bp, Artificial Sequence
  Description of Artificial Sequence: Synthetic oligonucleotide
  Target: FXN; (+) strand; PAM type: NRG; PAM sequence: GGG
ggcagggcaggctggtggag

SEQ ID NO: 16173 - DNA, 20 bp, Artificial Sequence
  Description of Artificial Sequence: Synthetic oligonucleotide
  Target: FXN; (+) strand; PAM type: NRG; PAM sequence: CGG
ggcaggctggtggaggggac

SEQ ID NO: 16174 - DNA, 20 bp, Artificial Sequence
  Description of Artificial Sequence: Synthetic oligonucleotide
  Target: FXN; (+) strand; PAM type: NRG; PAM sequence: GAG
tggtggaggggaccggttcc

SEQ ID NO: 16175 - DNA, 20 bp, Artificial Sequence
  Description of Artificial Sequence: Synthetic oligonucleotide
  Target: FXN; (+) strand; PAM type: NRG; PAM sequence: AGG
ggtggaggggaccggttccg

SEQ ID NO: 16176 - DNA, 20 bp, Artificial Sequence
  Description of Artificial Sequence: Synthetic oligonucleotide
  Target: FXN; (+) strand; PAM type: NRG; PAM sequence: GGG
gtggaggggaccggttccga

SEQ ID NO: 16177 - DNA, 20 bp, Artificial Sequence
  Description of Artificial Sequence: Synthetic oligonucleotide
  Target: FXN; (+) strand; PAM type: NRG; PAM sequence: GGG
tggaggggaccggttccgag

SEQ ID NO: 16178 - DNA, 20 bp, Artificial Sequence
  Description of Artificial Sequence: Synthetic oligonucleotide
  Target: FXN; (+) strand; PAM type: NRG; PAM sequence: CGG
gaccggttccgaggggtgtg

SEQ ID NO: 16179 - DNA, 20 bp, Artificial Sequence
  Description of Artificial Sequence: Synthetic oligonucleotide
  Target: FXN; (+) strand; PAM type: NRG; PAM sequence: CAG
ttctctgcgataacttgttt

SEQ ID NO: 16180 - DNA, 20 bp, Artificial Sequence
  Description of Artificial Sequence: Synthetic oligonucleotide
  Target: FXN; (+) strand; PAM type: NRG; PAM sequence: TAG
acttgtttcagtaatattaa

SEQ ID NO: 16181 - DNA, 20 bp, Artificial Sequence
  Description of Artificial Sequence: Synthetic oligonucleotide
  Target: FXN; (+) strand; PAM type: NRG; PAM sequence: TGG
gtttcagtaatattaataga

SEQ ID NO: 16182 - DNA, 20 bp, Artificial Sequence
  Description of Artificial Sequence: Synthetic oligonucleotide
  Target: FXN; (+) strand; PAM type: NRG; PAM sequence: TAG
tattaatagatggtatctgc

SEQ ID NO: 16183 - DNA, 20 bp, Artificial Sequence
  Description of Artificial Sequence: Synthetic oligonucleotide
  Target: FXN; (+) strand; PAM type: NRG; PAM sequence: TAG
tgtctgtgtgtatctgtata

SEQ ID NO: 16184 - DNA, 20 bp, Artificial Sequence
  Description of Artificial Sequence: Synthetic oligonucleotide
  Target: FXN; (+) strand; PAM type: NRG; PAM sequence: CGG
tgtgtgtgtgtttgcgcgca

SEQ ID NO: 16185 - DNA, 20 bp, Artificial Sequence
  Description of Artificial Sequence: Synthetic oligonucleotide
  Target: FXN; (+) strand; PAM type: NRG; PAM sequence: GGG
gtgtgtgtgtttgcgcgcac

SEQ ID NO: 16186 - DNA, 20 bp, Artificial Sequence
  Description of Artificial Sequence: Synthetic oligonucleotide
  Target: FXN; (+) strand; PAM type: NRG; PAM sequence: AAG
cgcgcacacctaatattttc

SEQ ID NO: 16187 - DNA, 20 bp, Artificial Sequence
  Description of Artificial Sequence: Synthetic oligonucleotide
  Target: FXN; (+) strand; PAM type: NRG; PAM sequence: AGG
gcgcacacctaatattttca

SEQ ID NO: 16188 - DNA, 20 bp, Artificial Sequence
  Description of Artificial Sequence: Synthetic oligonucleotide
  Target: FXN; (+) strand; PAM type: NRG; PAM sequence: TGG
acacctaatattttcaaggc

SEQ ID NO: 16189 - DNA, 20 bp, Artificial Sequence
  Description of Artificial Sequence: Synthetic oligonucleotide
  Target: FXN; (+) strand; PAM type: NRG; PAM sequence: TGG
ttttgaacgaaatgctttcc

SEQ ID NO: 16190 - DNA, 20 bp, Artificial Sequence
  Description of Artificial Sequence: Synthetic oligonucleotide
  Target: FXN; (+) strand; PAM type: NRG; PAM sequence: GAG
acgaaatgctttcctggaac

SEQ ID NO: 16191 - DNA, 20 bp, Artificial Sequence
  Description of Artificial Sequence: Synthetic oligonucleotide
  Target: FXN; (+) strand; PAM type: NRG; PAM sequence: AGG
cgaaatgctttcctggaacg

SEQ ID NO: 16192 - DNA, 20 bp, Artificial Sequence
  Description of Artificial Sequence: Synthetic oligonucleotide
  Target: FXN; (+) strand; PAM type: NRG; PAM sequence: CAG
ctggaacgaggtgaaacttt

SEQ ID NO: 16193 - DNA, 20 bp, Artificial Sequence
  Description of Artificial Sequence: Synthetic oligonucleotide
  Target: FXN; (+) strand; PAM type: NRG; PAM sequence: GAG
ggaacgaggtgaaactttca

SEQ ID NO: 16194 - DNA, 20 bp, Artificial Sequence
  Description of Artificial Sequence: Synthetic oligonucleotide
  Target: FXN; (+) strand; PAM type: NRG; PAM sequence: CAG
aggtgaaactttcagagctg

SEQ ID NO: 16195 - DNA, 20 bp, Artificial Sequence
  Description of Artificial Sequence: Synthetic oligonucleotide
  Target: FXN; (+) strand; PAM type: NRG; PAM sequence: TAG
aaactttcagagctgcagaa

SEQ ID NO: 16196 - DNA, 20 bp, Artificial Sequence
  Description of Artificial Sequence: Synthetic oligonucleotide
  Target: FXN; (+) strand; PAM type: NRG; PAM sequence: TAG
tttcagagctgcagaatagc

SEQ ID NO: 16197 - DNA, 20 bp, Artificial Sequence
  Description of Artificial Sequence: Synthetic oligonucleotide
  Target: FXN; (+) strand; PAM type: NRG; PAM sequence: GAG
tcagagctgcagaatagcta

SEQ ID NO: 16198 - DNA, 20 bp, Artificial Sequence
  Description of Artificial Sequence: Synthetic oligonucleotide
  Target: FXN; (+) strand; PAM type: NRG; PAM sequence: CAG
gagctgcagaatagctagag

SEQ ID NO: 16199 - DNA, 20 bp, Artificial Sequence
  Description of Artificial Sequence: Synthetic oligonucleotide
  Target: FXN; (+) strand; PAM type: NRG; PAM sequence: CAG
ctgcagaatagctagagcag

SEQ ID NO: 16200 - DNA, 20 bp, Artificial Sequence
  Description of Artificial Sequence: Synthetic oligonucleotide
  Target: FXN; (+) strand; PAM type: NRG; PAM sequence: AGG
tgcagaatagctagagcagc

SEQ ID NO: 16201 - DNA, 20 bp, Artificial Sequence
  Description of Artificial Sequence: Synthetic oligonucleotide
  Target: FXN; (+) strand; PAM type: NRG; PAM sequence: GGG
gcagaatagctagagcagca

SEQ ID NO: 16202 - DNA, 20 bp, Artificial Sequence
  Description of Artificial Sequence: Synthetic oligonucleotide
  Target: FXN; (+) strand; PAM type: NRG; PAM sequence: GGG
cagaatagctagagcagcag

SEQ ID NO: 16203 - DNA, 20 bp, Artificial Sequence
  Description of Artificial Sequence: Synthetic oligonucleotide
  Target: FXN; (+) strand; PAM type: NRG; PAM sequence: TGG
agctagagcagcaggggccc

SEQ ID NO: 16204 - DNA, 20 bp, Artificial Sequence
  Description of Artificial Sequence: Synthetic oligonucleotide
  Target: FXN; (+) strand; PAM type: NRG; PAM sequence: TGG
gcagcaggggccctggcttt

SEQ ID NO: 16205 - DNA, 20 bp, Artificial Sequence
  Description of Artificial Sequence: Synthetic oligonucleotide
  Target: FXN; (+) strand; PAM type: NRG; PAM sequence: CAG
aactgacccgacctttattc

SEQ ID NO: 16206 - DNA, 20 bp, Artificial Sequence
  Description of Artificial Sequence: Synthetic oligonucleotide
  Target: FXN; (+) strand; PAM type: NRG; PAM sequence: CAG
ccagattctgccccactccg

SEQ ID NO: 16207 - DNA, 20 bp, Artificial Sequence
  Description of Artificial Sequence: Synthetic oligonucleotide
  Target: FXN; (+) strand; PAM type: NRG; PAM sequence: GAG
agattctgccccactccgca

SEQ ID NO: 16208 - DNA, 20 bp, Artificial Sequence
  Description of Artificial Sequence: Synthetic oligonucleotide
  Target: FXN; (+) strand; PAM type: NRG; PAM sequence: TGG
tccgcagagctgtgtgacct

SEQ ID NO: 16209 - DNA, 20 bp, Artificial Sequence
  Description of Artificial Sequence: Synthetic oligonucleotide
  Target: FXN; (+) strand; PAM type: NRG; PAM sequence: GGG
ccgcagagctgtgtgacctt

SEQ ID NO: 16210 - DNA, 20 bp, Artificial Sequence
  Description of Artificial Sequence: Synthetic oligonucleotide
  Target: FXN; (+) strand; PAM type: NRG; PAM sequence: GGG
cgcagagctgtgtgaccttg

SEQ ID NO: 16211 - DNA, 20 bp, Artificial Sequence
  Description of Artificial Sequence: Synthetic oligonucleotide
  Target: FXN; (+) strand; PAM type: NRG; PAM sequence: GGG
gcagagctgtgtgaccttgg

SEQ ID NO: 16212 - DNA, 20 bp, Artificial Sequence
  Description of Artificial Sequence: Synthetic oligonucleotide
  Target: FXN; (+) strand; PAM type: NRG; PAM sequence: GAG
gggattcccctaacctctct

SEQ ID NO: 16213 - DNA, 20 bp, Artificial Sequence
  Description of Artificial Sequence: Synthetic oligonucleotide
  Target: FXN; (+) strand; PAM type: NRG; PAM sequence: TGG
cccctaacctctctgagacg

SEQ ID NO: 16214 - DNA, 20 bp, Artificial Sequence
  Description of Artificial Sequence: Synthetic oligonucleotide
  Target: FXN; (+) strand; PAM type: NRG; PAM sequence: TAG
agacgtggctttgttttctg

SEQ ID NO: 16215 - DNA, 20 bp, Artificial Sequence
  Description of Artificial Sequence: Synthetic oligonucleotide
  Target: FXN; (+) strand; PAM type: NRG; PAM sequence: AGG
gacgtggctttgttttctgt

SEQ ID NO: 16216 - DNA, 20 bp, Artificial Sequence
  Description of Artificial Sequence: Synthetic oligonucleotide
  Target: FXN; (+) strand; PAM type: NRG; PAM sequence: GGG
acgtggctttgttttctgta

SEQ ID NO: 16217 - DNA, 20 bp, Artificial Sequence
  Description of Artificial Sequence: Synthetic oligonucleotide
  Target: FXN; (+) strand; PAM type: NRG; PAM sequence: GAG
gtggctttgttttctgtagg

SEQ ID NO: 16218 - DNA, 20 bp, Artificial Sequence
  Description of Artificial Sequence: Synthetic oligonucleotide
  Target: FXN; (+) strand; PAM type: NRG; PAM sequence: AAG
gctttgttttctgtagggag

SEQ ID NO: 16219 - DNA, 20 bp, Artificial Sequence
  Description of Artificial Sequence: Synthetic oligonucleotide
  Target: FXN; (+) strand; PAM type: NRG; PAM sequence: AAG
ttttctgtagggagaagata

SEQ ID NO: 16220 - DNA, 20 bp, Artificial Sequence
  Description of Artificial Sequence: Synthetic oligonucleotide
  Target: FXN; (+) strand; PAM type: NRG; PAM sequence: AGG
tttctgtagggagaagataa

SEQ ID NO: 16221 - DNA, 20 bp, Artificial Sequence
  Description of Artificial Sequence: Synthetic oligonucleotide
  Target: FXN; (+) strand; PAM type: NRG; PAM sequence: CGG
taaaggtgacgcccattttg

SEQ ID NO: 16222 - DNA, 20 bp, Artificial Sequence
  Description of Artificial Sequence: Synthetic oligonucleotide
  Target: FXN; (+) strand; PAM type: NRG; PAM sequence: TGG
tgacgcccattttgcggacc

SEQ ID NO: 16223 - DNA, 20 bp, Artificial Sequence
  Description of Artificial Sequence: Synthetic oligonucleotide
  Target: FXN; (+) strand; PAM type: NRG; PAM sequence: GAG
ccattttgcggacctggtgt

SEQ ID NO: 16224 - DNA, 20 bp, Artificial Sequence
  Description of Artificial Sequence: Synthetic oligonucleotide
  Target: FXN; (+) strand; PAM type: NRG; PAM sequence: AGG
cattttgcggacctggtgtg

SEQ ID NO: 16225 - DNA, 20 bp, Artificial Sequence
  Description of Artificial Sequence: Synthetic oligonucleotide
  Target: FXN; (+) strand; PAM type: NRG; PAM sequence: TGG
gacctggtgtgaggattaaa

SEQ ID NO: 16226 - DNA, 20 bp, Artificial Sequence
  Description of Artificial Sequence: Synthetic oligonucleotide
  Target: FXN; (+) strand; PAM type: NRG; PAM sequence: GGG
acctggtgtgaggattaaat

SEQ ID NO: 16227 - DNA, 20 bp, Artificial Sequence
  Description of Artificial Sequence: Synthetic oligonucleotide
  Target: FXN; (+) strand; PAM type: NRG; PAM sequence: TAG
aggattaaatgggaataaca

SEQ ID NO: 16228 - DNA, 20 bp, Artificial Sequence
  Description of Artificial Sequence: Synthetic oligonucleotide
  Target: FXN; (+) strand; PAM type: NRG; PAM sequence: AAG
aaatgggaataacatagata

SEQ ID NO: 16229 - DNA, 20 bp, Artificial Sequence
  Description of Artificial Sequence: Synthetic oligonucleotide
  Target: FXN; (+) strand; PAM type: NRG; PAM sequence: CAG
aataacatagataaagtctt

SEQ ID NO: 16230 - DNA, 20 bp, Artificial Sequence
  Description of Artificial Sequence: Synthetic oligonucleotide
  Target: FXN; (+) strand; PAM type: NRG; PAM sequence: TAG
aagtcttcagaacttcaaat

SEQ ID NO: 16231 - DNA, 20 bp, Artificial Sequence
  Description of Artificial Sequence: Synthetic oligonucleotide
  Target: FXN; (+) strand; PAM type: NRG; PAM sequence: TGG
ttagttcccctttcttcctt

SEQ ID NO: 16232 - DNA, 20 bp, Artificial Sequence
  Description of Artificial Sequence: Synthetic oligonucleotide
  Target: FXN; (+) strand; PAM type: NRG; PAM sequence: GGG
tagttcccctttcttccttt

SEQ ID NO: 16233 - DNA, 20 bp, Artificial Sequence
  Description of Artificial Sequence: Synthetic oligonucleotide
  Target: FXN; (+) strand; PAM type: NRG; PAM sequence: GGG
agttcccctttcttcctttg

SEQ ID NO: 16234 - DNA, 20 bp, Artificial Sequence
  Description of Artificial Sequence: Synthetic oligonucleotide
  Target: FXN; (+) strand; PAM type: NRG; PAM sequence: GGG
gttcccctttcttcctttgg

SEQ ID NO: 16235 - DNA, 20 bp, Artificial Sequence
  Description of Artificial Sequence: Synthetic oligonucleotide
  Target: FXN; (+) strand; PAM type: NRG; PAM sequence: GGG
ttcccctttcttcctttggg

SEQ ID NO: 16236 - DNA, 20 bp, Artificial Sequence
  Description of Artificial Sequence: Synthetic oligonucleotide
  Target: FXN; (+) strand; PAM type: NRG; PAM sequence: AAG
ttcttcctttggggggtaca

SEQ ID NO: 16237 - DNA, 20 bp, Artificial Sequence
  Description of Artificial Sequence: Synthetic oligonucleotide
  Target: FXN; (+) strand; PAM type: NRG; PAM sequence: CAG
gtacaaagaaatatctgacc

SEQ ID NO: 16238 - DNA, 20 bp, Artificial Sequence
  Description of Artificial Sequence: Synthetic oligonucleotide
  Target: FXN; (+) strand; PAM type: NRG; PAM sequence: CGG
tatctgacccagttacgcca

SEQ ID NO: 16239 - DNA, 20 bp, Artificial Sequence
  Description of Artificial Sequence: Synthetic oligonucleotide
  Target: FXN; (+) strand; PAM type: NRG; PAM sequence: AAG
ccagttacgccacggcttga

SEQ ID NO: 16240 - DNA, 20 bp, Artificial Sequence
  Description of Artificial Sequence: Synthetic oligonucleotide
  Target: FXN; (+) strand; PAM type: NRG; PAM sequence: AGG
cagttacgccacggcttgaa

SEQ ID NO: 16241 - DNA, 20 bp, Artificial Sequence
  Description of Artificial Sequence: Synthetic oligonucleotide
  Target: FXN; (+) strand; PAM type: NRG; PAM sequence: GAG
gttacgccacggcttgaaag

SEQ ID NO: 16242 - DNA, 20 bp, Artificial Sequence
  Description of Artificial Sequence: Synthetic oligonucleotide
  Target: FXN; (+) strand; PAM type: NRG; PAM sequence: AGG
ttacgccacggcttgaaagg

SEQ ID NO: 16243 - DNA, 20 bp, Artificial Sequence
  Description of Artificial Sequence: Synthetic oligonucleotide
  Target: FXN; (+) strand; PAM type: NRG; PAM sequence: AAG
gcttgaaaggaggaaaccca

SEQ ID NO: 16244 - DNA, 20 bp, Artificial Sequence
  Description of Artificial Sequence: Synthetic oligonucleotide
  Target: FXN; (+) strand; PAM type: NRG; PAM sequence: TGG
aaaggaggaaacccaaagaa

SEQ ID NO: 16245 - DNA, 20 bp, Artificial Sequence
  Description of Artificial Sequence: Synthetic oligonucleotide
  Target: FXN; (+) strand; PAM type: NRG; PAM sequence: TGG
ggaaacccaaagaatggctg

SEQ ID NO: 16246 - DNA, 20 bp, Artificial Sequence
  Description of Artificial Sequence: Synthetic oligonucleotide
  Target: FXN; (+) strand; PAM type: NRG; PAM sequence: GGG
gaaacccaaagaatggctgt

SEQ ID NO: 16247 - DNA, 20 bp, Artificial Sequence
  Description of Artificial Sequence: Synthetic oligonucleotide
  Target: FXN; (+) strand; PAM type: NRG; PAM sequence: GGG
aaacccaaagaatggctgtg

SEQ ID NO: 16248 - DNA, 20 bp, Artificial Sequence
  Description of Artificial Sequence: Synthetic oligonucleotide
  Target: FXN; (+) strand; PAM type: NRG; PAM sequence: GAG
caaagaatggctgtggggat

SEQ ID NO: 16249 - DNA, 20 bp, Artificial Sequence
  Description of Artificial Sequence: Synthetic oligonucleotide
  Target: FXN; (+) strand; PAM type: NRG; PAM sequence: AGG
aaagaatggctgtggggatg

SEQ ID NO: 16250 - DNA, 20 bp, Artificial Sequence
  Description of Artificial Sequence: Synthetic oligonucleotide
  Target: FXN; (+) strand; PAM type: NRG; PAM sequence: AAG
gaatggctgtggggatgagg

SEQ ID NO: 16251 - DNA, 20 bp, Artificial Sequence
  Description of Artificial Sequence: Synthetic oligonucleotide
  Target: FXN; (+) strand; PAM type: NRG; PAM sequence: AAG
ggggatgaggaagattcctc

SEQ ID NO: 16252 - DNA, 20 bp, Artificial Sequence
  Description of Artificial Sequence: Synthetic oligonucleotide
  Target: FXN; (+) strand; PAM type: NRG; PAM sequence: AGG
gggatgaggaagattcctca

SEQ ID NO: 16253 - DNA, 20 bp, Artificial Sequence
  Description of Artificial Sequence: Synthetic oligonucleotide
  Target: FXN; (+) strand; PAM type: NRG; PAM sequence: GGG
ggatgaggaagattcctcaa

SEQ ID NO: 16254 - DNA, 20 bp, Artificial Sequence
  Description of Artificial Sequence: Synthetic oligonucleotide
  Target: FXN; (+) strand; PAM type: NRG; PAM sequence: GGG
gatgaggaagattcctcaag

SEQ ID NO: 16255 - DNA, 20 bp, Artificial Sequence
  Description of Artificial Sequence: Synthetic oligonucleotide
  Target: FXN; (+) strand; PAM type: NRG; PAM sequence: GAG
tgaggaagattcctcaaggg

SEQ ID NO: 16256 - DNA, 20 bp, Artificial Sequence
  Description of Artificial Sequence: Synthetic oligonucleotide
  Target: FXN; (+) strand; PAM type: NRG; PAM sequence: AGG
gaggaagattcctcaagggg

SEQ ID NO: 16257 - DNA, 20 bp, Artificial Sequence
  Description of Artificial Sequence: Synthetic oligonucleotide
  Target: FXN; (+) strand; PAM type: NRG; PAM sequence: TGG
gattcctcaaggggaggaca

SEQ ID NO: 16258 - DNA, 20 bp, Artificial Sequence
  Description of Artificial Sequence: Synthetic oligonucleotide
  Target: FXN; (+) strand; PAM type: NRG; PAM sequence: GAG
gggaggacatggtatttaat

SEQ ID NO: 16259 - DNA, 20 bp, Artificial Sequence
  Description of Artificial Sequence: Synthetic oligonucleotide
  Target: FXN; (+) strand; PAM type: NRG; PAM sequence: AGG
ggaggacatggtatttaatg

SEQ ID NO: 16260 - DNA, 20 bp, Artificial Sequence
  Description of Artificial Sequence: Synthetic oligonucleotide
  Target: FXN; (+) strand; PAM type: NRG; PAM sequence: GGG
gaggacatggtatttaatga

SEQ ID NO: 16261 - DNA, 20 bp, Artificial Sequence
  Description of Artificial Sequence: Synthetic oligonucleotide
  Target: FXN; (+) strand; PAM type: NRG; PAM sequence: AAG
ggtatttaatgagggtcttg

SEQ ID NO: 16262 - DNA, 20 bp, Artificial Sequence
  Description of Artificial Sequence: Synthetic oligonucleotide
  Target: FXN; (+) strand; PAM type: NRG; PAM sequence: AAG
atgagggtcttgaagatgcc

SEQ ID NO: 16263 - DNA, 20 bp, Artificial Sequence
  Description of Artificial Sequence: Synthetic oligonucleotide
  Target: FXN; (+) strand; PAM type: NRG; PAM sequence: AGG
tgagggtcttgaagatgcca

SEQ ID NO: 16264 - DNA, 20 bp, Artificial Sequence
  Description of Artificial Sequence: Synthetic oligonucleotide
  Target: FXN; (+) strand; PAM type: NRG; PAM sequence: AAG
gggtcttgaagatgccaagg

SEQ ID NO: 16265 - DNA, 20 bp, Artificial Sequence
  Description of Artificial Sequence: Synthetic oligonucleotide
  Target: FXN; (+) strand; PAM type: NRG; PAM sequence: TGG
tcttgaagatgccaaggaag

SEQ ID NO: 16266 - DNA, 20 bp, Artificial Sequence
  Description of Artificial Sequence: Synthetic oligonucleotide
  Target: FXN; (+) strand; PAM type: NRG; PAM sequence: TAG
tgaagatgccaaggaagtgg

SEQ ID NO: 16267 - DNA, 20 bp, Artificial Sequence
  Description of Artificial Sequence: Synthetic oligonucleotide
  Target: FXN; (+) strand; PAM type: NRG; PAM sequence: GAG
aagatgccaaggaagtggta

SEQ ID NO: 16268 - DNA, 20 bp, Artificial Sequence
  Description of Artificial Sequence: Synthetic oligonucleotide
  Target: FXN; (+) strand; PAM type: NRG; PAM sequence: AGG
agatgccaaggaagtggtag

SEQ ID NO: 16269 - DNA, 20 bp, Artificial Sequence
  Description of Artificial Sequence: Synthetic oligonucleotide
  Target: FXN; (+) strand; PAM type: NRG; PAM sequence: GGG
gatgccaaggaagtggtaga

SEQ ID NO: 16270 - DNA, 20 bp, Artificial Sequence
  Description of Artificial Sequence: Synthetic oligonucleotide
  Target: FXN; (+) strand; PAM type: NRG; PAM sequence: GAG
agtggtagagggtgtttcac

SEQ ID NO: 16271 - DNA, 20 bp, Artificial Sequence
  Description of Artificial Sequence: Synthetic oligonucleotide
  Target: FXN; (+) strand; PAM type: NRG; PAM sequence: AGG
gtggtagagggtgtttcacg

SEQ ID NO: 16272 - DNA, 20 bp, Artificial Sequence
  Description of Artificial Sequence: Synthetic oligonucleotide
  Target: FXN; (+) strand; PAM type: NRG; PAM sequence: GAG
ggtagagggtgtttcacgag

SEQ ID NO: 16273 - DNA, 20 bp, Artificial Sequence
  Description of Artificial Sequence: Synthetic oligonucleotide
  Target: FXN; (+) strand; PAM type: NRG; PAM sequence: AGG
gtagagggtgtttcacgagg

SEQ ID NO: 16274 - DNA, 20 bp, Artificial Sequence
  Description of Artificial Sequence: Synthetic oligonucleotide
  Target: FXN; (+) strand; PAM type: NRG; PAM sequence: GGG
tagagggtgtttcacgagga

SEQ ID NO: 16275 - DNA, 20 bp, Artificial Sequence
  Description of Artificial Sequence: Synthetic oligonucleotide
  Target: FXN; (+) strand; PAM type: NRG; PAM sequence: TGG
ttcacgaggagggaaccgtc

SEQ ID NO: 16276 - DNA, 20 bp, Artificial Sequence
  Description of Artificial Sequence: Synthetic oligonucleotide
  Target: FXN; (+) strand; PAM type: NRG; PAM sequence: GGG
tcacgaggagggaaccgtct

SEQ ID NO: 16277 - DNA, 20 bp, Artificial Sequence
  Description of Artificial Sequence: Synthetic oligonucleotide
  Target: FXN; (+) strand; PAM type: NRG; PAM sequence: AAG
aggagggaaccgtctgggca

SEQ ID NO: 16278 - DNA, 20 bp, Artificial Sequence
  Description of Artificial Sequence: Synthetic oligonucleotide
  Target: FXN; (+) strand; PAM type: NRG; PAM sequence: AGG
ggagggaaccgtctgggcaa

SEQ ID NO: 16279 - DNA, 20 bp, Artificial Sequence
  Description of Artificial Sequence: Synthetic oligonucleotide
  Target: FXN; (+) strand; PAM type: NRG; PAM sequence: CAG
ggaaccgtctgggcaaaggc

SEQ ID NO: 16280 - DNA, 20 bp, Artificial Sequence
  Description of Artificial Sequence: Synthetic oligonucleotide
  Target: FXN; (+) strand; PAM type: NRG; PAM sequence: AGG
gaaccgtctgggcaaaggcc

SEQ ID NO: 16281 - DNA, 20 bp, Artificial Sequence
  Description of Artificial Sequence: Synthetic oligonucleotide
  Target: FXN; (+) strand; PAM type: NRG; PAM sequence: AAG
ccgtctgggcaaaggccagg

SEQ ID NO: 16282 - DNA, 20 bp, Artificial Sequence
  Description of Artificial Sequence: Synthetic oligonucleotide
  Target: FXN; (+) strand; PAM type: NRG; PAM sequence: AGG
cgtctgggcaaaggccagga

SEQ ID NO: 16283 - DNA, 20 bp, Artificial Sequence
  Description of Artificial Sequence: Synthetic oligonucleotide
  Target: FXN; (+) strand; PAM type: NRG; PAM sequence: CGG
ctgggcaaaggccaggaagg

SEQ ID NO: 16284 - DNA, 20 bp, Artificial Sequence
  Description of Artificial Sequence: Synthetic oligonucleotide
  Target: FXN; (+) strand; PAM type: NRG; PAM sequence: AAG
ggcaaaggccaggaaggcgg

SEQ ID NO: 16285 - DNA, 20 bp, Artificial Sequence
  Description of Artificial Sequence: Synthetic oligonucleotide
  Target: FXN; (+) strand; PAM type: NRG; PAM sequence: AGG
gcaaaggccaggaaggcgga

SEQ ID NO: 16286 - DNA, 20 bp, Artificial Sequence
  Description of Artificial Sequence: Synthetic oligonucleotide
  Target: FXN; (+) strand; PAM type: NRG; PAM sequence: GGG
caaaggccaggaaggcggaa

SEQ ID NO: 16287 - DNA, 20 bp, Artificial Sequence
  Description of Artificial Sequence: Synthetic oligonucleotide
  Target: FXN; (+) strand; PAM type: NRG; PAM sequence: GGG
aaaggccaggaaggcggaag

SEQ ID NO: 16288 - DNA, 20 bp, Artificial Sequence
  Description of Artificial Sequence: Synthetic oligonucleotide
  Target: FXN; (+) strand; PAM type: NRG; PAM sequence: CAG
aaggcggaaggggatccctt

SEQ ID NO: 16289 - DNA, 20 bp, Artificial Sequence
  Description of Artificial Sequence: Synthetic oligonucleotide
  Target: FXN; (+) strand; PAM type: NRG; PAM sequence: GAG
ggcggaaggggatcccttca

SEQ ID NO: 16290 - DNA, 20 bp, Artificial Sequence
  Description of Artificial Sequence: Synthetic oligonucleotide
  Target: FXN; (+) strand; PAM type: NRG; PAM sequence: TGG
ggaaggggatcccttcagag

SEQ ID NO: 16291 - DNA, 20 bp, Artificial Sequence
  Description of Artificial Sequence: Synthetic oligonucleotide
  Target: FXN; (+) strand; PAM type: NRG; PAM sequence: TGG
ggggatcccttcagagtggc

SEQ ID NO: 16292 - DNA, 20 bp, Artificial Sequence
  Description of Artificial Sequence: Synthetic oligonucleotide
  Target: FXN; (+) strand; PAM type: NRG; PAM sequence: TAG
ggctggtacgccgcatgtat

SEQ ID NO: 16293 - DNA, 20 bp, Artificial Sequence
  Description of Artificial Sequence: Synthetic oligonucleotide
  Target: FXN; (+) strand; PAM type: NRG; PAM sequence: AGG
gctggtacgccgcatgtatt

SEQ ID NO: 16294 - DNA, 20 bp, Artificial Sequence
  Description of Artificial Sequence: Synthetic oligonucleotide
  Target: FXN; (+) strand; PAM type: NRG; PAM sequence: GGG
ctggtacgccgcatgtatta

SEQ ID NO: 16295 - DNA, 20 bp, Artificial Sequence
  Description of Artificial Sequence: Synthetic oligonucleotide
  Target: FXN; (+) strand; PAM type: NRG; PAM sequence: GGG
tggtacgccgcatgtattag

SEQ ID NO: 16296 - DNA, 20 bp, Artificial Sequence
  Description of Artificial Sequence: Synthetic oligonucleotide
  Target: FXN; (+) strand; PAM type: NRG; PAM sequence: GAG
gtacgccgcatgtattaggg

SEQ ID NO: 16297 - DNA, 20 bp, Artificial Sequence
  Description of Artificial Sequence: Synthetic oligonucleotide
  Target: FXN; (+) strand; PAM type: NRG; PAM sequence: AAG
gcatgtattaggggagatga

SEQ ID NO: 16298 - DNA, 20 bp, Artificial Sequence
  Description of Artificial Sequence: Synthetic oligonucleotide
  Target: FXN; (+) strand; PAM type: NRG; PAM sequence: GAG
atgtattaggggagatgaaa

SEQ ID NO: 16299 - DNA, 20 bp, Artificial Sequence
  Description of Artificial Sequence: Synthetic oligonucleotide
  Target: FXN; (+) strand; PAM type: NRG; PAM sequence: AGG
tgtattaggggagatgaaag

SEQ ID NO: 16300 - DNA, 20 bp, Artificial Sequence
  Description of Artificial Sequence: Synthetic oligonucleotide
  Target: FXN; (+) strand; PAM type: NRG; PAM sequence: CAG
attaggggagatgaaagagg

SEQ ID NO: 16301 - DNA, 20 bp, Artificial Sequence
  Description of Artificial Sequence: Synthetic oligonucleotide
  Target: FXN; (+) strand; PAM type: NRG; PAM sequence: AGG
ttaggggagatgaaagaggc

SEQ ID NO: 16302 - DNA, 20 bp, Artificial Sequence
  Description of Artificial Sequence: Synthetic oligonucleotide
  Target: FXN; (+) strand; PAM type: NRG; PAM sequence: AAG
gaaagaggcaggccacgtcc

SEQ ID NO: 16303 - DNA, 20 bp, Artificial Sequence
  Description of Artificial Sequence: Synthetic oligonucleotide
  Target: FXN; (+) strand; PAM type: NRG; PAM sequence: CGG
gccatatttgtgttgctctc

SEQ ID NO: 16304 - DNA, 20 bp, Artificial Sequence
  Description of Artificial Sequence: Synthetic oligonucleotide
  Target: FXN; (+) strand; PAM type: NRG; PAM sequence: GAG
catatttgtgttgctctccg

SEQ ID NO: 16305 - DNA, 20 bp, Artificial Sequence
  Description of Artificial Sequence: Synthetic oligonucleotide
  Target: FXN; (+) strand; PAM type: NRG; PAM sequence: TAG
gctctccggagtttgtactt

SEQ ID NO: 16306 - DNA, 20 bp, Artificial Sequence
  Description of Artificial Sequence: Synthetic oligonucleotide
  Target: FXN; (+) strand; PAM type: NRG; PAM sequence: AGG
ctctccggagtttgtacttt

SEQ ID NO: 16307 - DNA, 20 bp, Artificial Sequence
  Description of Artificial Sequence: Synthetic oligonucleotide
  Target: FXN; (+) strand; PAM type: NRG; PAM sequence: TGG
aacttcccacacgtgttatt

SEQ ID NO: 16308 - DNA, 20 bp, Artificial Sequence
  Description of Artificial Sequence: Synthetic oligonucleotide
  Target: FXN; (+) strand; PAM type: NRG; PAM sequence: AAG
tttggcccacattgtgtttg

SEQ ID NO: 16309 - DNA, 20 bp, Artificial Sequence
  Description of Artificial Sequence: Synthetic oligonucleotide
  Target: FXN; (+) strand; PAM type: NRG; PAM sequence: TGG
cattgtgtttgaagaaactt

SEQ ID NO: 16310 - DNA, 20 bp, Artificial Sequence
  Description of Artificial Sequence: Synthetic oligonucleotide
  Target: FXN; (+) strand; PAM type: NRG; PAM sequence: GGG
attgtgtttgaagaaacttt

SEQ ID NO: 16311 - DNA, 20 bp, Artificial Sequence
  Description of Artificial Sequence: Synthetic oligonucleotide
  Target: FXN; (+) strand; PAM type: NRG; PAM sequence: TGG
gtttgaagaaactttgggat

SEQ ID NO: 16312 - DNA, 20 bp, Artificial Sequence
  Description of Artificial Sequence: Synthetic oligonucleotide
  Target: FXN; (+) strand; PAM type: NRG; PAM sequence: CAG
gaaactttgggattggttgc

SEQ ID NO: 16313 - DNA, 20 bp, Artificial Sequence
  Description of Artificial Sequence: Synthetic oligonucleotide
  Target: FXN; (+) strand; PAM type: NRG; PAM sequence: AAG
gattggttgccagtgcttaa

SEQ ID NO: 16314 - DNA, 20 bp, Artificial Sequence
  Description of Artificial Sequence: Synthetic oligonucleotide
  Target: FXN; (+) strand; PAM type: NRG; PAM sequence: TAG
ggttgccagtgcttaaaagt

SEQ ID NO: 16315 - DNA, 20 bp, Artificial Sequence
  Description of Artificial Sequence: Synthetic oligonucleotide
  Target: FXN; (+) strand; PAM type: NRG; PAM sequence: AGG
gttgccagtgcttaaaagtt

SEQ ID NO: 16316 - DNA, 20 bp, Artificial Sequence
  Description of Artificial Sequence: Synthetic oligonucleotide
  Target: FXN; (+) strand; PAM type: NRG; PAM sequence: TAG
agtgcttaaaagttaggact

SEQ ID NO: 16317 - DNA, 20 bp, Artificial Sequence
  Description of Artificial Sequence: Synthetic oligonucleotide
  Target: FXN; (+) strand; PAM type: NRG; PAM sequence: TGG
aaaagttaggacttagaaaa

SEQ ID NO: 16318 - DNA, 20 bp, Artificial Sequence
  Description of Artificial Sequence: Synthetic oligonucleotide
  Target: FXN; (+) strand; PAM type: NRG; PAM sequence: TGG
gacttagaaaatggatttcc

SEQ ID NO: 16319 - DNA, 20 bp, Artificial Sequence
  Description of Artificial Sequence: Synthetic oligonucleotide
  Target: FXN; (+) strand; PAM type: NRG; PAM sequence: CAG
ttagaaaatggatttcctgg

SEQ ID NO: 16320 - DNA, 20 bp, Artificial Sequence
  Description of Artificial Sequence: Synthetic oligonucleotide
  Target: FXN; (+) strand; PAM type: NRG; PAM sequence: AGG
tagaaaatggatttcctggc

SEQ ID NO: 16321 - DNA, 20 bp, Artificial Sequence
  Description of Artificial Sequence: Synthetic oligonucleotide
  Target: FXN; (+) strand; PAM type: NRG; PAM sequence: CGG
atggatttcctggcaggacg

SEQ ID NO: 16322 - DNA, 20 bp, Artificial Sequence
  Description of Artificial Sequence: Synthetic oligonucleotide
  Target: FXN; (+) strand; PAM type: NRG; PAM sequence: TGG
gatttcctggcaggacgcgg

SEQ ID NO: 16323 - DNA, 20 bp, Artificial Sequence
  Description of Artificial Sequence: Synthetic oligonucleotide
  Target: FXN; (+) strand; PAM type: NRG; PAM sequence: CAG
gtggctcatgcccataatct

SEQ ID NO: 16324 - DNA, 20 bp, Artificial Sequence
  Description of Artificial Sequence: Synthetic oligonucleotide
  Target: FXN; (+) strand; PAM type: NRG; PAM sequence: TGG
tgcccataatctcagcactt

SEQ ID NO: 16325 - DNA, 20 bp, Artificial Sequence
  Description of Artificial Sequence: Synthetic oligonucleotide
  Target: FXN; (+) strand; PAM type: NRG; PAM sequence: GGG
gcccataatctcagcacttt

SEQ ID NO: 16326 - DNA, 20 bp, Artificial Sequence
  Description of Artificial Sequence: Synthetic oligonucleotide
  Target: FXN; (+) strand; PAM type: NRG; PAM sequence: GAG
ccataatctcagcactttgg

SEQ ID NO: 16327 - DNA, 20 bp, Artificial Sequence
  Description of Artificial Sequence: Synthetic oligonucleotide
  Target: FXN; (+) strand; PAM type: NRG; PAM sequence: AGG
cataatctcagcactttggg

SEQ ID NO: 16328 - DNA, 20 bp, Artificial Sequence
  Description of Artificial Sequence: Synthetic oligonucleotide
  Target: FXN; (+) strand; PAM type: NRG; PAM sequence: TAG
tctcagcactttgggaggcc

SEQ ID NO: 16329 - DNA, 20 bp, Artificial Sequence
  Description of Artificial Sequence: Synthetic oligonucleotide
  Target: FXN; (+) strand; PAM type: NRG; PAM sequence: AGG
ctcagcactttgggaggcct

SEQ ID NO: 16330 - DNA, 20 bp, Artificial Sequence
  Description of Artificial Sequence: Synthetic oligonucleotide
  Target: FXN; (+) strand; PAM type: NRG; PAM sequence: AAG
agcactttgggaggcctagg

SEQ ID NO: 16331 - DNA, 20 bp, Artificial Sequence
  Description of Artificial Sequence: Synthetic oligonucleotide
  Target: FXN; (+) strand; PAM type: NRG; PAM sequence: AGG
gcactttgggaggcctagga

SEQ ID NO: 16332 - DNA, 20 bp, Artificial Sequence
  Description of Artificial Sequence: Synthetic oligonucleotide
  Target: FXN; (+) strand; PAM type: NRG; PAM sequence: TGG
ctttgggaggcctaggaagg

SEQ ID NO: 16333 - DNA, 20 bp, Artificial Sequence
  Description of Artificial Sequence: Synthetic oligonucleotide
  Target: FXN; (+) strand; PAM type: NRG; PAM sequence: GAG
cctaggaaggtggatcacct

SEQ ID NO: 16334 - DNA, 20 bp, Artificial Sequence
  Description of Artificial Sequence: Synthetic oligonucleotide
  Target: FXN; (+) strand; PAM type: NRG; PAM sequence: AGG
ctaggaaggtggatcacctg

SEQ ID NO: 16335 - DNA, 20 bp, Artificial Sequence
  Description of Artificial Sequence: Synthetic oligonucleotide
  Target: FXN; (+) strand; PAM type: NRG; PAM sequence: CGG
aaggtggatcacctgaggtc

SEQ ID NO: 16336 - DNA, 20 bp, Artificial Sequence
  Description of Artificial Sequence: Synthetic oligonucleotide
  Target: FXN; (+) strand; PAM type: NRG; PAM sequence: GAG
ggtggatcacctgaggtccg

SEQ ID NO: 16337 - DNA, 20 bp, Artificial Sequence
  Description of Artificial Sequence: Synthetic oligonucleotide
  Target: FXN; (+) strand; PAM type: NRG; PAM sequence: AAG
tcacctgaggtccggagttc

SEQ ID NO: 16338 - DNA, 20 bp, Artificial Sequence
  Description of Artificial Sequence: Synthetic oligonucleotide
  Target: FXN; (+) strand; PAM type: NRG; PAM sequence: TGG
tccggagttcaagactaacc

SEQ ID NO: 16339 - DNA, 20 bp, Artificial Sequence
  Description of Artificial Sequence: Synthetic oligonucleotide
  Target: FXN; (+) strand; PAM type: NRG; PAM sequence: TGG
caagactaacctggccaaca

SEQ ID NO: 16340 - DNA, 20 bp, Artificial Sequence
  Description of Artificial Sequence: Synthetic oligonucleotide
  Target: FXN; (+) strand; PAM type: NRG; PAM sequence: CAG
ctggccaacatggtgaaacc

SEQ ID NO: 16341 - DNA, 20 bp, Artificial Sequence
  Description of Artificial Sequence: Synthetic oligonucleotide
  Target: FXN; (+) strand; PAM type: NRG; PAM sequence: AAG
aaatacaaaaaaaaaaaaaa

SEQ ID NO: 16342 - DNA, 20 bp, Artificial Sequence
  Description of Artificial Sequence: Synthetic oligonucleotide
  Target: FXN; (+) strand; PAM type: NRG; PAM sequence: AAG
tacaaaaaaaaaaaaaaaag

SEQ ID NO: 16343 - DNA, 20 bp, Artificial Sequence
  Description of Artificial Sequence: Synthetic oligonucleotide
  Target: FXN; (+) strand; PAM type: NRG; PAM sequence: AAG
aaaaaaaaaaaaaaaagaag

SEQ ID NO: 16344 - DNA, 20 bp, Artificial Sequence
  Description of Artificial Sequence: Synthetic oligonucleotide
  Target: FXN; (+) strand; PAM type: NRG; PAM sequence: AAG
aaaaaaaaaaaaagaagaag

SEQ ID NO: 16345 - DNA, 20 bp, Artificial Sequence
  Description of Artificial Sequence: Synthetic oligonucleotide
  Target: FXN; (+) strand; PAM type: NRG; PAM sequence: AAG
aaaaaaaaaagaagaagaag

SEQ ID NO: 16346 - DNA, 20 bp, Artificial Sequence
  Description of Artificial Sequence: Synthetic oligonucleotide
  Target: FXN; (+) strand; PAM type: NRG; PAM sequence: AAG
aaaaaaagaagaagaagaag

SEQ ID NO: 16347 - DNA, 20 bp, Artificial Sequence
  Description of Artificial Sequence: Synthetic oligonucleotide
  Target: FXN; (+) strand; PAM type: NRG; PAM sequence: AAG
agaagaagaagaagaaaata

SEQ ID NO: 16348 - DNA, 20 bp, Artificial Sequence
  Description of Artificial Sequence: Synthetic oligonucleotide
  Target: FXN; (+) strand; PAM type: NRG; PAM sequence: AAG
aagaagaagaaaataaagaa

SEQ ID NO: 16349 - DNA, 20 bp, Artificial Sequence
  Description of Artificial Sequence: Synthetic oligonucleotide
  Target: FXN; (+) strand; PAM type: NRG; PAM sequence: TAG
agaagaaaataaagaaaagt

SEQ ID NO: 16350 - DNA, 20 bp, Artificial Sequence
  Description of Artificial Sequence: Synthetic oligonucleotide
  Target: FXN; (+) strand; PAM type: NRG; PAM sequence: CGG
gaaaataaagaaaagttagc

SEQ ID NO: 16351 - DNA, 20 bp, Artificial Sequence
  Description of Artificial Sequence: Synthetic oligonucleotide
  Target: FXN; (+) strand; PAM type: NRG; PAM sequence: GGG
aaaataaagaaaagttagcc

SEQ ID NO: 16352 - DNA, 20 bp, Artificial Sequence
  Description of Artificial Sequence: Synthetic oligonucleotide
  Target: FXN; (+) strand; PAM type: NRG; PAM sequence: TGG
aaagaaaagttagccgggcg

SEQ ID NO: 16353 - DNA, 20 bp, Artificial Sequence
  Description of Artificial Sequence: Synthetic oligonucleotide
  Target: FXN; (+) strand; PAM type: NRG; PAM sequence: CAG
gtgtcgcgcgcctgtaatcc

SEQ ID NO: 16354 - DNA, 20 bp, Artificial Sequence
  Description of Artificial Sequence: Synthetic oligonucleotide
  Target: FXN; (+) strand; PAM type: NRG; PAM sequence: CAG
gcctgtaatcccagctactc

SEQ ID NO: 16355 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagctactcca

SEQ ID NO: 16356 - DNA, 20 bp, Artificial Sequence
  Description of Artificial Sequence: Synthetic oligonucleotide
  Target: FXN; (+) strand; PAM type: NRG; PAM sequence: AGG
tgtaatcccagctactccag

SEQ ID NO: 16357 - DNA, 20 bp, Artificial Sequence
  Description of Artificial Sequence: Synthetic oligonucleotide
  Target: FXN; (+) strand; PAM type: NRG; PAM sequence: CGG
cccagctactccagaggctg

SEQ ID NO: 16358 - DNA, 20 bp, Artificial Sequence
  Description of Artificial Sequence: Synthetic oligonucleotide
  Target: FXN; (+) strand; PAM type: NRG; PAM sequence: CAG
agctactccagaggctgcgg

SEQ ID NO: 16359 - DNA, 20 bp, Artificial Sequence
  Description of Artificial Sequence: Synthetic oligonucleotide
  Target: FXN; (+) strand; PAM type: NRG; PAM sequence: AGG
gctactccagaggctgcggc

SEQ ID NO: 16360 - DNA, 20 bp, Artificial Sequence
  Description of Artificial Sequence: Synthetic oligonucleotide
  Target: FXN; (+) strand; PAM type: NRG; PAM sequence: GAG
tactccagaggctgcggcag

SEQ ID NO: 16361 - DNA, 20 bp, Artificial Sequence
  Description of Artificial Sequence: Synthetic oligonucleotide
  Target: FXN; (+) strand; PAM type: NRG; PAM sequence: GAG
ctgcggcaggagaatcgctt

SEQ ID NO: 16362 - DNA, 20 bp, Artificial Sequence
  Description of Artificial Sequence: Synthetic oligonucleotide
  Target: FXN; (+) strand; PAM type: NRG; PAM sequence: CGG
gcaggagaatcgcttgagcc

SEQ ID NO: 16363 - DNA, 20 bp, Artificial Sequence
  Description of Artificial Sequence: Synthetic oligonucleotide
  Target: FXN; (+) strand; PAM type: NRG; PAM sequence: GGG
caggagaatcgcttgagccc

SEQ ID NO: 16364 - DNA, 20 bp, Artificial Sequence
  Description of Artificial Sequence: Synthetic oligonucleotide
  Target: FXN; (+) strand; PAM type: NRG; PAM sequence: GAG
ggagaatcgcttgagcccgg

SEQ ID NO: 16365 - DNA, 20 bp, Artificial Sequence
  Description of Artificial Sequence: Synthetic oligonucleotide
  Target: FXN; (+) strand; PAM type: NRG; PAM sequence: AGG
gagaatcgcttgagcccggg

SEQ ID NO: 16366 - DNA, 20 bp, Artificial Sequence
  Description of Artificial Sequence: Synthetic oligonucleotide
  Target: FXN; (+) strand; PAM type: NRG; PAM sequence: CAG
aatcgcttgagcccgggagg

SEQ ID NO: 16367 - DNA, 20 bp, Artificial Sequence
  Description of Artificial Sequence: Synthetic oligonucleotide
  Target: FXN; (+) strand; PAM type: NRG; PAM sequence: GAG
tcgcttgagcccgggaggca

SEQ ID NO: 16368 - DNA, 20 bp, Artificial Sequence
  Description of Artificial Sequence: Synthetic oligonucleotide
  Target: FXN; (+) strand; PAM type: NRG; PAM sequence: AGG
cgcttgagcccgggaggcag

SEQ ID NO: 16369 - DNA, 20 bp, Artificial Sequence
  Description of Artificial Sequence: Synthetic oligonucleotide
  Target: FXN; (+) strand; PAM type: NRG; PAM sequence: AAG
cgggaggcagaggttgcatt

SEQ ID NO: 16370 - DNA, 20 bp, Artificial Sequence
  Description of Artificial Sequence: Synthetic oligonucleotide
  Target: FXN; (+) strand; PAM type: NRG; PAM sequence: AAG
ggcagaggttgcattaagcc

SEQ ID NO: 16371 - DNA, 20 bp, Artificial Sequence
  Description of Artificial Sequence: Synthetic oligonucleotide
  Target: FXN; (+) strand; PAM type: NRG; PAM sequence: CGG
caagatcgcccaatgcactc

SEQ ID NO: 16372 - DNA, 20 bp, Artificial Sequence
  Description of Artificial Sequence: Synthetic oligonucleotide
  Target: FXN; (+) strand; PAM type: NRG; PAM sequence: TGG
tcgcccaatgcactccggcc

SEQ ID NO: 16373 - DNA, 20 bp, Artificial Sequence
  Description of Artificial Sequence: Synthetic oligonucleotide
  Target: FXN; (+) strand; PAM type: NRG; PAM sequence: GGG
cgcccaatgcactccggcct

SEQ ID NO: 16374 - DNA, 20 bp, Artificial Sequence
  Description of Artificial Sequence: Synthetic oligonucleotide
  Target: FXN; (+) strand; PAM type: NRG; PAM sequence: CAG
atgcactccggcctgggcga

SEQ ID NO: 16375 - DNA, 20 bp, Artificial Sequence
  Description of Artificial Sequence: Synthetic oligonucleotide
  Target: FXN; (+) strand; PAM type: NRG; PAM sequence: GAG
gcactccggcctgggcgaca

SEQ ID NO: 16376 - DNA, 20 bp, Artificial Sequence
  Description of Artificial Sequence: Synthetic oligonucleotide
  Target: FXN; (+) strand; PAM type: NRG; PAM sequence: AAG
tccggcctgggcgacagagc

SEQ ID NO: 16377 - DNA, 20 bp, Artificial Sequence
  Description of Artificial Sequence: Synthetic oligonucleotide
  Target: FXN; (+) strand; PAM type: NRG; PAM sequence: TGG
aataaaaataaaaaataaaa

SEQ ID NO: 16378 - DNA, 20 bp, Artificial Sequence
  Description of Artificial Sequence: Synthetic oligonucleotide
  Target: FXN; (+) strand; PAM type: NRG; PAM sequence: CAG
aaaaaataaaatggatttcc

SEQ ID NO: 16379 - DNA, 20 bp, Artificial Sequence
  Description of Artificial Sequence: Synthetic oligonucleotide
  Target: FXN; (+) strand; PAM type: NRG; PAM sequence: TGG
aatggatttcccagcatctc

SEQ ID NO: 16380 - DNA, 20 bp, Artificial Sequence
  Description of Artificial Sequence: Synthetic oligonucleotide
  Target: FXN; (+) strand; PAM type: NRG; PAM sequence: TAG
tcccagcatctctggaaaaa

SEQ ID NO: 16381 - DNA, 20 bp, Artificial Sequence
  Description of Artificial Sequence: Synthetic oligonucleotide
  Target: FXN; (+) strand; PAM type: NRG; PAM sequence: AGG
cccagcatctctggaaaaat

SEQ ID NO: 16382 - DNA, 20 bp, Artificial Sequence
  Description of Artificial Sequence: Synthetic oligonucleotide
  Target: FXN; (+) strand; PAM type: NRG; PAM sequence: AAG
gcatctctggaaaaataggc

SEQ ID NO: 16383 - DNA, 20 bp, Artificial Sequence
  Description of Artificial Sequence: Synthetic oligonucleotide
  Target: FXN; (+) strand; PAM type: NRG; PAM sequence: TGG
tctggaaaaataggcaagtg

SEQ ID NO: 16384 - DNA, 20 bp, Artificial Sequence
  Description of Artificial Sequence: Synthetic oligonucleotide
  Target: FXN; (+) strand; PAM type: NRG; PAM sequence: TGG
ataggcaagtgtggccatga

SEQ ID NO: 16385 - DNA, 20 bp, Artificial Sequence
  Description of Artificial Sequence: Synthetic oligonucleotide
  Target: FXN; (+) strand; PAM type: NRG; PAM sequence: TAG
agtgtggccatgatggtcct

SEQ ID NO: 16386 - DNA, 20 bp, Artificial Sequence
  Description of Artificial Sequence: Synthetic oligonucleotide
  Target: FXN; (+) strand; PAM type: NRG; PAM sequence: TAG
gatggtccttagatctcctc

SEQ ID NO: 16387 - DNA, 20 bp, Artificial Sequence
  Description of Artificial Sequence: Synthetic oligonucleotide
  Target: FXN; (+) strand; PAM type: NRG; PAM sequence: AGG
atggtccttagatctcctct

SEQ ID NO: 16388 - DNA, 20 bp, Artificial Sequence
  Description of Artificial Sequence: Synthetic oligonucleotide
  Target: FXN; (+) strand; PAM type: NRG; PAM sequence: AAG
tccttagatctcctctagga

SEQ ID NO: 16389 - DNA, 20 bp, Artificial Sequence
  Description of Artificial Sequence: Synthetic oligonucleotide
  Target: FXN; (+) strand; PAM type: NRG; PAM sequence: CAG
ttagatctcctctaggaaag

SEQ ID NO: 16390 - DNA, 20 bp, Artificial Sequence
  Description of Artificial Sequence: Synthetic oligonucleotide
  Target: FXN; (+) strand; PAM type: NRG; PAM sequence: TGG
gaaagcagacatttattact

SEQ ID NO: 16391 - DNA, 20 bp, Artificial Sequence
  Description of Artificial Sequence: Synthetic oligonucleotide
  Target: FXN; (+) strand; PAM type: NRG; PAM sequence: GAG
ttggcttctgtgcactatct

SEQ ID NO: 16392 - DNA, 20 bp, Artificial Sequence
  Description of Artificial Sequence: Synthetic oligonucleotide
  Target: FXN; (+) strand; PAM type: NRG; PAM sequence: TGG
ctatctgagctgccacgtat

SEQ ID NO: 16393 - DNA, 20 bp, Artificial Sequence
  Description of Artificial Sequence: Synthetic oligonucleotide
  Target: FXN; (+) strand; PAM type: NRG; PAM sequence: GGG
tatctgagctgccacgtatt

SEQ ID NO: 16394 - DNA, 20 bp, Artificial Sequence
  Description of Artificial Sequence: Synthetic oligonucleotide
  Target: FXN; (+) strand; PAM type: NRG; PAM sequence: TGG
ggcttccacccctgcctgtg

SEQ ID NO: 16395 - DNA, 20 bp, Artificial Sequence
  Description of Artificial Sequence: Synthetic oligonucleotide
  Target: FXN; (+) strand; PAM type: NRG; PAM sequence: CAG
tccacccctgcctgtgtgga

SEQ ID NO: 16396 - DNA, 20 bp, Artificial Sequence
  Description of Artificial Sequence: Synthetic oligonucleotide
  Target: FXN; (+) strand; PAM type: NRG; PAM sequence: TGG
ccctgcctgtgtggacagca

SEQ ID NO: 16397 - DNA, 20 bp, Artificial Sequence
  Description of Artificial Sequence: Synthetic oligonucleotide
  Target: FXN; (+) strand; PAM type: NRG; PAM sequence: GGG
cctgcctgtgtggacagcat

SEQ ID NO: 16398 - DNA, 20 bp, Artificial Sequence
  Description of Artificial Sequence: Synthetic oligonucleotide
  Target: FXN; (+) strand; PAM type: NRG; PAM sequence: CAG
gtgtggacagcatgggttgt

SEQ ID NO: 16399 - DNA, 20 bp, Artificial Sequence
  Description of Artificial Sequence: Synthetic oligonucleotide
  Target: FXN; (+) strand; PAM type: NRG; PAM sequence: CAG
tggacagcatgggttgtcag

SEQ ID NO: 16400 - DNA, 20 bp, Artificial Sequence
  Description of Artificial Sequence: Synthetic oligonucleotide
  Target: FXN; (+) strand; PAM type: NRG; PAM sequence: GAG
gacagcatgggttgtcagca

SEQ ID NO: 16401 - DNA, 20 bp, Artificial Sequence
  Description of Artificial Sequence: Synthetic oligonucleotide
  Target: FXN; (+) strand; PAM type: NRG; PAM sequence: GAG
gtgttttgttttgttttttt

SEQ ID NO: 16402 - DNA, 20 bp, Artificial Sequence
  Description of Artificial Sequence: Synthetic oligonucleotide
  Target: FXN; (+) strand; PAM type: NRG; PAM sequence: CAG
tttgttttgtttttttgaga

SEQ ID NO: 16403 - DNA, 20 bp, Artificial Sequence
  Description of Artificial Sequence: Synthetic oligonucleotide
  Target: FXN; (+) strand; PAM type: NRG; PAM sequence: GAG
tgttttgtttttttgagaca

SEQ ID NO: 16404 - DNA, 20 bp, Artificial Sequence
  Description of Artificial Sequence: Synthetic oligonucleotide
  Target: FXN; (+) strand; PAM type: NRG; PAM sequence: CAG
agagtttccctcttgttgcc

SEQ ID NO: 16405 - DNA, 20 bp, Artificial Sequence
  Description of Artificial Sequence: Synthetic oligonucleotide
  Target: FXN; (+) strand; PAM type: NRG; PAM sequence: AGG
gagtttccctcttgttgccc

SEQ ID NO: 16406 - DNA, 20 bp, Artificial Sequence
  Description of Artificial Sequence: Synthetic oligonucleotide
  Target: FXN; (+) strand; PAM type: NRG; PAM sequence: TGG
ttccctcttgttgcccaggc

SEQ ID NO: 16407 - DNA, 20 bp, Artificial Sequence
  Description of Artificial Sequence: Synthetic oligonucleotide
  Target: FXN; (+) strand; PAM type: NRG; PAM sequence: GAG
ccctcttgttgcccaggctg

SEQ ID NO: 16408 - DNA, 20 bp, Artificial Sequence
  Description of Artificial Sequence: Synthetic oligonucleotide
  Target: FXN; (+) strand; PAM type: NRG; PAM sequence: CAG
ttgttgcccaggctggagtg

SEQ ID NO: 16409 - DNA, 20 bp, Artificial Sequence
  Description of Artificial Sequence: Synthetic oligonucleotide
  Target: FXN; (+) strand; PAM type: NRG; PAM sequence: TGG
ttgcccaggctggagtgcag

SEQ ID NO: 16410 - DNA, 20 bp, Artificial Sequence
  Description of Artificial Sequence: Synthetic oligonucleotide
  Target: FXN; (+) strand; PAM type: NRG; PAM sequence: CAG
caggctggagtgcagtggct

SEQ ID NO: 16411 - DNA, 20 bp, Artificial Sequence
  Description of Artificial Sequence: Synthetic oligonucleotide
  Target: FXN; (+) strand; PAM type: NRG; PAM sequence: CAG
ggagtgcagtggctcagtct

SEQ ID NO: 16412 - DNA, 20 bp, Artificial Sequence
  Description of Artificial Sequence: Synthetic oligonucleotide
  Target: FXN; (+) strand; PAM type: NRG; PAM sequence: TGG
tcactgcaacctctgcctcc

SEQ ID NO: 16413 - DNA, 20 bp, Artificial Sequence
  Description of Artificial Sequence: Synthetic oligonucleotide
  Target: FXN; (+) strand; PAM type: NRG; PAM sequence: GGG
cactgcaacctctgcctcct

SEQ ID NO: 16414 - DNA, 20 bp, Artificial Sequence
  Description of Artificial Sequence: Synthetic oligonucleotide
  Target: FXN; (+) strand; PAM type: NRG; PAM sequence: AAG
aacctctgcctcctgggttc

SEQ ID NO: 16415 - DNA, 20 bp, Artificial Sequence
  Description of Artificial Sequence: Synthetic oligonucleotide
  Target: FXN; (+) strand; PAM type: NRG; PAM sequence: CAG
ttcaagtgattctcctgcct

SEQ ID NO: 16416 - DNA, 20 bp, Artificial Sequence
  Description of Artificial Sequence: Synthetic oligonucleotide
  Target: FXN; (+) strand; PAM type: NRG; PAM sequence: GAG
ttctcctgcctcagcctccc

SEQ ID NO: 16417 - DNA, 20 bp, Artificial Sequence
  Description of Artificial Sequence: Synthetic oligonucleotide
  Target: FXN; (+) strand; PAM type: NRG; PAM sequence: TAG
tcctgcctcagcctcccgag

SEQ ID NO: 16418 - DNA, 20 bp, Artificial Sequence
  Description of Artificial Sequence: Synthetic oligonucleotide
  Target: FXN; (+) strand; PAM type: NRG; PAM sequence: TGG
gcctcagcctcccgagtagc

SEQ ID NO: 16419 - DNA, 20 bp, Artificial Sequence
  Description of Artificial Sequence: Synthetic oligonucleotide
  Target: FXN; (+) strand; PAM type: NRG; PAM sequence: GGG
cctcagcctcccgagtagct

SEQ ID NO: 16420 - DNA, 20 bp, Artificial Sequence
  Description of Artificial Sequence: Synthetic oligonucleotide
  Target: FXN; (+) strand; PAM type: NRG; PAM sequence: CGG
tcccgagtagctgggattat

SEQ ID NO: 16421 - DNA, 20 bp, Artificial Sequence
  Description of Artificial Sequence: Synthetic oligonucleotide
  Target: FXN; (+) strand; PAM type: NRG; PAM sequence: TAG
atcggctaattttgtatttt

SEQ ID NO: 16422 - DNA, 20 bp, Artificial Sequence
  Description of Artificial Sequence: Synthetic oligonucleotide
  Target: FXN; (+) strand; PAM type: NRG; PAM sequence: TAG
ggctaattttgtatttttag

SEQ ID NO: 16423 - DNA, 20 bp, Artificial Sequence
  Description of Artificial Sequence: Synthetic oligonucleotide
  Target: FXN; (+) strand; PAM type: NRG; PAM sequence: GAG
ctaattttgtatttttagta

SEQ ID NO: 16424 - DNA, 20 bp, Artificial Sequence
  Description of Artificial Sequence: Synthetic oligonucleotide
  Target: FXN; (+) strand; PAM type: NRG; PAM sequence: CAG
ttttgtatttttagtagaga

SEQ ID NO: 16425 - DNA, 20 bp, Artificial Sequence
  Description of Artificial Sequence: Synthetic oligonucleotide
  Target: FXN; (+) strand; PAM type: NRG; PAM sequence: TGG
agagacagatttctccatgt

SEQ ID NO: 16426 - DNA, 20 bp, Artificial Sequence
  Description of Artificial Sequence: Synthetic oligonucleotide
  Target: FXN; (+) strand; PAM type: NRG; PAM sequence: CAG
acagatttctccatgttggt

SEQ ID NO: 16427 - DNA, 20 bp, Artificial Sequence
  Description of Artificial Sequence: Synthetic oligonucleotide
  Target: FXN; (+) strand; PAM type: NRG; PAM sequence: AGG
cagatttctccatgttggtc

SEQ ID NO: 16428 - DNA, 20 bp, Artificial Sequence
  Description of Artificial Sequence: Synthetic oligonucleotide
  Target: FXN; (+) strand; PAM type: NRG; PAM sequence: TGG
tttctccatgttggtcaggc

SEQ ID NO: 16429 - DNA, 20 bp, Artificial Sequence
  Description of Artificial Sequence: Synthetic oligonucleotide
  Target: FXN; (+) strand; PAM type: NRG; PAM sequence: CAG
tggtctcgaactcccaacct

SEQ ID NO: 16430 - DNA, 20 bp, Artificial Sequence
  Description of Artificial Sequence: Synthetic oligonucleotide
  Target: FXN; (+) strand; PAM type: NRG; PAM sequence: AGG
ggtctcgaactcccaacctc

SEQ ID NO: 16431 - DNA, 20 bp, Artificial Sequence
  Description of Artificial Sequence: Synthetic oligonucleotide
  Target: FXN; (+) strand; PAM type: NRG; PAM sequence: AAG
ccgcccacctcgccctccca

SEQ ID NO: 16432 - DNA, 20 bp, Artificial Sequence
  Description of Artificial Sequence: Synthetic oligonucleotide
  Target: FXN; (+) strand; PAM type: NRG; PAM sequence: TGG
acctcgccctcccaaagtgc

SEQ ID NO: 16433 - DNA, 20 bp, Artificial Sequence
  Description of Artificial Sequence: Synthetic oligonucleotide
  Target: FXN; (+) strand; PAM type: NRG; PAM sequence: CAG
ctcccaaagtgctggaatta

SEQ ID NO: 16434 - DNA, 20 bp, Artificial Sequence
  Description of Artificial Sequence: Synthetic oligonucleotide
  Target: FXN; (+) strand; PAM type: NRG; PAM sequence: AGG
tcccaaagtgctggaattac

SEQ ID NO: 16435 - DNA, 20 bp, Artificial Sequence
  Description of Artificial Sequence: Synthetic oligonucleotide
  Target: FXN; (+) strand; PAM type: NRG; PAM sequence: GAG
agtgctggaattacaggcgt

SEQ ID NO: 16436 - DNA, 20 bp, Artificial Sequence
  Description of Artificial Sequence: Synthetic oligonucleotide
  Target: FXN; (+) strand; PAM type: NRG; PAM sequence: TGG
caggcgtgagccaccgcgtc

SEQ ID NO: 16437 - DNA, 20 bp, Artificial Sequence
  Description of Artificial Sequence: Synthetic oligonucleotide
  Target: FXN; (+) strand; PAM type: NRG; PAM sequence: CAG
gagccaccgcgtctggccat

SEQ ID NO: 16438 - DNA, 20 bp, Artificial Sequence
  Description of Artificial Sequence: Synthetic oligonucleotide
  Target: FXN; (+) strand; PAM type: NRG; PAM sequence: CAG
ccaccgcgtctggccatcag

SEQ ID NO: 16439 - DNA, 20 bp, Artificial Sequence
  Description of Artificial Sequence: Synthetic oligonucleotide
  Target: FXN; (+) strand; PAM type: NRG; PAM sequence: GAG
accgcgtctggccatcagca

SEQ ID NO: 16440 - DNA, 20 bp, Artificial Sequence
  Description of Artificial Sequence: Synthetic oligonucleotide
  Target: FXN; (+) strand; PAM type: NRG; PAM sequence: TAG
catcagcagagtttttaatt

SEQ ID NO: 16441 - DNA, 20 bp, Artificial Sequence
  Description of Artificial Sequence: Synthetic oligonucleotide
  Target: FXN; (+) strand; PAM type: NRG; PAM sequence: AGG
atcagcagagtttttaattt

SEQ ID NO: 16442 - DNA, 20 bp, Artificial Sequence
  Description of Artificial Sequence: Synthetic oligonucleotide
  Target: FXN; (+) strand; PAM type: NRG; PAM sequence: GAG
cagcagagtttttaatttag

SEQ ID NO: 16443 - DNA, 20 bp, Artificial Sequence
  Description of Artificial Sequence: Synthetic oligonucleotide
  Target: FXN; (+) strand; PAM type: NRG; PAM sequence: AAG
ttttaatttaggagaatgac

SEQ ID NO: 16444 - DNA, 20 bp, Artificial Sequence
  Description of Artificial Sequence: Synthetic oligonucleotide
  Target: FXN; (+) strand; PAM type: NRG; PAM sequence: GAG
ttaatttaggagaatgacaa

SEQ ID NO: 16445 - DNA, 20 bp, Artificial Sequence
  Description of Artificial Sequence: Synthetic oligonucleotide
  Target: FXN; (+) strand; PAM type: NRG; PAM sequence: AGG
taatttaggagaatgacaag

SEQ ID NO: 16446 - DNA, 20 bp, Artificial Sequence
  Description of Artificial Sequence: Synthetic oligonucleotide
  Target: FXN; (+) strand; PAM type: NRG; PAM sequence: TGG
tttaggagaatgacaagagg

SEQ ID NO: 16447 - DNA, 20 bp, Artificial Sequence
  Description of Artificial Sequence: Synthetic oligonucleotide
  Target: FXN; (+) strand; PAM type: NRG; PAM sequence: CAG
gagaatgacaagaggtggta

SEQ ID NO: 16448 - DNA, 20 bp, Artificial Sequence
  Description of Artificial Sequence: Synthetic oligonucleotide
  Target: FXN; (+) strand; PAM type: NRG; PAM sequence: TAG
caagaggtggtacagttttt

SEQ ID NO: 16449 - DNA, 20 bp, Artificial Sequence
  Description of Artificial Sequence: Synthetic oligonucleotide
  Target: FXN; (+) strand; PAM type: NRG; PAM sequence: TGG
aggtggtacagttttttaga

SEQ ID NO: 16450 - DNA, 20 bp, Artificial Sequence
  Description of Artificial Sequence: Synthetic oligonucleotide
  Target: FXN; (+) strand; PAM type: NRG; PAM sequence: TGG
acagttttttagatggtacc

SEQ ID NO: 16451 - DNA, 20 bp, Artificial Sequence
  Description of Artificial Sequence: Synthetic oligonucleotide
  Target: FXN; (+) strand; PAM type: NRG; PAM sequence: TGG
gttttttagatggtacctgg

SEQ ID NO: 16452 - DNA, 20 bp, Artificial Sequence
  Description of Artificial Sequence: Synthetic oligonucleotide
  Target: FXN; (+) strand; PAM type: NRG; PAM sequence: AAG
gatggtacctggtggctgtt

SEQ ID NO: 16453 - DNA, 20 bp, Artificial Sequence
  Description of Artificial Sequence: Synthetic oligonucleotide
  Target: FXN; (+) strand; PAM type: NRG; PAM sequence: AGG
atggtacctggtggctgtta

SEQ ID NO: 16454 - DNA, 20 bp, Artificial Sequence
  Description of Artificial Sequence: Synthetic oligonucleotide
  Target: FXN; (+) strand; PAM type: NRG; PAM sequence: GGG
tggtacctggtggctgttaa

SEQ ID NO: 16455 - DNA, 20 bp, Artificial Sequence
  Description of Artificial Sequence: Synthetic oligonucleotide
  Target: FXN; (+) strand; PAM type: NRG; PAM sequence: TGG
actgacaaacacacccaact

SEQ ID NO: 16456 - DNA, 20 bp, Artificial Sequence
  Description of Artificial Sequence: Synthetic oligonucleotide
  Target: FXN; (+) strand; PAM type: NRG; PAM sequence: CAG
cccaacttggcgctgccgcc

SEQ ID NO: 16457 - DNA, 20 bp, Artificial Sequence
  Description of Artificial Sequence: Synthetic oligonucleotide
  Target: FXN; (+) strand; PAM type: NRG; PAM sequence: AGG
ccaacttggcgctgccgccc

SEQ ID NO: 16458 - DNA, 20 bp, Artificial Sequence
  Description of Artificial Sequence: Synthetic oligonucleotide
  Target: FXN; (+) strand; PAM type: NRG; PAM sequence: GAG
aacttggcgctgccgcccag

SEQ ID NO: 16459 - DNA, 20 bp, Artificial Sequence
  Description of Artificial Sequence: Synthetic oligonucleotide
  Target: FXN; (+) strand; PAM type: NRG; PAM sequence: AGG
acttggcgctgccgcccagg

SEQ ID NO: 16460 - DNA, 20 bp, Artificial Sequence
  Description of Artificial Sequence: Synthetic oligonucleotide
  Target: FXN; (+) strand; PAM type: NRG; PAM sequence: TGG
tggcgctgccgcccaggagg

SEQ ID NO: 16461 - DNA, 20 bp, Artificial Sequence
  Description of Artificial Sequence: Synthetic oligonucleotide
  Target: FXN; (+) strand; PAM type: NRG; PAM sequence: TGG
gccgcccaggaggtggacac

SEQ ID NO: 16462 - DNA, 20 bp, Artificial Sequence
  Description of Artificial Sequence: Synthetic oligonucleotide
  Target: FXN; (+) strand; PAM type: NRG; PAM sequence: GGG
ccgcccaggaggtggacact

SEQ ID NO: 16463 - DNA, 20 bp, Artificial Sequence
  Description of Artificial Sequence: Synthetic oligonucleotide
  Target: FXN; (+) strand; PAM type: NRG; PAM sequence: TGG
ggaggtggacactgggtttc

SEQ ID NO: 16464 - DNA, 20 bp, Artificial Sequence
  Description of Artificial Sequence: Synthetic oligonucleotide
  Target: FXN; (+) strand; PAM type: NRG; PAM sequence: TAG
gtggacactgggtttctgga

SEQ ID NO: 16465 - DNA, 20 bp, Artificial Sequence
  Description of Artificial Sequence: Synthetic oligonucleotide
  Target: FXN; (+) strand; PAM type: NRG; PAM sequence: TGG
acactgggtttctggataga

SEQ ID NO: 16466 - DNA, 20 bp, Artificial Sequence
  Description of Artificial Sequence: Synthetic oligonucleotide
  Target: FXN; (+) strand; PAM type: NRG; PAM sequence: TAG
tgggtttctggatagatggt

SEQ ID NO: 16467 - DNA, 20 bp, Artificial Sequence
  Description of Artificial Sequence: Synthetic oligonucleotide
  Target: FXN; (+) strand; PAM type: NRG; PAM sequence: CAG
tggttagcaacctctgtcac

SEQ ID NO: 16468 - DNA, 20 bp, Artificial Sequence
  Description of Artificial Sequence: Synthetic oligonucleotide
  Target: FXN; (+) strand; PAM type: NRG; PAM sequence: TGG
tagcaacctctgtcaccagc

SEQ ID NO: 16469 - DNA, 20 bp, Artificial Sequence
  Description of Artificial Sequence: Synthetic oligonucleotide
  Target: FXN; (+) strand; PAM type: NRG; PAM sequence: GGG
agcaacctctgtcaccagct

SEQ ID NO: 16470 - DNA, 20 bp, Artificial Sequence
  Description of Artificial Sequence: Synthetic oligonucleotide
  Target: FXN; (+) strand; PAM type: NRG; PAM sequence: TAG
tgtttaacctgtctgttcca

SEQ ID NO: 16471 - DNA, 20 bp, Artificial Sequence
  Description of Artificial Sequence: Synthetic oligonucleotide
  Target: FXN; (+) strand; PAM type: NRG; PAM sequence: TGG
catagttcccttgcacatct

SEQ ID NO: 16472 - DNA, 20 bp, Artificial Sequence
  Description of Artificial Sequence: Synthetic oligonucleotide
  Target: FXN; (+) strand; PAM type: NRG; PAM sequence: GGG
atagttcccttgcacatctt

SEQ ID NO: 16473 - DNA, 20 bp, Artificial Sequence
  Description of Artificial Sequence: Synthetic oligonucleotide
  Target: FXN; (+) strand; PAM type: NRG; PAM sequence: GAG
cttgcacatcttgggtattt

SEQ ID NO: 16474 - DNA, 20 bp, Artificial Sequence
  Description of Artificial Sequence: Synthetic oligonucleotide
  Target: FXN; (+) strand; PAM type: NRG; PAM sequence: AGG
ttgcacatcttgggtatttg

SEQ ID NO: 16475 - DNA, 20 bp, Artificial Sequence
  Description of Artificial Sequence: Synthetic oligonucleotide
  Target: FXN; (+) strand; PAM type: NRG; PAM sequence: GAG
gcacatcttgggtatttgag

SEQ ID NO: 16476 - DNA, 20 bp, Artificial Sequence
  Description of Artificial Sequence: Synthetic oligonucleotide
  Target: FXN; (+) strand; PAM type: NRG; PAM sequence: TGG
atcttgggtatttgaggagt

SEQ ID NO: 16477 - DNA, 20 bp, Artificial Sequence
  Description of Artificial Sequence: Synthetic oligonucleotide
  Target: FXN; (+) strand; PAM type: NRG; PAM sequence: GGG
tcttgggtatttgaggagtt

SEQ ID NO: 16478 - DNA, 20 bp, Artificial Sequence
  Description of Artificial Sequence: Synthetic oligonucleotide
  Target: FXN; (+) strand; PAM type: NRG; PAM sequence: TGG
tgggtatttgaggagttggg

SEQ ID NO: 16479 - DNA, 20 bp, Artificial Sequence
  Description of Artificial Sequence: Synthetic oligonucleotide
  Target: FXN; (+) strand; PAM type: NRG; PAM sequence: GGG
gggtatttgaggagttgggt

SEQ ID NO: 16480 - DNA, 20 bp, Artificial Sequence
  Description of Artificial Sequence: Synthetic oligonucleotide
  Target: FXN; (+) strand; PAM type: NRG; PAM sequence: TGG
tatttgaggagttgggtggg

SEQ ID NO: 16481 - DNA, 20 bp, Artificial Sequence
  Description of Artificial Sequence: Synthetic oligonucleotide
  Target: FXN; (+) strand; PAM type: NRG; PAM sequence: CAG
ttgaggagttgggtgggtgg

SEQ ID NO: 16482 - DNA, 20 bp, Artificial Sequence
  Description of Artificial Sequence: Synthetic oligonucleotide
  Target: FXN; (+) strand; PAM type: NRG; PAM sequence: TGG
aggagttgggtgggtggcag

SEQ ID NO: 16483 - DNA, 20 bp, Artificial Sequence
  Description of Artificial Sequence: Synthetic oligonucleotide
  Target: FXN; (+) strand; PAM type: NRG; PAM sequence: TGG
gggtgggtggcagtggcaac

SEQ ID NO: 16484 - DNA, 20 bp, Artificial Sequence
  Description of Artificial Sequence: Synthetic oligonucleotide
  Target: FXN; (+) strand; PAM type: NRG; PAM sequence: GGG
ggtgggtggcagtggcaact

SEQ ID NO: 16485 - DNA, 20 bp, Artificial Sequence
  Description of Artificial Sequence: Synthetic oligonucleotide
  Target: FXN; (+) strand; PAM type: NRG; PAM sequence: GGG
gtgggtggcagtggcaactg

SEQ ID NO: 16486 - DNA, 20 bp, Artificial Sequence
  Description of Artificial Sequence: Synthetic oligonucleotide
  Target: FXN; (+) strand; PAM type: NRG; PAM sequence: AAG
catcctgtttaattatttta

SEQ ID NO: 16487 - DNA, 20 bp, Artificial Sequence
  Description of Artificial Sequence: Synthetic oligonucleotide
  Target: FXN; (+) strand; PAM type: NRG; PAM sequence: TGG
ttttaaagccctgactgtcc

SEQ ID NO: 16488 - DNA, 20 bp, Artificial Sequence
  Description of Artificial Sequence: Synthetic oligonucleotide
  Target: FXN; (+) strand; PAM type: NRG; PAM sequence: AAG
gactgtcctggattgaccct

SEQ ID NO: 16489 - DNA, 20 bp, Artificial Sequence
  Description of Artificial Sequence: Synthetic oligonucleotide
  Target: FXN; (+) strand; PAM type: NRG; PAM sequence: TGG
gattgaccctaagctccccc

SEQ ID NO: 16490 - DNA, 20 bp, Artificial Sequence
  Description of Artificial Sequence: Synthetic oligonucleotide
  Target: FXN; (+) strand; PAM type: NRG; PAM sequence: CAG
ccctggtctccaaaattcat

SEQ ID NO: 16491 - DNA, 20 bp, Artificial Sequence
  Description of Artificial Sequence: Synthetic oligonucleotide
  Target: FXN; (+) strand; PAM type: NRG; PAM sequence: GAG
tccaaaattcatcagaaact

SEQ ID NO: 16492 - DNA, 20 bp, Artificial Sequence
  Description of Artificial Sequence: Synthetic oligonucleotide
  Target: FXN; (+) strand; PAM type: NRG; PAM sequence: AAG
tcagaaactgagttcacttg

SEQ ID NO: 16493 - DNA, 20 bp, Artificial Sequence
  Description of Artificial Sequence: Synthetic oligonucleotide
  Target: FXN; (+) strand; PAM type: NRG; PAM sequence: AGG
cagaaactgagttcacttga

SEQ ID NO: 16494 - DNA, 20 bp, Artificial Sequence
  Description of Artificial Sequence: Synthetic oligonucleotide
  Target: FXN; (+) strand; PAM type: NRG; PAM sequence: AAG
accccttgcatctacttcta

SEQ ID NO: 16495 - DNA, 20 bp, Artificial Sequence
  Description of Artificial Sequence: Synthetic oligonucleotide
  Target: FXN; (+) strand; PAM type: NRG; PAM sequence: CAG
ccttgcatctacttctaaag

SEQ ID NO: 16496 - DNA, 20 bp, Artificial Sequence
  Description of Artificial Sequence: Synthetic oligonucleotide
  Target: FXN; (+) strand; PAM type: NRG; PAM sequence: CAG
cttctaaagcagctgttcaa

SEQ ID NO: 16497 - DNA, 20 bp, Artificial Sequence
  Description of Artificial Sequence: Synthetic oligonucleotide
  Target: FXN; (+) strand; PAM type: NRG; PAM sequence: CAG
aagcagctgttcaacagaaa

SEQ ID NO: 16498 - DNA, 20 bp, Artificial Sequence
  Description of Artificial Sequence: Synthetic oligonucleotide
  Target: FXN; (+) strand; PAM type: NRG; PAM sequence: TGG
gctgttcaacagaaacagaa

SEQ ID NO: 16499 - DNA, 20 bp, Artificial Sequence
  Description of Artificial Sequence: Synthetic oligonucleotide
  Target: FXN; (+) strand; PAM type: NRG; PAM sequence: GGG
ctgttcaacagaaacagaat

SEQ ID NO: 16500 - DNA, 20 bp, Artificial Sequence
  Description of Artificial Sequence: Synthetic oligonucleotide
  Target: FXN; (+) strand; PAM type: NRG; PAM sequence: GAG
gttcaacagaaacagaatgg

SEQ ID NO: 16501 - DNA, 20 bp, Artificial Sequence
  Description of Artificial Sequence: Synthetic oligonucleotide
  Target: FXN; (+) strand; PAM type: NRG; PAM sequence: TAG
acacataattctacattttc

SEQ ID NO: 16502 - DNA, 20 bp, Artificial Sequence
  Description of Artificial Sequence: Synthetic oligonucleotide
  Target: FXN; (+) strand; PAM type: NRG; PAM sequence: AAG
ttctacattttctagttaaa

SEQ ID NO: 16503 - DNA, 20 bp, Artificial Sequence
  Description of Artificial Sequence: Synthetic oligonucleotide
  Target: FXN; (+) strand; PAM type: NRG; PAM sequence: TAG
aacaatatatttattcaacc

SEQ ID NO: 16504 - DNA, 20 bp, Artificial Sequence
  Description of Artificial Sequence: Synthetic oligonucleotide
  Target: FXN; (+) strand; PAM type: NRG; PAM sequence: CAG
ttatcattccaacatgtaat

SEQ ID NO: 16505 - DNA, 20 bp, Artificial Sequence
  Description of Artificial Sequence: Synthetic oligonucleotide
  Target: FXN; (+) strand; PAM type: NRG; PAM sequence: CAG
gtaatcagtattttaaaaat

SEQ ID NO: 16506 - DNA, 20 bp, Artificial Sequence
  Description of Artificial Sequence: Synthetic oligonucleotide
  Target: FXN; (+) strand; PAM type: NRG; PAM sequence: GAG
gtattttaaaaatcagtaat

SEQ ID NO: 16507 - DNA, 20 bp, Artificial Sequence
  Description of Artificial Sequence: Synthetic oligonucleotide
  Target: FXN; (+) strand; PAM type: NRG; PAM sequence: CAG
ttaaaaatcagtaatgagac

SEQ ID NO: 16508 - DNA, 20 bp, Artificial Sequence
  Description of Artificial Sequence: Synthetic oligonucleotide
  Target: FXN; (+) strand; PAM type: NRG; PAM sequence: AGG
taaaaatcagtaatgagacc

SEQ ID NO: 16509 - DNA, 20 bp, Artificial Sequence
  Description of Artificial Sequence: Synthetic oligonucleotide
  Target: FXN; (+) strand; PAM type: NRG; PAM sequence: CGG
atcagtaatgagaccaggca

SEQ ID NO: 16510 - DNA, 20 bp, Artificial Sequence
  Description of Artificial Sequence: Synthetic oligonucleotide
  Target: FXN; (+) strand; PAM type: NRG; PAM sequence: TGG
agtaatgagaccaggcacgg

SEQ ID NO: 16511 - DNA, 20 bp, Artificial Sequence
  Description of Artificial Sequence: Synthetic oligonucleotide
  Target: FXN; (+) strand; PAM type: NRG; PAM sequence: CAG
gtggctcacgactgtaatcc

SEQ ID NO: 16512 - DNA, 20 bp, Artificial Sequence
  Description of Artificial Sequence: Synthetic oligonucleotide
  Target: FXN; (+) strand; PAM type: NRG; PAM sequence: AGG
tggctcacgactgtaatccc

SEQ ID NO: 16513 - DNA, 20 bp, Artificial Sequence
  Description of Artificial Sequence: Synthetic oligonucleotide
  Target: FXN; (+) strand; PAM type: NRG; PAM sequence: TGG
cgactgtaatcccaggactt

SEQ ID NO: 16514 - DNA, 20 bp, Artificial Sequence
  Description of Artificial Sequence: Synthetic oligonucleotide
  Target: FXN; (+) strand; PAM type: NRG; PAM sequence: GGG
gactgtaatcccaggacttt

SEQ ID NO: 16515 - DNA, 20 bp, Artificial Sequence
  Description of Artificial Sequence: Synthetic oligonucleotide
  Target: FXN; (+) strand; PAM type: NRG; PAM sequence: GAG
ctgtaatcccaggactttgg

SEQ ID NO: 16516 - DNA, 20 bp, Artificial Sequence
  Description of Artificial Sequence: Synthetic oligonucleotide
  Target: FXN; (+) strand; PAM type: NRG; PAM sequence: AGG
tgtaatcccaggactttggg

SEQ ID NO: 16517 - DNA, 20 bp, Artificial Sequence
  Description of Artificial Sequence: Synthetic oligonucleotide
  Target: FXN; (+) strand; PAM type: NRG; PAM sequence: GAG
tcccaggactttgggaggcc

SEQ ID NO: 16518 - DNA, 20 bp, Artificial Sequence
  Description of Artificial Sequence: Synthetic oligonucleotide
  Target: FXN; (+) strand; PAM type: NRG; PAM sequence: AGG
cccaggactttgggaggccg

SEQ ID NO: 16519 - DNA, 20 bp, Artificial Sequence
  Description of Artificial Sequence: Synthetic oligonucleotide
  Target: FXN; (+) strand; PAM type: NRG; PAM sequence: GAG
ggactttgggaggccgaggc

SEQ ID NO: 16520 - DNA, 20 bp, Artificial Sequence
  Description of Artificial Sequence: Synthetic oligonucleotide
  Target: FXN; (+) strand; PAM type: NRG; PAM sequence: TGG
ctttgggaggccgaggcgag

SEQ ID NO: 16521 - DNA, 20 bp, Artificial Sequence
  Description of Artificial Sequence: Synthetic oligonucleotide
  Target: FXN; (+) strand; PAM type: NRG; PAM sequence: GAG
ccgaggcgagtggatcatct

SEQ ID NO: 16522 - DNA, 20 bp, Artificial Sequence
  Description of Artificial Sequence: Synthetic oligonucleotide
  Target: FXN; (+) strand; PAM type: NRG; PAM sequence: CAG
gcgagtggatcatctgagat

SEQ ID NO: 16523 - DNA, 20 bp, Artificial Sequence
  Description of Artificial Sequence: Synthetic oligonucleotide
  Target: FXN; (+) strand; PAM type: NRG; PAM sequence: AGG
cgagtggatcatctgagatc

SEQ ID NO: 16524 - DNA, 20 bp, Artificial Sequence
  Description of Artificial Sequence: Synthetic oligonucleotide
  Target: FXN; (+) strand; PAM type: NRG; PAM sequence: GAG
agtggatcatctgagatcag

SEQ ID NO: 16525 - DNA, 20 bp, Artificial Sequence
  Description of Artificial Sequence: Synthetic oligonucleotide
  Target: FXN; (+) strand; PAM type: NRG; PAM sequence: AAG
tcatctgagatcaggagttc

SEQ ID NO: 16526 - DNA, 20 bp, Artificial Sequence
  Description of Artificial Sequence: Synthetic oligonucleotide
  Target: FXN; (+) strand; PAM type: NRG; PAM sequence: CAG
tgagatcaggagttcaagac

SEQ ID NO: 16527 - DNA, 20 bp, Artificial Sequence
  Description of Artificial Sequence: Synthetic oligonucleotide
  Target: FXN; (+) strand; PAM type: NRG; PAM sequence: TGG
tcaggagttcaagaccagcc

SEQ ID NO: 16528 - DNA, 20 bp, Artificial Sequence
  Description of Artificial Sequence: Synthetic oligonucleotide
  Target: FXN; (+) strand; PAM type: NRG; PAM sequence: TGG
caagaccagcctggccaaca

SEQ ID NO: 16529 - DNA, 20 bp, Artificial Sequence
  Description of Artificial Sequence: Synthetic oligonucleotide
  Target: FXN; (+) strand; PAM type: NRG; PAM sequence: TAG
accccatctctactaaaaac

SEQ ID NO: 16530 - DNA, 20 bp, Artificial Sequence
  Description of Artificial Sequence: Synthetic oligonucleotide
  Target: FXN; (+) strand; PAM type: NRG; PAM sequence: CAG
atctctactaaaaactagct

SEQ ID NO: 16531 - DNA, 20 bp, Artificial Sequence
  Description of Artificial Sequence: Synthetic oligonucleotide
  Target: FXN; (+) strand; PAM type: NRG; PAM sequence: TGG
tactaaaaactagctcagca

SEQ ID NO: 16532 - DNA, 20 bp, Artificial Sequence
  Description of Artificial Sequence: Synthetic oligonucleotide
  Target: FXN; (+) strand; PAM type: NRG; PAM sequence: TGG
taaaaactagctcagcatgg

SEQ ID NO: 16533 - DNA, 20 bp, Artificial Sequence
  Description of Artificial Sequence: Synthetic oligonucleotide
  Target: FXN; (+) strand; PAM type: NRG; PAM sequence: TGG
aaactagctcagcatggtgg

SEQ ID NO: 16534 - DNA, 20 bp, Artificial Sequence
  Description of Artificial Sequence: Synthetic oligonucleotide
  Target: FXN; (+) strand; PAM type: NRG; PAM sequence: GGG
aactagctcagcatggtggt

SEQ ID NO: 16535 - DNA, 20 bp, Artificial Sequence
  Description of Artificial Sequence: Synthetic oligonucleotide
  Target: FXN; (+) strand; PAM type: NRG; PAM sequence: TAG
agcatggtggtgggtgcctg

SEQ ID NO: 16536 - DNA, 20 bp, Artificial Sequence
  Description of Artificial Sequence: Synthetic oligonucleotide
  Target: FXN; (+) strand; PAM type: NRG; PAM sequence: CAG
gtggtgggtgcctgtagtcc

SEQ ID NO: 16537 - DNA, 20 bp, Artificial Sequence
  Description of Artificial Sequence: Synthetic oligonucleotide
  Target: FXN; (+) strand; PAM type: NRG; PAM sequence: CGG
tgcctgtagtcccagctact

SEQ ID NO: 16538 - DNA, 20 bp, Artificial Sequence
  Description of Artificial Sequence: Synthetic oligonucleotide
  Target: FXN; (+) strand; PAM type: NRG; PAM sequence: GGG
gcctgtagtcccagctactc

SEQ ID NO: 16539 - DNA, 20 bp, Artificial Sequence
  Description of Artificial Sequence: Synthetic oligonucleotide
  Target: FXN; (+) strand; PAM type: NRG; PAM sequence: GAG
ctgtagtcccagctactcgg

SEQ ID NO: 16540 - DNA, 20 bp, Artificial Sequence
  Description of Artificial Sequence: Synthetic oligonucleotide
  Target: FXN; (+) strand; PAM type: NRG; PAM sequence: AGG
tgtagtcccagctactcggg

SEQ ID NO: 16541 - DNA, 20 bp, Artificial Sequence
  Description of Artificial Sequence: Synthetic oligonucleotide
  Target: FXN; (+) strand; PAM type: NRG; PAM sequence: GAG
tcccagctactcgggaggct

SEQ ID NO: 16542 - DNA, 20 bp, Artificial Sequence
  Description of Artificial Sequence: Synthetic oligonucleotide
  Target: FXN; (+) strand; PAM type: NRG; PAM sequence: AGG
cccagctactcgggaggctg

SEQ ID NO: 16543 - DNA, 20 bp, Artificial Sequence
  Description of Artificial Sequence: Synthetic oligonucleotide
  Target: FXN; (+) strand; PAM type: NRG; PAM sequence: GAG
tactcgggaggctgaggcat

SEQ ID NO: 16544 - DNA, 20 bp, Artificial Sequence
  Description of Artificial Sequence: Synthetic oligonucleotide
  Target: FXN; (+) strand; PAM type: NRG; PAM sequence: GAG
ctgaggcatgagaatcactt

SEQ ID NO: 16545 - DNA, 20 bp, Artificial Sequence
  Description of Artificial Sequence: Synthetic oligonucleotide
  Target: FXN; (+) strand; PAM type: NRG; PAM sequence: CAG
gcatgagaatcacttgagcc

SEQ ID NO: 16546 - DNA, 20 bp, Artificial Sequence
  Description of Artificial Sequence: Synthetic oligonucleotide
  Target: FXN; (+) strand; PAM type: NRG; PAM sequence: AGG
catgagaatcacttgagccc

SEQ ID NO: 16547 - DNA, 20 bp, Artificial Sequence
  Description of Artificial Sequence: Synthetic oligonucleotide
  Target: FXN; (+) strand; PAM type: NRG; PAM sequence: GAG
tgagaatcacttgagcccag

SEQ ID NO: 16548 - DNA, 20 bp, Artificial Sequence
  Description of Artificial Sequence: Synthetic oligonucleotide
  Target: FXN; (+) strand; PAM type: NRG; PAM sequence: AGG
gagaatcacttgagcccagg

SEQ ID NO: 16549 - DNA, 20 bp, Artificial Sequence
  Description of Artificial Sequence: Synthetic oligonucleotide
  Target: FXN; (+) strand; PAM type: NRG; PAM sequence: CAG
aatcacttgagcccaggagg

SEQ ID NO: 16550 - DNA, 20 bp, Artificial Sequence
  Description of Artificial Sequence: Synthetic oligonucleotide
  Target: FXN; (+) strand; PAM type: NRG; PAM sequence: GAG
tcacttgagcccaggaggca

SEQ ID NO: 16551 - DNA, 20 bp, Artificial Sequence
  Description of Artificial Sequence: Synthetic oligonucleotide
  Target: FXN; (+) strand; PAM type: NRG; PAM sequence: AGG
cacttgagcccaggaggcag

SEQ ID NO: 16552 - DNA, 20 bp, Artificial Sequence
  Description of Artificial Sequence: Synthetic oligonucleotide
  Target: FXN; (+) strand; PAM type: NRG; PAM sequence: CAG
agcccaggaggcagaggttg

SEQ ID NO: 16553 - DNA, 20 bp, Artificial Sequence
  Description of Artificial Sequence: Synthetic oligonucleotide
  Target: FXN; (+) strand; PAM type: NRG; PAM sequence: GAG
caggaggcagaggttgcagt

SEQ ID NO: 16554 - DNA, 20 bp, Artificial Sequence
  Description of Artificial Sequence: Synthetic oligonucleotide
  Target: FXN; (+) strand; PAM type: NRG; PAM sequence: AAG
ggcagaggttgcagtgagcc

SEQ ID NO: 16555 - DNA, 20 bp, Artificial Sequence
  Description of Artificial Sequence: Synthetic oligonucleotide
  Target: FXN; (+) strand; PAM type: NRG; PAM sequence: TGG
gttgcagtgagccaagattt

SEQ ID NO: 16556 - DNA, 20 bp, Artificial Sequence
  Description of Artificial Sequence: Synthetic oligonucleotide
  Target: FXN; (+) strand; PAM type: NRG; PAM sequence: GGG
ttgcagtgagccaagatttt

SEQ ID NO: 16557 - DNA, 20 bp, Artificial Sequence
  Description of Artificial Sequence: Synthetic oligonucleotide
  Target: FXN; (+) strand; PAM type: NRG; PAM sequence: GGG
tgcagtgagccaagattttg

SEQ ID NO: 16558 - DNA, 20 bp, Artificial Sequence
  Description of Artificial Sequence: Synthetic oligonucleotide
  Target: FXN; (+) strand; PAM type: NRG; PAM sequence: GGG
gcagtgagccaagattttgg

SEQ ID NO: 16559 - DNA, 20 bp, Artificial Sequence
  Description of Artificial Sequence: Synthetic oligonucleotide
  Target: FXN; (+) strand; PAM type: NRG; PAM sequence: CAG
ctgtgacatacaaaaaaaat

SEQ ID NO: 16560 - DNA, 20 bp, Artificial Sequence
  Description of Artificial Sequence: Synthetic oligonucleotide
  Target: FXN; (+) strand; PAM type: NRG; PAM sequence: AAG
atacaaaaaaaatcagtaat

SEQ ID NO: 16561 - DNA, 20 bp, Artificial Sequence
  Description of Artificial Sequence: Synthetic oligonucleotide
  Target: FXN; (+) strand; PAM type: NRG; PAM sequence: CAG
ttttcgtactcatatacttc

SEQ ID NO: 16562 - DNA, 20 bp, Artificial Sequence
  Description of Artificial Sequence: Synthetic oligonucleotide
  Target: FXN; (+) strand; PAM type: NRG; PAM sequence: AAG
tatctcaattcacaatttct

SEQ ID NO: 16563 - DNA, 20 bp, Artificial Sequence
  Description of Artificial Sequence: Synthetic oligonucleotide
  Target: FXN; (+) strand; PAM type: NRG; PAM sequence: AAG
aaaattcacaattaaaaatg

SEQ ID NO: 16564 - DNA, 20 bp, Artificial Sequence
  Description of Artificial Sequence: Synthetic oligonucleotide
  Target: FXN; (+) strand; PAM type: NRG; PAM sequence: AGG
aaattcacaattaaaaatga

SEQ ID NO: 16565 - DNA, 20 bp, Artificial Sequence
  Description of Artificial Sequence: Synthetic oligonucleotide
  Target: FXN; (+) strand; PAM type: NRG; PAM sequence: TAG
attaaaaatgaaggttcaca

SEQ ID NO: 16566 - DNA, 20 bp, Artificial Sequence
  Description of Artificial Sequence: Synthetic oligonucleotide
  Target: FXN; (+) strand; PAM type: NRG; PAM sequence: AAG
aaatgaaggttcacatagtc

SEQ ID NO: 16567 - DNA, 20 bp, Artificial Sequence
  Description of Artificial Sequence: Synthetic oligonucleotide
  Target: FXN; (+) strand; PAM type: NRG; PAM sequence: TAG
aaacacacttaaatgtctcc

SEQ ID NO: 16568 - DNA, 20 bp, Artificial Sequence
  Description of Artificial Sequence: Synthetic oligonucleotide
  Target: FXN; (+) strand; PAM type: NRG; PAM sequence: AGG
aacacacttaaatgtctcct

SEQ ID NO: 16569 - DNA, 20 bp, Artificial Sequence
  Description of Artificial Sequence: Synthetic oligonucleotide
  Target: FXN; (+) strand; PAM type: NRG; PAM sequence: TGG
cacttaaatgtctcctaggc

SEQ ID NO: 16570 - DNA, 20 bp, Artificial Sequence
  Description of Artificial Sequence: Synthetic oligonucleotide
  Target: FXN; (+) strand; PAM type: NRG; PAM sequence: GGG
acttaaatgtctcctaggct

SEQ ID NO: 16571 - DNA, 20 bp, Artificial Sequence
  Description of Artificial Sequence: Synthetic oligonucleotide
  Target: FXN; (+) strand; PAM type: NRG; PAM sequence: TGG
aatgtctcctaggctgggtg

SEQ ID NO: 16572 - DNA, 20 bp, Artificial Sequence
  Description of Artificial Sequence: Synthetic oligonucleotide
  Target: FXN; (+) strand; PAM type: NRG; PAM sequence: CAG
gttgctcacacctgtaatcc

SEQ ID NO: 16573 - DNA, 20 bp, Artificial Sequence
  Description of Artificial Sequence: Synthetic oligonucleotide
  Target: FXN; (+) strand; PAM type: NRG; PAM sequence: TGG
cacctgtaatcccagcactt

SEQ ID NO: 16574 - DNA, 20 bp, Artificial Sequence
  Description of Artificial Sequence: Synthetic oligonucleotide
  Target: FXN; (+) strand; PAM type: NRG; PAM sequence: GGG
acctgtaatcccagcacttt

SEQ ID NO: 16575 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttgg

SEQ ID NO: 16576 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttggg

SEQ ID NO: 16577 - DNA, 20 bp, Artificial Sequence
  Description of Artificial Sequence: Synthetic oligonucleotide
  Target: FXN; (+) strand; PAM type: NRG; PAM sequence: GAG
tcccagcactttgggaggct

SEQ ID NO: 16578 - DNA, 20 bp, Artificial Sequence
  Description of Artificial Sequence: Synthetic oligonucleotide
  Target: FXN; (+) strand; PAM type: NRG; PAM sequence: TGG
agcactttgggaggctgaga

SEQ ID NO: 16579 - DNA, 20 bp, Artificial Sequence
  Description of Artificial Sequence: Synthetic oligonucleotide
  Target: FXN; (+) strand; PAM type: NRG; PAM sequence: GGG
gcactttgggaggctgagat

SEQ ID NO: 16580 - DNA, 20 bp, Artificial Sequence
  Description of Artificial Sequence: Synthetic oligonucleotide
  Target: FXN; (+) strand; PAM type: NRG; PAM sequence: CGG
ctttgggaggctgagatggg

SEQ ID NO: 16581 - DNA, 20 bp, Artificial Sequence
  Description of Artificial Sequence: Synthetic oligonucleotide
  Target: FXN; (+) strand; PAM type: NRG; PAM sequence: GAG
ctgagatgggcggatcacct

SEQ ID NO: 16582 - DNA, 20 bp, Artificial Sequence
  Description of Artificial Sequence: Synthetic oligonucleotide
  Target: FXN; (+) strand; PAM type: NRG; PAM sequence: AGG
tgagatgggcggatcacctg

SEQ ID NO: 16583 - DNA, 20 bp, Artificial Sequence
  Description of Artificial Sequence: Synthetic oligonucleotide
  Target: FXN; (+) strand; PAM type: NRG; PAM sequence: CAG
atgggcggatcacctgaggt

SEQ ID NO: 16584 - DNA, 20 bp, Artificial Sequence
  Description of Artificial Sequence: Synthetic oligonucleotide
  Target: FXN; (+) strand; PAM type: NRG; PAM sequence: AGG
tgggcggatcacctgaggtc

SEQ ID NO: 16585 - DNA, 20 bp, Artificial Sequence
  Description of Artificial Sequence: Synthetic oligonucleotide
  Target: FXN; (+) strand; PAM type: NRG; PAM sequence: GAG
ggcggatcacctgaggtcag

SEQ ID NO: 16586 - DNA, 20 bp, Artificial Sequence
  Description of Artificial Sequence: Synthetic oligonucleotide
  Target: FXN; (+) strand; PAM type: NRG; PAM sequence: GAG
tcacctgaggtcaggagttt

SEQ ID NO: 16587 - DNA, 20 bp, Artificial Sequence
  Description of Artificial Sequence: Synthetic oligonucleotide
  Target: FXN; (+) strand; PAM type: NRG; PAM sequence: CAG
tgaggtcaggagtttgagac

SEQ ID NO: 16588 - DNA, 20 bp, Artificial Sequence
  Description of Artificial Sequence: Synthetic oligonucleotide
  Target: FXN; (+) strand; PAM type: NRG; PAM sequence: TGG
tcaggagtttgagaccagcc

SEQ ID NO: 16589 - DNA, 20 bp, Artificial Sequence
  Description of Artificial Sequence: Synthetic oligonucleotide
  Target: FXN; (+) strand; PAM type: NRG; PAM sequence: TGG
tgagaccagcctggccaaca

SEQ ID NO: 16590 - DNA, 20 bp, Artificial Sequence
  Description of Artificial Sequence: Synthetic oligonucleotide
  Target: FXN; (+) strand; PAM type: NRG; PAM sequence: TAG
tctactaaaaatacaaaaat

SEQ ID NO: 16591 - DNA, 20 bp, Artificial Sequence
  Description of Artificial Sequence: Synthetic oligonucleotide
  Target: FXN; (+) strand; PAM type: NRG; PAM sequence: TGG
ctaaaaatacaaaaattagc

SEQ ID NO: 16592 - DNA, 20 bp, Artificial Sequence
  Description of Artificial Sequence: Synthetic oligonucleotide
  Target: FXN; (+) strand; PAM type: NRG; PAM sequence: TGG
atacaaaaattagctggatg

SEQ ID NO: 16593 - DNA, 20 bp, Artificial Sequence
  Description of Artificial Sequence: Synthetic oligonucleotide
  Target: FXN; (+) strand; PAM type: NRG; PAM sequence: TGG
caaaaattagctggatgtgg

SEQ ID NO: 16594 - DNA, 20 bp, Artificial Sequence
  Description of Artificial Sequence: Synthetic oligonucleotide
  Target: FXN; (+) strand; PAM type: NRG; PAM sequence: CAG
gtggcactcacctgtaatcc

SEQ ID NO: 16595 - DNA, 20 bp, Artificial Sequence
  Description of Artificial Sequence: Synthetic oligonucleotide
  Target: FXN; (+) strand; PAM type: NRG; PAM sequence: CAG
cacctgtaatcccagctact

SEQ ID NO: 16596 - DNA, 20 bp, Artificial Sequence
  Description of Artificial Sequence: Synthetic oligonucleotide
  Target: FXN; (+) strand; PAM type: NRG; PAM sequence: AGG
acctgtaatcccagctactc

SEQ ID NO: 16597 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagctactcag

SEQ ID NO: 16598 - DNA, 20 bp, Artificial Sequence
  Description of Artificial Sequence: Synthetic oligonucleotide
  Target: FXN; (+) strand; PAM type: NRG; PAM sequence: AGG
tgtaatcccagctactcagg

SEQ ID NO: 16599 - DNA, 20 bp, Artificial Sequence
  Description of Artificial Sequence: Synthetic oligonucleotide
  Target: FXN; (+) strand; PAM type: NRG; PAM sequence: GAG
tcccagctactcaggaggct

SEQ ID NO: 16600 - DNA, 20 bp, Artificial Sequence
  Description of Artificial Sequence: Synthetic oligonucleotide
  Target: FXN; (+) strand; PAM type: NRG; PAM sequence: AGG
cccagctactcaggaggctg

SEQ ID NO: 16601 - DNA, 20 bp, Artificial Sequence
  Description of Artificial Sequence: Synthetic oligonucleotide
  Target: FXN; (+) strand; PAM type: NRG; PAM sequence: CAG
agctactcaggaggctgagg

SEQ ID NO: 16602 - DNA, 20 bp, Artificial Sequence
  Description of Artificial Sequence: Synthetic oligonucleotide
  Target: FXN; (+) strand; PAM type: NRG; PAM sequence: AGG
gctactcaggaggctgaggc

SEQ ID NO: 16603 - DNA, 20 bp, Artificial Sequence
  Description of Artificial Sequence: Synthetic oligonucleotide
  Target: FXN; (+) strand; PAM type: NRG; PAM sequence: CGG
gcaggataattgcttgaacc

SEQ ID NO: 16604 - DNA, 20 bp, Artificial Sequence
  Description of Artificial Sequence: Synthetic oligonucleotide
  Target: FXN; (+) strand; PAM type: NRG; PAM sequence: GGG
caggataattgcttgaaccc

SEQ ID NO: 16605 - DNA, 20 bp, Artificial Sequence
  Description of Artificial Sequence: Synthetic oligonucleotide
  Target: FXN; (+) strand; PAM type: NRG; PAM sequence: GAG
ggataattgcttgaacccgg

SEQ ID NO: 16606 - DNA, 20 bp, Artificial Sequence
  Description of Artificial Sequence: Synthetic oligonucleotide
  Target: FXN; (+) strand; PAM type: NRG; PAM sequence: AGG
gataattgcttgaacccggg

SEQ ID NO: 16607 - DNA, 20 bp, Artificial Sequence
  Description of Artificial Sequence: Synthetic oligonucleotide
  Target: FXN; (+) strand; PAM type: NRG; PAM sequence: TGG
aattgcttgaacccgggagg

SEQ ID NO: 16608 - DNA, 20 bp, Artificial Sequence
  Description of Artificial Sequence: Synthetic oligonucleotide
  Target: FXN; (+) strand; PAM type: NRG; PAM sequence: TGG
tgcttgaacccgggaggtgg

SEQ ID NO: 16609 - DNA, 20 bp, Artificial Sequence
  Description of Artificial Sequence: Synthetic oligonucleotide
  Target: FXN; (+) strand; PAM type: NRG; PAM sequence: GAG
cttgaacccgggaggtggtg

SEQ ID NO: 16610 - DNA, 20 bp, Artificial Sequence
  Description of Artificial Sequence: Synthetic oligonucleotide
  Target: FXN; (+) strand; PAM type: NRG; PAM sequence: AGG
ttgaacccgggaggtggtgg

SEQ ID NO: 16611 - DNA, 20 bp, Artificial Sequence
  Description of Artificial Sequence: Synthetic oligonucleotide
  Target: FXN; (+) strand; PAM type: NRG; PAM sequence: CAG
ccgggaggtggtggaggttg

SEQ ID NO: 16612 - DNA, 20 bp, Artificial Sequence
  Description of Artificial Sequence: Synthetic oligonucleotide
  Target: FXN; (+) strand; PAM type: NRG; PAM sequence: GAG
gaggtggtggaggttgcagt

SEQ ID NO: 16613 - DNA, 20 bp, Artificial Sequence
  Description of Artificial Sequence: Synthetic oligonucleotide
  Target: FXN; (+) strand; PAM type: NRG; PAM sequence: GAG
ggtggaggttgcagtgagcc

SEQ ID NO: 16614 - DNA, 20 bp, Artificial Sequence
  Description of Artificial Sequence: Synthetic oligonucleotide
  Target: FXN; (+) strand; PAM type: NRG; PAM sequence: TGG
cgcaccactgccttccaacc

SEQ ID NO: 16615 - DNA, 20 bp, Artificial Sequence
  Description of Artificial Sequence: Synthetic oligonucleotide
  Target: FXN; (+) strand; PAM type: NRG; PAM sequence: GGG
gcaccactgccttccaacct

SEQ ID NO: 16616 - DNA, 20 bp, Artificial Sequence
  Description of Artificial Sequence: Synthetic oligonucleotide
  Target: FXN; (+) strand; PAM type: NRG; PAM sequence: CAG
ctgccttccaacctgggcga

SEQ ID NO: 16617 - DNA, 20 bp, Artificial Sequence
  Description of Artificial Sequence: Synthetic oligonucleotide
  Target: FXN; (+) strand; PAM type: NRG; PAM sequence: GAG
gccttccaacctgggcgaca

SEQ ID NO: 16618 - DNA, 20 bp, Artificial Sequence
  Description of Artificial Sequence: Synthetic oligonucleotide
  Target: FXN; (+) strand; PAM type: NRG; PAM sequence: GAG
tccaacctgggcgacagagc

SEQ ID NO: 16619 - DNA, 20 bp, Artificial Sequence
  Description of Artificial Sequence: Synthetic oligonucleotide
  Target: FXN; (+) strand; PAM type: NRG; PAM sequence: AAG
tccgtctcaaaaaaaaaaaa

SEQ ID NO: 16620 - DNA, 20 bp, Artificial Sequence
  Description of Artificial Sequence: Synthetic oligonucleotide
  Target: FXN; (+) strand; PAM type: NRG; PAM sequence: AGG
ccgtctcaaaaaaaaaaaaa

SEQ ID NO: 16621 - DNA, 20 bp, Artificial Sequence
  Description of Artificial Sequence: Synthetic oligonucleotide
  Target: FXN; (+) strand; PAM type: NRG; PAM sequence: AAG
caaataattaaaattaaatg

SEQ ID NO: 16622 - DNA, 20 bp, Artificial Sequence
  Description of Artificial Sequence: Synthetic oligonucleotide
  Target: FXN; (+) strand; PAM type: NRG; PAM sequence: CAG
attaaatgaagttgaaaatc

SEQ ID NO: 16623 - DNA, 20 bp, Artificial Sequence
  Description of Artificial Sequence: Synthetic oligonucleotide
  Target: FXN; (+) strand; PAM type: NRG; PAM sequence: AGG
ttaaatgaagttgaaaatcc

SEQ ID NO: 16624 - DNA, 20 bp, Artificial Sequence
  Description of Artificial Sequence: Synthetic oligonucleotide
  Target: FXN; (+) strand; PAM type: NRG; PAM sequence: CAG
aagttgaaaatccaggtcct

SEQ ID NO: 16625 - DNA, 20 bp, Artificial Sequence
  Description of Artificial Sequence: Synthetic oligonucleotide
  Target: FXN; (+) strand; PAM type: NRG; PAM sequence: TAG
atccaggtcctcagtcccat

SEQ ID NO: 16626 - DNA, 20 bp, Artificial Sequence
  Description of Artificial Sequence: Synthetic oligonucleotide
  Target: FXN; (+) strand; PAM type: NRG; PAM sequence: TAG
agtcccattagccacatttc

SEQ ID NO: 16627 - DNA, 20 bp, Artificial Sequence
  Description of Artificial Sequence: Synthetic oligonucleotide
  Target: FXN; (+) strand; PAM type: NRG; PAM sequence: CAG
ttagccacatttctagtgct

SEQ ID NO: 16628 - DNA, 20 bp, Artificial Sequence
  Description of Artificial Sequence: Synthetic oligonucleotide
  Target: FXN; (+) strand; PAM type: NRG; PAM sequence: TAG
gccacatttctagtgctcag

SEQ ID NO: 16629 - DNA, 20 bp, Artificial Sequence
  Description of Artificial Sequence: Synthetic oligonucleotide
  Target: FXN; (+) strand; PAM type: NRG; PAM sequence: CGG
tttctagtgctcagtagcca

SEQ ID NO: 16630 - DNA, 20 bp, Artificial Sequence
  Description of Artificial Sequence: Synthetic oligonucleotide
  Target: FXN; (+) strand; PAM type: NRG; PAM sequence: GGG
ttctagtgctcagtagccac

SEQ ID NO: 16631 - DNA, 20 bp, Artificial Sequence
  Description of Artificial Sequence: Synthetic oligonucleotide
  Target: FXN; (+) strand; PAM type: NRG; PAM sequence: GGG
tctagtgctcagtagccacg

SEQ ID NO: 16632 - DNA, 20 bp, Artificial Sequence
  Description of Artificial Sequence: Synthetic oligonucleotide
  Target: FXN; (+) strand; PAM type: NRG; PAM sequence: GGG
ctagtgctcagtagccacgg

SEQ ID NO: 16633 - DNA, 20 bp, Artificial Sequence
  Description of Artificial Sequence: Synthetic oligonucleotide
  Target: FXN; (+) strand; PAM type: NRG; PAM sequence: TGG
tgctcagtagccacgggggc

SEQ ID NO: 16634 - DNA, 20 bp, Artificial Sequence
  Description of Artificial Sequence: Synthetic oligonucleotide
  Target: FXN; (+) strand; PAM type: NRG; PAM sequence: TGG
gggggctggtgaccaccaca

SEQ ID NO: 16635 - DNA, 20 bp, Artificial Sequence
  Description of Artificial Sequence: Synthetic oligonucleotide
  Target: FXN; (+) strand; PAM type: NRG; PAM sequence: GGG
ggggctggtgaccaccacat

SEQ ID NO: 16636 - DNA, 20 bp, Artificial Sequence
  Description of Artificial Sequence: Synthetic oligonucleotide
  Target: FXN; (+) strand; PAM type: NRG; PAM sequence: CAG
ctggtgaccaccacatggga

SEQ ID NO: 16637 - DNA, 20 bp, Artificial Sequence
  Description of Artificial Sequence: Synthetic oligonucleotide
  Target: FXN; (+) strand; PAM type: NRG; PAM sequence: TAG
accacatgggacagcatatt

SEQ ID NO: 16638 - DNA, 20 bp, Artificial Sequence
  Description of Artificial Sequence: Synthetic oligonucleotide
  Target: FXN; (+) strand; PAM type: NRG; PAM sequence: TGG
catatttagtacctgatcat

SEQ ID NO: 16639 - DNA, 20 bp, Artificial Sequence
  Description of Artificial Sequence: Synthetic oligonucleotide
  Target: FXN; (+) strand; PAM type: NRG; PAM sequence: CAG
agtacctgatcattggttct

SEQ ID NO: 16640 - DNA, 20 bp, Artificial Sequence
  Description of Artificial Sequence: Synthetic oligonucleotide
  Target: FXN; (+) strand; PAM type: NRG; PAM sequence: TGG
tgatcattggttctcagatc

SEQ ID NO: 16641 - DNA, 20 bp, Artificial Sequence
  Description of Artificial Sequence: Synthetic oligonucleotide
  Target: FXN; (+) strand; PAM type: NRG; PAM sequence: CAG
ggttctcagatctggctact

SEQ ID NO: 16642 - DNA, 20 bp, Artificial Sequence
  Description of Artificial Sequence: Synthetic oligonucleotide
  Target: FXN; (+) strand; PAM type: NRG; PAM sequence: CAG
tctcagatctggctactcag

SEQ ID NO: 16643 - DNA, 20 bp, Artificial Sequence
  Description of Artificial Sequence: Synthetic oligonucleotide
  Target: FXN; (+) strand; PAM type: NRG; PAM sequence: AAG
tctggctactcagcagaacc

SEQ ID NO: 16644 - DNA, 20 bp, Artificial Sequence
  Description of Artificial Sequence: Synthetic oligonucleotide
  Target: FXN; (+) strand; PAM type: NRG; PAM sequence: CAG
tcagcagaaccaagaatcca

SEQ ID NO: 16645 - DNA, 20 bp, Artificial Sequence
  Description of Artificial Sequence: Synthetic oligonucleotide
  Target: FXN; (+) strand; PAM type: NRG; PAM sequence: CGG
gaaccaagaatccacagaaa

SEQ ID NO: 16646 - DNA, 20 bp, Artificial Sequence
  Description of Artificial Sequence: Synthetic oligonucleotide
  Target: FXN; (+) strand; PAM type: NRG; PAM sequence: AAG
tccacagaaacggcttttaa

SEQ ID NO: 16647 - DNA, 20 bp, Artificial Sequence
  Description of Artificial Sequence: Synthetic oligonucleotide
  Target: FXN; (+) strand; PAM type: NRG; PAM sequence: CAG
agaaacggcttttaaaagca

SEQ ID NO: 16648 - DNA, 20 bp, Artificial Sequence
  Description of Artificial Sequence: Synthetic oligonucleotide
  Target: FXN; (+) strand; PAM type: NRG; PAM sequence: CAG
cttttaaaagcacagcccca

SEQ ID NO: 16649 - DNA, 20 bp, Artificial Sequence
  Description of Artificial Sequence: Synthetic oligonucleotide
  Target: FXN; (+) strand; PAM type: NRG; PAM sequence: CAG
aagcacagccccacagcccc

SEQ ID NO: 16650 - DNA, 20 bp, Artificial Sequence
  Description of Artificial Sequence: Synthetic oligonucleotide
  Target: FXN; (+) strand; PAM type: NRG; PAM sequence: CAG
agccccacagcccccagccc

SEQ ID NO: 16651 - DNA, 20 bp, Artificial Sequence
  Description of Artificial Sequence: Synthetic oligonucleotide
  Target: FXN; (+) strand; PAM type: NRG; PAM sequence: TGG
cagccccagccttacctacc

SEQ ID NO: 16652 - DNA, 20 bp, Artificial Sequence
  Description of Artificial Sequence: Synthetic oligonucleotide
  Target: FXN; (+) strand; PAM type: NRG; PAM sequence: GAG
gccccagccttacctacctg

SEQ ID NO: 16653 - DNA, 20 bp, Artificial Sequence
  Description of Artificial Sequence: Synthetic oligonucleotide
  Target: FXN; (+) strand; PAM type: NRG; PAM sequence: AGG
ccccagccttacctacctgg

SEQ ID NO: 16654 - DNA, 20 bp, Artificial Sequence
  Description of Artificial Sequence: Synthetic oligonucleotide
  Target: FXN; (+) strand; PAM type: NRG; PAM sequence: TGG
agccttacctacctggaggc

SEQ ID NO: 16655 - DNA, 20 bp, Artificial Sequence
  Description of Artificial Sequence: Synthetic oligonucleotide
  Target: FXN; (+) strand; PAM type: NRG; PAM sequence: GGG
gccttacctacctggaggct

SEQ ID NO: 16656 - DNA, 20 bp, Artificial Sequence
  Description of Artificial Sequence: Synthetic oligonucleotide
  Target: FXN; (+) strand; PAM type: NRG; PAM sequence: AAG
ttacctacctggaggctggg

SEQ ID NO: 16657 - DNA, 20 bp, Artificial Sequence
  Description of Artificial Sequence: Synthetic oligonucleotide
  Target: FXN; (+) strand; PAM type: NRG; PAM sequence: AGG
tacctacctggaggctggga

SEQ ID NO: 16658 - DNA, 20 bp, Artificial Sequence
  Description of Artificial Sequence: Synthetic oligonucleotide
  Target: FXN; (+) strand; PAM type: NRG; PAM sequence: GAG
gggaaggactctgattccac

SEQ ID NO: 16659 - DNA, 20 bp, Artificial Sequence
  Description of Artificial Sequence: Synthetic oligonucleotide
  Target: FXN; (+) strand; PAM type: NRG; PAM sequence: AGG
ggaaggactctgattccacg

SEQ ID NO: 16660 - DNA, 20 bp, Artificial Sequence
  Description of Artificial Sequence: Synthetic oligonucleotide
  Target: FXN; (+) strand; PAM type: NRG; PAM sequence: CAG
aggactctgattccacgagg

SEQ ID NO: 16661 - DNA, 20 bp, Artificial Sequence
  Description of Artificial Sequence: Synthetic oligonucleotide
  Target: FXN; (+) strand; PAM type: NRG; PAM sequence: TGG
aggcagcctatgttttttga

SEQ ID NO: 16662 - DNA, 20 bp, Artificial Sequence
  Description of Artificial Sequence: Synthetic oligonucleotide
  Target: FXN; (+) strand; PAM type: NRG; PAM sequence: GAG
gcagcctatgttttttgatg

SEQ ID NO: 16663 - DNA, 20 bp, Artificial Sequence
  Description of Artificial Sequence: Synthetic oligonucleotide
  Target: FXN; (+) strand; PAM type: NRG; PAM sequence: AGG
cagcctatgttttttgatgg

SEQ ID NO: 16664 - DNA, 20 bp, Artificial Sequence
  Description of Artificial Sequence: Synthetic oligonucleotide
  Target: FXN; (+) strand; PAM type: NRG; PAM sequence: GGG
agcctatgttttttgatgga

SEQ ID NO: 16665 - DNA, 20 bp, Artificial Sequence
  Description of Artificial Sequence: Synthetic oligonucleotide
  Target: FXN; (+) strand; PAM type: NRG; PAM sequence: CAG
tttttgatggagggatgtga

SEQ ID NO: 16666 - DNA, 20 bp, Artificial Sequence
  Description of Artificial Sequence: Synthetic oligonucleotide
  Target: FXN; (+) strand; PAM type: NRG; PAM sequence: AGG
ttttgatggagggatgtgac

SEQ ID NO: 16667 - DNA, 20 bp, Artificial Sequence
  Description of Artificial Sequence: Synthetic oligonucleotide
  Target: FXN; (+) strand; PAM type: NRG; PAM sequence: GGG
tttgatggagggatgtgaca

SEQ ID NO: 16668 - DNA, 20 bp, Artificial Sequence
  Description of Artificial Sequence: Synthetic oligonucleotide
  Target: FXN; (+) strand; PAM type: NRG; PAM sequence: GGG
ttgatggagggatgtgacag

SEQ ID NO: 16669 - DNA, 20 bp, Artificial Sequence
  Description of Artificial Sequence: Synthetic oligonucleotide
  Target: FXN; (+) strand; PAM type: NRG; PAM sequence: TGG
taacgtttcctcttaaatac

SEQ ID NO: 16670 - DNA, 20 bp, Artificial Sequence
  Description of Artificial Sequence: Synthetic oligonucleotide
  Target: FXN; (+) strand; PAM type: NRG; PAM sequence: GAG
acgtttcctcttaaatactg

SEQ ID NO: 16671 - DNA, 20 bp, Artificial Sequence
  Description of Artificial Sequence: Synthetic oligonucleotide
  Target: FXN; (+) strand; PAM type: NRG; PAM sequence: CAG
ttcctcttaaatactggaga

SEQ ID NO: 16672 - DNA, 20 bp, Artificial Sequence
  Description of Artificial Sequence: Synthetic oligonucleotide
  Target: FXN; (+) strand; PAM type: NRG; PAM sequence: GAG
taaatactggagacagcttc

SEQ ID NO: 16673 - DNA, 20 bp, Artificial Sequence
  Description of Artificial Sequence: Synthetic oligonucleotide
  Target: FXN; (+) strand; PAM type: NRG; PAM sequence: AGG
aaatactggagacagcttcg

SEQ ID NO: 16674 - DNA, 20 bp, Artificial Sequence
  Description of Artificial Sequence: Synthetic oligonucleotide
  Target: FXN; (+) strand; PAM type: NRG; PAM sequence: GAG
atactggagacagcttcgag

SEQ ID NO: 16675 - DNA, 20 bp, Artificial Sequence
  Description of Artificial Sequence: Synthetic oligonucleotide
  Target: FXN; (+) strand; PAM type: NRG; PAM sequence: AGG
tactggagacagcttcgagg

SEQ ID NO: 16676 - DNA, 20 bp, Artificial Sequence
  Description of Artificial Sequence: Synthetic oligonucleotide
  Target: FXN; (+) strand; PAM type: NRG; PAM sequence: GAG
ctggagacagcttcgaggag

SEQ ID NO: 16677 - DNA, 20 bp, Artificial Sequence
  Description of Artificial Sequence: Synthetic oligonucleotide
  Target: FXN; (+) strand; PAM type: NRG; PAM sequence: TGG
agcttcgaggaggagataac

SEQ ID NO: 16678 - DNA, 20 bp, Artificial Sequence
  Description of Artificial Sequence: Synthetic oligonucleotide
  Target: FXN; (+) strand; PAM type: NRG; PAM sequence: TAG
ggagataactggatgtgtct

SEQ ID NO: 16679 - DNA, 20 bp, Artificial Sequence
  Description of Artificial Sequence: Synthetic oligonucleotide
  Target: FXN; (+) strand; PAM type: NRG; PAM sequence: TGG
atgtgtcttagtccatttga

SEQ ID NO: 16680 - DNA, 20 bp, Artificial Sequence
  Description of Artificial Sequence: Synthetic oligonucleotide
  Target: FXN; (+) strand; PAM type: NRG; PAM sequence: GAG
gtgtcttagtccatttgatg

SEQ ID NO: 16681 - DNA, 20 bp, Artificial Sequence
  Description of Artificial Sequence: Synthetic oligonucleotide
  Target: FXN; (+) strand; PAM type: NRG; PAM sequence: AGG
tgtcttagtccatttgatgg

SEQ ID NO: 16682 - DNA, 20 bp, Artificial Sequence
  Description of Artificial Sequence: Synthetic oligonucleotide
  Target: FXN; (+) strand; PAM type: NRG; PAM sequence: GGG
gtcttagtccatttgatgga

SEQ ID NO: 16683 - DNA, 20 bp, Artificial Sequence
  Description of Artificial Sequence: Synthetic oligonucleotide
  Target: FXN; (+) strand; PAM type: NRG; PAM sequence: CGG
catttgatggagggatgtga

SEQ ID NO: 16684 - DNA, 20 bp, Artificial Sequence
  Description of Artificial Sequence: Synthetic oligonucleotide
  Target: FXN; (+) strand; PAM type: NRG; PAM sequence: GGG
atttgatggagggatgtgac

SEQ ID NO: 16685 - DNA, 20 bp, Artificial Sequence
  Description of Artificial Sequence: Synthetic oligonucleotide
  Target: FXN; (+) strand; PAM type: NRG; PAM sequence: GGG
tttgatggagggatgtgacg

SEQ ID NO: 16686 - DNA, 20 bp, Artificial Sequence
  Description of Artificial Sequence: Synthetic oligonucleotide
  Target: FXN; (+) strand; PAM type: NRG; PAM sequence: CGG
taacgtttcctcttaaatac

SEQ ID NO: 16687 - DNA, 20 bp, Artificial Sequence
  Description of Artificial Sequence: Synthetic oligonucleotide
  Target: FXN; (+) strand; PAM type: NRG; PAM sequence: GAG
acgtttcctcttaaataccg

SEQ ID NO: 16688 - DNA, 20 bp, Artificial Sequence
  Description of Artificial Sequence: Synthetic oligonucleotide
  Target: FXN; (+) strand; PAM type: NRG; PAM sequence: CAG
ttcctcttaaataccggaga

SEQ ID NO: 16689 - DNA, 20 bp, Artificial Sequence
  Description of Artificial Sequence: Synthetic oligonucleotide
  Target: FXN; (+) strand; PAM type: NRG; PAM sequence: GAG
taaataccggagacagcttc

SEQ ID NO: 16690 - DNA, 20 bp, Artificial Sequence
  Description of Artificial Sequence: Synthetic oligonucleotide
  Target: FXN; (+) strand; PAM type: NRG; PAM sequence: AAG
ataccggagacagcttcgag

SEQ ID NO: 16691 - DNA, 20 bp, Artificial Sequence
  Description of Artificial Sequence: Synthetic oligonucleotide
  Target: FXN; (+) strand; PAM type: NRG; PAM sequence: AGG
taccggagacagcttcgaga

SEQ ID NO: 16692 - DNA, 20 bp, Artificial Sequence
  Description of Artificial Sequence: Synthetic oligonucleotide
  Target: FXN; (+) strand; PAM type: NRG; PAM sequence: GAG
ccggagacagcttcgagaag

SEQ ID NO: 16693 - DNA, 20 bp, Artificial Sequence
  Description of Artificial Sequence: Synthetic oligonucleotide
  Target: FXN; (+) strand; PAM type: NRG; PAM sequence: TGG
agcttcgagaaggagataac

SEQ ID NO: 16694 - DNA, 20 bp, Artificial Sequence
  Description of Artificial Sequence: Synthetic oligonucleotide
  Target: FXN; (+) strand; PAM type: NRG; PAM sequence: TAG
ggagataactggatgtttct

SEQ ID NO: 16695 - DNA, 20 bp, Artificial Sequence
  Description of Artificial Sequence: Synthetic oligonucleotide
  Target: FXN; (+) strand; PAM type: NRG; PAM sequence: CAG
ccattttctgttgcttgtga

SEQ ID NO: 16696 - DNA, 20 bp, Artificial Sequence
  Description of Artificial Sequence: Synthetic oligonucleotide
  Target: FXN; (+) strand; PAM type: NRG; PAM sequence: TGG
tgtgacagaatacctgaaac

SEQ ID NO: 16697 - DNA, 20 bp, Artificial Sequence
  Description of Artificial Sequence: Synthetic oligonucleotide
  Target: FXN; (+) strand; PAM type: NRG; PAM sequence: GGG
gtgacagaatacctgaaact

SEQ ID NO: 16698 - DNA, 20 bp, Artificial Sequence
  Description of Artificial Sequence: Synthetic oligonucleotide
  Target: FXN; (+) strand; PAM type: NRG; PAM sequence: TGG
ctgaaactgggcaatttata

SEQ ID NO: 16699 - DNA, 20 bp, Artificial Sequence
  Description of Artificial Sequence: Synthetic oligonucleotide
  Target: FXN; (+) strand; PAM type: NRG; PAM sequence: TGG
aaattttcttcttactgctc

SEQ ID NO: 16700 - DNA, 20 bp, Artificial Sequence
  Description of Artificial Sequence: Synthetic oligonucleotide
  Target: FXN; (+) strand; PAM type: NRG; PAM sequence: GAG
attttcttcttactgctctg

SEQ ID NO: 16701 - DNA, 20 bp, Artificial Sequence
  Description of Artificial Sequence: Synthetic oligonucleotide
  Target: FXN; (+) strand; PAM type: NRG; PAM sequence: AGG
ttttcttcttactgctctgg

SEQ ID NO: 16702 - DNA, 20 bp, Artificial Sequence
  Description of Artificial Sequence: Synthetic oligonucleotide
  Target: FXN; (+) strand; PAM type: NRG; PAM sequence: GAG
ttcttactgctctggaggct

SEQ ID NO: 16703 - DNA, 20 bp, Artificial Sequence
  Description of Artificial Sequence: Synthetic oligonucleotide
  Target: FXN; (+) strand; PAM type: NRG; PAM sequence: AAG
ttactgctctggaggctgag

SEQ ID NO: 16704 - DNA, 20 bp, Artificial Sequence
  Description of Artificial Sequence: Synthetic oligonucleotide
  Target: FXN; (+) strand; PAM type: NRG; PAM sequence: AAG
tctggaggctgagaagtcca

SEQ ID NO: 16705 - DNA, 20 bp, Artificial Sequence
  Description of Artificial Sequence: Synthetic oligonucleotide
  Target: FXN; (+) strand; PAM type: NRG; PAM sequence: AAG
aggctgagaagtccaaagtc

SEQ ID NO: 16706 - DNA, 20 bp, Artificial Sequence
  Description of Artificial Sequence: Synthetic oligonucleotide
  Target: FXN; (+) strand; PAM type: NRG; PAM sequence: TGG
aaagtcaagtcccttcttgc

SEQ ID NO: 16707 - DNA, 20 bp, Artificial Sequence
  Description of Artificial Sequence: Synthetic oligonucleotide
  Target: FXN; (+) strand; PAM type: NRG; PAM sequence: TGG
gtcaagtcccttcttgctgg

SEQ ID NO: 16708 - DNA, 20 bp, Artificial Sequence
  Description of Artificial Sequence: Synthetic oligonucleotide
  Target: FXN; (+) strand; PAM type: NRG; PAM sequence: GGG
tcaagtcccttcttgctggt

SEQ ID NO: 16709 - DNA, 20 bp, Artificial Sequence
  Description of Artificial Sequence: Synthetic oligonucleotide
  Target: FXN; (+) strand; PAM type: NRG; PAM sequence: GGG
caagtcccttcttgctggtg

SEQ ID NO: 16710 - DNA, 20 bp, Artificial Sequence
  Description of Artificial Sequence: Synthetic oligonucleotide
  Target: FXN; (+) strand; PAM type: NRG; PAM sequence: CAG
tcttgctggtggggactttg

SEQ ID NO: 16711 - DNA, 20 bp, Artificial Sequence
  Description of Artificial Sequence: Synthetic oligonucleotide
  Target: FXN; (+) strand; PAM type: NRG; PAM sequence: GAG
ttgctggtggggactttgca

SEQ ID NO: 16712 - DNA, 20 bp, Artificial Sequence
  Description of Artificial Sequence: Synthetic oligonucleotide
  Target: FXN; (+) strand; PAM type: NRG; PAM sequence: GAG
tggggactttgcagagtatt

SEQ ID NO: 16713 - DNA, 20 bp, Artificial Sequence
  Description of Artificial Sequence: Synthetic oligonucleotide
  Target: FXN; (+) strand; PAM type: NRG; PAM sequence: AGG
ggggactttgcagagtattg

SEQ ID NO: 16714 - DNA, 20 bp, Artificial Sequence
  Description of Artificial Sequence: Synthetic oligonucleotide
  Target: FXN; (+) strand; PAM type: NRG; PAM sequence: CGG
gactttgcagagtattgagg

SEQ ID NO: 16715 - DNA, 20 bp, Artificial Sequence
  Description of Artificial Sequence: Synthetic oligonucleotide
  Target: FXN; (+) strand; PAM type: NRG; PAM sequence: CGG
gcagagtattgaggcggcac

SEQ ID NO: 16716 - DNA, 20 bp, Artificial Sequence
  Description of Artificial Sequence: Synthetic oligonucleotide
  Target: FXN; (+) strand; PAM type: NRG; PAM sequence: GGG
cagagtattgaggcggcacc

SEQ ID NO: 16717 - DNA, 20 bp, Artificial Sequence
  Description of Artificial Sequence: Synthetic oligonucleotide
  Target: FXN; (+) strand; PAM type: NRG; PAM sequence: TGG
aggcggcaccgggcgtcata

SEQ ID NO: 16718 - DNA, 20 bp, Artificial Sequence
  Description of Artificial Sequence: Synthetic oligonucleotide
  Target: FXN; (+) strand; PAM type: NRG; PAM sequence: AAG
ggcaccgggcgtcatatggt

SEQ ID NO: 16719 - DNA, 20 bp, Artificial Sequence
  Description of Artificial Sequence: Synthetic oligonucleotide
  Target: FXN; (+) strand; PAM type: NRG; PAM sequence: AGG
gcaccgggcgtcatatggta

SEQ ID NO: 16720 - DNA, 20 bp, Artificial Sequence
  Description of Artificial Sequence: Synthetic oligonucleotide
  Target: FXN; (+) strand; PAM type: NRG; PAM sequence: GGG
caccgggcgtcatatggtaa

SEQ ID NO: 16721 - DNA, 20 bp, Artificial Sequence
  Description of Artificial Sequence: Synthetic oligonucleotide
  Target: FXN; (+) strand; PAM type: NRG; PAM sequence: GGG
accgggcgtcatatggtaag

SEQ ID NO: 16722 - DNA, 20 bp, Artificial Sequence
  Description of Artificial Sequence: Synthetic oligonucleotide
  Target: FXN; (+) strand; PAM type: NRG; PAM sequence: GAG
gcgtcatatggtaaggggct

SEQ ID NO: 16723 - DNA, 20 bp, Artificial Sequence
  Description of Artificial Sequence: Synthetic oligonucleotide
  Target: FXN; (+) strand; PAM type: NRG; PAM sequence: CAG
aggggctgagtgtgctacct

SEQ ID NO: 16724 - DNA, 20 bp, Artificial Sequence
  Description of Artificial Sequence: Synthetic oligonucleotide
  Target: FXN; (+) strand; PAM type: NRG; PAM sequence: AGG
ggggctgagtgtgctacctc

SEQ ID NO: 16725 - DNA, 20 bp, Artificial Sequence
  Description of Artificial Sequence: Synthetic oligonucleotide
  Target: FXN; (+) strand; PAM type: NRG; PAM sequence: AAG
tgtctttttcttttcttata

SEQ ID NO: 16726 - DNA, 20 bp, Artificial Sequence
  Description of Artificial Sequence: Synthetic oligonucleotide
  Target: FXN; (+) strand; PAM type: NRG; PAM sequence: TAG
cttttcttataaagcctaac

SEQ ID NO: 16727 - DNA, 20 bp, Artificial Sequence
  Description of Artificial Sequence: Synthetic oligonucleotide
  Target: FXN; (+) strand; PAM type: NRG; PAM sequence: TGG
ataacccattaatctatgaa

SEQ ID NO: 16728 - DNA, 20 bp, Artificial Sequence
  Description of Artificial Sequence: Synthetic oligonucleotide
  Target: FXN; (+) strand; PAM type: NRG; PAM sequence: GAG
gaatggattaatccattatt

SEQ ID NO: 16729 - DNA, 20 bp, Artificial Sequence
  Description of Artificial Sequence: Synthetic oligonucleotide
  Target: FXN; (+) strand; PAM type: NRG; PAM sequence: AGG
aatggattaatccattattg

SEQ ID NO: 16730 - DNA, 20 bp, Artificial Sequence
  Description of Artificial Sequence: Synthetic oligonucleotide
  Target: FXN; (+) strand; PAM type: NRG; PAM sequence: GGG
atggattaatccattattga

SEQ ID NO: 16731 - DNA, 20 bp, Artificial Sequence
  Description of Artificial Sequence: Synthetic oligonucleotide
  Target: FXN; (+) strand; PAM type: NRG; PAM sequence: AAG
gattaatccattattgaggg

SEQ ID NO: 16732 - DNA, 20 bp, Artificial Sequence
  Description of Artificial Sequence: Synthetic oligonucleotide
  Target: FXN; (+) strand; PAM type: NRG; PAM sequence: CAG
agggaagaaccttcatgacc

SEQ ID NO: 16733 - DNA, 20 bp, Artificial Sequence
  Description of Artificial Sequence: Synthetic oligonucleotide
  Target: FXN; (+) strand; PAM type: NRG; PAM sequence: AAG
catgacccagtcaccgctta

SEQ ID NO: 16734 - DNA, 20 bp, Artificial Sequence
  Description of Artificial Sequence: Synthetic oligonucleotide
  Target: FXN; (+) strand; PAM type: NRG; PAM sequence: AGG
atgacccagtcaccgcttaa

SEQ ID NO: 16735 - DNA, 20 bp, Artificial Sequence
  Description of Artificial Sequence: Synthetic oligonucleotide
  Target: FXN; (+) strand; PAM type: NRG; PAM sequence: CGG
acctctcaatactgccacat

SEQ ID NO: 16736 - DNA, 20 bp, Artificial Sequence
  Description of Artificial Sequence: Synthetic oligonucleotide
  Target: FXN; (+) strand; PAM type: NRG; PAM sequence: GGG
cctctcaatactgccacatc

SEQ ID NO: 16737 - DNA, 20 bp, Artificial Sequence
  Description of Artificial Sequence: Synthetic oligonucleotide
  Target: FXN; (+) strand; PAM type: NRG; PAM sequence: AAG
atactgccacatcgggaatt

SEQ ID NO: 16738 - DNA, 20 bp, Artificial Sequence
  Description of Artificial Sequence: Synthetic oligonucleotide
  Target: FXN; (+) strand; PAM type: NRG; PAM sequence: GAG
cgggaattaagtttcaacat

SEQ ID NO: 16739 - DNA, 20 bp, Artificial Sequence
  Description of Artificial Sequence: Synthetic oligonucleotide
  Target: FXN; (+) strand; PAM type: NRG; PAM sequence: CGG
ttaagtttcaacatgagttt

SEQ ID NO: 16740 - DNA, 20 bp, Artificial Sequence
  Description of Artificial Sequence: Synthetic oligonucleotide
  Target: FXN; (+) strand; PAM type: NRG; PAM sequence: GAG
aagtttcaacatgagtttcg

SEQ ID NO: 16741 - DNA, 20 bp, Artificial Sequence
  Description of Artificial Sequence: Synthetic oligonucleotide
  Target: FXN; (+) strand; PAM type: NRG; PAM sequence: AGG
agtttcaacatgagtttcgg

SEQ ID NO: 16742 - DNA, 20 bp, Artificial Sequence
  Description of Artificial Sequence: Synthetic oligonucleotide
  Target: FXN; (+) strand; PAM type: NRG; PAM sequence: TAG
ggtgacaaacattcaaacca

SEQ ID NO: 16743 - DNA, 20 bp, Artificial Sequence
  Description of Artificial Sequence: Synthetic oligonucleotide
  Target: FXN; (+) strand; PAM type: NRG; PAM sequence: AAG
tgtctcttaaatgactcaat

SEQ ID NO: 16744 - DNA, 20 bp, Artificial Sequence
  Description of Artificial Sequence: Synthetic oligonucleotide
  Target: FXN; (+) strand; PAM type: NRG; PAM sequence: TGG
aatgactcaataagctcctg

SEQ ID NO: 16745 - DNA, 20 bp, Artificial Sequence
  Description of Artificial Sequence: Synthetic oligonucleotide
  Target: FXN; (+) strand; PAM type: NRG; PAM sequence: TGG
gcatccacttctgcatgcct

SEQ ID NO: 16746 - DNA, 20 bp, Artificial Sequence
  Description of Artificial Sequence: Synthetic oligonucleotide
  Target: FXN; (+) strand; PAM type: NRG; PAM sequence: GGG
catccacttctgcatgcctt

SEQ ID NO: 16747 - DNA, 20 bp, Artificial Sequence
  Description of Artificial Sequence: Synthetic oligonucleotide
  Target: FXN; (+) strand; PAM type: NRG; PAM sequence: CAG
ccacttctgcatgccttggg

SEQ ID NO: 16748 - DNA, 20 bp, Artificial Sequence
  Description of Artificial Sequence: Synthetic oligonucleotide
  Target: FXN; (+) strand; PAM type: NRG; PAM sequence: TAG
tgcatgccttgggcagcttt

SEQ ID NO: 16749 - DNA, 20 bp, Artificial Sequence
  Description of Artificial Sequence: Synthetic oligonucleotide
  Target: FXN; (+) strand; PAM type: NRG; PAM sequence: TAG
tagacatctgtccattttcc

SEQ ID NO: 16750 - DNA, 20 bp, Artificial Sequence
  Description of Artificial Sequence: Synthetic oligonucleotide
  Target: FXN; (+) strand; PAM type: NRG; PAM sequence: GAG
gacatctgtccattttccta

SEQ ID NO: 16751 - DNA, 20 bp, Artificial Sequence
  Description of Artificial Sequence: Synthetic oligonucleotide
  Target: FXN; (+) strand; PAM type: NRG; PAM sequence: AGG
acatctgtccattttcctag

SEQ ID NO: 16752 - DNA, 20 bp, Artificial Sequence
  Description of Artificial Sequence: Synthetic oligonucleotide
  Target: FXN; (+) strand; PAM type: NRG; PAM sequence: GGG
catctgtccattttcctaga

SEQ ID NO: 16753 - DNA, 20 bp, Artificial Sequence
  Description of Artificial Sequence: Synthetic oligonucleotide
  Target: FXN; (+) strand; PAM type: NRG; PAM sequence: AAG
gtccattttcctagagggac

SEQ ID NO: 16754 - DNA, 20 bp, Artificial Sequence
  Description of Artificial Sequence: Synthetic oligonucleotide
  Target: FXN; (+) strand; PAM type: NRG; PAM sequence: TGG
cctgtgatcctatgaccttt

SEQ ID NO: 16755 - DNA, 20 bp, Artificial Sequence
  Description of Artificial Sequence: Synthetic oligonucleotide
  Target: FXN; (+) strand; PAM type: NRG; PAM sequence: TAG
atcctatgaccttttggctt

SEQ ID NO: 16756 - DNA, 20 bp, Artificial Sequence
  Description of Artificial Sequence: Synthetic oligonucleotide
  Target: FXN; (+) strand; PAM type: NRG; PAM sequence: AGG
tcctatgaccttttggcttt

SEQ ID NO: 16757 - DNA, 20 bp, Artificial Sequence
  Description of Artificial Sequence: Synthetic oligonucleotide
  Target: FXN; (+) strand; PAM type: NRG; PAM sequence: AAG
cttttggctttaggcctaac

SEQ ID NO: 16758 - DNA, 20 bp, Artificial Sequence
  Description of Artificial Sequence: Synthetic oligonucleotide
  Target: FXN; (+) strand; PAM type: NRG; PAM sequence: CAG
ttggctttaggcctaacaag

SEQ ID NO: 16759 - DNA, 20 bp, Artificial Sequence
  Description of Artificial Sequence: Synthetic oligonucleotide
  Target: FXN; (+) strand; PAM type: NRG; PAM sequence: AGG
tggctttaggcctaacaagc

SEQ ID NO: 16760 - DNA, 20 bp, Artificial Sequence
  Description of Artificial Sequence: Synthetic oligonucleotide
  Target: FXN; (+) strand; PAM type: NRG; PAM sequence: CAG
aaatcatttttattgtcttg

SEQ ID NO: 16761 - DNA, 20 bp, Artificial Sequence
  Description of Artificial Sequence: Synthetic oligonucleotide
  Target: FXN; (+) strand; PAM type: NRG; PAM sequence: AAG
gtcttgcagacaatttacac

SEQ ID NO: 16762 - DNA, 20 bp, Artificial Sequence
  Description of Artificial Sequence: Synthetic oligonucleotide
  Target: FXN; (+) strand; PAM type: NRG; PAM sequence: TAG
aatttacacaagtttacaca

SEQ ID NO: 16763 - DNA, 20 bp, Artificial Sequence
  Description of Artificial Sequence: Synthetic oligonucleotide
  Target: FXN; (+) strand; PAM type: NRG; PAM sequence: AAG
acacaagtttacacatagaa

SEQ ID NO: 16764 - DNA, 20 bp, Artificial Sequence
  Description of Artificial Sequence: Synthetic oligonucleotide
  Target: FXN; (+) strand; PAM type: NRG; PAM sequence: AGG
cacaagtttacacatagaaa

SEQ ID NO: 16765 - DNA, 20 bp, Artificial Sequence
  Description of Artificial Sequence: Synthetic oligonucleotide
  Target: FXN; (+) strand; PAM type: NRG; PAM sequence: CGG
tgtaaatatttatacgctgc

SEQ ID NO: 16766 - DNA, 20 bp, Artificial Sequence
  Description of Artificial Sequence: Synthetic oligonucleotide
  Target: FXN; (+) strand; PAM type: NRG; PAM sequence: GGG
gtaaatatttatacgctgcc

SEQ ID NO: 16767 - DNA, 20 bp, Artificial Sequence
  Description of Artificial Sequence: Synthetic oligonucleotide
  Target: FXN; (+) strand; PAM type: NRG; PAM sequence: CGG
tatttatacgctgccgggcg

SEQ ID NO: 16768 - DNA, 20 bp, Artificial Sequence
  Description of Artificial Sequence: Synthetic oligonucleotide
  Target: FXN; (+) strand; PAM type: NRG; PAM sequence: TGG
ttatacgctgccgggcgcgg

SEQ ID NO: 16769 - DNA, 20 bp, Artificial Sequence
  Description of Artificial Sequence: Synthetic oligonucleotide
  Target: FXN; (+) strand; PAM type: NRG; PAM sequence: CAG
gtggctcacgcctgtaatcc

SEQ ID NO: 16770 - DNA, 20 bp, Artificial Sequence
  Description of Artificial Sequence: Synthetic oligonucleotide
  Target: FXN; (+) strand; PAM type: NRG; PAM sequence: TGG
cgcctgtaatcccagcactt

SEQ ID NO: 16771 - DNA, 20 bp, Artificial Sequence
  Description of Artificial Sequence: Synthetic oligonucleotide
  Target: FXN; (+) strand; PAM type: NRG; PAM sequence: GGG
gcctgtaatcccagcacttt

SEQ ID NO: 16772 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttgg

SEQ ID NO: 16773 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttggg

SEQ ID NO: 16774 - DNA, 20 bp, Artificial Sequence
  Description of Artificial Sequence: Synthetic oligonucleotide
  Target: FXN; (+) strand; PAM type: NRG; PAM sequence: GAG
tcccagcactttgggaggcc

SEQ ID NO: 16775 - DNA, 20 bp, Artificial Sequence
  Description of Artificial Sequence: Synthetic oligonucleotide
  Target: FXN; (+) strand; PAM type: NRG; PAM sequence: AGG
cccagcactttgggaggccg

SEQ ID NO: 16776 - DNA, 20 bp, Artificial Sequence
  Description of Artificial Sequence: Synthetic oligonucleotide
  Target: FXN; (+) strand; PAM type: NRG; PAM sequence: CAG
agcactttgggaggccgagg

SEQ ID NO: 16777 - DNA, 20 bp, Artificial Sequence
  Description of Artificial Sequence: Synthetic oligonucleotide
  Target: FXN; (+) strand; PAM type: NRG; PAM sequence: AGG
gcactttgggaggccgaggc

SEQ ID NO: 16778 - DNA, 20 bp, Artificial Sequence
  Description of Artificial Sequence: Synthetic oligonucleotide
  Target: FXN; (+) strand; PAM type: NRG; PAM sequence: TGG
ctttgggaggccgaggcagg

SEQ ID NO: 16779 - DNA, 20 bp, Artificial Sequence
  Description of Artificial Sequence: Synthetic oligonucleotide
  Target: FXN; (+) strand; PAM type: NRG; PAM sequence: GAG
ggccgaggcaggtggatcac

SEQ ID NO: 16780 - DNA, 20 bp, Artificial Sequence
  Description of Artificial Sequence: Synthetic oligonucleotide
  Target: FXN; (+) strand; PAM type: NRG; PAM sequence: CAG
aggcaggtggatcacgagtt

SEQ ID NO: 16781 - DNA, 20 bp, Artificial Sequence
  Description of Artificial Sequence: Synthetic oligonucleotide
  Target: FXN; (+) strand; PAM type: NRG; PAM sequence: AGG
ggcaggtggatcacgagttc

SEQ ID NO: 16782 - DNA, 20 bp, Artificial Sequence
  Description of Artificial Sequence: Synthetic oligonucleotide
  Target: FXN; (+) strand; PAM type: NRG; PAM sequence: GAG
caggtggatcacgagttcag

SEQ ID NO: 16783 - DNA, 20 bp, Artificial Sequence
  Description of Artificial Sequence: Synthetic oligonucleotide
  Target: FXN; (+) strand; PAM type: NRG; PAM sequence: TGG
tggatcacgagttcaggaga

SEQ ID NO: 16784 - DNA, 20 bp, Artificial Sequence
  Description of Artificial Sequence: Synthetic oligonucleotide
  Target: FXN; (+) strand; PAM type: NRG; PAM sequence: GAG
gatcacgagttcaggagatg

SEQ ID NO: 16785 - DNA, 20 bp, Artificial Sequence
  Description of Artificial Sequence: Synthetic oligonucleotide
  Target: FXN; (+) strand; PAM type: NRG; PAM sequence: TGG
tcaggagatggagaccatcc

SEQ ID NO: 16786 - DNA, 20 bp, Artificial Sequence
  Description of Artificial Sequence: Synthetic oligonucleotide
  Target: FXN; (+) strand; PAM type: NRG; PAM sequence: TAG
ctactaaaaatacaaaaaat

SEQ ID NO: 16787 - DNA, 20 bp, Artificial Sequence
  Description of Artificial Sequence: Synthetic oligonucleotide
  Target: FXN; (+) strand; PAM type: NRG; PAM sequence: CGG
taaaaatacaaaaaattagc

SEQ ID NO: 16788 - DNA, 20 bp, Artificial Sequence
  Description of Artificial Sequence: Synthetic oligonucleotide
  Target: FXN; (+) strand; PAM type: NRG; PAM sequence: GGG
aaaaatacaaaaaattagcc

SEQ ID NO: 16789 - DNA, 20 bp, Artificial Sequence
  Description of Artificial Sequence: Synthetic oligonucleotide
  Target: FXN; (+) strand; PAM type: NRG; PAM sequence: TGG
tacaaaaaattagccgggcg

SEQ ID NO: 16790 - DNA, 20 bp, Artificial Sequence
  Description of Artificial Sequence: Synthetic oligonucleotide
  Target: FXN; (+) strand; PAM type: NRG; PAM sequence: CGG
aaattagccgggcgtggtga

SEQ ID NO: 16791 - DNA, 20 bp, Artificial Sequence
  Description of Artificial Sequence: Synthetic oligonucleotide
  Target: FXN; (+) strand; PAM type: NRG; PAM sequence: GGG
aattagccgggcgtggtgac

SEQ ID NO: 16792 - DNA, 20 bp, Artificial Sequence
  Description of Artificial Sequence: Synthetic oligonucleotide
  Target: FXN; (+) strand; PAM type: NRG; PAM sequence: TAG
ggcgtggtgacgggtgcctg

SEQ ID NO: 16793 - DNA, 20 bp, Artificial Sequence
  Description of Artificial Sequence: Synthetic oligonucleotide
  Target: FXN; (+) strand; PAM type: NRG; PAM sequence: CGG
tgcctgtagtccccactact

SEQ ID NO: 16794 - DNA, 20 bp, Artificial Sequence
  Description of Artificial Sequence: Synthetic oligonucleotide
  Target: FXN; (+) strand; PAM type: NRG; PAM sequence: GGG
gcctgtagtccccactactc

SEQ ID NO: 16795 - DNA, 20 bp, Artificial Sequence
  Description of Artificial Sequence: Synthetic oligonucleotide
  Target: FXN; (+) strand; PAM type: NRG; PAM sequence: GAG
tccccactactcgggacgct

SEQ ID NO: 16796 - DNA, 20 bp, Artificial Sequence
  Description of Artificial Sequence: Synthetic oligonucleotide
  Target: FXN; (+) strand; PAM type: NRG; PAM sequence: AGG
ccccactactcgggacgctg

SEQ ID NO: 16797 - DNA, 20 bp, Artificial Sequence
  Description of Artificial Sequence: Synthetic oligonucleotide
  Target: FXN; (+) strand; PAM type: NRG; PAM sequence: CAG
cactactcgggacgctgagg

SEQ ID NO: 16798 - DNA, 20 bp, Artificial Sequence
  Description of Artificial Sequence: Synthetic oligonucleotide
  Target: FXN; (+) strand; PAM type: NRG; PAM sequence: AGG
actactcgggacgctgaggc

SEQ ID NO: 16799 - DNA, 20 bp, Artificial Sequence
  Description of Artificial Sequence: Synthetic oligonucleotide
  Target: FXN; (+) strand; PAM type: NRG; PAM sequence: GAG
tactcgggacgctgaggcag

SEQ ID NO: 16800 - DNA, 20 bp, Artificial Sequence
  Description of Artificial Sequence: Synthetic oligonucleotide
  Target: FXN; (+) strand; PAM type: NRG; PAM sequence: TGG
gggacgctgaggcaggagaa

SEQ ID NO: 16801 - DNA, 20 bp, Artificial Sequence
  Description of Artificial Sequence: Synthetic oligonucleotide
  Target: FXN; (+) strand; PAM type: NRG; PAM sequence: CGG
gcaggagaatggcgtgaacc

SEQ ID NO: 16802 - DNA, 20 bp, Artificial Sequence
  Description of Artificial Sequence: Synthetic oligonucleotide
  Target: FXN; (+) strand; PAM type: NRG; PAM sequence: GGG
caggagaatggcgtgaaccc

SEQ ID NO: 16803 - DNA, 20 bp, Artificial Sequence
  Description of Artificial Sequence: Synthetic oligonucleotide
  Target: FXN; (+) strand; PAM type: NRG; PAM sequence: GAG
ggagaatggcgtgaacccgg

SEQ ID NO: 16804 - DNA, 20 bp, Artificial Sequence
  Description of Artificial Sequence: Synthetic oligonucleotide
  Target: FXN; (+) strand; PAM type: NRG; PAM sequence: AGG
gagaatggcgtgaacccggg

SEQ ID NO: 16805 - DNA, 20 bp, Artificial Sequence
  Description of Artificial Sequence: Synthetic oligonucleotide
  Target: FXN; (+) strand; PAM type: NRG; PAM sequence: CAG
aatggcgtgaacccgggagg

SEQ ID NO: 16806 - DNA, 20 bp, Artificial Sequence
  Description of Artificial Sequence: Synthetic oligonucleotide
  Target: FXN; (+) strand; PAM type: NRG; PAM sequence: GAG
tggcgtgaacccgggaggca

SEQ ID NO: 16807 - DNA, 20 bp, Artificial Sequence
  Description of Artificial Sequence: Synthetic oligonucleotide
  Target: FXN; (+) strand; PAM type: NRG; PAM sequence: CAG
aacccgggaggcagagcttg

SEQ ID NO: 16808 - DNA, 20 bp, Artificial Sequence
  Description of Artificial Sequence: Synthetic oligonucleotide
  Target: FXN; (+) strand; PAM type: NRG; PAM sequence: GAG
ggcagagcttgcagtgatcc

SEQ ID NO: 16809 - DNA, 20 bp, Artificial Sequence
  Description of Artificial Sequence: Synthetic oligonucleotide
  Target: FXN; (+) strand; PAM type: NRG; PAM sequence: CAG
gagatcgtgccactgcactc

SEQ ID NO: 16810 - DNA, 20 bp, Artificial Sequence
  Description of Artificial Sequence: Synthetic oligonucleotide
  Target: FXN; (+) strand; PAM type: NRG; PAM sequence: TGG
cgtgccactgcactccagcc

SEQ ID NO: 16811 - DNA, 20 bp, Artificial Sequence
  Description of Artificial Sequence: Synthetic oligonucleotide
  Target: FXN; (+) strand; PAM type: NRG; PAM sequence: GGG
gtgccactgcactccagcct

SEQ ID NO: 16812 - DNA, 20 bp, Artificial Sequence
  Description of Artificial Sequence: Synthetic oligonucleotide
  Target: FXN; (+) strand; PAM type: NRG; PAM sequence: CAG
ctgcactccagcctgggtga

SEQ ID NO: 16813 - DNA, 20 bp, Artificial Sequence
  Description of Artificial Sequence: Synthetic oligonucleotide
  Target: FXN; (+) strand; PAM type: NRG; PAM sequence: GAG
gcactccagcctgggtgaca

SEQ ID NO: 16814 - DNA, 20 bp, Artificial Sequence
  Description of Artificial Sequence: Synthetic oligonucleotide
  Target: FXN; (+) strand; PAM type: NRG; PAM sequence: GAG
tccagcctgggtgacagagc

SEQ ID NO: 16815 - DNA, 20 bp, Artificial Sequence
  Description of Artificial Sequence: Synthetic oligonucleotide
  Target: FXN; (+) strand; PAM type: NRG; PAM sequence: AAG
cagagcgagactgcatctca

SEQ ID NO: 16816 - DNA, 20 bp, Artificial Sequence
  Description of Artificial Sequence: Synthetic oligonucleotide
  Target: FXN; (+) strand; PAM type: NRG; PAM sequence: TGG
taaactaataataaatgcta

SEQ ID NO: 16817 - DNA, 20 bp, Artificial Sequence
  Description of Artificial Sequence: Synthetic oligonucleotide
  Target: FXN; (+) strand; PAM type: NRG; PAM sequence: AAG
atgttaaaacctaatcacca

SEQ ID NO: 16818 - DNA, 20 bp, Artificial Sequence
  Description of Artificial Sequence: Synthetic oligonucleotide
  Target: FXN; (+) strand; PAM type: NRG; PAM sequence: TAG
cctaatcaccaaagtgatat

SEQ ID NO: 16819 - DNA, 20 bp, Artificial Sequence
  Description of Artificial Sequence: Synthetic oligonucleotide
  Target: FXN; (+) strand; PAM type: NRG; PAM sequence: AGG
ctaatcaccaaagtgatatt

SEQ ID NO: 16820 - DNA, 20 bp, Artificial Sequence
  Description of Artificial Sequence: Synthetic oligonucleotide
  Target: FXN; (+) strand; PAM type: NRG; PAM sequence: GAG
aatcaccaaagtgatattag

SEQ ID NO: 16821 - DNA, 20 bp, Artificial Sequence
  Description of Artificial Sequence: Synthetic oligonucleotide
  Target: FXN; (+) strand; PAM type: NRG; PAM sequence: AGG
atcaccaaagtgatattagg

SEQ ID NO: 16822 - DNA, 20 bp, Artificial Sequence
  Description of Artificial Sequence: Synthetic oligonucleotide
  Target: FXN; (+) strand; PAM type: NRG; PAM sequence: TGG
accaaagtgatattaggagg

SEQ ID NO: 16823 - DNA, 20 bp, Artificial Sequence
  Description of Artificial Sequence: Synthetic oligonucleotide
  Target: FXN; (+) strand; PAM type: NRG; PAM sequence: GGG
ccaaagtgatattaggaggt

SEQ ID NO: 16824 - DNA, 20 bp, Artificial Sequence
  Description of Artificial Sequence: Synthetic oligonucleotide
  Target: FXN; (+) strand; PAM type: NRG; PAM sequence: GGG
caaagtgatattaggaggtg

SEQ ID NO: 16825 - DNA, 20 bp, Artificial Sequence
  Description of Artificial Sequence: Synthetic oligonucleotide
  Target: FXN; (+) strand; PAM type: NRG; PAM sequence: TGG
atattaggaggtggggccct

SEQ ID NO: 16826 - DNA, 20 bp, Artificial Sequence
  Description of Artificial Sequence: Synthetic oligonucleotide
  Target: FXN; (+) strand; PAM type: NRG; PAM sequence: GGG
tattaggaggtggggccctt

SEQ ID NO: 16827 - DNA, 20 bp, Artificial Sequence
  Description of Artificial Sequence: Synthetic oligonucleotide
  Target: FXN; (+) strand; PAM type: NRG; PAM sequence: GAG
ttaggaggtggggcccttgg

SEQ ID NO: 16828 - DNA, 20 bp, Artificial Sequence
  Description of Artificial Sequence: Synthetic oligonucleotide
  Target: FXN; (+) strand; PAM type: NRG; PAM sequence: AGG
taggaggtggggcccttggg

SEQ ID NO: 16829 - DNA, 20 bp, Artificial Sequence
  Description of Artificial Sequence: Synthetic oligonucleotide
  Target: FXN; (+) strand; PAM type: NRG; PAM sequence: GAG
tggggcccttgggaggtgat

SEQ ID NO: 16830 - DNA, 20 bp, Artificial Sequence
  Description of Artificial Sequence: Synthetic oligonucleotide
  Target: FXN; (+) strand; PAM type: NRG; PAM sequence: AGG
ggggcccttgggaggtgatg

SEQ ID NO: 16831 - DNA, 20 bp, Artificial Sequence
  Description of Artificial Sequence: Synthetic oligonucleotide
  Target: FXN; (+) strand; PAM type: NRG; PAM sequence: GAG
cttgggaggtgatgaggtat

SEQ ID NO: 16832 - DNA, 20 bp, Artificial Sequence
  Description of Artificial Sequence: Synthetic oligonucleotide
  Target: FXN; (+) strand; PAM type: NRG; PAM sequence: AGG
ttgggaggtgatgaggtatg

SEQ ID NO: 16833 - DNA, 20 bp, Artificial Sequence
  Description of Artificial Sequence: Synthetic oligonucleotide
  Target: FXN; (+) strand; PAM type: NRG; PAM sequence: GGG
tgggaggtgatgaggtatga

SEQ ID NO: 16834 - DNA, 20 bp, Artificial Sequence
  Description of Artificial Sequence: Synthetic oligonucleotide
  Target: FXN; (+) strand; PAM type: NRG; PAM sequence: TGG
gaggtgatgaggtatgaggg

SEQ ID NO: 16835 - DNA, 20 bp, Artificial Sequence
  Description of Artificial Sequence: Synthetic oligonucleotide
  Target: FXN; (+) strand; PAM type: NRG; PAM sequence: GAG
ggtgatgaggtatgagggtg

SEQ ID NO: 16836 - DNA, 20 bp, Artificial Sequence
  Description of Artificial Sequence: Synthetic oligonucleotide
  Target: FXN; (+) strand; PAM type: NRG; PAM sequence: TGG
gagggtggagcccatatgat

SEQ ID NO: 16837 - DNA, 20 bp, Artificial Sequence
  Description of Artificial Sequence: Synthetic oligonucleotide
  Target: FXN; (+) strand; PAM type: NRG; PAM sequence: GGG
agggtggagcccatatgatt

SEQ ID NO: 16838 - DNA, 20 bp, Artificial Sequence
  Description of Artificial Sequence: Synthetic oligonucleotide
  Target: FXN; (+) strand; PAM type: NRG; PAM sequence: TAG
ggagcccatatgattgggat

SEQ ID NO: 16839 - DNA, 20 bp, Artificial Sequence
  Description of Artificial Sequence: Synthetic oligonucleotide
  Target: FXN; (+) strand; PAM type: NRG; PAM sequence: TAG
ggattagtgcccttctaaaa

SEQ ID NO: 16840 - DNA, 20 bp, Artificial Sequence
  Description of Artificial Sequence: Synthetic oligonucleotide
  Target: FXN; (+) strand; PAM type: NRG; PAM sequence: CGG
gcccttctaaaatagcccaa

SEQ ID NO: 16841 - DNA, 20 bp, Artificial Sequence
  Description of Artificial Sequence: Synthetic oligonucleotide
  Target: FXN; (+) strand; PAM type: NRG; PAM sequence: GAG
ccttctaaaatagcccaacg

SEQ ID NO: 16842 - DNA, 20 bp, Artificial Sequence
  Description of Artificial Sequence: Synthetic oligonucleotide
  Target: FXN; (+) strand; PAM type: NRG; PAM sequence: CAG
taaaatagcccaacggagcc

SEQ ID NO: 16843 - DNA, 20 bp, Artificial Sequence
  Description of Artificial Sequence: Synthetic oligonucleotide
  Target: FXN; (+) strand; PAM type: NRG; PAM sequence: AAG
gcccaacggagcccagtgac

SEQ ID NO: 16844 - DNA, 20 bp, Artificial Sequence
  Description of Artificial Sequence: Synthetic oligonucleotide
  Target: FXN; (+) strand; PAM type: NRG; PAM sequence: AGG
cccaacggagcccagtgaca

SEQ ID NO: 16845 - DNA, 20 bp, Artificial Sequence
  Description of Artificial Sequence: Synthetic oligonucleotide
  Target: FXN; (+) strand; PAM type: NRG; PAM sequence: CAG
acaaggcatcatctatgaac

SEQ ID NO: 16846 - DNA, 20 bp, Artificial Sequence
  Description of Artificial Sequence: Synthetic oligonucleotide
  Target: FXN; (+) strand; PAM type: NRG; PAM sequence: AGG
caaggcatcatctatgaacc

SEQ ID NO: 16847 - DNA, 20 bp, Artificial Sequence
  Description of Artificial Sequence: Synthetic oligonucleotide
  Target: FXN; (+) strand; PAM type: NRG; PAM sequence: TGG
tcatctatgaaccaggaaac

SEQ ID NO: 16848 - DNA, 20 bp, Artificial Sequence
  Description of Artificial Sequence: Synthetic oligonucleotide
  Target: FXN; (+) strand; PAM type: NRG; PAM sequence: CAG
accaggaaactggccctcac

SEQ ID NO: 16849 - DNA, 20 bp, Artificial Sequence
  Description of Artificial Sequence: Synthetic oligonucleotide
  Target: FXN; (+) strand; PAM type: NRG; PAM sequence: AAG
ctggccctcaccagacacca

SEQ ID NO: 16850 - DNA, 20 bp, Artificial Sequence
  Description of Artificial Sequence: Synthetic oligonucleotide
  Target: FXN; (+) strand; PAM type: NRG; PAM sequence: TGG
tcaccagacaccaaagctgt

SEQ ID NO: 16851 - DNA, 20 bp, Artificial Sequence
  Description of Artificial Sequence: Synthetic oligonucleotide
  Target: FXN; (+) strand; PAM type: NRG; PAM sequence: TGG
agctgttggtgcattgatct

SEQ ID NO: 16852 - DNA, 20 bp, Artificial Sequence
  Description of Artificial Sequence: Synthetic oligonucleotide
  Target: FXN; (+) strand; PAM type: NRG; PAM sequence: CAG
atcttggatttcccaccctc

SEQ ID NO: 16853 - DNA, 20 bp, Artificial Sequence
  Description of Artificial Sequence: Synthetic oligonucleotide
  Target: FXN; (+) strand; PAM type: NRG; PAM sequence: AGG
tcttggatttcccaccctcc

SEQ ID NO: 16854 - DNA, 20 bp, Artificial Sequence
  Description of Artificial Sequence: Synthetic oligonucleotide
  Target: FXN; (+) strand; PAM type: NRG; PAM sequence: AAG
ttcccaccctccaggactct

SEQ ID NO: 16855 - DNA, 20 bp, Artificial Sequence
  Description of Artificial Sequence: Synthetic oligonucleotide
  Target: FXN; (+) strand; PAM type: NRG; PAM sequence: AAG
aacacatttctattgtttat

SEQ ID NO: 16856 - DNA, 20 bp, Artificial Sequence
  Description of Artificial Sequence: Synthetic oligonucleotide
  Target: FXN; (+) strand; PAM type: NRG; PAM sequence: CAG
tctattgtttataagccacc

SEQ ID NO: 16857 - DNA, 20 bp, Artificial Sequence
  Description of Artificial Sequence: Synthetic oligonucleotide
  Target: FXN; (+) strand; PAM type: NRG; PAM sequence: TGG
attgtttataagccacccag

SEQ ID NO: 16858 - DNA, 20 bp, Artificial Sequence
  Description of Artificial Sequence: Synthetic oligonucleotide
  Target: FXN; (+) strand; PAM type: NRG; PAM sequence: TGG
tttataagccacccagtggc

SEQ ID NO: 16859 - DNA, 20 bp, Artificial Sequence
  Description of Artificial Sequence: Synthetic oligonucleotide
  Target: FXN; (+) strand; PAM type: NRG; PAM sequence: CAG
ggtattttgttataacatcc

SEQ ID NO: 16860 - DNA, 20 bp, Artificial Sequence
  Description of Artificial Sequence: Synthetic oligonucleotide
  Target: FXN; (+) strand; PAM type: NRG; PAM sequence: AAG
ttgttataacatcccagact

SEQ ID NO: 16861 - DNA, 20 bp, Artificial Sequence
  Description of Artificial Sequence: Synthetic oligonucleotide
  Target: FXN; (+) strand; PAM type: NRG; PAM sequence: CAG
aatacttgtatccctgacac

SEQ ID NO: 16862 - DNA, 20 bp, Artificial Sequence
  Description of Artificial Sequence: Synthetic oligonucleotide
  Target: FXN; (+) strand; PAM type: NRG; PAM sequence: AGG
atacttgtatccctgacacc

SEQ ID NO: 16863 - DNA, 20 bp, Artificial Sequence
  Description of Artificial Sequence: Synthetic oligonucleotide
  Target: FXN; (+) strand; PAM type: NRG; PAM sequence: AAG
tgtatccctgacaccaggtt

SEQ ID NO: 16864 - DNA, 20 bp, Artificial Sequence
  Description of Artificial Sequence: Synthetic oligonucleotide
  Target: FXN; (+) strand; PAM type: NRG; PAM sequence: GAG
tatccctgacaccaggttaa

SEQ ID NO: 16865 - DNA, 20 bp, Artificial Sequence
  Description of Artificial Sequence: Synthetic oligonucleotide
  Target: FXN; (+) strand; PAM type: NRG; PAM sequence: TAG
cctgacaccaggttaagaga

SEQ ID NO: 16866 - DNA, 20 bp, Artificial Sequence
  Description of Artificial Sequence: Synthetic oligonucleotide
  Target: FXN; (+) strand; PAM type: NRG; PAM sequence: TGG
atagaatttgtttgttcctc

SEQ ID NO: 16867 - DNA, 20 bp, Artificial Sequence
  Description of Artificial Sequence: Synthetic oligonucleotide
  Target: FXN; (+) strand; PAM type: NRG; PAM sequence: GAG
agaatttgtttgttcctctg

SEQ ID NO: 16868 - DNA, 20 bp, Artificial Sequence
  Description of Artificial Sequence: Synthetic oligonucleotide
  Target: FXN; (+) strand; PAM type: NRG; PAM sequence: AGG
gaatttgtttgttcctctgg

SEQ ID NO: 16869 - DNA, 20 bp, Artificial Sequence
  Description of Artificial Sequence: Synthetic oligonucleotide
  Target: FXN; (+) strand; PAM type: NRG; PAM sequence: TGG
catcactgccctgtcctccc

SEQ ID NO: 16870 - DNA, 20 bp, Artificial Sequence
  Description of Artificial Sequence: Synthetic oligonucleotide
  Target: FXN; (+) strand; PAM type: NRG; PAM sequence: GAG
tcactgccctgtcctccctg

SEQ ID NO: 16871 - DNA, 20 bp, Artificial Sequence
  Description of Artificial Sequence: Synthetic oligonucleotide
  Target: FXN; (+) strand; PAM type: NRG; PAM sequence: AGG
cactgccctgtcctccctgg

SEQ ID NO: 16872 - DNA, 20 bp, Artificial Sequence
  Description of Artificial Sequence: Synthetic oligonucleotide
  Target: FXN; (+) strand; PAM type: NRG; PAM sequence: CAG
tcctccctggaggaatctgc

SEQ ID NO: 16873 - DNA, 20 bp, Artificial Sequence
  Description of Artificial Sequence: Synthetic oligonucleotide
  Target: FXN; (+) strand; PAM type: NRG; PAM sequence: TAG
tcatcgtaccctccttttct

SEQ ID NO: 16874 - DNA, 20 bp, Artificial Sequence
  Description of Artificial Sequence: Synthetic oligonucleotide
  Target: FXN; (+) strand; PAM type: NRG; PAM sequence: GAG
atcgtaccctccttttctta

SEQ ID NO: 16875 - DNA, 20 bp, Artificial Sequence
  Description of Artificial Sequence: Synthetic oligonucleotide
  Target: FXN; (+) strand; PAM type: NRG; PAM sequence: AAG
tccatgtattgcttatatac

SEQ ID NO: 16876 - DNA, 20 bp, Artificial Sequence
  Description of Artificial Sequence: Synthetic oligonucleotide
  Target: FXN; (+) strand; PAM type: NRG; PAM sequence: AGG
ccatgtattgcttatataca

SEQ ID NO: 16877 - DNA, 20 bp, Artificial Sequence
  Description of Artificial Sequence: Synthetic oligonucleotide
  Target: FXN; (+) strand; PAM type: NRG; PAM sequence: TGG
ctgctgtatctgttctgcta

SEQ ID NO: 16878 - DNA, 20 bp, Artificial Sequence
  Description of Artificial Sequence: Synthetic oligonucleotide
  Target: FXN; (+) strand; PAM type: NRG; PAM sequence: CAG
gtcatctgcattgatgcatg

SEQ ID NO: 16879 - DNA, 20 bp, Artificial Sequence
  Description of Artificial Sequence: Synthetic oligonucleotide
  Target: FXN; (+) strand; PAM type: NRG; PAM sequence: TGG
cctttatttgttctcactgc

SEQ ID NO: 16880 - DNA, 20 bp, Artificial Sequence
  Description of Artificial Sequence: Synthetic oligonucleotide
  Target: FXN; (+) strand; PAM type: NRG; PAM sequence: TAG
tatttgttctcactgctgga

SEQ ID NO: 16881 - DNA, 20 bp, Artificial Sequence
  Description of Artificial Sequence: Synthetic oligonucleotide
  Target: FXN; (+) strand; PAM type: NRG; PAM sequence: TGG
tctcactgctggatagtatc

SEQ ID NO: 16882 - DNA, 20 bp, Artificial Sequence
  Description of Artificial Sequence: Synthetic oligonucleotide
  Target: FXN; (+) strand; PAM type: NRG; PAM sequence: TGG
actgctggatagtatctggt

SEQ ID NO: 16883 - DNA, 20 bp, Artificial Sequence
  Description of Artificial Sequence: Synthetic oligonucleotide
  Target: FXN; (+) strand; PAM type: NRG; PAM sequence: GGG
ctgctggatagtatctggtt

SEQ ID NO: 16884 - DNA, 20 bp, Artificial Sequence
  Description of Artificial Sequence: Synthetic oligonucleotide
  Target: FXN; (+) strand; PAM type: NRG; PAM sequence: CAG
acactgtaaatcacactatc

SEQ ID NO: 16885 - DNA, 20 bp, Artificial Sequence
  Description of Artificial Sequence: Synthetic oligonucleotide
  Target: FXN; (+) strand; PAM type: NRG; PAM sequence: AGG
cactgtaaatcacactatcc

SEQ ID NO: 16886 - DNA, 20 bp, Artificial Sequence
  Description of Artificial Sequence: Synthetic oligonucleotide
  Target: FXN; (+) strand; PAM type: NRG; PAM sequence: TAG
tcacactatccaggttcctt

SEQ ID NO: 16887 - DNA, 20 bp, Artificial Sequence
  Description of Artificial Sequence: Synthetic oligonucleotide
  Target: FXN; (+) strand; PAM type: NRG; PAM sequence: AGG
cacactatccaggttccttt

SEQ ID NO: 16888 - DNA, 20 bp, Artificial Sequence
  Description of Artificial Sequence: Synthetic oligonucleotide
  Target: FXN; (+) strand; PAM type: NRG; PAM sequence: TGG
aggttcctttaggtgacatt

SEQ ID NO: 16889 - DNA, 20 bp, Artificial Sequence
  Description of Artificial Sequence: Synthetic oligonucleotide
  Target: FXN; (+) strand; PAM type: NRG; PAM sequence: CAG
aggtgacatttggttgattg

SEQ ID NO: 16890 - DNA, 20 bp, Artificial Sequence
  Description of Artificial Sequence: Synthetic oligonucleotide
  Target: FXN; (+) strand; PAM type: NRG; PAM sequence: TGG
gcagtgttctgttgttacga

SEQ ID NO: 16891 - DNA, 20 bp, Artificial Sequence
  Description of Artificial Sequence: Synthetic oligonucleotide
  Target: FXN; (+) strand; PAM type: NRG; PAM sequence: TGG
gctgtgactgttcttgtgca

SEQ ID NO: 16892 - DNA, 20 bp, Artificial Sequence
  Description of Artificial Sequence: Synthetic oligonucleotide
  Target: FXN; (+) strand; PAM type: NRG; PAM sequence: CAG
tgactgttcttgtgcatgga

SEQ ID NO: 16893 - DNA, 20 bp, Artificial Sequence
  Description of Artificial Sequence: Synthetic oligonucleotide
  Target: FXN; (+) strand; PAM type: NRG; PAM sequence: AAG
ctgttcttgtgcatggacag

SEQ ID NO: 16894 - DNA, 20 bp, Artificial Sequence
  Description of Artificial Sequence: Synthetic oligonucleotide
  Target: FXN; (+) strand; PAM type: NRG; PAM sequence: CAG
gcatggacagaagttccttt

SEQ ID NO: 16895 - DNA, 20 bp, Artificial Sequence
  Description of Artificial Sequence: Synthetic oligonucleotide
  Target: FXN; (+) strand; PAM type: NRG; PAM sequence: AGG
catggacagaagttcctttc

SEQ ID NO: 16896 - DNA, 20 bp, Artificial Sequence
  Description of Artificial Sequence: Synthetic oligonucleotide
  Target: FXN; (+) strand; PAM type: NRG; PAM sequence: CAG
ttcctttcaggtgaatttct

SEQ ID NO: 16897 - DNA, 20 bp, Artificial Sequence
  Description of Artificial Sequence: Synthetic oligonucleotide
  Target: FXN; (+) strand; PAM type: NRG; PAM sequence: TGG
ttcaggtgaatttctcagaa

SEQ ID NO: 16898 - DNA, 20 bp, Artificial Sequence
  Description of Artificial Sequence: Synthetic oligonucleotide
  Target: FXN; (+) strand; PAM type: NRG; PAM sequence: TGG
atttctcagaatggaattgc

SEQ ID NO: 16899 - DNA, 20 bp, Artificial Sequence
  Description of Artificial Sequence: Synthetic oligonucleotide
  Target: FXN; (+) strand; PAM type: NRG; PAM sequence: GGG
tttctcagaatggaattgct

SEQ ID NO: 16900 - DNA, 20 bp, Artificial Sequence
  Description of Artificial Sequence: Synthetic oligonucleotide
  Target: FXN; (+) strand; PAM type: NRG; PAM sequence: AAG
cagaatggaattgctgggca

SEQ ID NO: 16901 - DNA, 20 bp, Artificial Sequence
  Description of Artificial Sequence: Synthetic oligonucleotide
  Target: FXN; (+) strand; PAM type: NRG; PAM sequence: AGG
agaatggaattgctgggcaa

SEQ ID NO: 16902 - DNA, 20 bp, Artificial Sequence
  Description of Artificial Sequence: Synthetic oligonucleotide
  Target: FXN; (+) strand; PAM type: NRG; PAM sequence: GGG
gaatggaattgctgggcaaa

SEQ ID NO: 16903 - DNA, 20 bp, Artificial Sequence
  Description of Artificial Sequence: Synthetic oligonucleotide
  Target: FXN; (+) strand; PAM type: NRG; PAM sequence: GGG
aatggaattgctgggcaaag

SEQ ID NO: 16904 - DNA, 20 bp, Artificial Sequence
  Description of Artificial Sequence: Synthetic oligonucleotide
  Target: FXN; (+) strand; PAM type: NRG; PAM sequence: CAG
ggaattgctgggcaaagggg

SEQ ID NO: 16905 - DNA, 20 bp, Artificial Sequence
  Description of Artificial Sequence: Synthetic oligonucleotide
  Target: FXN; (+) strand; PAM type: NRG; PAM sequence: AAG
atcaactcatttgatgccaa

SEQ ID NO: 16906 - DNA, 20 bp, Artificial Sequence
  Description of Artificial Sequence: Synthetic oligonucleotide
  Target: FXN; (+) strand; PAM type: NRG; PAM sequence: TGG
aactcatttgatgccaaaag

SEQ ID NO: 16907 - DNA, 20 bp, Artificial Sequence
  Description of Artificial Sequence: Synthetic oligonucleotide
  Target: FXN; (+) strand; PAM type: NRG; PAM sequence: TGG
tcatttgatgccaaaagtgg

SEQ ID NO: 16908 - DNA, 20 bp, Artificial Sequence
  Description of Artificial Sequence: Synthetic oligonucleotide
  Target: FXN; (+) strand; PAM type: NRG; PAM sequence: CAG
gatgccaaaagtggtggtgc

SEQ ID NO: 16909 - DNA, 20 bp, Artificial Sequence
  Description of Artificial Sequence: Synthetic oligonucleotide
  Target: FXN; (+) strand; PAM type: NRG; PAM sequence: GAG
gccagttcatcctcccctgc

SEQ ID NO: 16910 - DNA, 20 bp, Artificial Sequence
  Description of Artificial Sequence: Synthetic oligonucleotide
  Target: FXN; (+) strand; PAM type: NRG; PAM sequence: AGG
ccagttcatcctcccctgcg

SEQ ID NO: 16911 - DNA, 20 bp, Artificial Sequence
  Description of Artificial Sequence: Synthetic oligonucleotide
  Target: FXN; (+) strand; PAM type: NRG; PAM sequence: TGG
tcatcctcccctgcgaggta

SEQ ID NO: 16912 - DNA, 20 bp, Artificial Sequence
  Description of Artificial Sequence: Synthetic oligonucleotide
  Target: FXN; (+) strand; PAM type: NRG; PAM sequence: GGG
catcctcccctgcgaggtat

SEQ ID NO: 16913 - DNA, 20 bp, Artificial Sequence
  Description of Artificial Sequence: Synthetic oligonucleotide
  Target: FXN; (+) strand; PAM type: NRG; PAM sequence: AAG
tgggtcctgattcactcttc

SEQ ID NO: 16914 - DNA, 20 bp, Artificial Sequence
  Description of Artificial Sequence: Synthetic oligonucleotide
  Target: FXN; (+) strand; PAM type: NRG; PAM sequence: TGG
gattcactcttcaagtgctg

SEQ ID NO: 16915 - DNA, 20 bp, Artificial Sequence
  Description of Artificial Sequence: Synthetic oligonucleotide
  Target: FXN; (+) strand; PAM type: NRG; PAM sequence: CAG
cttcaagtgctgtggtttga

SEQ ID NO: 16916 - DNA, 20 bp, Artificial Sequence
  Description of Artificial Sequence: Synthetic oligonucleotide
  Target: FXN; (+) strand; PAM type: NRG; PAM sequence: AGG
ttcaagtgctgtggtttgac

SEQ ID NO: 16917 - DNA, 20 bp, Artificial Sequence
  Description of Artificial Sequence: Synthetic oligonucleotide
  Target: FXN; (+) strand; PAM type: NRG; PAM sequence: GGG
tcaagtgctgtggtttgaca

SEQ ID NO: 16918 - DNA, 20 bp, Artificial Sequence
  Description of Artificial Sequence: Synthetic oligonucleotide
  Target: FXN; (+) strand; PAM type: NRG; PAM sequence: CGG
gtgctgtggtttgacagggc

SEQ ID NO: 16919 - DNA, 20 bp, Artificial Sequence
  Description of Artificial Sequence: Synthetic oligonucleotide
  Target: FXN; (+) strand; PAM type: NRG; PAM sequence: GGG
tgctgtggtttgacagggcc

SEQ ID NO: 16920 - DNA, 20 bp, Artificial Sequence
  Description of Artificial Sequence: Synthetic oligonucleotide
  Target: FXN; (+) strand; PAM type: NRG; PAM sequence: GGG
gctgtggtttgacagggccg

SEQ ID NO: 16921 - DNA, 20 bp, Artificial Sequence
  Description of Artificial Sequence: Synthetic oligonucleotide
  Target: FXN; (+) strand; PAM type: NRG; PAM sequence: GGG
ctgtggtttgacagggccgg

SEQ ID NO: 16922 - DNA, 20 bp, Artificial Sequence
  Description of Artificial Sequence: Synthetic oligonucleotide
  Target: FXN; (+) strand; PAM type: NRG; PAM sequence: AAG
ttgacagggccgggggtgac

SEQ ID NO: 16923 - DNA, 20 bp, Artificial Sequence
  Description of Artificial Sequence: Synthetic oligonucleotide
  Target: FXN; (+) strand; PAM type: NRG; PAM sequence: AGG
tgacagggccgggggtgaca

SEQ ID NO: 16924 - DNA, 20 bp, Artificial Sequence
  Description of Artificial Sequence: Synthetic oligonucleotide
  Target: FXN; (+) strand; PAM type: NRG; PAM sequence: GGG
gacagggccgggggtgacaa

SEQ ID NO: 16925 - DNA, 20 bp, Artificial Sequence
  Description of Artificial Sequence: Synthetic oligonucleotide
  Target: FXN; (+) strand; PAM type: NRG; PAM sequence: GGG
acagggccgggggtgacaag

SEQ ID NO: 16926 - DNA, 20 bp, Artificial Sequence
  Description of Artificial Sequence: Synthetic oligonucleotide
  Target: FXN; (+) strand; PAM type: NRG; PAM sequence: TGG
gggggtgacaaggggacacc

SEQ ID NO: 16927 - DNA, 20 bp, Artificial Sequence
  Description of Artificial Sequence: Synthetic oligonucleotide
  Target: FXN; (+) strand; PAM type: NRG; PAM sequence: GGG
ggggtgacaaggggacacct

SEQ ID NO: 16928 - DNA, 20 bp, Artificial Sequence
  Description of Artificial Sequence: Synthetic oligonucleotide
  Target: FXN; (+) strand; PAM type: NRG; PAM sequence: AAG
gtgacaaggggacacctggg

SEQ ID NO: 16929 - DNA, 20 bp, Artificial Sequence
  Description of Artificial Sequence: Synthetic oligonucleotide
  Target: FXN; (+) strand; PAM type: NRG; PAM sequence: AGG
tgacaaggggacacctggga

SEQ ID NO: 16930 - DNA, 20 bp, Artificial Sequence
  Description of Artificial Sequence: Synthetic oligonucleotide
  Target: FXN; (+) strand; PAM type: NRG; PAM sequence: AAG
aaggggacacctgggaagga

SEQ ID NO: 16931 - DNA, 20 bp, Artificial Sequence
  Description of Artificial Sequence: Synthetic oligonucleotide
  Target: FXN; (+) strand; PAM type: NRG; PAM sequence: TGG
ggacacctgggaaggaaagc

SEQ ID NO: 16932 - DNA, 20 bp, Artificial Sequence
  Description of Artificial Sequence: Synthetic oligonucleotide
  Target: FXN; (+) strand; PAM type: NRG; PAM sequence: GGG
gacacctgggaaggaaagct

SEQ ID NO: 16933 - DNA, 20 bp, Artificial Sequence
  Description of Artificial Sequence: Synthetic oligonucleotide
  Target: FXN; (+) strand; PAM type: NRG; PAM sequence: TGG
aggaaagctgggctccctgc

SEQ ID NO: 16934 - DNA, 20 bp, Artificial Sequence
  Description of Artificial Sequence: Synthetic oligonucleotide
  Target: FXN; (+) strand; PAM type: NRG; PAM sequence: CAG
tgggctccctgctggccatc

SEQ ID NO: 16935 - DNA, 20 bp, Artificial Sequence
  Description of Artificial Sequence: Synthetic oligonucleotide
  Target: FXN; (+) strand; PAM type: NRG; PAM sequence: AGG
gggctccctgctggccatcc

SEQ ID NO: 16936 - DNA, 20 bp, Artificial Sequence
  Description of Artificial Sequence: Synthetic oligonucleotide
  Target: FXN; (+) strand; PAM type: NRG; PAM sequence: CAG
tccctgctggccatccaggc

SEQ ID NO: 16937 - DNA, 20 bp, Artificial Sequence
  Description of Artificial Sequence: Synthetic oligonucleotide
  Target: FXN; (+) strand; PAM type: NRG; PAM sequence: CAG
ccatccaggccagtccttac

SEQ ID NO: 16938 - DNA, 20 bp, Artificial Sequence
  Description of Artificial Sequence: Synthetic oligonucleotide
  Target: FXN; (+) strand; PAM type: NRG; PAM sequence: AGG
catccaggccagtccttacc

SEQ ID NO: 16939 - DNA, 20 bp, Artificial Sequence
  Description of Artificial Sequence: Synthetic oligonucleotide
  Target: FXN; (+) strand; PAM type: NRG; PAM sequence: GGG
atccaggccagtccttacca

SEQ ID NO: 16940 - DNA, 20 bp, Artificial Sequence
  Description of Artificial Sequence: Synthetic oligonucleotide
  Target: FXN; (+) strand; PAM type: NRG; PAM sequence: GGG
tccaggccagtccttaccag

SEQ ID NO: 16941 - DNA, 20 bp, Artificial Sequence
  Description of Artificial Sequence: Synthetic oligonucleotide
  Target: FXN; (+) strand; PAM type: NRG; PAM sequence: GGG
ccaggccagtccttaccagg

SEQ ID NO: 16942 - DNA, 20 bp, Artificial Sequence
  Description of Artificial Sequence: Synthetic oligonucleotide
  Target: FXN; (+) strand; PAM type: NRG; PAM sequence: TAG
ggccagtccttaccaggggg

SEQ ID NO: 16943 - DNA, 20 bp, Artificial Sequence
  Description of Artificial Sequence: Synthetic oligonucleotide
  Target: FXN; (+) strand; PAM type: NRG; PAM sequence: AGG
gccagtccttaccagggggt

SEQ ID NO: 16944 - DNA, 20 bp, Artificial Sequence
  Description of Artificial Sequence: Synthetic oligonucleotide
  Target: FXN; (+) strand; PAM type: NRG; PAM sequence: TGG
accagggggtaggcaatgat

SEQ ID NO: 16945 - DNA, 20 bp, Artificial Sequence
  Description of Artificial Sequence: Synthetic oligonucleotide
  Target: FXN; (+) strand; PAM type: NRG; PAM sequence: GGG
ccagggggtaggcaatgatt

SEQ ID NO: 16946 - DNA, 20 bp, Artificial Sequence
  Description of Artificial Sequence: Synthetic oligonucleotide
  Target: FXN; (+) strand; PAM type: NRG; PAM sequence: AAG
gggtaggcaatgattgggtc

SEQ ID NO: 16947 - DNA, 20 bp, Artificial Sequence
  Description of Artificial Sequence: Synthetic oligonucleotide
  Target: FXN; (+) strand; PAM type: NRG; PAM sequence: TGG
taggcaatgattgggtcaag

SEQ ID NO: 16948 - DNA, 20 bp, Artificial Sequence
  Description of Artificial Sequence: Synthetic oligonucleotide
  Target: FXN; (+) strand; PAM type: NRG; PAM sequence: TGG
gtcaagtggttcctgaccac

SEQ ID NO: 16949 - DNA, 20 bp, Artificial Sequence
  Description of Artificial Sequence: Synthetic oligonucleotide
  Target: FXN; (+) strand; PAM type: NRG; PAM sequence: GGG
tcaagtggttcctgaccact

SEQ ID NO: 16950 - DNA, 20 bp, Artificial Sequence
  Description of Artificial Sequence: Synthetic oligonucleotide
  Target: FXN; (+) strand; PAM type: NRG; PAM sequence: GAG
ggttcctgaccactgggcct

SEQ ID NO: 16951 - DNA, 20 bp, Artificial Sequence
  Description of Artificial Sequence: Synthetic oligonucleotide
  Target: FXN; (+) strand; PAM type: NRG; PAM sequence: CAG
gaccactgggcctgagactt

SEQ ID NO: 16952 - DNA, 20 bp, Artificial Sequence
  Description of Artificial Sequence: Synthetic oligonucleotide
  Target: FXN; (+) strand; PAM type: NRG; PAM sequence: AGG
accactgggcctgagacttc

SEQ ID NO: 16953 - DNA, 20 bp, Artificial Sequence
  Description of Artificial Sequence: Synthetic oligonucleotide
  Target: FXN; (+) strand; PAM type: NRG; PAM sequence: CAG
tgggcctgagacttcaggcc

SEQ ID NO: 16954 - DNA, 20 bp, Artificial Sequence
  Description of Artificial Sequence: Synthetic oligonucleotide
  Target: FXN; (+) strand; PAM type: NRG; PAM sequence: GAG
tttcctcaaatgcatcccat

SEQ ID NO: 16955 - DNA, 20 bp, Artificial Sequence
  Description of Artificial Sequence: Synthetic oligonucleotide
  Target: FXN; (+) strand; PAM type: NRG; PAM sequence: CAG
cctcaaatgcatcccatgag

SEQ ID NO: 16956 - DNA, 20 bp, Artificial Sequence
  Description of Artificial Sequence: Synthetic oligonucleotide
  Target: FXN; (+) strand; PAM type: NRG; PAM sequence: AGG
ctcaaatgcatcccatgagc

SEQ ID NO: 16957 - DNA, 20 bp, Artificial Sequence
  Description of Artificial Sequence: Synthetic oligonucleotide
  Target: FXN; (+) strand; PAM type: NRG; PAM sequence: GAG
cccatgagcaggcactgtgt

SEQ ID NO: 16958 - DNA, 20 bp, Artificial Sequence
  Description of Artificial Sequence: Synthetic oligonucleotide
  Target: FXN; (+) strand; PAM type: NRG; PAM sequence: GAG
tgagcaggcactgtgtgagt

SEQ ID NO: 16959 - DNA, 20 bp, Artificial Sequence
  Description of Artificial Sequence: Synthetic oligonucleotide
  Target: FXN; (+) strand; PAM type: NRG; PAM sequence: AAG
tgagtgagcacacacatctg

SEQ ID NO: 16960 - DNA, 20 bp, Artificial Sequence
  Description of Artificial Sequence: Synthetic oligonucleotide
  Target: FXN; (+) strand; PAM type: NRG; PAM sequence: AAG
gcacacacatctgaagcctc

SEQ ID NO: 16961 - DNA, 20 bp, Artificial Sequence
  Description of Artificial Sequence: Synthetic oligonucleotide
  Target: FXN; (+) strand; PAM type: NRG; PAM sequence: TAG
acacatctgaagcctcaagc

SEQ ID NO: 16962 - DNA, 20 bp, Artificial Sequence
  Description of Artificial Sequence: Synthetic oligonucleotide
  Target: FXN; (+) strand; PAM type: NRG; PAM sequence: AGG
cacatctgaagcctcaagct

SEQ ID NO: 16963 - DNA, 20 bp, Artificial Sequence
  Description of Artificial Sequence: Synthetic oligonucleotide
  Target: FXN; (+) strand; PAM type: NRG; PAM sequence: AAG
tctgaagcctcaagctaggc

SEQ ID NO: 16964 - DNA, 20 bp, Artificial Sequence
  Description of Artificial Sequence: Synthetic oligonucleotide
  Target: FXN; (+) strand; PAM type: NRG; PAM sequence: TGG
ggcaagcctaccatgacttg

SEQ ID NO: 16965 - DNA, 20 bp, Artificial Sequence
  Description of Artificial Sequence: Synthetic oligonucleotide
  Target: FXN; (+) strand; PAM type: NRG; PAM sequence: AAG
cctaccatgacttgtggtcc

SEQ ID NO: 16966 - DNA, 20 bp, Artificial Sequence
  Description of Artificial Sequence: Synthetic oligonucleotide
  Target: FXN; (+) strand; PAM type: NRG; PAM sequence: AGG
ctaccatgacttgtggtcca

SEQ ID NO: 16967 - DNA, 20 bp, Artificial Sequence
  Description of Artificial Sequence: Synthetic oligonucleotide
  Target: FXN; (+) strand; PAM type: NRG; PAM sequence: GGG
taccatgacttgtggtccaa

SEQ ID NO: 16968 - DNA, 20 bp, Artificial Sequence
  Description of Artificial Sequence: Synthetic oligonucleotide
  Target: FXN; (+) strand; PAM type: NRG; PAM sequence: CGG
acttgtggtccaagggctca

SEQ ID NO: 16969 - DNA, 20 bp, Artificial Sequence
  Description of Artificial Sequence: Synthetic oligonucleotide
  Target: FXN; (+) strand; PAM type: NRG; PAM sequence: GGG
cttgtggtccaagggctcac

SEQ ID NO: 16970 - DNA, 20 bp, Artificial Sequence
  Description of Artificial Sequence: Synthetic oligonucleotide
  Target: FXN; (+) strand; PAM type: NRG; PAM sequence: TGG
ccaagggctcacgggtgacc

SEQ ID NO: 16971 - DNA, 20 bp, Artificial Sequence
  Description of Artificial Sequence: Synthetic oligonucleotide
  Target: FXN; (+) strand; PAM type: NRG; PAM sequence: GAG
aagggctcacgggtgacctg

SEQ ID NO: 16972 - DNA, 20 bp, Artificial Sequence
  Description of Artificial Sequence: Synthetic oligonucleotide
  Target: FXN; (+) strand; PAM type: NRG; PAM sequence: TAG
gctcacgggtgacctggagt

SEQ ID NO: 16973 - DNA, 20 bp, Artificial Sequence
  Description of Artificial Sequence: Synthetic oligonucleotide
  Target: FXN; (+) strand; PAM type: NRG; PAM sequence: GAG
tcacgggtgacctggagtta

SEQ ID NO: 16974 - DNA, 20 bp, Artificial Sequence
  Description of Artificial Sequence: Synthetic oligonucleotide
  Target: FXN; (+) strand; PAM type: NRG; PAM sequence: AGG
cacgggtgacctggagttag

SEQ ID NO: 16975 - DNA, 20 bp, Artificial Sequence
  Description of Artificial Sequence: Synthetic oligonucleotide
  Target: FXN; (+) strand; PAM type: NRG; PAM sequence: GGG
acgggtgacctggagttaga

SEQ ID NO: 16976 - DNA, 20 bp, Artificial Sequence
  Description of Artificial Sequence: Synthetic oligonucleotide
  Target: FXN; (+) strand; PAM type: NRG; PAM sequence: GAG
gggtgacctggagttagagg

SEQ ID NO: 16977 - DNA, 20 bp, Artificial Sequence
  Description of Artificial Sequence: Synthetic oligonucleotide
  Target: FXN; (+) strand; PAM type: NRG; PAM sequence: TGG
cctggagttagagggagaca

SEQ ID NO: 16978 - DNA, 20 bp, Artificial Sequence
  Description of Artificial Sequence: Synthetic oligonucleotide
  Target: FXN; (+) strand; PAM type: NRG; PAM sequence: CAG
ttagagggagacatggctgc

SEQ ID NO: 16979 - DNA, 20 bp, Artificial Sequence
  Description of Artificial Sequence: Synthetic oligonucleotide
  Target: FXN; (+) strand; PAM type: NRG; PAM sequence: AGG
tagagggagacatggctgcc

SEQ ID NO: 16980 - DNA, 20 bp, Artificial Sequence
  Description of Artificial Sequence: Synthetic oligonucleotide
  Target: FXN; (+) strand; PAM type: NRG; PAM sequence: TGG
agggagacatggctgccagg

SEQ ID NO: 16981 - DNA, 20 bp, Artificial Sequence
  Description of Artificial Sequence: Synthetic oligonucleotide
  Target: FXN; (+) strand; PAM type: NRG; PAM sequence: TAG
acatggctgccaggtggctt

SEQ ID NO: 16982 - DNA, 20 bp, Artificial Sequence
  Description of Artificial Sequence: Synthetic oligonucleotide
  Target: FXN; (+) strand; PAM type: NRG; PAM sequence: AAG
ggctgccaggtggctttaga

SEQ ID NO: 16983 - DNA, 20 bp, Artificial Sequence
  Description of Artificial Sequence: Synthetic oligonucleotide
  Target: FXN; (+) strand; PAM type: NRG; PAM sequence: TGG
tttagaaagaacactcatca

SEQ ID NO: 16984 - DNA, 20 bp, Artificial Sequence
  Description of Artificial Sequence: Synthetic oligonucleotide
  Target: FXN; (+) strand; PAM type: NRG; PAM sequence: CAG
gaaagaacactcatcatggc

SEQ ID NO: 16985 - DNA, 20 bp, Artificial Sequence
  Description of Artificial Sequence: Synthetic oligonucleotide
  Target: FXN; (+) strand; PAM type: NRG; PAM sequence: AGG
aaagaacactcatcatggcc

SEQ ID NO: 16986 - DNA, 20 bp, Artificial Sequence
  Description of Artificial Sequence: Synthetic oligonucleotide
  Target: FXN; (+) strand; PAM type: NRG; PAM sequence: CGG
acactcatcatggccaggtg

SEQ ID NO: 16987 - DNA, 20 bp, Artificial Sequence
  Description of Artificial Sequence: Synthetic oligonucleotide
  Target: FXN; (+) strand; PAM type: NRG; PAM sequence: TGG
ctcatcatggccaggtgcgg

SEQ ID NO: 16988 - DNA, 20 bp, Artificial Sequence
  Description of Artificial Sequence: Synthetic oligonucleotide
  Target: FXN; (+) strand; PAM type: NRG; PAM sequence: CAG
gtggcttacgcctgtaatcc

SEQ ID NO: 16989 - DNA, 20 bp, Artificial Sequence
  Description of Artificial Sequence: Synthetic oligonucleotide
  Target: FXN; (+) strand; PAM type: NRG; PAM sequence: TGG
cgcctgtaatcccagcactt

SEQ ID NO: 16990 - DNA, 20 bp, Artificial Sequence
  Description of Artificial Sequence: Synthetic oligonucleotide
  Target: FXN; (+) strand; PAM type: NRG; PAM sequence: GGG
gcctgtaatcccagcacttt

SEQ ID NO: 16991 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttgg

SEQ ID NO: 16992 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttggg

SEQ ID NO: 16993 - DNA, 20 bp, Artificial Sequence
  Description of Artificial Sequence: Synthetic oligonucleotide
  Target: FXN; (+) strand; PAM type: NRG; PAM sequence: AAG
tcccagcactttgggaggcc

SEQ ID NO: 16994 - DNA, 20 bp, Artificial Sequence
  Description of Artificial Sequence: Synthetic oligonucleotide
  Target: FXN; (+) strand; PAM type: NRG; PAM sequence: AGG
cccagcactttgggaggcca

SEQ ID NO: 16995 - DNA, 20 bp, Artificial Sequence
  Description of Artificial Sequence: Synthetic oligonucleotide
  Target: FXN; (+) strand; PAM type: NRG; PAM sequence: TGG
agcactttgggaggccaagg

SEQ ID NO: 16996 - DNA, 20 bp, Artificial Sequence
  Description of Artificial Sequence: Synthetic oligonucleotide
  Target: FXN; (+) strand; PAM type: NRG; PAM sequence: GGG
gcactttgggaggccaaggt

SEQ ID NO: 16997 - DNA, 20 bp, Artificial Sequence
  Description of Artificial Sequence: Synthetic oligonucleotide
  Target: FXN; (+) strand; PAM type: NRG; PAM sequence: TGG
ctttgggaggccaaggtggg

SEQ ID NO: 16998 - DNA, 20 bp, Artificial Sequence
  Description of Artificial Sequence: Synthetic oligonucleotide
  Target: FXN; (+) strand; PAM type: NRG; PAM sequence: GAG
ggccaaggtgggtggatcat

SEQ ID NO: 16999 - DNA, 20 bp, Artificial Sequence
  Description of Artificial Sequence: Synthetic oligonucleotide
  Target: FXN; (+) strand; PAM type: NRG; PAM sequence: AGG
gccaaggtgggtggatcatg

SEQ ID NO: 17000 - DNA, 20 bp, Artificial Sequence
  Description of Artificial Sequence: Synthetic oligonucleotide
  Target: FXN; (+) strand; PAM type: NRG; PAM sequence: CAG
aggtgggtggatcatgaggt

SEQ ID NO: 17001 - DNA, 20 bp, Artificial Sequence
  Description of Artificial Sequence: Synthetic oligonucleotide
  Target: FXN; (+) strand; PAM type: NRG; PAM sequence: AGG
ggtgggtggatcatgaggtc

SEQ ID NO: 17002 - DNA, 20 bp, Artificial Sequence
  Description of Artificial Sequence: Synthetic oligonucleotide
  Target: FXN; (+) strand; PAM type: NRG; PAM sequence: GAG
tgggtggatcatgaggtcag

SEQ ID NO: 17003 - DNA, 20 bp, Artificial Sequence
  Description of Artificial Sequence: Synthetic oligonucleotide
  Target: FXN; (+) strand; PAM type: NRG; PAM sequence: GAG
tggatcatgaggtcaggagt

SEQ ID NO: 17004 - DNA, 20 bp, Artificial Sequence
  Description of Artificial Sequence: Synthetic oligonucleotide
  Target: FXN; (+) strand; PAM type: NRG; PAM sequence: CAG
catgaggtcaggagtgagac

SEQ ID NO: 17005 - DNA, 20 bp, Artificial Sequence
  Description of Artificial Sequence: Synthetic oligonucleotide
  Target: FXN; (+) strand; PAM type: NRG; PAM sequence: TAG
tctcctaaaaacacaaaaat

SEQ ID NO: 17006 - DNA, 20 bp, Artificial Sequence
  Description of Artificial Sequence: Synthetic oligonucleotide
  Target: FXN; (+) strand; PAM type: NRG; PAM sequence: TGG
ctaaaaacacaaaaattagc

SEQ ID NO: 17007 - DNA, 20 bp, Artificial Sequence
  Description of Artificial Sequence: Synthetic oligonucleotide
  Target: FXN; (+) strand; PAM type: NRG; PAM sequence: GGG
taaaaacacaaaaattagct

SEQ ID NO: 17008 - DNA, 20 bp, Artificial Sequence
  Description of Artificial Sequence: Synthetic oligonucleotide
  Target: FXN; (+) strand; PAM type: NRG; PAM sequence: TGG
acacaaaaattagctgggca

SEQ ID NO: 17009 - DNA, 20 bp, Artificial Sequence
  Description of Artificial Sequence: Synthetic oligonucleotide
  Target: FXN; (+) strand; PAM type: NRG; PAM sequence: GAG
acaaaaattagctgggcatg

SEQ ID NO: 17010 - DNA, 20 bp, Artificial Sequence
  Description of Artificial Sequence: Synthetic oligonucleotide
  Target: FXN; (+) strand; PAM type: NRG; PAM sequence: AGG
caaaaattagctgggcatgg

SEQ ID NO: 17011 - DNA, 20 bp, Artificial Sequence
  Description of Artificial Sequence: Synthetic oligonucleotide
  Target: FXN; (+) strand; PAM type: NRG; PAM sequence: CAG
gaggtgcacgcctgtaatcc

SEQ ID NO: 17012 - DNA, 20 bp, Artificial Sequence
  Description of Artificial Sequence: Synthetic oligonucleotide
  Target: FXN; (+) strand; PAM type: NRG; PAM sequence: CAG
cgcctgtaatcccagctact

SEQ ID NO: 17013 - DNA, 20 bp, Artificial Sequence
  Description of Artificial Sequence: Synthetic oligonucleotide
  Target: FXN; (+) strand; PAM type: NRG; PAM sequence: AGG
gcctgtaatcccagctactc

SEQ ID NO: 17014 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagctactcag

SEQ ID NO: 17015 - DNA, 20 bp, Artificial Sequence
  Description of Artificial Sequence: Synthetic oligonucleotide
  Target: FXN; (+) strand; PAM type: NRG; PAM sequence: AGG
tgtaatcccagctactcagg

SEQ ID NO: 17016 - DNA, 20 bp, Artificial Sequence
  Description of Artificial Sequence: Synthetic oligonucleotide
  Target: FXN; (+) strand; PAM type: NRG; PAM sequence: GAG
tcccagctactcaggaggct

SEQ ID NO: 17017 - DNA, 20 bp, Artificial Sequence
  Description of Artificial Sequence: Synthetic oligonucleotide
  Target: FXN; (+) strand; PAM type: NRG; PAM sequence: AGG
cccagctactcaggaggctg

SEQ ID NO: 17018 - DNA, 20 bp, Artificial Sequence
  Description of Artificial Sequence: Synthetic oligonucleotide
  Target: FXN; (+) strand; PAM type: NRG; PAM sequence: CAG
agctactcaggaggctgagg

SEQ ID NO: 17019 - DNA, 20 bp, Artificial Sequence
  Description of Artificial Sequence: Synthetic oligonucleotide
  Target: FXN; (+) strand; PAM type: NRG; PAM sequence: AGG
gctactcaggaggctgaggc

SEQ ID NO: 17020 - DNA, 20 bp, Artificial Sequence
  Description of Artificial Sequence: Synthetic oligonucleotide
  Target: FXN; (+) strand; PAM type: NRG; PAM sequence: GAG
tactcaggaggctgaggcag

SEQ ID NO: 17021 - DNA, 20 bp, Artificial Sequence
  Description of Artificial Sequence: Synthetic oligonucleotide
  Target: FXN; (+) strand; PAM type: NRG; PAM sequence: CGG
gcaggagaatcacttgaacc

SEQ ID NO: 17022 - DNA, 20 bp, Artificial Sequence
  Description of Artificial Sequence: Synthetic oligonucleotide
  Target: FXN; (+) strand; PAM type: NRG; PAM sequence: GGG
caggagaatcacttgaaccc

SEQ ID NO: 17023 - DNA, 20 bp, Artificial Sequence
  Description of Artificial Sequence: Synthetic oligonucleotide
  Target: FXN; (+) strand; PAM type: NRG; PAM sequence: GAG
ggagaatcacttgaacccgg

SEQ ID NO: 17024 - DNA, 20 bp, Artificial Sequence
  Description of Artificial Sequence: Synthetic oligonucleotide
  Target: FXN; (+) strand; PAM type: NRG; PAM sequence: AGG
gagaatcacttgaacccggg

SEQ ID NO: 17025 - DNA, 20 bp, Artificial Sequence
  Description of Artificial Sequence: Synthetic oligonucleotide
  Target: FXN; (+) strand; PAM type: NRG; PAM sequence: CGG
aatcacttgaacccgggagg

SEQ ID NO: 17026 - DNA, 20 bp, Artificial Sequence
  Description of Artificial Sequence: Synthetic oligonucleotide
  Target: FXN; (+) strand; PAM type: NRG; PAM sequence: GAG
tcacttgaacccgggaggcg

SEQ ID NO: 17027 - DNA, 20 bp, Artificial Sequence
  Description of Artificial Sequence: Synthetic oligonucleotide
  Target: FXN; (+) strand; PAM type: NRG; PAM sequence: AGG
cacttgaacccgggaggcgg

SEQ ID NO: 17028 - DNA, 20 bp, Artificial Sequence
  Description of Artificial Sequence: Synthetic oligonucleotide
  Target: FXN; (+) strand; PAM type: NRG; PAM sequence: AAG
cgggaggcggaggttgcaat

SEQ ID NO: 17029 - DNA, 20 bp, Artificial Sequence
  Description of Artificial Sequence: Synthetic oligonucleotide
  Target: FXN; (+) strand; PAM type: NRG; PAM sequence: TAG
ggcggaggttgcaataagcc

SEQ ID NO: 17030 - DNA, 20 bp, Artificial Sequence
  Description of Artificial Sequence: Synthetic oligonucleotide
  Target: FXN; (+) strand; PAM type: NRG; PAM sequence: CAG
tagattgtgccactgcattc

SEQ ID NO: 17031 - DNA, 20 bp, Artificial Sequence
  Description of Artificial Sequence: Synthetic oligonucleotide
  Target: FXN; (+) strand; PAM type: NRG; PAM sequence: TGG
tgtgccactgcattccagcc

SEQ ID NO: 17032 - DNA, 20 bp, Artificial Sequence
  Description of Artificial Sequence: Synthetic oligonucleotide
  Target: FXN; (+) strand; PAM type: NRG; PAM sequence: GGG
gtgccactgcattccagcct

SEQ ID NO: 17033 - DNA, 20 bp, Artificial Sequence
  Description of Artificial Sequence: Synthetic oligonucleotide
  Target: FXN; (+) strand; PAM type: NRG; PAM sequence: CAG
ctgcattccagcctgggcaa

SEQ ID NO: 17034 - DNA, 20 bp, Artificial Sequence
  Description of Artificial Sequence: Synthetic oligonucleotide
  Target: FXN; (+) strand; PAM type: NRG; PAM sequence: GAG
gcattccagcctgggcaaca

SEQ ID NO: 17035 - DNA, 20 bp, Artificial Sequence
  Description of Artificial Sequence: Synthetic oligonucleotide
  Target: FXN; (+) strand; PAM type: NRG; PAM sequence: AAG
tccagcctgggcaacagagc

SEQ ID NO: 17036 - DNA, 20 bp, Artificial Sequence
  Description of Artificial Sequence: Synthetic oligonucleotide
  Target: FXN; (+) strand; PAM type: NRG; PAM sequence: CAG
aacagagcaagactccgtct

SEQ ID NO: 17037 - DNA, 20 bp, Artificial Sequence
  Description of Artificial Sequence: Synthetic oligonucleotide
  Target: FXN; (+) strand; PAM type: NRG; PAM sequence: AAG
gtctcagaaaaaaaaaaaaa

SEQ ID NO: 17038 - DNA, 20 bp, Artificial Sequence
  Description of Artificial Sequence: Synthetic oligonucleotide
  Target: FXN; (+) strand; PAM type: NRG; PAM sequence: AGG
tctcagaaaaaaaaaaaaaa

SEQ ID NO: 17039 - DNA, 20 bp, Artificial Sequence
  Description of Artificial Sequence: Synthetic oligonucleotide
  Target: FXN; (+) strand; PAM type: NRG; PAM sequence: AAG
cagaaaaaaaaaaaaaaagg

SEQ ID NO: 17040 - DNA, 20 bp, Artificial Sequence
  Description of Artificial Sequence: Synthetic oligonucleotide
  Target: FXN; (+) strand; PAM type: NRG; PAM sequence: AAG
atcctatgaccttgacctcc

SEQ ID NO: 17041 - DNA, 20 bp, Artificial Sequence
  Description of Artificial Sequence: Synthetic oligonucleotide
  Target: FXN; (+) strand; PAM type: NRG; PAM sequence: AAG
ctccaagctttgcctccctc

SEQ ID NO: 17042 - DNA, 20 bp, Artificial Sequence
  Description of Artificial Sequence: Synthetic oligonucleotide
  Target: FXN; (+) strand; PAM type: NRG; PAM sequence: CAG
caagctttgcctccctcaag

SEQ ID NO: 17043 - DNA, 20 bp, Artificial Sequence
  Description of Artificial Sequence: Synthetic oligonucleotide
  Target: FXN; (+) strand; PAM type: NRG; PAM sequence: CAG
tttgcctccctcaagcagaa

SEQ ID NO: 17044 - DNA, 20 bp, Artificial Sequence
  Description of Artificial Sequence: Synthetic oligonucleotide
  Target: FXN; (+) strand; PAM type: NRG; PAM sequence: TGG
ctccctcaagcagaacagaa

SEQ ID NO: 17045 - DNA, 20 bp, Artificial Sequence
  Description of Artificial Sequence: Synthetic oligonucleotide
  Target: FXN; (+) strand; PAM type: NRG; PAM sequence: GAG
ccctcaagcagaacagaatg

SEQ ID NO: 17046 - DNA, 20 bp, Artificial Sequence
  Description of Artificial Sequence: Synthetic oligonucleotide
  Target: FXN; (+) strand; PAM type: NRG; PAM sequence: TAG
gaacagaatggagcctccct

SEQ ID NO: 17047 - DNA, 20 bp, Artificial Sequence
  Description of Artificial Sequence: Synthetic oligonucleotide
  Target: FXN; (+) strand; PAM type: NRG; PAM sequence: AGG
aacagaatggagcctccctt

SEQ ID NO: 17048 - DNA, 20 bp, Artificial Sequence
  Description of Artificial Sequence: Synthetic oligonucleotide
  Target: FXN; (+) strand; PAM type: NRG; PAM sequence: CAG
agaatggagcctcccttagg

SEQ ID NO: 17049 - DNA, 20 bp, Artificial Sequence
  Description of Artificial Sequence: Synthetic oligonucleotide
  Target: FXN; (+) strand; PAM type: NRG; PAM sequence: GAG
aatggagcctcccttaggca

SEQ ID NO: 17050 - DNA, 20 bp, Artificial Sequence
  Description of Artificial Sequence: Synthetic oligonucleotide
  Target: FXN; (+) strand; PAM type: NRG; PAM sequence: AGG
atggagcctcccttaggcag

SEQ ID NO: 17051 - DNA, 20 bp, Artificial Sequence
  Description of Artificial Sequence: Synthetic oligonucleotide
  Target: FXN; (+) strand; PAM type: NRG; PAM sequence: CGG
gagcctcccttaggcagagg

SEQ ID NO: 17052 - DNA, 20 bp, Artificial Sequence
  Description of Artificial Sequence: Synthetic oligonucleotide
  Target: FXN; (+) strand; PAM type: NRG; PAM sequence: AAG
cctcccttaggcagaggcgg

SEQ ID NO: 17053 - DNA, 20 bp, Artificial Sequence
  Description of Artificial Sequence: Synthetic oligonucleotide
  Target: FXN; (+) strand; PAM type: NRG; PAM sequence: TAG
gcggaagtttgcctctcacc

SEQ ID NO: 17054 - DNA, 20 bp, Artificial Sequence
  Description of Artificial Sequence: Synthetic oligonucleotide
  Target: FXN; (+) strand; PAM type: NRG; PAM sequence: CAG
tagttctccattcttttgtt

SEQ ID NO: 17055 - DNA, 20 bp, Artificial Sequence
  Description of Artificial Sequence: Synthetic oligonucleotide
  Target: FXN; (+) strand; PAM type: NRG; PAM sequence: GAG
gttctccattcttttgttca

SEQ ID NO: 17056 - DNA, 20 bp, Artificial Sequence
  Description of Artificial Sequence: Synthetic oligonucleotide
  Target: FXN; (+) strand; PAM type: NRG; PAM sequence: CAG
gttcagagcctgaataccct

SEQ ID NO: 17057 - DNA, 20 bp, Artificial Sequence
  Description of Artificial Sequence: Synthetic oligonucleotide
  Target: FXN; (+) strand; PAM type: NRG; PAM sequence: AGG
ttcagagcctgaataccctc

SEQ ID NO: 17058 - DNA, 20 bp, Artificial Sequence
  Description of Artificial Sequence: Synthetic oligonucleotide
  Target: FXN; (+) strand; PAM type: NRG; PAM sequence: TGG
ataccctcaggctctgtact

SEQ ID NO: 17059 - DNA, 20 bp, Artificial Sequence
  Description of Artificial Sequence: Synthetic oligonucleotide
  Target: FXN; (+) strand; PAM type: NRG; PAM sequence: GGG
taccctcaggctctgtactt

SEQ ID NO: 17060 - DNA, 20 bp, Artificial Sequence
  Description of Artificial Sequence: Synthetic oligonucleotide
  Target: FXN; (+) strand; PAM type: NRG; PAM sequence: GGG
accctcaggctctgtacttg

SEQ ID NO: 17061 - DNA, 20 bp, Artificial Sequence
  Description of Artificial Sequence: Synthetic oligonucleotide
  Target: FXN; (+) strand; PAM type: NRG; PAM sequence: CGG
gttctcttgttttatgctca

SEQ ID NO: 17062 - DNA, 20 bp, Artificial Sequence
  Description of Artificial Sequence: Synthetic oligonucleotide
  Target: FXN; (+) strand; PAM type: NRG; PAM sequence: GAG
tgttttatgctcacggttgt

SEQ ID NO: 17063 - DNA, 20 bp, Artificial Sequence
  Description of Artificial Sequence: Synthetic oligonucleotide
  Target: FXN; (+) strand; PAM type: NRG; PAM sequence: AGG
gttttatgctcacggttgtg

SEQ ID NO: 17064 - DNA, 20 bp, Artificial Sequence
  Description of Artificial Sequence: Synthetic oligonucleotide
  Target: FXN; (+) strand; PAM type: NRG; PAM sequence: GAG
acggttgtgaggtttgttgt

SEQ ID NO: 17065 - DNA, 20 bp, Artificial Sequence
  Description of Artificial Sequence: Synthetic oligonucleotide
  Target: FXN; (+) strand; PAM type: NRG; PAM sequence: CAG
agtaccacgatcccttcctt

SEQ ID NO: 17066 - DNA, 20 bp, Artificial Sequence
  Description of Artificial Sequence: Synthetic oligonucleotide
  Target: FXN; (+) strand; PAM type: NRG; PAM sequence: GAG
taccacgatcccttccttca

SEQ ID NO: 17067 - DNA, 20 bp, Artificial Sequence
  Description of Artificial Sequence: Synthetic oligonucleotide
  Target: FXN; (+) strand; PAM type: NRG; PAM sequence: AGG
accacgatcccttccttcag

SEQ ID NO: 17068 - DNA, 20 bp, Artificial Sequence
  Description of Artificial Sequence: Synthetic oligonucleotide
  Target: FXN; (+) strand; PAM type: NRG; PAM sequence: GAG
cacgatcccttccttcagag

SEQ ID NO: 17069 - DNA, 20 bp, Artificial Sequence
  Description of Artificial Sequence: Synthetic oligonucleotide
  Target: FXN; (+) strand; PAM type: NRG; PAM sequence: GAG
ttccttcagaggagtaaact

SEQ ID NO: 17070 - DNA, 20 bp, Artificial Sequence
  Description of Artificial Sequence: Synthetic oligonucleotide
  Target: FXN; (+) strand; PAM type: NRG; PAM sequence: AGG
tccttcagaggagtaaactg

SEQ ID NO: 17071 - DNA, 20 bp, Artificial Sequence
  Description of Artificial Sequence: Synthetic oligonucleotide
  Target: FXN; (+) strand; PAM type: NRG; PAM sequence: AAG
ggagtaaactgaggttccaa

SEQ ID NO: 17072 - DNA, 20 bp, Artificial Sequence
  Description of Artificial Sequence: Synthetic oligonucleotide
  Target: FXN; (+) strand; PAM type: NRG; PAM sequence: AGG
gagtaaactgaggttccaaa

SEQ ID NO: 17073 - DNA, 20 bp, Artificial Sequence
  Description of Artificial Sequence: Synthetic oligonucleotide
  Target: FXN; (+) strand; PAM type: NRG; PAM sequence: TAG
aactgaggttccaaaaggtt

SEQ ID NO: 17074 - DNA, 20 bp, Artificial Sequence
  Description of Artificial Sequence: Synthetic oligonucleotide
  Target: FXN; (+) strand; PAM type: NRG; PAM sequence: CAG
tgaggttccaaaaggtttag

SEQ ID NO: 17075 - DNA, 20 bp, Artificial Sequence
  Description of Artificial Sequence: Synthetic oligonucleotide
  Target: FXN; (+) strand; PAM type: NRG; PAM sequence: GAG
aaaaggtttagcagttgccc

SEQ ID NO: 17076 - DNA, 20 bp, Artificial Sequence
  Description of Artificial Sequence: Synthetic oligonucleotide
  Target: FXN; (+) strand; PAM type: NRG; PAM sequence: AGG
aaaggtttagcagttgcccg

SEQ ID NO: 17077 - DNA, 20 bp, Artificial Sequence
  Description of Artificial Sequence: Synthetic oligonucleotide
  Target: FXN; (+) strand; PAM type: NRG; PAM sequence: TGG
ttgcccgaggaatattaaat

SEQ ID NO: 17078 - DNA, 20 bp, Artificial Sequence
  Description of Artificial Sequence: Synthetic oligonucleotide
  Target: FXN; (+) strand; PAM type: NRG; PAM sequence: AAG
gaggaatattaaattggcaa

SEQ ID NO: 17079 - DNA, 20 bp, Artificial Sequence
  Description of Artificial Sequence: Synthetic oligonucleotide
  Target: FXN; (+) strand; PAM type: NRG; PAM sequence: CAG
gaatattaaattggcaaaag

SEQ ID NO: 17080 - DNA, 20 bp, Artificial Sequence
  Description of Artificial Sequence: Synthetic oligonucleotide
  Target: FXN; (+) strand; PAM type: NRG; PAM sequence: AGG
aatattaaattggcaaaagc

SEQ ID NO: 17081 - DNA, 20 bp, Artificial Sequence
  Description of Artificial Sequence: Synthetic oligonucleotide
  Target: FXN; (+) strand; PAM type: NRG; PAM sequence: TAG
attaaattggcaaaagcagg

SEQ ID NO: 17082 - DNA, 20 bp, Artificial Sequence
  Description of Artificial Sequence: Synthetic oligonucleotide
  Target: FXN; (+) strand; PAM type: NRG; PAM sequence: AAG
gcaaaagcaggtagaatata

SEQ ID NO: 17083 - DNA, 20 bp, Artificial Sequence
  Description of Artificial Sequence: Synthetic oligonucleotide
  Target: FXN; (+) strand; PAM type: NRG; PAM sequence: AAG
aagcaggtagaatataaagc

SEQ ID NO: 17084 - DNA, 20 bp, Artificial Sequence
  Description of Artificial Sequence: Synthetic oligonucleotide
  Target: FXN; (+) strand; PAM type: NRG; PAM sequence: AGG
agcaggtagaatataaagca

SEQ ID NO: 17085 - DNA, 20 bp, Artificial Sequence
  Description of Artificial Sequence: Synthetic oligonucleotide
  Target: FXN; (+) strand; PAM type: NRG; PAM sequence: GAG
caggtagaatataaagcaag

SEQ ID NO: 17086 - DNA, 20 bp, Artificial Sequence
  Description of Artificial Sequence: Synthetic oligonucleotide
  Target: FXN; (+) strand; PAM type: NRG; PAM sequence: TGG
aatataaagcaaggagtatt

SEQ ID NO: 17087 - DNA, 20 bp, Artificial Sequence
  Description of Artificial Sequence: Synthetic oligonucleotide
  Target: FXN; (+) strand; PAM type: NRG; PAM sequence: CGG
aagcaaggagtatttggcaa

SEQ ID NO: 17088 - DNA, 20 bp, Artificial Sequence
  Description of Artificial Sequence: Synthetic oligonucleotide
  Target: FXN; (+) strand; PAM type: NRG; PAM sequence: CAG
ttcttttttatgattaaaaa

SEQ ID NO: 17089 - DNA, 20 bp, Artificial Sequence
  Description of Artificial Sequence: Synthetic oligonucleotide
  Target: FXN; (+) strand; PAM type: NRG; PAM sequence: AAG
tttatgattaaaaacagccg

SEQ ID NO: 17090 - DNA, 20 bp, Artificial Sequence
  Description of Artificial Sequence: Synthetic oligonucleotide
  Target: FXN; (+) strand; PAM type: NRG; PAM sequence: AAG
tgattaaaaacagccgaaga

SEQ ID NO: 17091 - DNA, 20 bp, Artificial Sequence
  Description of Artificial Sequence: Synthetic oligonucleotide
  Target: FXN; (+) strand; PAM type: NRG; PAM sequence: AAG
gacttctacttgtgcctttg

SEQ ID NO: 17092 - DNA, 20 bp, Artificial Sequence
  Description of Artificial Sequence: Synthetic oligonucleotide
  Target: FXN; (+) strand; PAM type: NRG; PAM sequence: AGG
acttctacttgtgcctttga

SEQ ID NO: 17093 - DNA, 20 bp, Artificial Sequence
  Description of Artificial Sequence: Synthetic oligonucleotide
  Target: FXN; (+) strand; PAM type: NRG; PAM sequence: GAG
ttctacttgtgcctttgaag

SEQ ID NO: 17094 - DNA, 20 bp, Artificial Sequence
  Description of Artificial Sequence: Synthetic oligonucleotide
  Target: FXN; (+) strand; PAM type: NRG; PAM sequence: CAG
actgcatttgaccttcccac

SEQ ID NO: 17095 - DNA, 20 bp, Artificial Sequence
  Description of Artificial Sequence: Synthetic oligonucleotide
  Target: FXN; (+) strand; PAM type: NRG; PAM sequence: CAG
cacacacacacaaacaaaaa

SEQ ID NO: 17096 - DNA, 20 bp, Artificial Sequence
  Description of Artificial Sequence: Synthetic oligonucleotide
  Target: FXN; (+) strand; PAM type: NRG; PAM sequence: AAG
aaacaaaaacagctattgtg

SEQ ID NO: 17097 - DNA, 20 bp, Artificial Sequence
  Description of Artificial Sequence: Synthetic oligonucleotide
  Target: FXN; (+) strand; PAM type: NRG; PAM sequence: AGG
aacaaaaacagctattgtga

SEQ ID NO: 17098 - DNA, 20 bp, Artificial Sequence
  Description of Artificial Sequence: Synthetic oligonucleotide
  Target: FXN; (+) strand; PAM type: NRG; PAM sequence: CAG
aacagctattgtgaaggtat

SEQ ID NO: 17099 - DNA, 20 bp, Artificial Sequence
  Description of Artificial Sequence: Synthetic oligonucleotide
  Target: FXN; (+) strand; PAM type: NRG; PAM sequence: AAG
ttgtgaaggtatcagcgact

SEQ ID NO: 17100 - DNA, 20 bp, Artificial Sequence
  Description of Artificial Sequence: Synthetic oligonucleotide
  Target: FXN; (+) strand; PAM type: NRG; PAM sequence: AAG
tatcagcgactaagacaact

SEQ ID NO: 17101 - DNA, 20 bp, Artificial Sequence
  Description of Artificial Sequence: Synthetic oligonucleotide
  Target: FXN; (+) strand; PAM type: NRG; PAM sequence: AGG
atcagcgactaagacaacta

SEQ ID NO: 17102 - DNA, 20 bp, Artificial Sequence
  Description of Artificial Sequence: Synthetic oligonucleotide
  Target: FXN; (+) strand; PAM type: NRG; PAM sequence: GAG
gactaagacaactaaggttt

SEQ ID NO: 17103 - DNA, 20 bp, Artificial Sequence
  Description of Artificial Sequence: Synthetic oligonucleotide
  Target: FXN; (+) strand; PAM type: NRG; PAM sequence: AGG
actaagacaactaaggtttg

SEQ ID NO: 17104 - DNA, 20 bp, Artificial Sequence
  Description of Artificial Sequence: Synthetic oligonucleotide
  Target: FXN; (+) strand; PAM type: NRG; PAM sequence: GGG
ctaagacaactaaggtttga

SEQ ID NO: 17105 - DNA, 20 bp, Artificial Sequence
  Description of Artificial Sequence: Synthetic oligonucleotide
  Target: FXN; (+) strand; PAM type: NRG; PAM sequence: GGG
taagacaactaaggtttgag

SEQ ID NO: 17106 - DNA, 20 bp, Artificial Sequence
  Description of Artificial Sequence: Synthetic oligonucleotide
  Target: FXN; (+) strand; PAM type: NRG; PAM sequence: CAG
acaactaaggtttgaggggc

SEQ ID NO: 17107 - DNA, 20 bp, Artificial Sequence
  Description of Artificial Sequence: Synthetic oligonucleotide
  Target: FXN; (+) strand; PAM type: NRG; PAM sequence: AGG
caactaaggtttgaggggcc

SEQ ID NO: 17108 - DNA, 20 bp, Artificial Sequence
  Description of Artificial Sequence: Synthetic oligonucleotide
  Target: FXN; (+) strand; PAM type: NRG; PAM sequence: TGG
ggtttgaggggccaggatcc

SEQ ID NO: 17109 - DNA, 20 bp, Artificial Sequence
  Description of Artificial Sequence: Synthetic oligonucleotide
  Target: FXN; (+) strand; PAM type: NRG; PAM sequence: GAG
tttgaggggccaggatcctg

SEQ ID NO: 17110 - DNA, 20 bp, Artificial Sequence
  Description of Artificial Sequence: Synthetic oligonucleotide
  Target: FXN; (+) strand; PAM type: NRG; PAM sequence: GAG
tgaggggccaggatcctgga

SEQ ID NO: 17111 - DNA, 20 bp, Artificial Sequence
  Description of Artificial Sequence: Synthetic oligonucleotide
  Target: FXN; (+) strand; PAM type: NRG; PAM sequence: TGG
gggccaggatcctggagaga

SEQ ID NO: 17112 - DNA, 20 bp, Artificial Sequence
  Description of Artificial Sequence: Synthetic oligonucleotide
  Target: FXN; (+) strand; PAM type: NRG; PAM sequence: GAG
ggagagatggaaacttccct

SEQ ID NO: 17113 - DNA, 20 bp, Artificial Sequence
  Description of Artificial Sequence: Synthetic oligonucleotide
  Target: FXN; (+) strand; PAM type: NRG; PAM sequence: AGG
gagagatggaaacttccctg

SEQ ID NO: 17114 - DNA, 20 bp, Artificial Sequence
  Description of Artificial Sequence: Synthetic oligonucleotide
  Target: FXN; (+) strand; PAM type: NRG; PAM sequence: GAG
gatggaaacttccctgaggt

SEQ ID NO: 17115 - DNA, 20 bp, Artificial Sequence
  Description of Artificial Sequence: Synthetic oligonucleotide
  Target: FXN; (+) strand; PAM type: NRG; PAM sequence: CAG
tgaggtgagccccacattct

SEQ ID NO: 17116 - DNA, 20 bp, Artificial Sequence
  Description of Artificial Sequence: Synthetic oligonucleotide
  Target: FXN; (+) strand; PAM type: NRG; PAM sequence: TGG
cattctcagacacttttcct

SEQ ID NO: 17117 - DNA, 20 bp, Artificial Sequence
  Description of Artificial Sequence: Synthetic oligonucleotide
  Target: FXN; (+) strand; PAM type: NRG; PAM sequence: GAG
cacttttccttggatgtttt

SEQ ID NO: 17118 - DNA, 20 bp, Artificial Sequence
  Description of Artificial Sequence: Synthetic oligonucleotide
  Target: FXN; (+) strand; PAM type: NRG; PAM sequence: TGG
ttgagcactgctttaattcc

SEQ ID NO: 17119 - DNA, 20 bp, Artificial Sequence
  Description of Artificial Sequence: Synthetic oligonucleotide
  Target: FXN; (+) strand; PAM type: NRG; PAM sequence: GGG
tgagcactgctttaattcct

SEQ ID NO: 17120 - DNA, 20 bp, Artificial Sequence
  Description of Artificial Sequence: Synthetic oligonucleotide
  Target: FXN; (+) strand; PAM type: NRG; PAM sequence: CAG
acaattccttccactgtgca

SEQ ID NO: 17121 - DNA, 20 bp, Artificial Sequence
  Description of Artificial Sequence: Synthetic oligonucleotide
  Target: FXN; (+) strand; PAM type: NRG; PAM sequence: TGG
cttccactgtgcacagactc

SEQ ID NO: 17122 - DNA, 20 bp, Artificial Sequence
  Description of Artificial Sequence: Synthetic oligonucleotide
  Target: FXN; (+) strand; PAM type: NRG; PAM sequence: GGG
ttccactgtgcacagactct

SEQ ID NO: 17123 - DNA, 20 bp, Artificial Sequence
  Description of Artificial Sequence: Synthetic oligonucleotide
  Target: FXN; (+) strand; PAM type: NRG; PAM sequence: GGG
tccactgtgcacagactctg

SEQ ID NO: 17124 - DNA, 20 bp, Artificial Sequence
  Description of Artificial Sequence: Synthetic oligonucleotide
  Target: FXN; (+) strand; PAM type: NRG; PAM sequence: CAG
ctgtgcacagactctggggc

SEQ ID NO: 17125 - DNA, 20 bp, Artificial Sequence
  Description of Artificial Sequence: Synthetic oligonucleotide
  Target: FXN; (+) strand; PAM type: NRG; PAM sequence: CAG
gcacagactctggggccaga

SEQ ID NO: 17126 - DNA, 20 bp, Artificial Sequence
  Description of Artificial Sequence: Synthetic oligonucleotide
  Target: FXN; (+) strand; PAM type: NRG; PAM sequence: TGG
gactctggggccagacagct

SEQ ID NO: 17127 - DNA, 20 bp, Artificial Sequence
  Description of Artificial Sequence: Synthetic oligonucleotide
  Target: FXN; (+) strand; PAM type: NRG; PAM sequence: GGG
actctggggccagacagctt

SEQ ID NO: 17128 - DNA, 20 bp, Artificial Sequence
  Description of Artificial Sequence: Synthetic oligonucleotide
  Target: FXN; (+) strand; PAM type: NRG; PAM sequence: CAG
agacagcttgggttcaatcc

SEQ ID NO: 17129 - DNA, 20 bp, Artificial Sequence
  Description of Artificial Sequence: Synthetic oligonucleotide
  Target: FXN; (+) strand; PAM type: NRG; PAM sequence: TAG
ttaatgtctgtgtatctgtg

SEQ ID NO: 17130 - DNA, 20 bp, Artificial Sequence
  Description of Artificial Sequence: Synthetic oligonucleotide
  Target: FXN; (+) strand; PAM type: NRG; PAM sequence: AGG
taatgtctgtgtatctgtgt

SEQ ID NO: 17131 - DNA, 20 bp, Artificial Sequence
  Description of Artificial Sequence: Synthetic oligonucleotide
  Target: FXN; (+) strand; PAM type: NRG; PAM sequence: AAG
gtctgtgtatctgtgtaggc

SEQ ID NO: 17132 - DNA, 20 bp, Artificial Sequence
  Description of Artificial Sequence: Synthetic oligonucleotide
  Target: FXN; (+) strand; PAM type: NRG; PAM sequence: TGG
tgtgtaggcaagttaccctt

SEQ ID NO: 17133 - DNA, 20 bp, Artificial Sequence
  Description of Artificial Sequence: Synthetic oligonucleotide
  Target: FXN; (+) strand; PAM type: NRG; PAM sequence: CAG
caagttaccctttggtgcgt

SEQ ID NO: 17134 - DNA, 20 bp, Artificial Sequence
  Description of Artificial Sequence: Synthetic oligonucleotide
  Target: FXN; (+) strand; PAM type: NRG; PAM sequence: TAG
tcatctgtaaaacacaacta

SEQ ID NO: 17135 - DNA, 20 bp, Artificial Sequence
  Description of Artificial Sequence: Synthetic oligonucleotide
  Target: FXN; (+) strand; PAM type: NRG; PAM sequence: AAG
atagttgatcctcattcgtt

SEQ ID NO: 17136 - DNA, 20 bp, Artificial Sequence
  Description of Artificial Sequence: Synthetic oligonucleotide
  Target: FXN; (+) strand; PAM type: NRG; PAM sequence: GAG
agttgatcctcattcgttaa

SEQ ID NO: 17137 - DNA, 20 bp, Artificial Sequence
  Description of Artificial Sequence: Synthetic oligonucleotide
  Target: FXN; (+) strand; PAM type: NRG; PAM sequence: CAG
aaaatttgttaccccaaaat

SEQ ID NO: 17138 - DNA, 20 bp, Artificial Sequence
  Description of Artificial Sequence: Synthetic oligonucleotide
  Target: FXN; (+) strand; PAM type: NRG; PAM sequence: TAG
taccccaaaatcagtacccc

SEQ ID NO: 17139 - DNA, 20 bp, Artificial Sequence
  Description of Artificial Sequence: Synthetic oligonucleotide
  Target: FXN; (+) strand; PAM type: NRG; PAM sequence: TGG
aatcagtacccctagccttt

SEQ ID NO: 17140 - DNA, 20 bp, Artificial Sequence
  Description of Artificial Sequence: Synthetic oligonucleotide
  Target: FXN; (+) strand; PAM type: NRG; PAM sequence: GGG
atcagtacccctagcctttt

SEQ ID NO: 17141 - DNA, 20 bp, Artificial Sequence
  Description of Artificial Sequence: Synthetic oligonucleotide
  Target: FXN; (+) strand; PAM type: NRG; PAM sequence: GGG
tcagtacccctagccttttg

SEQ ID NO: 17142 - DNA, 20 bp, Artificial Sequence
  Description of Artificial Sequence: Synthetic oligonucleotide
  Target: FXN; (+) strand; PAM type: NRG; PAM sequence: AAG
agccttttggggtcgtttca

SEQ ID NO: 17143 - DNA, 20 bp, Artificial Sequence
  Description of Artificial Sequence: Synthetic oligonucleotide
  Target: FXN; (+) strand; PAM type: NRG; PAM sequence: CAG
ggtcgtttcaaagatgtgtg

SEQ ID NO: 17144 - DNA, 20 bp, Artificial Sequence
  Description of Artificial Sequence: Synthetic oligonucleotide
  Target: FXN; (+) strand; PAM type: NRG; PAM sequence: GAG
tcgtttcaaagatgtgtgca

SEQ ID NO: 17145 - DNA, 20 bp, Artificial Sequence
  Description of Artificial Sequence: Synthetic oligonucleotide
  Target: FXN; (+) strand; PAM type: NRG; PAM sequence: CGG
tttcaaagatgtgtgcagag

SEQ ID NO: 17146 - DNA, 20 bp, Artificial Sequence
  Description of Artificial Sequence: Synthetic oligonucleotide
  Target: FXN; (+) strand; PAM type: NRG; PAM sequence: GAG
gcagagcggcaaaaaaatgt

SEQ ID NO: 17147 - DNA, 20 bp, Artificial Sequence
  Description of Artificial Sequence: Synthetic oligonucleotide
  Target: FXN; (+) strand; PAM type: NRG; PAM sequence: CAG
caaaaaaatgtgagctcctc

SEQ ID NO: 17148 - DNA, 20 bp, Artificial Sequence
  Description of Artificial Sequence: Synthetic oligonucleotide
  Target: FXN; (+) strand; PAM type: NRG; PAM sequence: AGG
aaaaaaatgtgagctcctcc

SEQ ID NO: 17149 - DNA, 20 bp, Artificial Sequence
  Description of Artificial Sequence: Synthetic oligonucleotide
  Target: FXN; (+) strand; PAM type: NRG; PAM sequence: CAG
ctcctccaggctcatgttcc

SEQ ID NO: 17150 - DNA, 20 bp, Artificial Sequence
  Description of Artificial Sequence: Synthetic oligonucleotide
  Target: FXN; (+) strand; PAM type: NRG; PAM sequence: AAG
ccaggctcatgttcccagcc

SEQ ID NO: 17151 - DNA, 20 bp, Artificial Sequence
  Description of Artificial Sequence: Synthetic oligonucleotide
  Target: FXN; (+) strand; PAM type: NRG; PAM sequence: AGG
caggctcatgttcccagcca

SEQ ID NO: 17152 - DNA, 20 bp, Artificial Sequence
  Description of Artificial Sequence: Synthetic oligonucleotide
  Target: FXN; (+) strand; PAM type: NRG; PAM sequence: AAG
ttcccagccaaggtccaaca

SEQ ID NO: 17153 - DNA, 20 bp, Artificial Sequence
  Description of Artificial Sequence: Synthetic oligonucleotide
  Target: FXN; (+) strand; PAM type: NRG; PAM sequence: CAG
gctgccctgccttcttattt

SEQ ID NO: 17154 - DNA, 20 bp, Artificial Sequence
  Description of Artificial Sequence: Synthetic oligonucleotide
  Target: FXN; (+) strand; PAM type: NRG; PAM sequence: TAG
ccttcttatttcagctgtca

SEQ ID NO: 17155 - DNA, 20 bp, Artificial Sequence
  Description of Artificial Sequence: Synthetic oligonucleotide
  Target: FXN; (+) strand; PAM type: NRG; PAM sequence: CAG
tgtaaactgtgtccttttca

SEQ ID NO: 17156 - DNA, 20 bp, Artificial Sequence
  Description of Artificial Sequence: Synthetic oligonucleotide
  Target: FXN; (+) strand; PAM type: NRG; PAM sequence: TAG
tgtccttttcacagtctgat

SEQ ID NO: 17157 - DNA, 20 bp, Artificial Sequence
  Description of Artificial Sequence: Synthetic oligonucleotide
  Target: FXN; (+) strand; PAM type: NRG; PAM sequence: CAG
ctgattagtgccatgttttt

SEQ ID NO: 17158 - DNA, 20 bp, Artificial Sequence
  Description of Artificial Sequence: Synthetic oligonucleotide
  Target: FXN; (+) strand; PAM type: NRG; PAM sequence: TGG
agatttttatgcttttttct

SEQ ID NO: 17159 - DNA, 20 bp, Artificial Sequence
  Description of Artificial Sequence: Synthetic oligonucleotide
  Target: FXN; (+) strand; PAM type: NRG; PAM sequence: AAG
tctctgttaaaattgtctcc

SEQ ID NO: 17160 - DNA, 20 bp, Artificial Sequence
  Description of Artificial Sequence: Synthetic oligonucleotide
  Target: FXN; (+) strand; PAM type: NRG; PAM sequence: TAG
gttaaaattgtctccaagtg

SEQ ID NO: 17161 - DNA, 20 bp, Artificial Sequence
  Description of Artificial Sequence: Synthetic oligonucleotide
  Target: FXN; (+) strand; PAM type: NRG; PAM sequence: AAG
ttgtctccaagtgtagtgca

SEQ ID NO: 17162 - DNA, 20 bp, Artificial Sequence
  Description of Artificial Sequence: Synthetic oligonucleotide
  Target: FXN; (+) strand; PAM type: NRG; PAM sequence: TAG
tccaagtgtagtgcaaagtt

SEQ ID NO: 17163 - DNA, 20 bp, Artificial Sequence
  Description of Artificial Sequence: Synthetic oligonucleotide
  Target: FXN; (+) strand; PAM type: NRG; PAM sequence: GAG
tgtagtgcaaagtttagcac

SEQ ID NO: 17164 - DNA, 20 bp, Artificial Sequence
  Description of Artificial Sequence: Synthetic oligonucleotide
  Target: FXN; (+) strand; PAM type: NRG; PAM sequence: AGG
gtagtgcaaagtttagcacg

SEQ ID NO: 17165 - DNA, 20 bp, Artificial Sequence
  Description of Artificial Sequence: Synthetic oligonucleotide
  Target: FXN; (+) strand; PAM type: NRG; PAM sequence: GAG
agtgcaaagtttagcacgag

SEQ ID NO: 17166 - DNA, 20 bp, Artificial Sequence
  Description of Artificial Sequence: Synthetic oligonucleotide
  Target: FXN; (+) strand; PAM type: NRG; PAM sequence: AGG
gtgcaaagtttagcacgagg

SEQ ID NO: 17167 - DNA, 20 bp, Artificial Sequence
  Description of Artificial Sequence: Synthetic oligonucleotide
  Target: FXN; (+) strand; PAM type: NRG; PAM sequence: CAG
ggaggctgtgatgttcctta

SEQ ID NO: 17168 - DNA, 20 bp, Artificial Sequence
  Description of Artificial Sequence: Synthetic oligonucleotide
  Target: FXN; (+) strand; PAM type: NRG; PAM sequence: GAG
aggctgtgatgttccttaca

SEQ ID NO: 17169 - DNA, 20 bp, Artificial Sequence
  Description of Artificial Sequence: Synthetic oligonucleotide
  Target: FXN; (+) strand; PAM type: NRG; PAM sequence: TAG
tacagagaaaatgcatgtgt

SEQ ID NO: 17170 - DNA, 20 bp, Artificial Sequence
  Description of Artificial Sequence: Synthetic oligonucleotide
  Target: FXN; (+) strand; PAM type: NRG; PAM sequence: GAG
cagagaaaatgcatgtgtta

SEQ ID NO: 17171 - DNA, 20 bp, Artificial Sequence
  Description of Artificial Sequence: Synthetic oligonucleotide
  Target: FXN; (+) strand; PAM type: NRG; PAM sequence: AAG
agaaaatgcatgtgttagag

SEQ ID NO: 17172 - DNA, 20 bp, Artificial Sequence
  Description of Artificial Sequence: Synthetic oligonucleotide
  Target: FXN; (+) strand; PAM type: NRG; PAM sequence: CAG
atgtgttagagaagctttgt

SEQ ID NO: 17173 - DNA, 20 bp, Artificial Sequence
  Description of Artificial Sequence: Synthetic oligonucleotide
  Target: FXN; (+) strand; PAM type: NRG; PAM sequence: AGG
tgtgttagagaagctttgtc

SEQ ID NO: 17174 - DNA, 20 bp, Artificial Sequence
  Description of Artificial Sequence: Synthetic oligonucleotide
  Target: FXN; (+) strand; PAM type: NRG; PAM sequence: GAG
agagaagctttgtcaggcat

SEQ ID NO: 17175 - DNA, 20 bp, Artificial Sequence
  Description of Artificial Sequence: Synthetic oligonucleotide
  Target: FXN; (+) strand; PAM type: NRG; PAM sequence: AAG
agctttgtcaggcatgagtt

SEQ ID NO: 17176 - DNA, 20 bp, Artificial Sequence
  Description of Artificial Sequence: Synthetic oligonucleotide
  Target: FXN; (+) strand; PAM type: NRG; PAM sequence: AGG
gctttgtcaggcatgagtta

SEQ ID NO: 17177 - DNA, 20 bp, Artificial Sequence
  Description of Artificial Sequence: Synthetic oligonucleotide
  Target: FXN; (+) strand; PAM type: NRG; PAM sequence: GAG
agttaaggtgctgttgtcct

SEQ ID NO: 17178 - DNA, 20 bp, Artificial Sequence
  Description of Artificial Sequence: Synthetic oligonucleotide
  Target: FXN; (+) strand; PAM type: NRG; PAM sequence: GAG
atttgttgttgttgttgttt

SEQ ID NO: 17179 - DNA, 20 bp, Artificial Sequence
  Description of Artificial Sequence: Synthetic oligonucleotide
  Target: FXN; (+) strand; PAM type: NRG; PAM sequence: CAG
gttgttgttgttgtttgaga

SEQ ID NO: 17180 - DNA, 20 bp, Artificial Sequence
  Description of Artificial Sequence: Synthetic oligonucleotide
  Target: FXN; (+) strand; PAM type: NRG; PAM sequence: AGG
ttgttgttgttgtttgagac

SEQ ID NO: 17181 - DNA, 20 bp, Artificial Sequence
  Description of Artificial Sequence: Synthetic oligonucleotide
  Target: FXN; (+) strand; PAM type: NRG; PAM sequence: GGG
tgttgttgttgtttgagaca

SEQ ID NO: 17182 - DNA, 20 bp, Artificial Sequence
  Description of Artificial Sequence: Synthetic oligonucleotide
  Target: FXN; (+) strand; PAM type: NRG; PAM sequence: CAG
cagggtctccctctgttgcc

SEQ ID NO: 17183 - DNA, 20 bp, Artificial Sequence
  Description of Artificial Sequence: Synthetic oligonucleotide
  Target: FXN; (+) strand; PAM type: NRG; PAM sequence: AGG
agggtctccctctgttgccc

SEQ ID NO: 17184 - DNA, 20 bp, Artificial Sequence
  Description of Artificial Sequence: Synthetic oligonucleotide
  Target: FXN; (+) strand; PAM type: NRG; PAM sequence: TGG
ccctctgttgcccaggctgc

SEQ ID NO: 17185 - DNA, 20 bp, Artificial Sequence
  Description of Artificial Sequence: Synthetic oligonucleotide
  Target: FXN; (+) strand; PAM type: NRG; PAM sequence: GAG
ctctgttgcccaggctgctg

SEQ ID NO: 17186 - DNA, 20 bp, Artificial Sequence
  Description of Artificial Sequence: Synthetic oligonucleotide
  Target: FXN; (+) strand; PAM type: NRG; PAM sequence: TGG
cccaggctgctggagtgcaa

SEQ ID NO: 17187 - DNA, 20 bp, Artificial Sequence
  Description of Artificial Sequence: Synthetic oligonucleotide
  Target: FXN; (+) strand; PAM type: NRG; PAM sequence: TAG
ggagtgcaatggtgtaatca

SEQ ID NO: 17188 - DNA, 20 bp, Artificial Sequence
  Description of Artificial Sequence: Synthetic oligonucleotide
  Target: FXN; (+) strand; PAM type: NRG; PAM sequence: CAG
ggtgtaatcatagctcactg

SEQ ID NO: 17189 - DNA, 20 bp, Artificial Sequence
  Description of Artificial Sequence: Synthetic oligonucleotide
  Target: FXN; (+) strand; PAM type: NRG; PAM sequence: TGG
cactgcagcctctacctctc

SEQ ID NO: 17190 - DNA, 20 bp, Artificial Sequence
  Description of Artificial Sequence: Synthetic oligonucleotide
  Target: FXN; (+) strand; PAM type: NRG; PAM sequence: AAG
agcctctacctctctggctc

SEQ ID NO: 17191 - DNA, 20 bp, Artificial Sequence
  Description of Artificial Sequence: Synthetic oligonucleotide
  Target: FXN; (+) strand; PAM type: NRG; PAM sequence: CGG
ctcaagcaatcctcccacct

SEQ ID NO: 17192 - DNA, 20 bp, Artificial Sequence
  Description of Artificial Sequence: Synthetic oligonucleotide
  Target: FXN; (+) strand; PAM type: NRG; PAM sequence: GAG
tcctcccacctcggcctcct

SEQ ID NO: 17193 - DNA, 20 bp, Artificial Sequence
  Description of Artificial Sequence: Synthetic oligonucleotide
  Target: FXN; (+) strand; PAM type: NRG; PAM sequence: TAG
tcccacctcggcctcctgag

SEQ ID NO: 17194 - DNA, 20 bp, Artificial Sequence
  Description of Artificial Sequence: Synthetic oligonucleotide
  Target: FXN; (+) strand; PAM type: NRG; PAM sequence: TGG
acctcggcctcctgagtagc

SEQ ID NO: 17195 - DNA, 20 bp, Artificial Sequence
  Description of Artificial Sequence: Synthetic oligonucleotide
  Target: FXN; (+) strand; PAM type: NRG; PAM sequence: GGG
cctcggcctcctgagtagct

SEQ ID NO: 17196 - DNA, 20 bp, Artificial Sequence
  Description of Artificial Sequence: Synthetic oligonucleotide
  Target: FXN; (+) strand; PAM type: NRG; PAM sequence: CAG
ctcctgagtagctgggacta

SEQ ID NO: 17197 - DNA, 20 bp, Artificial Sequence
  Description of Artificial Sequence: Synthetic oligonucleotide
  Target: FXN; (+) strand; PAM type: NRG; PAM sequence: AGG
tcctgagtagctgggactac

SEQ ID NO: 17198 - DNA, 20 bp, Artificial Sequence
  Description of Artificial Sequence: Synthetic oligonucleotide
  Target: FXN; (+) strand; PAM type: NRG; PAM sequence: CAG
caggtacaccccaccacacc

SEQ ID NO: 17199 - DNA, 20 bp, Artificial Sequence
  Description of Artificial Sequence: Synthetic oligonucleotide
  Target: FXN; (+) strand; PAM type: NRG; PAM sequence: TAG
taatgtttttgatatttttt

SEQ ID NO: 17200 - DNA, 20 bp, Artificial Sequence
  Description of Artificial Sequence: Synthetic oligonucleotide
  Target: FXN; (+) strand; PAM type: NRG; PAM sequence: AGG
aatgtttttgatattttttt

SEQ ID NO: 17201 - DNA, 20 bp, Artificial Sequence
  Description of Artificial Sequence: Synthetic oligonucleotide
  Target: FXN; (+) strand; PAM type: NRG; PAM sequence: TGG
gtttttgatatttttttagg

SEQ ID NO: 17202 - DNA, 20 bp, Artificial Sequence
  Description of Artificial Sequence: Synthetic oligonucleotide
  Target: FXN; (+) strand; PAM type: NRG; PAM sequence: CAG
gtggaattttgctcatcacc

SEQ ID NO: 17203 - DNA, 20 bp, Artificial Sequence
  Description of Artificial Sequence: Synthetic oligonucleotide
  Target: FXN; (+) strand; PAM type: NRG; PAM sequence: AGG
tggaattttgctcatcaccc

SEQ ID NO: 17204 - DNA, 20 bp, Artificial Sequence
  Description of Artificial Sequence: Synthetic oligonucleotide
  Target: FXN; (+) strand; PAM type: NRG; PAM sequence: TGG
attttgctcatcacccaggc

SEQ ID NO: 17205 - DNA, 20 bp, Artificial Sequence
  Description of Artificial Sequence: Synthetic oligonucleotide
  Target: FXN; (+) strand; PAM type: NRG; PAM sequence: GAG
tttgctcatcacccaggctg

SEQ ID NO: 17206 - DNA, 20 bp, Artificial Sequence
  Description of Artificial Sequence: Synthetic oligonucleotide
  Target: FXN; (+) strand; PAM type: NRG; PAM sequence: TGG
tcacccaggctggagtgcaa

SEQ ID NO: 17207 - DNA, 20 bp, Artificial Sequence
  Description of Artificial Sequence: Synthetic oligonucleotide
  Target: FXN; (+) strand; PAM type: NRG; PAM sequence: TGG
ggagtgcaatggtgcgatcc

SEQ ID NO: 17208 - DNA, 20 bp, Artificial Sequence
  Description of Artificial Sequence: Synthetic oligonucleotide
  Target: FXN; (+) strand; PAM type: NRG; PAM sequence: CGG
tcactgcaacctccacctcc

SEQ ID NO: 17209 - DNA, 20 bp, Artificial Sequence
  Description of Artificial Sequence: Synthetic oligonucleotide
  Target: FXN; (+) strand; PAM type: NRG; PAM sequence: AAG
aacctccacctcccggattc

SEQ ID NO: 17210 - DNA, 20 bp, Artificial Sequence
  Description of Artificial Sequence: Synthetic oligonucleotide
  Target: FXN; (+) strand; PAM type: NRG; PAM sequence: CAG
ttcaagcaattcttctgcct

SEQ ID NO: 17211 - DNA, 20 bp, Artificial Sequence
  Description of Artificial Sequence: Synthetic oligonucleotide
  Target: FXN; (+) strand; PAM type: NRG; PAM sequence: GAG
ttcttctgcctcagcctcct

SEQ ID NO: 17212 - DNA, 20 bp, Artificial Sequence
  Description of Artificial Sequence: Synthetic oligonucleotide
  Target: FXN; (+) strand; PAM type: NRG; PAM sequence: TAG
ttctgcctcagcctcctgag

SEQ ID NO: 17213 - DNA, 20 bp, Artificial Sequence
  Description of Artificial Sequence: Synthetic oligonucleotide
  Target: FXN; (+) strand; PAM type: NRG; PAM sequence: CAG
cctcagcctcctgagtagca

SEQ ID NO: 17214 - DNA, 20 bp, Artificial Sequence
  Description of Artificial Sequence: Synthetic oligonucleotide
  Target: FXN; (+) strand; PAM type: NRG; PAM sequence: CAG
ctcctgagtagcacagatta

SEQ ID NO: 17215 - DNA, 20 bp, Artificial Sequence
  Description of Artificial Sequence: Synthetic oligonucleotide
  Target: FXN; (+) strand; PAM type: NRG; PAM sequence: AGG
tcctgagtagcacagattac

SEQ ID NO: 17216 - DNA, 20 bp, Artificial Sequence
  Description of Artificial Sequence: Synthetic oligonucleotide
  Target: FXN; (+) strand; PAM type: NRG; PAM sequence: TAG
cttgctaatttttgtgtttt

SEQ ID NO: 17217 - DNA, 20 bp, Artificial Sequence
  Description of Artificial Sequence: Synthetic oligonucleotide
  Target: FXN; (+) strand; PAM type: NRG; PAM sequence: TAG
gctaatttttgtgtttttag

SEQ ID NO: 17218 - DNA, 20 bp, Artificial Sequence
  Description of Artificial Sequence: Synthetic oligonucleotide
  Target: FXN; (+) strand; PAM type: NRG; PAM sequence: GAG
taatttttgtgtttttagta

SEQ ID NO: 17219 - DNA, 20 bp, Artificial Sequence
  Description of Artificial Sequence: Synthetic oligonucleotide
  Target: FXN; (+) strand; PAM type: NRG; PAM sequence: AGG
aatttttgtgtttttagtag

SEQ ID NO: 17220 - DNA, 20 bp, Artificial Sequence
  Description of Artificial Sequence: Synthetic oligonucleotide
  Target: FXN; (+) strand; PAM type: NRG; PAM sequence: CGG
ttttgtgtttttagtagagg

SEQ ID NO: 17221 - DNA, 20 bp, Artificial Sequence
  Description of Artificial Sequence: Synthetic oligonucleotide
  Target: FXN; (+) strand; PAM type: NRG; PAM sequence: GGG
tttgtgtttttagtagaggc

SEQ ID NO: 17222 - DNA, 20 bp, Artificial Sequence
  Description of Artificial Sequence: Synthetic oligonucleotide
  Target: FXN; (+) strand; PAM type: NRG; PAM sequence: GGG
ttgtgtttttagtagaggcg

SEQ ID NO: 17223 - DNA, 20 bp, Artificial Sequence
  Description of Artificial Sequence: Synthetic oligonucleotide
  Target: FXN; (+) strand; PAM type: NRG; PAM sequence: TGG
gaggcggggtttcaccatgt

SEQ ID NO: 17224 - DNA, 20 bp, Artificial Sequence
  Description of Artificial Sequence: Synthetic oligonucleotide
  Target: FXN; (+) strand; PAM type: NRG; PAM sequence: CAG
cggggtttcaccatgttggc

SEQ ID NO: 17225 - DNA, 20 bp, Artificial Sequence
  Description of Artificial Sequence: Synthetic oligonucleotide
  Target: FXN; (+) strand; PAM type: NRG; PAM sequence: AGG
ggggtttcaccatgttggcc

SEQ ID NO: 17226 - DNA, 20 bp, Artificial Sequence
  Description of Artificial Sequence: Synthetic oligonucleotide
  Target: FXN; (+) strand; PAM type: NRG; PAM sequence: TAG
tttcaccatgttggccaggc

SEQ ID NO: 17227 - DNA, 20 bp, Artificial Sequence
  Description of Artificial Sequence: Synthetic oligonucleotide
  Target: FXN; (+) strand; PAM type: NRG; PAM sequence: CAG
tagtcttgaactcctgacct

SEQ ID NO: 17228 - DNA, 20 bp, Artificial Sequence
  Description of Artificial Sequence: Synthetic oligonucleotide
  Target: FXN; (+) strand; PAM type: NRG; PAM sequence: AGG
agtcttgaactcctgacctc

SEQ ID NO: 17229 - DNA, 20 bp, Artificial Sequence
  Description of Artificial Sequence: Synthetic oligonucleotide
  Target: FXN; (+) strand; PAM type: NRG; PAM sequence: CAG
cgcctccgcctcccaaactg

SEQ ID NO: 17230 - DNA, 20 bp, Artificial Sequence
  Description of Artificial Sequence: Synthetic oligonucleotide
  Target: FXN; (+) strand; PAM type: NRG; PAM sequence: GAG
cctccgcctcccaaactgca

SEQ ID NO: 17231 - DNA, 20 bp, Artificial Sequence
  Description of Artificial Sequence: Synthetic oligonucleotide
  Target: FXN; (+) strand; PAM type: NRG; PAM sequence: TAG
ctcccaaactgcagagatta

SEQ ID NO: 17232 - DNA, 20 bp, Artificial Sequence
  Description of Artificial Sequence: Synthetic oligonucleotide
  Target: FXN; (+) strand; PAM type: NRG; PAM sequence: AGG
tcccaaactgcagagattat

SEQ ID NO: 17233 - DNA, 20 bp, Artificial Sequence
  Description of Artificial Sequence: Synthetic oligonucleotide
  Target: FXN; (+) strand; PAM type: NRG; PAM sequence: CGG
taggcacgaaccacaatgcc

SEQ ID NO: 17234 - DNA, 20 bp, Artificial Sequence
  Description of Artificial Sequence: Synthetic oligonucleotide
  Target: FXN; (+) strand; PAM type: NRG; PAM sequence: AAG
cctcatgttttttatttttc

SEQ ID NO: 17235 - DNA, 20 bp, Artificial Sequence
  Description of Artificial Sequence: Synthetic oligonucleotide
  Target: FXN; (+) strand; PAM type: NRG; PAM sequence: GAG
tttatttttcaagttgaaat

SEQ ID NO: 17236 - DNA, 20 bp, Artificial Sequence
  Description of Artificial Sequence: Synthetic oligonucleotide
  Target: FXN; (+) strand; PAM type: NRG; PAM sequence: AGG
ttatttttcaagttgaaatg

SEQ ID NO: 17237 - DNA, 20 bp, Artificial Sequence
  Description of Artificial Sequence: Synthetic oligonucleotide
  Target: FXN; (+) strand; PAM type: NRG; PAM sequence: CAG
tgaggtctctctatgttgcc

SEQ ID NO: 17238 - DNA, 20 bp, Artificial Sequence
  Description of Artificial Sequence: Synthetic oligonucleotide
  Target: FXN; (+) strand; PAM type: NRG; PAM sequence: AGG
gaggtctctctatgttgccc

SEQ ID NO: 17239 - DNA, 20 bp, Artificial Sequence
  Description of Artificial Sequence: Synthetic oligonucleotide
  Target: FXN; (+) strand; PAM type: NRG; PAM sequence: TGG
tctctctatgttgcccaggt

SEQ ID NO: 17240 - DNA, 20 bp, Artificial Sequence
  Description of Artificial Sequence: Synthetic oligonucleotide
  Target: FXN; (+) strand; PAM type: NRG; PAM sequence: GAG
caggttggtctcaaactctt

SEQ ID NO: 17241 - DNA, 20 bp, Artificial Sequence
  Description of Artificial Sequence: Synthetic oligonucleotide
  Target: FXN; (+) strand; PAM type: NRG; PAM sequence: AAG
ggtctcaaactcttgagctc

SEQ ID NO: 17242 - DNA, 20 bp, Artificial Sequence
  Description of Artificial Sequence: Synthetic oligonucleotide
  Target: FXN; (+) strand; PAM type: NRG; PAM sequence: TGG
ctcaagtaatcctcccacct

SEQ ID NO: 17243 - DNA, 20 bp, Artificial Sequence
  Description of Artificial Sequence: Synthetic oligonucleotide
  Target: FXN; (+) strand; PAM type: NRG; PAM sequence: AAG
cctcccaccttggcctccca

SEQ ID NO: 17244 - DNA, 20 bp, Artificial Sequence
  Description of Artificial Sequence: Synthetic oligonucleotide
  Target: FXN; (+) strand; PAM type: NRG; PAM sequence: CGG
caccttggcctcccaaagtg

SEQ ID NO: 17245 - DNA, 20 bp, Artificial Sequence
  Description of Artificial Sequence: Synthetic oligonucleotide
  Target: FXN; (+) strand; PAM type: NRG; PAM sequence: GGG
accttggcctcccaaagtgc

SEQ ID NO: 17246 - DNA, 20 bp, Artificial Sequence
  Description of Artificial Sequence: Synthetic oligonucleotide
  Target: FXN; (+) strand; PAM type: NRG; PAM sequence: GGG
ccttggcctcccaaagtgcg

SEQ ID NO: 17247 - DNA, 20 bp, Artificial Sequence
  Description of Artificial Sequence: Synthetic oligonucleotide
  Target: FXN; (+) strand; PAM type: NRG; PAM sequence: CAG
ctcccaaagtgcggggatta

SEQ ID NO: 17248 - DNA, 20 bp, Artificial Sequence
  Description of Artificial Sequence: Synthetic oligonucleotide
  Target: FXN; (+) strand; PAM type: NRG; PAM sequence: AGG
tcccaaagtgcggggattac

SEQ ID NO: 17249 - DNA, 20 bp, Artificial Sequence
  Description of Artificial Sequence: Synthetic oligonucleotide
  Target: FXN; (+) strand; PAM type: NRG; PAM sequence: GAG
agtgcggggattacaggtgt

SEQ ID NO: 17250 - DNA, 20 bp, Artificial Sequence
  Description of Artificial Sequence: Synthetic oligonucleotide
  Target: FXN; (+) strand; PAM type: NRG; PAM sequence: CAG
caggtgtgagctaccatgcc

SEQ ID NO: 17251 - DNA, 20 bp, Artificial Sequence
  Description of Artificial Sequence: Synthetic oligonucleotide
  Target: FXN; (+) strand; PAM type: NRG; PAM sequence: AAG
gtgagctaccatgcccagcc

SEQ ID NO: 17252 - DNA, 20 bp, Artificial Sequence
  Description of Artificial Sequence: Synthetic oligonucleotide
  Target: FXN; (+) strand; PAM type: NRG; PAM sequence: CAG
ctaccatgcccagccaagat

SEQ ID NO: 17253 - DNA, 20 bp, Artificial Sequence
  Description of Artificial Sequence: Synthetic oligonucleotide
  Target: FXN; (+) strand; PAM type: NRG; PAM sequence: AAG
atcaactatatatattacat

SEQ ID NO: 17254 - DNA, 20 bp, Artificial Sequence
  Description of Artificial Sequence: Synthetic oligonucleotide
  Target: FXN; (+) strand; PAM type: NRG; PAM sequence: AGG
tcaactatatatattacata

SEQ ID NO: 17255 - DNA, 20 bp, Artificial Sequence
  Description of Artificial Sequence: Synthetic oligonucleotide
  Target: FXN; (+) strand; PAM type: NRG; PAM sequence: CAG
ttacataaggtgtctttaaa

SEQ ID NO: 17256 - DNA, 20 bp, Artificial Sequence
  Description of Artificial Sequence: Synthetic oligonucleotide
  Target: FXN; (+) strand; PAM type: NRG; PAM sequence: AAG
aggtgtctttaaacagaaat

SEQ ID NO: 17257 - DNA, 20 bp, Artificial Sequence
  Description of Artificial Sequence: Synthetic oligonucleotide
  Target: FXN; (+) strand; PAM type: NRG; PAM sequence: AGG
ggtgtctttaaacagaaata

SEQ ID NO: 17258 - DNA, 20 bp, Artificial Sequence
  Description of Artificial Sequence: Synthetic oligonucleotide
  Target: FXN; (+) strand; PAM type: NRG; PAM sequence: TGG
aaggttatatattgatcgat

SEQ ID NO: 17259 - DNA, 20 bp, Artificial Sequence
  Description of Artificial Sequence: Synthetic oligonucleotide
  Target: FXN; (+) strand; PAM type: NRG; PAM sequence: CAG
attggtaacaatgttgtgac

SEQ ID NO: 17260 - DNA, 20 bp, Artificial Sequence
  Description of Artificial Sequence: Synthetic oligonucleotide
  Target: FXN; (+) strand; PAM type: NRG; PAM sequence: CAG
ggtaacaatgttgtgaccag

SEQ ID NO: 17261 - DNA, 20 bp, Artificial Sequence
  Description of Artificial Sequence: Synthetic oligonucleotide
  Target: FXN; (+) strand; PAM type: NRG; PAM sequence: CAG
atgttgtgaccagcagctta

SEQ ID NO: 17262 - DNA, 20 bp, Artificial Sequence
  Description of Artificial Sequence: Synthetic oligonucleotide
  Target: FXN; (+) strand; PAM type: NRG; PAM sequence: AGG
tgttgtgaccagcagcttac

SEQ ID NO: 17263 - DNA, 20 bp, Artificial Sequence
  Description of Artificial Sequence: Synthetic oligonucleotide
  Target: FXN; (+) strand; PAM type: NRG; PAM sequence: GGG
gttgtgaccagcagcttaca

SEQ ID NO: 17264 - DNA, 20 bp, Artificial Sequence
  Description of Artificial Sequence: Synthetic oligonucleotide
  Target: FXN; (+) strand; PAM type: NRG; PAM sequence: TAG
ccagcagcttacagggtacc

SEQ ID NO: 17265 - DNA, 20 bp, Artificial Sequence
  Description of Artificial Sequence: Synthetic oligonucleotide
  Target: FXN; (+) strand; PAM type: NRG; PAM sequence: GAG
ctataaataatttgctcgtt

SEQ ID NO: 17266 - DNA, 20 bp, Artificial Sequence
  Description of Artificial Sequence: Synthetic oligonucleotide
  Target: FXN; (+) strand; PAM type: NRG; PAM sequence: TGG
atttgctcgttgagtgtttg

SEQ ID NO: 17267 - DNA, 20 bp, Artificial Sequence
  Description of Artificial Sequence: Synthetic oligonucleotide
  Target: FXN; (+) strand; PAM type: NRG; PAM sequence: TAG
gagtgtttgtggcaactttg

SEQ ID NO: 17268 - DNA, 20 bp, Artificial Sequence
  Description of Artificial Sequence: Synthetic oligonucleotide
  Target: FXN; (+) strand; PAM type: NRG; PAM sequence: AAG
ctttgtagcacataactacc

SEQ ID NO: 17269 - DNA, 20 bp, Artificial Sequence
  Description of Artificial Sequence: Synthetic oligonucleotide
  Target: FXN; (+) strand; PAM type: NRG; PAM sequence: AAG
agcacataactaccaagaat

SEQ ID NO: 17270 - DNA, 20 bp, Artificial Sequence
  Description of Artificial Sequence: Synthetic oligonucleotide
  Target: FXN; (+) strand; PAM type: NRG; PAM sequence: AGG
gcacataactaccaagaata

SEQ ID NO: 17271 - DNA, 20 bp, Artificial Sequence
  Description of Artificial Sequence: Synthetic oligonucleotide
  Target: FXN; (+) strand; PAM type: NRG; PAM sequence: AAG
ccaagaataaggactgtaat

SEQ ID NO: 17272 - DNA, 20 bp, Artificial Sequence
  Description of Artificial Sequence: Synthetic oligonucleotide
  Target: FXN; (+) strand; PAM type: NRG; PAM sequence: GAG
aagaataaggactgtaataa

SEQ ID NO: 17273 - DNA, 20 bp, Artificial Sequence
  Description of Artificial Sequence: Synthetic oligonucleotide
  Target: FXN; (+) strand; PAM type: NRG; PAM sequence: CAG
taataagagtacgtccctca

SEQ ID NO: 17274 - DNA, 20 bp, Artificial Sequence
  Description of Artificial Sequence: Synthetic oligonucleotide
  Target: FXN; (+) strand; PAM type: NRG; PAM sequence: AGG
aataagagtacgtccctcac

SEQ ID NO: 17275 - DNA, 20 bp, Artificial Sequence
  Description of Artificial Sequence: Synthetic oligonucleotide
  Target: FXN; (+) strand; PAM type: NRG; PAM sequence: AAG
tccctcacaggattgtaatg

SEQ ID NO: 17276 - DNA, 20 bp, Artificial Sequence
  Description of Artificial Sequence: Synthetic oligonucleotide
  Target: FXN; (+) strand; PAM type: NRG; PAM sequence: GAG
acaggattgtaatgaagact

SEQ ID NO: 17277 - DNA, 20 bp, Artificial Sequence
  Description of Artificial Sequence: Synthetic oligonucleotide
  Target: FXN; (+) strand; PAM type: NRG; PAM sequence: AAG
agactgagtccatttacata

SEQ ID NO: 17278 - DNA, 20 bp, Artificial Sequence
  Description of Artificial Sequence: Synthetic oligonucleotide
  Target: FXN; (+) strand; PAM type: NRG; PAM sequence: AGG
gactgagtccatttacataa

SEQ ID NO: 17279 - DNA, 20 bp, Artificial Sequence
  Description of Artificial Sequence: Synthetic oligonucleotide
  Target: FXN; (+) strand; PAM type: NRG; PAM sequence: GAG
agtccatttacataaaggct

SEQ ID NO: 17280 - DNA, 20 bp, Artificial Sequence
  Description of Artificial Sequence: Synthetic oligonucleotide
  Target: FXN; (+) strand; PAM type: NRG; PAM sequence: GAG
tccatttacataaaggctga

SEQ ID NO: 17281 - DNA, 20 bp, Artificial Sequence
  Description of Artificial Sequence: Synthetic oligonucleotide
  Target: FXN; (+) strand; PAM type: NRG; PAM sequence: CAG
atttacataaaggctgagag

SEQ ID NO: 17282 - DNA, 20 bp, Artificial Sequence
  Description of Artificial Sequence: Synthetic oligonucleotide
  Target: FXN; (+) strand; PAM type: NRG; PAM sequence: AAG
taaaggctgagagcagtgtc

SEQ ID NO: 17283 - DNA, 20 bp, Artificial Sequence
  Description of Artificial Sequence: Synthetic oligonucleotide
  Target: FXN; (+) strand; PAM type: NRG; PAM sequence: CAG
aggctgagagcagtgtcaag

SEQ ID NO: 17284 - DNA, 20 bp, Artificial Sequence
  Description of Artificial Sequence: Synthetic oligonucleotide
  Target: FXN; (+) strand; PAM type: NRG; PAM sequence: TGG
tgagagcagtgtcaagcaga

SEQ ID NO: 17285 - DNA, 20 bp, Artificial Sequence
  Description of Artificial Sequence: Synthetic oligonucleotide
  Target: FXN; (+) strand; PAM type: NRG; PAM sequence: GAG
agagcagtgtcaagcagatg

SEQ ID NO: 17286 - DNA, 20 bp, Artificial Sequence
  Description of Artificial Sequence: Synthetic oligonucleotide
  Target: FXN; (+) strand; PAM type: NRG; PAM sequence: TAG
caagcagatggagaacactg

SEQ ID NO: 17287 - DNA, 20 bp, Artificial Sequence
  Description of Artificial Sequence: Synthetic oligonucleotide
  Target: FXN; (+) strand; PAM type: NRG; PAM sequence: TAG
gaacactgtagaatgtgcga

SEQ ID NO: 17288 - DNA, 20 bp, Artificial Sequence
  Description of Artificial Sequence: Synthetic oligonucleotide
  Target: FXN; (+) strand; PAM type: NRG; PAM sequence: CAG
agaatgtgcgatagctctaa

SEQ ID NO: 17289 - DNA, 20 bp, Artificial Sequence
  Description of Artificial Sequence: Synthetic oligonucleotide
  Target: FXN; (+) strand; PAM type: NRG; PAM sequence: TGG
atgtgcgatagctctaacag

SEQ ID NO: 17290 - DNA, 20 bp, Artificial Sequence
  Description of Artificial Sequence: Synthetic oligonucleotide
  Target: FXN; (+) strand; PAM type: NRG; PAM sequence: TGG
agctctaacagtggttatca

SEQ ID NO: 17291 - DNA, 20 bp, Artificial Sequence
  Description of Artificial Sequence: Synthetic oligonucleotide
  Target: FXN; (+) strand; PAM type: NRG; PAM sequence: CAG
tggctgccctctcacttctt

SEQ ID NO: 17292 - DNA, 20 bp, Artificial Sequence
  Description of Artificial Sequence: Synthetic oligonucleotide
  Target: FXN; (+) strand; PAM type: NRG; PAM sequence: GAG
gctgccctctcacttcttca

SEQ ID NO: 17293 - DNA, 20 bp, Artificial Sequence
  Description of Artificial Sequence: Synthetic oligonucleotide
  Target: FXN; (+) strand; PAM type: NRG; PAM sequence: AAG
cttcagagacatgtgtttct

SEQ ID NO: 17294 - DNA, 20 bp, Artificial Sequence
  Description of Artificial Sequence: Synthetic oligonucleotide
  Target: FXN; (+) strand; PAM type: NRG; PAM sequence: AGG
ttcagagacatgtgtttcta

SEQ ID NO: 17295 - DNA, 20 bp, Artificial Sequence
  Description of Artificial Sequence: Synthetic oligonucleotide
  Target: FXN; (+) strand; PAM type: NRG; PAM sequence: CAG
cctccccatccactgtcccc

SEQ ID NO: 17296 - DNA, 20 bp, Artificial Sequence
  Description of Artificial Sequence: Synthetic oligonucleotide
  Target: FXN; (+) strand; PAM type: NRG; PAM sequence: CAG
ttcctcctccacttacttcc

SEQ ID NO: 17297 - DNA, 20 bp, Artificial Sequence
  Description of Artificial Sequence: Synthetic oligonucleotide
  Target: FXN; (+) strand; PAM type: NRG; PAM sequence: GAG
ccttctgccttctcttttct

SEQ ID NO: 17298 - DNA, 20 bp, Artificial Sequence
  Description of Artificial Sequence: Synthetic oligonucleotide
  Target: FXN; (+) strand; PAM type: NRG; PAM sequence: AAG
ttctcttttctgagtttgct

SEQ ID NO: 17299 - DNA, 20 bp, Artificial Sequence
  Description of Artificial Sequence: Synthetic oligonucleotide
  Target: FXN; (+) strand; PAM type: NRG; PAM sequence: AGG
tctcttttctgagtttgcta

SEQ ID NO: 17300 - DNA, 20 bp, Artificial Sequence
  Description of Artificial Sequence: Synthetic oligonucleotide
  Target: FXN; (+) strand; PAM type: NRG; PAM sequence: GGG
ctcttttctgagtttgctaa

SEQ ID NO: 17301 - DNA, 20 bp, Artificial Sequence
  Description of Artificial Sequence: Synthetic oligonucleotide
  Target: FXN; (+) strand; PAM type: NRG; PAM sequence: TGG
gagtttgctaagggcactgc

SEQ ID NO: 17302 - DNA, 20 bp, Artificial Sequence
  Description of Artificial Sequence: Synthetic oligonucleotide
  Target: FXN; (+) strand; PAM type: NRG; PAM sequence: AAG
gctaagggcactgctggctc

SEQ ID NO: 17303 - DNA, 20 bp, Artificial Sequence
  Description of Artificial Sequence: Synthetic oligonucleotide
  Target: FXN; (+) strand; PAM type: NRG; PAM sequence: GAG
taagggcactgctggctcaa

SEQ ID NO: 17304 - DNA, 20 bp, Artificial Sequence
  Description of Artificial Sequence: Synthetic oligonucleotide
  Target: FXN; (+) strand; PAM type: NRG; PAM sequence: CAG
gggcactgctggctcaagag

SEQ ID NO: 17305 - DNA, 20 bp, Artificial Sequence
  Description of Artificial Sequence: Synthetic oligonucleotide
  Target: FXN; (+) strand; PAM type: NRG; PAM sequence: CAG
ggctcaagagcagtaactaa

SEQ ID NO: 17306 - DNA, 20 bp, Artificial Sequence
  Description of Artificial Sequence: Synthetic oligonucleotide
  Target: FXN; (+) strand; PAM type: NRG; PAM sequence: TGG
tctctcgcctcttctctcca

SEQ ID NO: 17307 - DNA, 20 bp, Artificial Sequence
  Description of Artificial Sequence: Synthetic oligonucleotide
  Target: FXN; (+) strand; PAM type: NRG; PAM sequence: CAG
cctcttctctccatggcaac

SEQ ID NO: 17308 - DNA, 20 bp, Artificial Sequence
  Description of Artificial Sequence: Synthetic oligonucleotide
  Target: FXN; (+) strand; PAM type: NRG; PAM sequence: TGG
ccatggcaaccagtgacctt

SEQ ID NO: 17309 - DNA, 20 bp, Artificial Sequence
  Description of Artificial Sequence: Synthetic oligonucleotide
  Target: FXN; (+) strand; PAM type: NRG; PAM sequence: GAG
atggcaaccagtgacctttg

SEQ ID NO: 17310 - DNA, 20 bp, Artificial Sequence
  Description of Artificial Sequence: Synthetic oligonucleotide
  Target: FXN; (+) strand; PAM type: NRG; PAM sequence: AAG
accttatcaccaatctctta

SEQ ID NO: 17311 - DNA, 20 bp, Artificial Sequence
  Description of Artificial Sequence: Synthetic oligonucleotide
  Target: FXN; (+) strand; PAM type: NRG; PAM sequence: CGG
accaatctcttaaagccctt

SEQ ID NO: 17312 - DNA, 20 bp, Artificial Sequence
  Description of Artificial Sequence: Synthetic oligonucleotide
  Target: FXN; (+) strand; PAM type: NRG; PAM sequence: CAG
aaagcccttcggtgccttcc

SEQ ID NO: 17313 - DNA, 20 bp, Artificial Sequence
  Description of Artificial Sequence: Synthetic oligonucleotide
  Target: FXN; (+) strand; PAM type: NRG; PAM sequence: AGG
aagcccttcggtgccttccc

SEQ ID NO: 17314 - DNA, 20 bp, Artificial Sequence
  Description of Artificial Sequence: Synthetic oligonucleotide
  Target: FXN; (+) strand; PAM type: NRG; PAM sequence: CAG
tgccttcccaggatgacgtc

SEQ ID NO: 17315 - DNA, 20 bp, Artificial Sequence
  Description of Artificial Sequence: Synthetic oligonucleotide
  Target: FXN; (+) strand; PAM type: NRG; PAM sequence: GAG
tcccaggatgacgtccagct

SEQ ID NO: 17316 - DNA, 20 bp, Artificial Sequence
  Description of Artificial Sequence: Synthetic oligonucleotide
  Target: FXN; (+) strand; PAM type: NRG; PAM sequence: AGG
cccaggatgacgtccagctg

SEQ ID NO: 17317 - DNA, 20 bp, Artificial Sequence
  Description of Artificial Sequence: Synthetic oligonucleotide
  Target: FXN; (+) strand; PAM type: NRG; PAM sequence: TGG
tgacgtccagctgaggtcct

SEQ ID NO: 17318 - DNA, 20 bp, Artificial Sequence
  Description of Artificial Sequence: Synthetic oligonucleotide
  Target: FXN; (+) strand; PAM type: NRG; PAM sequence: AAG
gtccagctgaggtccttggc

SEQ ID NO: 17319 - DNA, 20 bp, Artificial Sequence
  Description of Artificial Sequence: Synthetic oligonucleotide
  Target: FXN; (+) strand; PAM type: NRG; PAM sequence: CAG
ctgaggtccttggcaagacc

SEQ ID NO: 17320 - DNA, 20 bp, Artificial Sequence
  Description of Artificial Sequence: Synthetic oligonucleotide
  Target: FXN; (+) strand; PAM type: NRG; PAM sequence: AGG
tgaggtccttggcaagaccc

SEQ ID NO: 17321 - DNA, 20 bp, Artificial Sequence
  Description of Artificial Sequence: Synthetic oligonucleotide
  Target: FXN; (+) strand; PAM type: NRG; PAM sequence: GGG
gaggtccttggcaagaccca

SEQ ID NO: 17322 - DNA, 20 bp, Artificial Sequence
  Description of Artificial Sequence: Synthetic oligonucleotide
  Target: FXN; (+) strand; PAM type: NRG; PAM sequence: CAG
tcccctgcatctccctactc

SEQ ID NO: 17323 - DNA, 20 bp, Artificial Sequence
  Description of Artificial Sequence: Synthetic oligonucleotide
  Target: FXN; (+) strand; PAM type: NRG; PAM sequence: CAG
gctgcaccactcttgtgccc

SEQ ID NO: 17324 - DNA, 20 bp, Artificial Sequence
  Description of Artificial Sequence: Synthetic oligonucleotide
  Target: FXN; (+) strand; PAM type: NRG; PAM sequence: TGG
gcaccactcttgtgccccag

SEQ ID NO: 17325 - DNA, 20 bp, Artificial Sequence
  Description of Artificial Sequence: Synthetic oligonucleotide
  Target: FXN; (+) strand; PAM type: NRG; PAM sequence: CAG
gattatttccttcatctccc

SEQ ID NO: 17326 - DNA, 20 bp, Artificial Sequence
  Description of Artificial Sequence: Synthetic oligonucleotide
  Target: FXN; (+) strand; PAM type: NRG; PAM sequence: TGG
atttccttcatctccccagc

SEQ ID NO: 17327 - DNA, 20 bp, Artificial Sequence
  Description of Artificial Sequence: Synthetic oligonucleotide
  Target: FXN; (+) strand; PAM type: NRG; PAM sequence: CAG
ccttcatctccccagctggt

SEQ ID NO: 17328 - DNA, 20 bp, Artificial Sequence
  Description of Artificial Sequence: Synthetic oligonucleotide
  Target: FXN; (+) strand; PAM type: NRG; PAM sequence: CAG
tcatctccccagctggtcag

SEQ ID NO: 17329 - DNA, 20 bp, Artificial Sequence
  Description of Artificial Sequence: Synthetic oligonucleotide
  Target: FXN; (+) strand; PAM type: NRG; PAM sequence: GAG
atctccccagctggtcagca

SEQ ID NO: 17330 - DNA, 20 bp, Artificial Sequence
  Description of Artificial Sequence: Synthetic oligonucleotide
  Target: FXN; (+) strand; PAM type: NRG; PAM sequence: TGG
ccccagctggtcagcagagc

SEQ ID NO: 17331 - DNA, 20 bp, Artificial Sequence
  Description of Artificial Sequence: Synthetic oligonucleotide
  Target: FXN; (+) strand; PAM type: NRG; PAM sequence: TGG
cagctggtcagcagagctgg

SEQ ID NO: 17332 - DNA, 20 bp, Artificial Sequence
  Description of Artificial Sequence: Synthetic oligonucleotide
  Target: FXN; (+) strand; PAM type: NRG; PAM sequence: CAG
agagctggtggtaatcaact

SEQ ID NO: 17333 - DNA, 20 bp, Artificial Sequence
  Description of Artificial Sequence: Synthetic oligonucleotide
  Target: FXN; (+) strand; PAM type: NRG; PAM sequence: TGG
tcaactcagaccctgtcacc

SEQ ID NO: 17334 - DNA, 20 bp, Artificial Sequence
  Description of Artificial Sequence: Synthetic oligonucleotide
  Target: FXN; (+) strand; PAM type: NRG; PAM sequence: CAG
gaccctgtcacctggatgtc

SEQ ID NO: 17335 - DNA, 20 bp, Artificial Sequence
  Description of Artificial Sequence: Synthetic oligonucleotide
  Target: FXN; (+) strand; PAM type: NRG; PAM sequence: CAG
cctgtcacctggatgtccag

SEQ ID NO: 17336 - DNA, 20 bp, Artificial Sequence
  Description of Artificial Sequence: Synthetic oligonucleotide
  Target: FXN; (+) strand; PAM type: NRG; PAM sequence: TAG
tcacctggatgtccagcagt

SEQ ID NO: 17337 - DNA, 20 bp, Artificial Sequence
  Description of Artificial Sequence: Synthetic oligonucleotide
  Target: FXN; (+) strand; PAM type: NRG; PAM sequence: AGG
cacctggatgtccagcagtt

SEQ ID NO: 17338 - DNA, 20 bp, Artificial Sequence
  Description of Artificial Sequence: Synthetic oligonucleotide
  Target: FXN; (+) strand; PAM type: NRG; PAM sequence: GGG
acctggatgtccagcagtta

SEQ ID NO: 17339 - DNA, 20 bp, Artificial Sequence
  Description of Artificial Sequence: Synthetic oligonucleotide
  Target: FXN; (+) strand; PAM type: NRG; PAM sequence: CAG
tagggactaaaaaaaatcaa

SEQ ID NO: 17340 - DNA, 20 bp, Artificial Sequence
  Description of Artificial Sequence: Synthetic oligonucleotide
  Target: FXN; (+) strand; PAM type: NRG; PAM sequence: AGG
agggactaaaaaaaatcaac

SEQ ID NO: 17341 - DNA, 20 bp, Artificial Sequence
  Description of Artificial Sequence: Synthetic oligonucleotide
  Target: FXN; (+) strand; PAM type: NRG; PAM sequence: CAG
acaggtcacattctgtcctg

SEQ ID NO: 17342 - DNA, 20 bp, Artificial Sequence
  Description of Artificial Sequence: Synthetic oligonucleotide
  Target: FXN; (+) strand; PAM type: NRG; PAM sequence: AAG
gtcctgcagatcatgataat

SEQ ID NO: 17343 - DNA, 20 bp, Artificial Sequence
  Description of Artificial Sequence: Synthetic oligonucleotide
  Target: FXN; (+) strand; PAM type: NRG; PAM sequence: CAG
atcatgataataagatctgt

SEQ ID NO: 17344 - DNA, 20 bp, Artificial Sequence
  Description of Artificial Sequence: Synthetic oligonucleotide
  Target: FXN; (+) strand; PAM type: NRG; PAM sequence: CAG
tgataataagatctgtcaga

SEQ ID NO: 17345 - DNA, 20 bp, Artificial Sequence
  Description of Artificial Sequence: Synthetic oligonucleotide
  Target: FXN; (+) strand; PAM type: NRG; PAM sequence: CAG
taataagatctgtcagacag

SEQ ID NO: 17346 - DNA, 20 bp, Artificial Sequence
  Description of Artificial Sequence: Synthetic oligonucleotide
  Target: FXN; (+) strand; PAM type: NRG; PAM sequence: CAG
aagatctgtcagacagcagt

SEQ ID NO: 17347 - DNA, 20 bp, Artificial Sequence
  Description of Artificial Sequence: Synthetic oligonucleotide
  Target: FXN; (+) strand; PAM type: NRG; PAM sequence: CAG
atctgtcagacagcagtcag

SEQ ID NO: 17348 - DNA, 20 bp, Artificial Sequence
  Description of Artificial Sequence: Synthetic oligonucleotide
  Target: FXN; (+) strand; PAM type: NRG; PAM sequence: CAG
gtcagacagcagtcagcagt

SEQ ID NO: 17349 - DNA, 20 bp, Artificial Sequence
  Description of Artificial Sequence: Synthetic oligonucleotide
  Target: FXN; (+) strand; PAM type: NRG; PAM sequence: GAG
cagacagcagtcagcagtca

SEQ ID NO: 17350 - DNA, 20 bp, Artificial Sequence
  Description of Artificial Sequence: Synthetic oligonucleotide
  Target: FXN; (+) strand; PAM type: NRG; PAM sequence: TGG
gcagtcagagccaaatcttc

SEQ ID NO: 17351 - DNA, 20 bp, Artificial Sequence
  Description of Artificial Sequence: Synthetic oligonucleotide
  Target: FXN; (+) strand; PAM type: NRG; PAM sequence: CAG
gagccaaatcttctggactt

SEQ ID NO: 17352 - DNA, 20 bp, Artificial Sequence
  Description of Artificial Sequence: Synthetic oligonucleotide
  Target: FXN; (+) strand; PAM type: NRG; PAM sequence: CAG
ccaaatcttctggacttcag

SEQ ID NO: 17353 - DNA, 20 bp, Artificial Sequence
  Description of Artificial Sequence: Synthetic oligonucleotide
  Target: FXN; (+) strand; PAM type: NRG; PAM sequence: AGG
caaatcttctggacttcagc

SEQ ID NO: 17354 - DNA, 20 bp, Artificial Sequence
  Description of Artificial Sequence: Synthetic oligonucleotide
  Target: FXN; (+) strand; PAM type: NRG; PAM sequence: TAG
ctatttcctgttgcctctct

SEQ ID NO: 17355 - DNA, 20 bp, Artificial Sequence
  Description of Artificial Sequence: Synthetic oligonucleotide
  Target: FXN; (+) strand; PAM type: NRG; PAM sequence: AAG
gcctctcttagtgacctttt

SEQ ID NO: 17356 - DNA, 20 bp, Artificial Sequence
  Description of Artificial Sequence: Synthetic oligonucleotide
  Target: FXN; (+) strand; PAM type: NRG; PAM sequence: GAG
ctctcttagtgaccttttaa

SEQ ID NO: 17357 - DNA, 20 bp, Artificial Sequence
  Description of Artificial Sequence: Synthetic oligonucleotide
  Target: FXN; (+) strand; PAM type: NRG; PAM sequence: TGG
gtgaccttttaagagcattg

SEQ ID NO: 17358 - DNA, 20 bp, Artificial Sequence
  Description of Artificial Sequence: Synthetic oligonucleotide
  Target: FXN; (+) strand; PAM type: NRG; PAM sequence: CAG
agagcattgtggatgcctcc

SEQ ID NO: 17359 - DNA, 20 bp, Artificial Sequence
  Description of Artificial Sequence: Synthetic oligonucleotide
  Target: FXN; (+) strand; PAM type: NRG; PAM sequence: CAG
taaccaccctgtaacctgaa

SEQ ID NO: 17360 - DNA, 20 bp, Artificial Sequence
  Description of Artificial Sequence: Synthetic oligonucleotide
  Target: FXN; (+) strand; PAM type: NRG; PAM sequence: CAG
cctgtaacctgaacagcctg

SEQ ID NO: 17361 - DNA, 20 bp, Artificial Sequence
  Description of Artificial Sequence: Synthetic oligonucleotide
  Target: FXN; (+) strand; PAM type: NRG; PAM sequence: CAG
gtaacctgaacagcctgcag

SEQ ID NO: 17362 - DNA, 20 bp, Artificial Sequence
  Description of Artificial Sequence: Synthetic oligonucleotide
  Target: FXN; (+) strand; PAM type: NRG; PAM sequence: CAG
cagcctgcagcagccctgcc

SEQ ID NO: 17363 - DNA, 20 bp, Artificial Sequence
  Description of Artificial Sequence: Synthetic oligonucleotide
  Target: FXN; (+) strand; PAM type: NRG; PAM sequence: TAG
cctgcagcagccctgcccag

SEQ ID NO: 17364 - DNA, 20 bp, Artificial Sequence
  Description of Artificial Sequence: Synthetic oligonucleotide
  Target: FXN; (+) strand; PAM type: NRG; PAM sequence: TGG
agtagaacttcctgatgtga

SEQ ID NO: 17365 - DNA, 20 bp, Artificial Sequence
  Description of Artificial Sequence: Synthetic oligonucleotide
  Target: FXN; (+) strand; PAM type: NRG; PAM sequence: TAG
aaatgctgtgtctgcaccac

SEQ ID NO: 17366 - DNA, 20 bp, Artificial Sequence
  Description of Artificial Sequence: Synthetic oligonucleotide
  Target: FXN; (+) strand; PAM type: NRG; PAM sequence: TGG
tctgcaccactagccacatg

SEQ ID NO: 17367 - DNA, 20 bp, Artificial Sequence
  Description of Artificial Sequence: Synthetic oligonucleotide
  Target: FXN; (+) strand; PAM type: NRG; PAM sequence: CAG
ccactagccacatgtggcca

SEQ ID NO: 17368 - DNA, 20 bp, Artificial Sequence
  Description of Artificial Sequence: Synthetic oligonucleotide
  Target: FXN; (+) strand; PAM type: NRG; PAM sequence: AGG
cactagccacatgtggccac

SEQ ID NO: 17369 - DNA, 20 bp, Artificial Sequence
  Description of Artificial Sequence: Synthetic oligonucleotide
  Target: FXN; (+) strand; PAM type: NRG; PAM sequence: TGG
ggccacaggattctcgaaac

SEQ ID NO: 17370 - DNA, 20 bp, Artificial Sequence
  Description of Artificial Sequence: Synthetic oligonucleotide
  Target: FXN; (+) strand; PAM type: NRG; PAM sequence: TGG
cacaggattctcgaaactgg

SEQ ID NO: 17371 - DNA, 20 bp, Artificial Sequence
  Description of Artificial Sequence: Synthetic oligonucleotide
  Target: FXN; (+) strand; PAM type: NRG; PAM sequence: CAG
gattctcgaaactggtggtg

SEQ ID NO: 17372 - DNA, 20 bp, Artificial Sequence
  Description of Artificial Sequence: Synthetic oligonucleotide
  Target: FXN; (+) strand; PAM type: NRG; PAM sequence: GAG
tcgaaactggtggtgcagtt

SEQ ID NO: 17373 - DNA, 20 bp, Artificial Sequence
  Description of Artificial Sequence: Synthetic oligonucleotide
  Target: FXN; (+) strand; PAM type: NRG; PAM sequence: AGG
cgaaactggtggtgcagttg

SEQ ID NO: 17374 - DNA, 20 bp, Artificial Sequence
  Description of Artificial Sequence: Synthetic oligonucleotide
  Target: FXN; (+) strand; PAM type: NRG; PAM sequence: GAG
aaactggtggtgcagttgag

SEQ ID NO: 17375 - DNA, 20 bp, Artificial Sequence
  Description of Artificial Sequence: Synthetic oligonucleotide
  Target: FXN; (+) strand; PAM type: NRG; PAM sequence: TAG
tcattaaatttaaatgtaaa

SEQ ID NO: 17376 - DNA, 20 bp, Artificial Sequence
  Description of Artificial Sequence: Synthetic oligonucleotide
  Target: FXN; (+) strand; PAM type: NRG; PAM sequence: TGG
taaatgtaaatagctacgtg

SEQ ID NO: 17377 - DNA, 20 bp, Artificial Sequence
  Description of Artificial Sequence: Synthetic oligonucleotide
  Target: FXN; (+) strand; PAM type: NRG; PAM sequence: TGG
aatagctacgtgtggcttgt

SEQ ID NO: 17378 - DNA, 20 bp, Artificial Sequence
  Description of Artificial Sequence: Synthetic oligonucleotide
  Target: FXN; (+) strand; PAM type: NRG; PAM sequence: TAG
gctacgtgtggcttgttggc

SEQ ID NO: 17379 - DNA, 20 bp, Artificial Sequence
  Description of Artificial Sequence: Synthetic oligonucleotide
  Target: FXN; (+) strand; PAM type: NRG; PAM sequence: TGG
tggcttgttggctagcctat

SEQ ID NO: 17380 - DNA, 20 bp, Artificial Sequence
  Description of Artificial Sequence: Synthetic oligonucleotide
  Target: FXN; (+) strand; PAM type: NRG; PAM sequence: CGG
ggctagcctattggaaaaca

SEQ ID NO: 17381 - DNA, 20 bp, Artificial Sequence
  Description of Artificial Sequence: Synthetic oligonucleotide
  Target: FXN; (+) strand; PAM type: NRG; PAM sequence: GGG
gctagcctattggaaaacac

SEQ ID NO: 17382 - DNA, 20 bp, Artificial Sequence
  Description of Artificial Sequence: Synthetic oligonucleotide
  Target: FXN; (+) strand; PAM type: NRG; PAM sequence: TAG
cctattggaaaacacgggct

SEQ ID NO: 17383 - DNA, 20 bp, Artificial Sequence
  Description of Artificial Sequence: Synthetic oligonucleotide
  Target: FXN; (+) strand; PAM type: NRG; PAM sequence: GAG
tattggaaaacacgggctta

SEQ ID NO: 17384 - DNA, 20 bp, Artificial Sequence
  Description of Artificial Sequence: Synthetic oligonucleotide
  Target: FXN; (+) strand; PAM type: NRG; PAM sequence: GAG
ttggaaaacacgggcttaga

SEQ ID NO: 17385 - DNA, 20 bp, Artificial Sequence
  Description of Artificial Sequence: Synthetic oligonucleotide
  Target: FXN; (+) strand; PAM type: NRG; PAM sequence: CAG
aacacgggcttagagagaca

SEQ ID NO: 17386 - DNA, 20 bp, Artificial Sequence
  Description of Artificial Sequence: Synthetic oligonucleotide
  Target: FXN; (+) strand; PAM type: NRG; PAM sequence: AGG
acacgggcttagagagacac

SEQ ID NO: 17387 - DNA, 20 bp, Artificial Sequence
  Description of Artificial Sequence: Synthetic oligonucleotide
  Target: FXN; (+) strand; PAM type: NRG; PAM sequence: GGG
cacgggcttagagagacaca

SEQ ID NO: 17388 - DNA, 20 bp, Artificial Sequence
  Description of Artificial Sequence: Synthetic oligonucleotide
  Target: FXN; (+) strand; PAM type: NRG; PAM sequence: GAG
cgggcttagagagacacagg

SEQ ID NO: 17389 - DNA, 20 bp, Artificial Sequence
  Description of Artificial Sequence: Synthetic oligonucleotide
  Target: FXN; (+) strand; PAM type: NRG; PAM sequence: AAG
gaatcactgtaatgcactaa

SEQ ID NO: 17390 - DNA, 20 bp, Artificial Sequence
  Description of Artificial Sequence: Synthetic oligonucleotide
  Target: FXN; (+) strand; PAM type: NRG; PAM sequence: AAG
tcactgtaatgcactaaaag

SEQ ID NO: 17391 - DNA, 20 bp, Artificial Sequence
  Description of Artificial Sequence: Synthetic oligonucleotide
  Target: FXN; (+) strand; PAM type: NRG; PAM sequence: AGG
cactgtaatgcactaaaaga

SEQ ID NO: 17392 - DNA, 20 bp, Artificial Sequence
  Description of Artificial Sequence: Synthetic oligonucleotide
  Target: FXN; (+) strand; PAM type: NRG; PAM sequence: AAG
ggtaaaaaaaaaaaaatcct

SEQ ID NO: 17393 - DNA, 20 bp, Artificial Sequence
  Description of Artificial Sequence: Synthetic oligonucleotide
  Target: FXN; (+) strand; PAM type: NRG; PAM sequence: TAG
attcctaaaatactttaata

SEQ ID NO: 17394 - DNA, 20 bp, Artificial Sequence
  Description of Artificial Sequence: Synthetic oligonucleotide
  Target: FXN; (+) strand; PAM type: NRG; PAM sequence: AGG
ttcctaaaatactttaatat

SEQ ID NO: 17395 - DNA, 20 bp, Artificial Sequence
  Description of Artificial Sequence: Synthetic oligonucleotide
  Target: FXN; (+) strand; PAM type: NRG; PAM sequence: GGG
tcctaaaatactttaatata

SEQ ID NO: 17396 - DNA, 20 bp, Artificial Sequence
  Description of Artificial Sequence: Synthetic oligonucleotide
  Target: FXN; (+) strand; PAM type: NRG; PAM sequence: TGG
aaaatactttaatatagggc

SEQ ID NO: 17397 - DNA, 20 bp, Artificial Sequence
  Description of Artificial Sequence: Synthetic oligonucleotide
  Target: FXN; (+) strand; PAM type: NRG; PAM sequence: GGG
aaatactttaatatagggct

SEQ ID NO: 17398 - DNA, 20 bp, Artificial Sequence
  Description of Artificial Sequence: Synthetic oligonucleotide
  Target: FXN; (+) strand; PAM type: NRG; PAM sequence: CGG
ctttaatatagggctgggtg

SEQ ID NO: 17399 - DNA, 20 bp, Artificial Sequence
  Description of Artificial Sequence: Synthetic oligonucleotide
  Target: FXN; (+) strand; PAM type: NRG; PAM sequence: TGG
taatatagggctgggtgcgg

SEQ ID NO: 17400 - DNA, 20 bp, Artificial Sequence
  Description of Artificial Sequence: Synthetic oligonucleotide
  Target: FXN; (+) strand; PAM type: NRG; PAM sequence: CAG
tgggtgcggtggctcacatc

SEQ ID NO: 17401 - DNA, 20 bp, Artificial Sequence
  Description of Artificial Sequence: Synthetic oligonucleotide
  Target: FXN; (+) strand; PAM type: NRG; PAM sequence: TGG
gtggctcacatccagcattt

SEQ ID NO: 17402 - DNA, 20 bp, Artificial Sequence
  Description of Artificial Sequence: Synthetic oligonucleotide
  Target: FXN; (+) strand; PAM type: NRG; PAM sequence: GGG
tggctcacatccagcatttt

SEQ ID NO: 17403 - DNA, 20 bp, Artificial Sequence
  Description of Artificial Sequence: Synthetic oligonucleotide
  Target: FXN; (+) strand; PAM type: NRG; PAM sequence: AAG
ctcacatccagcattttggg

SEQ ID NO: 17404 - DNA, 20 bp, Artificial Sequence
  Description of Artificial Sequence: Synthetic oligonucleotide
  Target: FXN; (+) strand; PAM type: NRG; PAM sequence: GAG
atccagcattttgggaagct

SEQ ID NO: 17405 - DNA, 20 bp, Artificial Sequence
  Description of Artificial Sequence: Synthetic oligonucleotide
  Target: FXN; (+) strand; PAM type: NRG; PAM sequence: AGG
tccagcattttgggaagctg

SEQ ID NO: 17406 - DNA, 20 bp, Artificial Sequence
  Description of Artificial Sequence: Synthetic oligonucleotide
  Target: FXN; (+) strand; PAM type: NRG; PAM sequence: GAG
cagcattttgggaagctgag

SEQ ID NO: 17407 - DNA, 20 bp, Artificial Sequence
  Description of Artificial Sequence: Synthetic oligonucleotide
  Target: FXN; (+) strand; PAM type: NRG; PAM sequence: AGG
agcattttgggaagctgagg

SEQ ID NO: 17408 - DNA, 20 bp, Artificial Sequence
  Description of Artificial Sequence: Synthetic oligonucleotide
  Target: FXN; (+) strand; PAM type: NRG; PAM sequence: GGG
gcattttgggaagctgagga

SEQ ID NO: 17409 - DNA, 20 bp, Artificial Sequence
  Description of Artificial Sequence: Synthetic oligonucleotide
  Target: FXN; (+) strand; PAM type: NRG; PAM sequence: CAG
ttttgggaagctgaggaggg

SEQ ID NO: 17410 - DNA, 20 bp, Artificial Sequence
  Description of Artificial Sequence: Synthetic oligonucleotide
  Target: FXN; (+) strand; PAM type: NRG; PAM sequence: GAG
ctgaggagggcagatcactt

SEQ ID NO: 17411 - DNA, 20 bp, Artificial Sequence
  Description of Artificial Sequence: Synthetic oligonucleotide
  Target: FXN; (+) strand; PAM type: NRG; PAM sequence: AGG
tgaggagggcagatcacttg

SEQ ID NO: 17412 - DNA, 20 bp, Artificial Sequence
  Description of Artificial Sequence: Synthetic oligonucleotide
  Target: FXN; (+) strand; PAM type: NRG; PAM sequence: CAG
gagggcagatcacttgaggc

SEQ ID NO: 17413 - DNA, 20 bp, Artificial Sequence
  Description of Artificial Sequence: Synthetic oligonucleotide
  Target: FXN; (+) strand; PAM type: NRG; PAM sequence: AGG
agggcagatcacttgaggcc

SEQ ID NO: 17414 - DNA, 20 bp, Artificial Sequence
  Description of Artificial Sequence: Synthetic oligonucleotide
  Target: FXN; (+) strand; PAM type: NRG; PAM sequence: GAG
ggcagatcacttgaggccag

SEQ ID NO: 17415 - DNA, 20 bp, Artificial Sequence
  Description of Artificial Sequence: Synthetic oligonucleotide
  Target: FXN; (+) strand; PAM type: NRG; PAM sequence: AAG
tcacttgaggccaggagttc

SEQ ID NO: 17416 - DNA, 20 bp, Artificial Sequence
  Description of Artificial Sequence: Synthetic oligonucleotide
  Target: FXN; (+) strand; PAM type: NRG; PAM sequence: CAG
tgaggccaggagttcaagac

SEQ ID NO: 17417 - DNA, 20 bp, Artificial Sequence
  Description of Artificial Sequence: Synthetic oligonucleotide
  Target: FXN; (+) strand; PAM type: NRG; PAM sequence: TGG
ccaggagttcaagaccagcc

SEQ ID NO: 17418 - DNA, 20 bp, Artificial Sequence
  Description of Artificial Sequence: Synthetic oligonucleotide
  Target: FXN; (+) strand; PAM type: NRG; PAM sequence: TGG
caagaccagcctggccaaca

SEQ ID NO: 17419 - DNA, 20 bp, Artificial Sequence
  Description of Artificial Sequence: Synthetic oligonucleotide
  Target: FXN; (+) strand; PAM type: NRG; PAM sequence: CGG
ctactaaaaatacaaaaaat

SEQ ID NO: 17420 - DNA, 20 bp, Artificial Sequence
  Description of Artificial Sequence: Synthetic oligonucleotide
  Target: FXN; (+) strand; PAM type: NRG; PAM sequence: GGG
tactaaaaatacaaaaaatc

SEQ ID NO: 17421 - DNA, 20 bp, Artificial Sequence
  Description of Artificial Sequence: Synthetic oligonucleotide
  Target: FXN; (+) strand; PAM type: NRG; PAM sequence: CGG
aaaatacaaaaaatcgggtg

SEQ ID NO: 17422 - DNA, 20 bp, Artificial Sequence
  Description of Artificial Sequence: Synthetic oligonucleotide
  Target: FXN; (+) strand; PAM type: NRG; PAM sequence: TGG
atacaaaaaatcgggtgcgg

SEQ ID NO: 17423 - DNA, 20 bp, Artificial Sequence
  Description of Artificial Sequence: Synthetic oligonucleotide
  Target: FXN; (+) strand; PAM type: NRG; PAM sequence: CGG
caaaaaatcgggtgcggtgg

SEQ ID NO: 17424 - DNA, 20 bp, Artificial Sequence
  Description of Artificial Sequence: Synthetic oligonucleotide
  Target: FXN; (+) strand; PAM type: NRG; PAM sequence: GGG
aaaaaatcgggtgcggtggc

SEQ ID NO: 17425 - DNA, 20 bp, Artificial Sequence
  Description of Artificial Sequence: Synthetic oligonucleotide
  Target: FXN; (+) strand; PAM type: NRG; PAM sequence: CAG
gtggcgggtgcctgtaatcc

SEQ ID NO: 17426 - DNA, 20 bp, Artificial Sequence
  Description of Artificial Sequence: Synthetic oligonucleotide
  Target: FXN; (+) strand; PAM type: NRG; PAM sequence: CGG
tgcctgtaatcccagctacg

SEQ ID NO: 17427 - DNA, 20 bp, Artificial Sequence
  Description of Artificial Sequence: Synthetic oligonucleotide
  Target: FXN; (+) strand; PAM type: NRG; PAM sequence: GGG
gcctgtaatcccagctacgc

SEQ ID NO: 17428 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagctacgcgg

SEQ ID NO: 17429 - DNA, 20 bp, Artificial Sequence
  Description of Artificial Sequence: Synthetic oligonucleotide
  Target: FXN; (+) strand; PAM type: NRG; PAM sequence: AGG
tgtaatcccagctacgcggg

SEQ ID NO: 17430 - DNA, 20 bp, Artificial Sequence
  Description of Artificial Sequence: Synthetic oligonucleotide
  Target: FXN; (+) strand; PAM type: NRG; PAM sequence: GAG
tcccagctacgcgggaggct

SEQ ID NO: 17431 - DNA, 20 bp, Artificial Sequence
  Description of Artificial Sequence: Synthetic oligonucleotide
  Target: FXN; (+) strand; PAM type: NRG; PAM sequence: AGG
cccagctacgcgggaggctg

SEQ ID NO: 17432 - DNA, 20 bp, Artificial Sequence
  Description of Artificial Sequence: Synthetic oligonucleotide
  Target: FXN; (+) strand; PAM type: NRG; PAM sequence: GAG
tacgcgggaggctgaggcac

SEQ ID NO: 17433 - DNA, 20 bp, Artificial Sequence
  Description of Artificial Sequence: Synthetic oligonucleotide
  Target: FXN; (+) strand; PAM type: NRG; PAM sequence: CGG
gcacgagaatcactcgaacc

SEQ ID NO: 17434 - DNA, 20 bp, Artificial Sequence
  Description of Artificial Sequence: Synthetic oligonucleotide
  Target: FXN; (+) strand; PAM type: NRG; PAM sequence: GGG
cacgagaatcactcgaaccc

SEQ ID NO: 17435 - DNA, 20 bp, Artificial Sequence
  Description of Artificial Sequence: Synthetic oligonucleotide
  Target: FXN; (+) strand; PAM type: NRG; PAM sequence: GAG
cgagaatcactcgaacccgg

SEQ ID NO: 17436 - DNA, 20 bp, Artificial Sequence
  Description of Artificial Sequence: Synthetic oligonucleotide
  Target: FXN; (+) strand; PAM type: NRG; PAM sequence: AGG
gagaatcactcgaacccggg

SEQ ID NO: 17437 - DNA, 20 bp, Artificial Sequence
  Description of Artificial Sequence: Synthetic oligonucleotide
  Target: FXN; (+) strand; PAM type: NRG; PAM sequence: CGG
aatcactcgaacccgggagg

SEQ ID NO: 17438 - DNA, 20 bp, Artificial Sequence
  Description of Artificial Sequence: Synthetic oligonucleotide
  Target: FXN; (+) strand; PAM type: NRG; PAM sequence: GGG
atcactcgaacccgggaggc

SEQ ID NO: 17439 - DNA, 20 bp, Artificial Sequence
  Description of Artificial Sequence: Synthetic oligonucleotide
  Target: FXN; (+) strand; PAM type: NRG; PAM sequence: GGG
tcactcgaacccgggaggcg

SEQ ID NO: 17440 - DNA, 20 bp, Artificial Sequence
  Description of Artificial Sequence: Synthetic oligonucleotide
  Target: FXN; (+) strand; PAM type: NRG; PAM sequence: GGG
cactcgaacccgggaggcgg

SEQ ID NO: 17441 - DNA, 20 bp, Artificial Sequence
  Description of Artificial Sequence: Synthetic oligonucleotide
  Target: FXN; (+) strand; PAM type: NRG; PAM sequence: CAG
aacccgggaggcgggggttg

SEQ ID NO: 17442 - DNA, 20 bp, Artificial Sequence
  Description of Artificial Sequence: Synthetic oligonucleotide
  Target: FXN; (+) strand; PAM type: NRG; PAM sequence: GAG
cgggaggcgggggttgcagt

SEQ ID NO: 17443 - DNA, 20 bp, Artificial Sequence
  Description of Artificial Sequence: Synthetic oligonucleotide
  Target: FXN; (+) strand; PAM type: NRG; PAM sequence: GAG
ggcgggggttgcagtgagcc

SEQ ID NO: 17444 - DNA, 20 bp, Artificial Sequence
  Description of Artificial Sequence: Synthetic oligonucleotide
  Target: FXN; (+) strand; PAM type: NRG; PAM sequence: CAG
gagatcgtgccactgcactc

SEQ ID NO: 17445 - DNA, 20 bp, Artificial Sequence
  Description of Artificial Sequence: Synthetic oligonucleotide
  Target: FXN; (+) strand; PAM type: NRG; PAM sequence: TGG
cgtgccactgcactccagcc

SEQ ID NO: 17446 - DNA, 20 bp, Artificial Sequence
  Description of Artificial Sequence: Synthetic oligonucleotide
  Target: FXN; (+) strand; PAM type: NRG; PAM sequence: GGG
gtgccactgcactccagcct

SEQ ID NO: 17447 - DNA, 20 bp, Artificial Sequence
  Description of Artificial Sequence: Synthetic oligonucleotide
  Target: FXN; (+) strand; PAM type: NRG; PAM sequence: CAG
ctgcactccagcctgggcga

SEQ ID NO: 17448 - DNA, 20 bp, Artificial Sequence
  Description of Artificial Sequence: Synthetic oligonucleotide
  Target: FXN; (+) strand; PAM type: NRG; PAM sequence: GAG
gcactccagcctgggcgaca

SEQ ID NO: 17449 - DNA, 20 bp, Artificial Sequence
  Description of Artificial Sequence: Synthetic oligonucleotide
  Target: FXN; (+) strand; PAM type: NRG; PAM sequence: GAG
tccagcctgggcgacagagc

SEQ ID NO: 17450 - DNA, 20 bp, Artificial Sequence
  Description of Artificial Sequence: Synthetic oligonucleotide
  Target: FXN; (+) strand; PAM type: NRG; PAM sequence: CAG
aaaaccaaaaaaaaaaactt

SEQ ID NO: 17451 - DNA, 20 bp, Artificial Sequence
  Description of Artificial Sequence: Synthetic oligonucleotide
  Target: FXN; (+) strand; PAM type: NRG; PAM sequence: CAG
atgattatttaaccaaaatg

SEQ ID NO: 17452 - DNA, 20 bp, Artificial Sequence
  Description of Artificial Sequence: Synthetic oligonucleotide
  Target: FXN; (+) strand; PAM type: NRG; PAM sequence: AGG
tgattatttaaccaaaatgc

SEQ ID NO: 17453 - DNA, 20 bp, Artificial Sequence
  Description of Artificial Sequence: Synthetic oligonucleotide
  Target: FXN; (+) strand; PAM type: NRG; PAM sequence: TAG
tatttaaccaaaatgcaggt

SEQ ID NO: 17454 - DNA, 20 bp, Artificial Sequence
  Description of Artificial Sequence: Synthetic oligonucleotide
  Target: FXN; (+) strand; PAM type: NRG; PAM sequence: CGG
aatgcaggttagttgttcac

SEQ ID NO: 17455 - DNA, 20 bp, Artificial Sequence
  Description of Artificial Sequence: Synthetic oligonucleotide
  Target: FXN; (+) strand; PAM type: NRG; PAM sequence: CAG
ggttagttgttcaccggatg

SEQ ID NO: 17456 - DNA, 20 bp, Artificial Sequence
  Description of Artificial Sequence: Synthetic oligonucleotide
  Target: FXN; (+) strand; PAM type: NRG; PAM sequence: GAG
ttagttgttcaccggatgca

SEQ ID NO: 17457 - DNA, 20 bp, Artificial Sequence
  Description of Artificial Sequence: Synthetic oligonucleotide
  Target: FXN; (+) strand; PAM type: NRG; PAM sequence: AAG
ggatgcagagtccaattaac

SEQ ID NO: 17458 - DNA, 20 bp, Artificial Sequence
  Description of Artificial Sequence: Synthetic oligonucleotide
  Target: FXN; (+) strand; PAM type: NRG; PAM sequence: GAG
atgcagagtccaattaacaa

SEQ ID NO: 17459 - DNA, 20 bp, Artificial Sequence
  Description of Artificial Sequence: Synthetic oligonucleotide
  Target: FXN; (+) strand; PAM type: NRG; PAM sequence: AAG
agagtccaattaacaagagc

SEQ ID NO: 17460 - DNA, 20 bp, Artificial Sequence
  Description of Artificial Sequence: Synthetic oligonucleotide
  Target: FXN; (+) strand; PAM type: NRG; PAM sequence: AGG
gagtccaattaacaagagca

SEQ ID NO: 17461 - DNA, 20 bp, Artificial Sequence
  Description of Artificial Sequence: Synthetic oligonucleotide
  Target: FXN; (+) strand; PAM type: NRG; PAM sequence: TGG
caattaacaagagcaaggcc

SEQ ID NO: 17462 - DNA, 20 bp, Artificial Sequence
  Description of Artificial Sequence: Synthetic oligonucleotide
  Target: FXN; (+) strand; PAM type: NRG; PAM sequence: AAG
gcaaggcctggtaccaaaaa

SEQ ID NO: 17463 - DNA, 20 bp, Artificial Sequence
  Description of Artificial Sequence: Synthetic oligonucleotide
  Target: FXN; (+) strand; PAM type: NRG; PAM sequence: TAG
aagtgaatttactccgaaac

SEQ ID NO: 17464 - DNA, 20 bp, Artificial Sequence
  Description of Artificial Sequence: Synthetic oligonucleotide
  Target: FXN; (+) strand; PAM type: NRG; PAM sequence: TGG
aatttactccgaaactagct

SEQ ID NO: 17465 - DNA, 20 bp, Artificial Sequence
  Description of Artificial Sequence: Synthetic oligonucleotide
  Target: FXN; (+) strand; PAM type: NRG; PAM sequence: GGG
atttactccgaaactagctt

SEQ ID NO: 17466 - DNA, 20 bp, Artificial Sequence
  Description of Artificial Sequence: Synthetic oligonucleotide
  Target: FXN; (+) strand; PAM type: NRG; PAM sequence: GAG
actccgaaactagcttgggt

SEQ ID NO: 17467 - DNA, 20 bp, Artificial Sequence
  Description of Artificial Sequence: Synthetic oligonucleotide
  Target: FXN; (+) strand; PAM type: NRG; PAM sequence: AGG
ctccgaaactagcttgggtg

SEQ ID NO: 17468 - DNA, 20 bp, Artificial Sequence
  Description of Artificial Sequence: Synthetic oligonucleotide
  Target: FXN; (+) strand; PAM type: NRG; PAM sequence: GGG
tccgaaactagcttgggtga

SEQ ID NO: 17469 - DNA, 20 bp, Artificial Sequence
  Description of Artificial Sequence: Synthetic oligonucleotide
  Target: FXN; (+) strand; PAM type: NRG; PAM sequence: GGG
ccgaaactagcttgggtgag

SEQ ID NO: 17470 - DNA, 20 bp, Artificial Sequence
  Description of Artificial Sequence: Synthetic oligonucleotide
  Target: FXN; (+) strand; PAM type: NRG; PAM sequence: AAG
tagcttgggtgaggggtaca

SEQ ID NO: 17471 - DNA, 20 bp, Artificial Sequence
  Description of Artificial Sequence: Synthetic oligonucleotide
  Target: FXN; (+) strand; PAM type: NRG; PAM sequence: AAG
agcatcctgcctttctttaa

SEQ ID NO: 17472 - DNA, 20 bp, Artificial Sequence
  Description of Artificial Sequence: Synthetic oligonucleotide
  Target: FXN; (+) strand; PAM type: NRG; PAM sequence: TGG
ttaaaagtgctgcttcccct

SEQ ID NO: 17473 - DNA, 20 bp, Artificial Sequence
  Description of Artificial Sequence: Synthetic oligonucleotide
  Target: FXN; (+) strand; PAM type: NRG; PAM sequence: AAG
aaagtgctgcttccccttgg

SEQ ID NO: 17474 - DNA, 20 bp, Artificial Sequence
  Description of Artificial Sequence: Synthetic oligonucleotide
  Target: FXN; (+) strand; PAM type: NRG; PAM sequence: TAG
gtgctgcttccccttggaag

SEQ ID NO: 17475 - DNA, 20 bp, Artificial Sequence
  Description of Artificial Sequence: Synthetic oligonucleotide
  Target: FXN; (+) strand; PAM type: NRG; PAM sequence: AAG
tgcttccccttggaagtaga

SEQ ID NO: 17476 - DNA, 20 bp, Artificial Sequence
  Description of Artificial Sequence: Synthetic oligonucleotide
  Target: FXN; (+) strand; PAM type: NRG; PAM sequence: TGG
ttccccttggaagtagaaag

SEQ ID NO: 17477 - DNA, 20 bp, Artificial Sequence
  Description of Artificial Sequence: Synthetic oligonucleotide
  Target: FXN; (+) strand; PAM type: NRG; PAM sequence: AAG
tagaaagtggacacttttat

SEQ ID NO: 17478 - DNA, 20 bp, Artificial Sequence
  Description of Artificial Sequence: Synthetic oligonucleotide
  Target: FXN; (+) strand; PAM type: NRG; PAM sequence: AGG
agaaagtggacacttttata

SEQ ID NO: 17479 - DNA, 20 bp, Artificial Sequence
  Description of Artificial Sequence: Synthetic oligonucleotide
  Target: FXN; (+) strand; PAM type: NRG; PAM sequence: AAG
agtggacacttttataaggt

SEQ ID NO: 17480 - DNA, 20 bp, Artificial Sequence
  Description of Artificial Sequence: Synthetic oligonucleotide
  Target: FXN; (+) strand; PAM type: NRG; PAM sequence: AGG
gtggacacttttataaggta

SEQ ID NO: 17481 - DNA, 20 bp, Artificial Sequence
  Description of Artificial Sequence: Synthetic oligonucleotide
  Target: FXN; (+) strand; PAM type: NRG; PAM sequence: GGG
tggacacttttataaggtaa

SEQ ID NO: 17482 - DNA, 20 bp, Artificial Sequence
  Description of Artificial Sequence: Synthetic oligonucleotide
  Target: FXN; (+) strand; PAM type: NRG; PAM sequence: GGG
ggacacttttataaggtaag

SEQ ID NO: 17483 - DNA, 20 bp, Artificial Sequence
  Description of Artificial Sequence: Synthetic oligonucleotide
  Target: FXN; (+) strand; PAM type: NRG; PAM sequence: GGG
gacacttttataaggtaagg

SEQ ID NO: 17484 - DNA, 20 bp, Artificial Sequence
  Description of Artificial Sequence: Synthetic oligonucleotide
  Target: FXN; (+) strand; PAM type: NRG; PAM sequence: GGG
acacttttataaggtaaggg

SEQ ID NO: 17485 - DNA, 20 bp, Artificial Sequence
  Description of Artificial Sequence: Synthetic oligonucleotide
  Target: FXN; (+) strand; PAM type: NRG; PAM sequence: AAG
cttttataaggtaagggggg

SEQ ID NO: 17486 - DNA, 20 bp, Artificial Sequence
  Description of Artificial Sequence: Synthetic oligonucleotide
  Target: FXN; (+) strand; PAM type: NRG; PAM sequence: AAG
aggtaaggggggaagtgtgc

SEQ ID NO: 17487 - DNA, 20 bp, Artificial Sequence
  Description of Artificial Sequence: Synthetic oligonucleotide
  Target: FXN; (+) strand; PAM type: NRG; PAM sequence: AGG
ggtaaggggggaagtgtgca

SEQ ID NO: 17488 - DNA, 20 bp, Artificial Sequence
  Description of Artificial Sequence: Synthetic oligonucleotide
  Target: FXN; (+) strand; PAM type: NRG; PAM sequence: GGG
gtaaggggggaagtgtgcaa

SEQ ID NO: 17489 - DNA, 20 bp, Artificial Sequence
  Description of Artificial Sequence: Synthetic oligonucleotide
  Target: FXN; (+) strand; PAM type: NRG; PAM sequence: AAG
ggggggaagtgtgcaagggc

SEQ ID NO: 17490 - DNA, 20 bp, Artificial Sequence
  Description of Artificial Sequence: Synthetic oligonucleotide
  Target: FXN; (+) strand; PAM type: NRG; PAM sequence: TGG
gggaagtgtgcaagggcaag

SEQ ID NO: 17491 - DNA, 20 bp, Artificial Sequence
  Description of Artificial Sequence: Synthetic oligonucleotide
  Target: FXN; (+) strand; PAM type: NRG; PAM sequence: GGG
ggaagtgtgcaagggcaagt

SEQ ID NO: 17492 - DNA, 20 bp, Artificial Sequence
  Description of Artificial Sequence: Synthetic oligonucleotide
  Target: FXN; (+) strand; PAM type: NRG; PAM sequence: GGG
gaagtgtgcaagggcaagtg

SEQ ID NO: 17493 - DNA, 20 bp, Artificial Sequence
  Description of Artificial Sequence: Synthetic oligonucleotide
  Target: FXN; (+) strand; PAM type: NRG; PAM sequence: GGG
aagtgtgcaagggcaagtgg

SEQ ID NO: 17494 - DNA, 20 bp, Artificial Sequence
  Description of Artificial Sequence: Synthetic oligonucleotide
  Target: FXN; (+) strand; PAM type: NRG; PAM sequence: GGG
agtgtgcaagggcaagtggg

SEQ ID NO: 17495 - DNA, 20 bp, Artificial Sequence
  Description of Artificial Sequence: Synthetic oligonucleotide
  Target: FXN; (+) strand; PAM type: NRG; PAM sequence: GGG
gtgtgcaagggcaagtgggg

SEQ ID NO: 17496 - DNA, 20 bp, Artificial Sequence
  Description of Artificial Sequence: Synthetic oligonucleotide
  Target: FXN; (+) strand; PAM type: NRG; PAM sequence: TAG
aagtgggggggtccctctgc

SEQ ID NO: 17497 - DNA, 20 bp, Artificial Sequence
  Description of Artificial Sequence: Synthetic oligonucleotide
  Target: FXN; (+) strand; PAM type: NRG; PAM sequence: CAG
ctagttccgtgcatactcta

SEQ ID NO: 17498 - DNA, 20 bp, Artificial Sequence
  Description of Artificial Sequence: Synthetic oligonucleotide
  Target: FXN; (+) strand; PAM type: NRG; PAM sequence: AGG
tagttccgtgcatactctac

SEQ ID NO: 17499 - DNA, 20 bp, Artificial Sequence
  Description of Artificial Sequence: Synthetic oligonucleotide
  Target: FXN; (+) strand; PAM type: NRG; PAM sequence: CAG
tccgtgcatactctacagga

SEQ ID NO: 17500 - DNA, 20 bp, Artificial Sequence
  Description of Artificial Sequence: Synthetic oligonucleotide
  Target: FXN; (+) strand; PAM type: NRG; PAM sequence: TGG
actctacaggacagttgact

SEQ ID NO: 17501 - DNA, 20 bp, Artificial Sequence
  Description of Artificial Sequence: Synthetic oligonucleotide
  Target: FXN; (+) strand; PAM type: NRG; PAM sequence: TGG
cagttgacttggcaccttcc

SEQ ID NO: 17502 - DNA, 20 bp, Artificial Sequence
  Description of Artificial Sequence: Synthetic oligonucleotide
  Target: FXN; (+) strand; PAM type: NRG; PAM sequence: TAG
tgacttggcaccttcctggt

SEQ ID NO: 17503 - DNA, 20 bp, Artificial Sequence
  Description of Artificial Sequence: Synthetic oligonucleotide
  Target: FXN; (+) strand; PAM type: NRG; PAM sequence: AAG
gcaccttcctggttagtaat

SEQ ID NO: 17504 - DNA, 20 bp, Artificial Sequence
  Description of Artificial Sequence: Synthetic oligonucleotide
  Target: FXN; (+) strand; PAM type: NRG; PAM sequence: TAG
tcctggttagtaataagctg

SEQ ID NO: 17505 - DNA, 20 bp, Artificial Sequence
  Description of Artificial Sequence: Synthetic oligonucleotide
  Target: FXN; (+) strand; PAM type: NRG; PAM sequence: CAG
tggttagtaataagctgtag

SEQ ID NO: 17506 - DNA, 20 bp, Artificial Sequence
  Description of Artificial Sequence: Synthetic oligonucleotide
  Target: FXN; (+) strand; PAM type: NRG; PAM sequence: TGG
ttagtaataagctgtagcag

SEQ ID NO: 17507 - DNA, 20 bp, Artificial Sequence
  Description of Artificial Sequence: Synthetic oligonucleotide
  Target: FXN; (+) strand; PAM type: NRG; PAM sequence: AAG
aataagctgtagcagtggcc

SEQ ID NO: 17508 - DNA, 20 bp, Artificial Sequence
  Description of Artificial Sequence: Synthetic oligonucleotide
  Target: FXN; (+) strand; PAM type: NRG; PAM sequence: TGG
aagctgtagcagtggccaag

SEQ ID NO: 17509 - DNA, 20 bp, Artificial Sequence
  Description of Artificial Sequence: Synthetic oligonucleotide
  Target: FXN; (+) strand; PAM type: NRG; PAM sequence: GGG
agctgtagcagtggccaagt

SEQ ID NO: 17510 - DNA, 20 bp, Artificial Sequence
  Description of Artificial Sequence: Synthetic oligonucleotide
  Target: FXN; (+) strand; PAM type: NRG; PAM sequence: CAG
tggccaagtgggcatgcttt

SEQ ID NO: 17511 - DNA, 20 bp, Artificial Sequence
  Description of Artificial Sequence: Synthetic oligonucleotide
  Target: FXN; (+) strand; PAM type: NRG; PAM sequence: CAG
atgctttcagtatgccctcc

SEQ ID NO: 17512 - DNA, 20 bp, Artificial Sequence
  Description of Artificial Sequence: Synthetic oligonucleotide
  Target: FXN; (+) strand; PAM type: NRG; PAM sequence: AAG
tatgccctcccagtgaatga

SEQ ID NO: 17513 - DNA, 20 bp, Artificial Sequence
  Description of Artificial Sequence: Synthetic oligonucleotide
  Target: FXN; (+) strand; PAM type: NRG; PAM sequence: GAG
tcccagtgaatgaaagtcct

SEQ ID NO: 17514 - DNA, 20 bp, Artificial Sequence
  Description of Artificial Sequence: Synthetic oligonucleotide
  Target: FXN; (+) strand; PAM type: NRG; PAM sequence: AGG
cccagtgaatgaaagtcctg

SEQ ID NO: 17515 - DNA, 20 bp, Artificial Sequence
  Description of Artificial Sequence: Synthetic oligonucleotide
  Target: FXN; (+) strand; PAM type: NRG; PAM sequence: AAG
aaagtcctgaggcaaccccc

SEQ ID NO: 17516 - DNA, 20 bp, Artificial Sequence
  Description of Artificial Sequence: Synthetic oligonucleotide
  Target: FXN; (+) strand; PAM type: NRG; PAM sequence: AGG
aagtcctgaggcaaccccca

SEQ ID NO: 17517 - DNA, 20 bp, Artificial Sequence
  Description of Artificial Sequence: Synthetic oligonucleotide
  Target: FXN; (+) strand; PAM type: NRG; PAM sequence: GGG
agtcctgaggcaacccccaa

SEQ ID NO: 17518 - DNA, 20 bp, Artificial Sequence
  Description of Artificial Sequence: Synthetic oligonucleotide
  Target: FXN; (+) strand; PAM type: NRG; PAM sequence: TGG
cctgaggcaacccccaaggg

SEQ ID NO: 17519 - DNA, 20 bp, Artificial Sequence
  Description of Artificial Sequence: Synthetic oligonucleotide
  Target: FXN; (+) strand; PAM type: NRG; PAM sequence: AAG
gaggcaacccccaagggtgg

SEQ ID NO: 17520 - DNA, 20 bp, Artificial Sequence
  Description of Artificial Sequence: Synthetic oligonucleotide
  Target: FXN; (+) strand; PAM type: NRG; PAM sequence: CAG
acccccaagggtggaagtgc

SEQ ID NO: 17521 - DNA, 20 bp, Artificial Sequence
  Description of Artificial Sequence: Synthetic oligonucleotide
  Target: FXN; (+) strand; PAM type: NRG; PAM sequence: AGG
cccccaagggtggaagtgcc

SEQ ID NO: 17522 - DNA, 20 bp, Artificial Sequence
  Description of Artificial Sequence: Synthetic oligonucleotide
  Target: FXN; (+) strand; PAM type: NRG; PAM sequence: TGG
agtgccaggccaccacccac

SEQ ID NO: 17523 - DNA, 20 bp, Artificial Sequence
  Description of Artificial Sequence: Synthetic oligonucleotide
  Target: FXN; (+) strand; PAM type: NRG; PAM sequence: GAG
tgccaggccaccacccactg

SEQ ID NO: 17524 - DNA, 20 bp, Artificial Sequence
  Description of Artificial Sequence: Synthetic oligonucleotide
  Target: FXN; (+) strand; PAM type: NRG; PAM sequence: AGG
gccaggccaccacccactgg

SEQ ID NO: 17525 - DNA, 20 bp, Artificial Sequence
  Description of Artificial Sequence: Synthetic oligonucleotide
  Target: FXN; (+) strand; PAM type: NRG; PAM sequence: AAG
ccaccacccactggaggtga

SEQ ID NO: 17526 - DNA, 20 bp, Artificial Sequence
  Description of Artificial Sequence: Synthetic oligonucleotide
  Target: FXN; (+) strand; PAM type: NRG; PAM sequence: TGG
tggaggtgaaagttccgtga

SEQ ID NO: 17527 - DNA, 20 bp, Artificial Sequence
  Description of Artificial Sequence: Synthetic oligonucleotide
  Target: FXN; (+) strand; PAM type: NRG; PAM sequence: GGG
ggaggtgaaagttccgtgat

SEQ ID NO: 17528 - DNA, 20 bp, Artificial Sequence
  Description of Artificial Sequence: Synthetic oligonucleotide
  Target: FXN; (+) strand; PAM type: NRG; PAM sequence: TGG
gttccgtgatgggtttgctt

SEQ ID NO: 17529 - DNA, 20 bp, Artificial Sequence
  Description of Artificial Sequence: Synthetic oligonucleotide
  Target: FXN; (+) strand; PAM type: NRG; PAM sequence: TGG
tctgcgaatctactgtcatg

SEQ ID NO: 17530 - DNA, 20 bp, Artificial Sequence
  Description of Artificial Sequence: Synthetic oligonucleotide
  Target: FXN; (+) strand; PAM type: NRG; PAM sequence: GAG
tgcgaatctactgtcatgtg

SEQ ID NO: 17531 - DNA, 20 bp, Artificial Sequence
  Description of Artificial Sequence: Synthetic oligonucleotide
  Target: FXN; (+) strand; PAM type: NRG; PAM sequence: GAG
cgaatctactgtcatgtgga

SEQ ID NO: 17532 - DNA, 20 bp, Artificial Sequence
  Description of Artificial Sequence: Synthetic oligonucleotide
  Target: FXN; (+) strand; PAM type: NRG; PAM sequence: TGG
atgtggagagatctgtgctc

SEQ ID NO: 17533 - DNA, 20 bp, Artificial Sequence
  Description of Artificial Sequence: Synthetic oligonucleotide
  Target: FXN; (+) strand; PAM type: NRG; PAM sequence: AAG
tggagagatctgtgctctgg

SEQ ID NO: 17534 - DNA, 20 bp, Artificial Sequence
  Description of Artificial Sequence: Synthetic oligonucleotide
  Target: FXN; (+) strand; PAM type: NRG; PAM sequence: GAG
gagagatctgtgctctggaa

SEQ ID NO: 17535 - DNA, 20 bp, Artificial Sequence
  Description of Artificial Sequence: Synthetic oligonucleotide
  Target: FXN; (+) strand; PAM type: NRG; PAM sequence: CAG
ctgtgctctggaagagcata

SEQ ID NO: 17536 - DNA, 20 bp, Artificial Sequence
  Description of Artificial Sequence: Synthetic oligonucleotide
  Target: FXN; (+) strand; PAM type: NRG; PAM sequence: TAG
gctctggaagagcatacagt

SEQ ID NO: 17537 - DNA, 20 bp, Artificial Sequence
  Description of Artificial Sequence: Synthetic oligonucleotide
  Target: FXN; (+) strand; PAM type: NRG; PAM sequence: AAG
ggaagagcatacagttagaa

SEQ ID NO: 17538 - DNA, 20 bp, Artificial Sequence
  Description of Artificial Sequence: Synthetic oligonucleotide
  Target: FXN; (+) strand; PAM type: NRG; PAM sequence: AAG
agttagaaaagcttgccctg

SEQ ID NO: 17539 - DNA, 20 bp, Artificial Sequence
  Description of Artificial Sequence: Synthetic oligonucleotide
  Target: FXN; (+) strand; PAM type: NRG; PAM sequence: AGG
gttagaaaagcttgccctga

SEQ ID NO: 17540 - DNA, 20 bp, Artificial Sequence
  Description of Artificial Sequence: Synthetic oligonucleotide
  Target: FXN; (+) strand; PAM type: NRG; PAM sequence: GGG
ttagaaaagcttgccctgaa

SEQ ID NO: 17541 - DNA, 20 bp, Artificial Sequence
  Description of Artificial Sequence: Synthetic oligonucleotide
  Target: FXN; (+) strand; PAM type: NRG; PAM sequence: TGG
cttgccctgaagggaatgta

SEQ ID NO: 17542 - DNA, 20 bp, Artificial Sequence
  Description of Artificial Sequence: Synthetic oligonucleotide
  Target: FXN; (+) strand; PAM type: NRG; PAM sequence: AAG
cctgaagggaatgtatggtg

SEQ ID NO: 17543 - DNA, 20 bp, Artificial Sequence
  Description of Artificial Sequence: Synthetic oligonucleotide
  Target: FXN; (+) strand; PAM type: NRG; PAM sequence: AGG
ctgaagggaatgtatggtga

SEQ ID NO: 17544 - DNA, 20 bp, Artificial Sequence
  Description of Artificial Sequence: Synthetic oligonucleotide
  Target: FXN; (+) strand; PAM type: NRG; PAM sequence: GGG
tgaagggaatgtatggtgaa

SEQ ID NO: 17545 - DNA, 20 bp, Artificial Sequence
  Description of Artificial Sequence: Synthetic oligonucleotide
  Target: FXN; (+) strand; PAM type: NRG; PAM sequence: GGG
gaagggaatgtatggtgaag

SEQ ID NO: 17546 - DNA, 20 bp, Artificial Sequence
  Description of Artificial Sequence: Synthetic oligonucleotide
  Target: FXN; (+) strand; PAM type: NRG; PAM sequence: GAG
agggaatgtatggtgaaggg

SEQ ID NO: 17547 - DNA, 20 bp, Artificial Sequence
  Description of Artificial Sequence: Synthetic oligonucleotide
  Target: FXN; (+) strand; PAM type: NRG; PAM sequence: AGG
gggaatgtatggtgaagggg

SEQ ID NO: 17548 - DNA, 20 bp, Artificial Sequence
  Description of Artificial Sequence: Synthetic oligonucleotide
  Target: FXN; (+) strand; PAM type: NRG; PAM sequence: AAG
gtatggtgaaggggaggtga

SEQ ID NO: 17549 - DNA, 20 bp, Artificial Sequence
  Description of Artificial Sequence: Synthetic oligonucleotide
  Target: FXN; (+) strand; PAM type: NRG; PAM sequence: AGG
tatggtgaaggggaggtgaa

SEQ ID NO: 17550 - DNA, 20 bp, Artificial Sequence
  Description of Artificial Sequence: Synthetic oligonucleotide
  Target: FXN; (+) strand; PAM type: NRG; PAM sequence: AAG
aggttatatttgcatttctg

SEQ ID NO: 17551 - DNA, 20 bp, Artificial Sequence
  Description of Artificial Sequence: Synthetic oligonucleotide
  Target: FXN; (+) strand; PAM type: NRG; PAM sequence: AGG
ggttatatttgcatttctga

SEQ ID NO: 17552 - DNA, 20 bp, Artificial Sequence
  Description of Artificial Sequence: Synthetic oligonucleotide
  Target: FXN; (+) strand; PAM type: NRG; PAM sequence: GGG
gttatatttgcatttctgaa

SEQ ID NO: 17553 - DNA, 20 bp, Artificial Sequence
  Description of Artificial Sequence: Synthetic oligonucleotide
  Target: FXN; (+) strand; PAM type: NRG; PAM sequence: AAG
atttgcatttctgaagggct

SEQ ID NO: 17554 - DNA, 20 bp, Artificial Sequence
  Description of Artificial Sequence: Synthetic oligonucleotide
  Target: FXN; (+) strand; PAM type: NRG; PAM sequence: TAG
tgcatttctgaagggctaag

SEQ ID NO: 17555 - DNA, 20 bp, Artificial Sequence
  Description of Artificial Sequence: Synthetic oligonucleotide
  Target: FXN; (+) strand; PAM type: NRG; PAM sequence: AGG
gcatttctgaagggctaagt

SEQ ID NO: 17556 - DNA, 20 bp, Artificial Sequence
  Description of Artificial Sequence: Synthetic oligonucleotide
  Target: FXN; (+) strand; PAM type: NRG; PAM sequence: CGG
tgaagggctaagtaggaaac

SEQ ID NO: 17557 - DNA, 20 bp, Artificial Sequence
  Description of Artificial Sequence: Synthetic oligonucleotide
  Target: FXN; (+) strand; PAM type: NRG; PAM sequence: GGG
gaagggctaagtaggaaacc

SEQ ID NO: 17558 - DNA, 20 bp, Artificial Sequence
  Description of Artificial Sequence: Synthetic oligonucleotide
  Target: FXN; (+) strand; PAM type: NRG; PAM sequence: CAG
ctaagtaggaaaccgggaac

SEQ ID NO: 17559 - DNA, 20 bp, Artificial Sequence
  Description of Artificial Sequence: Synthetic oligonucleotide
  Target: FXN; (+) strand; PAM type: NRG; PAM sequence: AGG
taagtaggaaaccgggaacc

SEQ ID NO: 17560 - DNA, 20 bp, Artificial Sequence
  Description of Artificial Sequence: Synthetic oligonucleotide
  Target: FXN; (+) strand; PAM type: NRG; PAM sequence: GGG
aagtaggaaaccgggaacca

SEQ ID NO: 17561 - DNA, 20 bp, Artificial Sequence
  Description of Artificial Sequence: Synthetic oligonucleotide
  Target: FXN; (+) strand; PAM type: NRG; PAM sequence: GGG
agtaggaaaccgggaaccag

SEQ ID NO: 17562 - DNA, 20 bp, Artificial Sequence
  Description of Artificial Sequence: Synthetic oligonucleotide
  Target: FXN; (+) strand; PAM type: NRG; PAM sequence: GAG
taggaaaccgggaaccaggg

SEQ ID NO: 17563 - DNA, 20 bp, Artificial Sequence
  Description of Artificial Sequence: Synthetic oligonucleotide
  Target: FXN; (+) strand; PAM type: NRG; PAM sequence: GAG
ggaaaccgggaaccagggga

SEQ ID NO: 17564 - DNA, 20 bp, Artificial Sequence
  Description of Artificial Sequence: Synthetic oligonucleotide
  Target: FXN; (+) strand; PAM type: NRG; PAM sequence: AGG
gaaaccgggaaccaggggag

SEQ ID NO: 17565 - DNA, 20 bp, Artificial Sequence
  Description of Artificial Sequence: Synthetic oligonucleotide
  Target: FXN; (+) strand; PAM type: NRG; PAM sequence: GAG
aaccgggaaccaggggagag

SEQ ID NO: 17566 - DNA, 20 bp, Artificial Sequence
  Description of Artificial Sequence: Synthetic oligonucleotide
  Target: FXN; (+) strand; PAM type: NRG; PAM sequence: AAG
cgggaaccaggggagaggag

SEQ ID NO: 17567 - DNA, 20 bp, Artificial Sequence
  Description of Artificial Sequence: Synthetic oligonucleotide
  Target: FXN; (+) strand; PAM type: NRG; PAM sequence: GAG
ggaaccaggggagaggagaa

SEQ ID NO: 17568 - DNA, 20 bp, Artificial Sequence
  Description of Artificial Sequence: Synthetic oligonucleotide
  Target: FXN; (+) strand; PAM type: NRG; PAM sequence: AAG
accaggggagaggagaagag

SEQ ID NO: 17569 - DNA, 20 bp, Artificial Sequence
  Description of Artificial Sequence: Synthetic oligonucleotide
  Target: FXN; (+) strand; PAM type: NRG; PAM sequence: GAG
caggggagaggagaagagaa

SEQ ID NO: 17570 - DNA, 20 bp, Artificial Sequence
  Description of Artificial Sequence: Synthetic oligonucleotide
  Target: FXN; (+) strand; PAM type: NRG; PAM sequence: GAG
ggggagaggagaagagaaga

SEQ ID NO: 17571 - DNA, 20 bp, Artificial Sequence
  Description of Artificial Sequence: Synthetic oligonucleotide
  Target: FXN; (+) strand; PAM type: NRG; PAM sequence: AGG
gggagaggagaagagaagag

SEQ ID NO: 17572 - DNA, 20 bp, Artificial Sequence
  Description of Artificial Sequence: Synthetic oligonucleotide
  Target: FXN; (+) strand; PAM type: NRG; PAM sequence: AAG
aagagaggataatttttttt

SEQ ID NO: 17573 - DNA, 20 bp, Artificial Sequence
  Description of Artificial Sequence: Synthetic oligonucleotide
  Target: FXN; (+) strand; PAM type: NRG; PAM sequence: AAG
aggataattttttttaagaa

SEQ ID NO: 17574 - DNA, 20 bp, Artificial Sequence
  Description of Artificial Sequence: Synthetic oligonucleotide
  Target: FXN; (+) strand; PAM type: NRG; PAM sequence: TAG
gcaacatattccctttttct

SEQ ID NO: 17575 - DNA, 20 bp, Artificial Sequence
  Description of Artificial Sequence: Synthetic oligonucleotide
  Target: FXN; (+) strand; PAM type: NRG; PAM sequence: TGG
tccctttttcttagaaaaaa

SEQ ID NO: 17576 - DNA, 20 bp, Artificial Sequence
  Description of Artificial Sequence: Synthetic oligonucleotide
  Target: FXN; (+) strand; PAM type: NRG; PAM sequence: GAG
cctttttcttagaaaaaatg

SEQ ID NO: 17577 - DNA, 20 bp, Artificial Sequence
  Description of Artificial Sequence: Synthetic oligonucleotide
  Target: FXN; (+) strand; PAM type: NRG; PAM sequence: CGG
cttagaaaaaatggagcact

SEQ ID NO: 17578 - DNA, 20 bp, Artificial Sequence
  Description of Artificial Sequence: Synthetic oligonucleotide
  Target: FXN; (+) strand; PAM type: NRG; PAM sequence: CAG
aaaaatggagcactcggtta

SEQ ID NO: 17579 - DNA, 20 bp, Artificial Sequence
  Description of Artificial Sequence: Synthetic oligonucleotide
  Target: FXN; (+) strand; PAM type: NRG; PAM sequence: AGG
aaaatggagcactcggttac

SEQ ID NO: 17580 - DNA, 20 bp, Artificial Sequence
  Description of Artificial Sequence: Synthetic oligonucleotide
  Target: FXN; (+) strand; PAM type: NRG; PAM sequence: TAG
cggttacaggcactcgaatg

SEQ ID NO: 17581 - DNA, 20 bp, Artificial Sequence
  Description of Artificial Sequence: Synthetic oligonucleotide
  Target: FXN; (+) strand; PAM type: NRG; PAM sequence: AAG
ttacaggcactcgaatgtag

SEQ ID NO: 17582 - DNA, 20 bp, Artificial Sequence
  Description of Artificial Sequence: Synthetic oligonucleotide
  Target: FXN; (+) strand; PAM type: NRG; PAM sequence: TAG
caggcactcgaatgtagaag

SEQ ID NO: 17583 - DNA, 20 bp, Artificial Sequence
  Description of Artificial Sequence: Synthetic oligonucleotide
  Target: FXN; (+) strand; PAM type: NRG; PAM sequence: TGG
atatataaattatgcattaa

SEQ ID NO: 17584 - DNA, 20 bp, Artificial Sequence
  Description of Artificial Sequence: Synthetic oligonucleotide
  Target: FXN; (+) strand; PAM type: NRG; PAM sequence: GGG
tatataaattatgcattaat

SEQ ID NO: 17585 - DNA, 20 bp, Artificial Sequence
  Description of Artificial Sequence: Synthetic oligonucleotide
  Target: FXN; (+) strand; PAM type: NRG; PAM sequence: TAG
ggttataattcactgaaaaa

SEQ ID NO: 17586 - DNA, 20 bp, Artificial Sequence
  Description of Artificial Sequence: Synthetic oligonucleotide
  Target: FXN; (+) strand; PAM type: NRG; PAM sequence: TGG
agtaacgtacttcttaactt

SEQ ID NO: 17587 - DNA, 20 bp, Artificial Sequence
  Description of Artificial Sequence: Synthetic oligonucleotide
  Target: FXN; (+) strand; PAM type: NRG; PAM sequence: CAG
tacttcttaactttggcttt

SEQ ID NO: 17588 - DNA, 20 bp, Artificial Sequence
  Description of Artificial Sequence: Synthetic oligonucleotide
  Target: FXN; (+) strand; PAM type: NRG; PAM sequence: GAG
cttcttaactttggctttca

SEQ ID NO: 17589 - DNA, 20 bp, Artificial Sequence
  Description of Artificial Sequence: Synthetic oligonucleotide
  Target: FXN; (+) strand; PAM type: NRG; PAM sequence: TGG
tttcagagttcgaaccaacg

SEQ ID NO: 17590 - DNA, 20 bp, Artificial Sequence
  Description of Artificial Sequence: Synthetic oligonucleotide
  Target: FXN; (+) strand; PAM type: NRG; PAM sequence: CAG
cgaaccaacgtggcctcaac

SEQ ID NO: 17591 - DNA, 20 bp, Artificial Sequence
  Description of Artificial Sequence: Synthetic oligonucleotide
  Target: FXN; (+) strand; PAM type: NRG; PAM sequence: TGG
aacgtggcctcaaccagatt

SEQ ID NO: 17592 - DNA, 20 bp, Artificial Sequence
  Description of Artificial Sequence: Synthetic oligonucleotide
  Target: FXN; (+) strand; PAM type: NRG; PAM sequence: AAG
accagatttggaatgtcaaa

SEQ ID NO: 17593 - DNA, 20 bp, Artificial Sequence
  Description of Artificial Sequence: Synthetic oligonucleotide
  Target: FXN; (+) strand; PAM type: NRG; PAM sequence: CAG
agatttggaatgtcaaaaag

SEQ ID NO: 17594 - DNA, 20 bp, Artificial Sequence
  Description of Artificial Sequence: Synthetic oligonucleotide
  Target: FXN; (+) strand; PAM type: NRG; PAM sequence: GAG
atttggaatgtcaaaaagca

SEQ ID NO: 17595 - DNA, 20 bp, Artificial Sequence
  Description of Artificial Sequence: Synthetic oligonucleotide
  Target: FXN; (+) strand; PAM type: NRG; PAM sequence: GAG
agtgtctatttgatgaattt

SEQ ID NO: 17596 - DNA, 20 bp, Artificial Sequence
  Description of Artificial Sequence: Synthetic oligonucleotide
  Target: FXN; (+) strand; PAM type: NRG; PAM sequence: AGG
gtgtctatttgatgaatttg

SEQ ID NO: 17597 - DNA, 20 bp, Artificial Sequence
  Description of Artificial Sequence: Synthetic oligonucleotide
  Target: FXN; (+) strand; PAM type: NRG; PAM sequence: TGG
ttgatgaatttgaggaaatc

SEQ ID NO: 17598 - DNA, 20 bp, Artificial Sequence
  Description of Artificial Sequence: Synthetic oligonucleotide
  Target: FXN; (+) strand; PAM type: NRG; PAM sequence: TGG
tttgaggaaatctggaactt

SEQ ID NO: 17599 - DNA, 20 bp, Artificial Sequence
  Description of Artificial Sequence: Synthetic oligonucleotide
  Target: FXN; (+) strand; PAM type: NRG; PAM sequence: GGG
ttgaggaaatctggaacttt

SEQ ID NO: 17600 - DNA, 20 bp, Artificial Sequence
  Description of Artificial Sequence: Synthetic oligonucleotide
  Target: FXN; (+) strand; PAM type: NRG; PAM sequence: CAG
atctggaactttgggccacc

SEQ ID NO: 17601 - DNA, 20 bp, Artificial Sequence
  Description of Artificial Sequence: Synthetic oligonucleotide
  Target: FXN; (+) strand; PAM type: NRG; PAM sequence: AGG
tctggaactttgggccaccc

SEQ ID NO: 17602 - DNA, 20 bp, Artificial Sequence
  Description of Artificial Sequence: Synthetic oligonucleotide
  Target: FXN; (+) strand; PAM type: NRG; PAM sequence: GGG
ctggaactttgggccaccca

SEQ ID NO: 17603 - DNA, 20 bp, Artificial Sequence
  Description of Artificial Sequence: Synthetic oligonucleotide
  Target: FXN; (+) strand; PAM type: NRG; PAM sequence: AAG
aactttgggccacccagggt

SEQ ID NO: 17604 - DNA, 20 bp, Artificial Sequence
  Description of Artificial Sequence: Synthetic oligonucleotide
  Target: FXN; (+) strand; PAM type: NRG; PAM sequence: TAG
ataaaacaccttccacgtca

SEQ ID NO: 17605 - DNA, 20 bp, Artificial Sequence
  Description of Artificial Sequence: Synthetic oligonucleotide
  Target: FXN; (+) strand; PAM type: NRG; PAM sequence: AGG
taaaacaccttccacgtcat

SEQ ID NO: 17606 - DNA, 20 bp, Artificial Sequence
  Description of Artificial Sequence: Synthetic oligonucleotide
  Target: FXN; (+) strand; PAM type: NRG; PAM sequence: TAG
tccttccctgcctctcccat

SEQ ID NO: 17607 - DNA, 20 bp, Artificial Sequence
  Description of Artificial Sequence: Synthetic oligonucleotide
  Target: FXN; (+) strand; PAM type: NRG; PAM sequence: TGG
ctgcctctcccattagaacc

SEQ ID NO: 17608 - DNA, 20 bp, Artificial Sequence
  Description of Artificial Sequence: Synthetic oligonucleotide
  Target: FXN; (+) strand; PAM type: NRG; PAM sequence: GAG
tagaacctggttttcttcct

SEQ ID NO: 17609 - DNA, 20 bp, Artificial Sequence
  Description of Artificial Sequence: Synthetic oligonucleotide
  Target: FXN; (+) strand; PAM type: NRG; PAM sequence: CAG
aacctggttttcttcctgag

SEQ ID NO: 17610 - DNA, 20 bp, Artificial Sequence
  Description of Artificial Sequence: Synthetic oligonucleotide
  Target: FXN; (+) strand; PAM type: NRG; PAM sequence: TAG
ttcctgagcagcaacaatct

SEQ ID NO: 17611 - DNA, 20 bp, Artificial Sequence
  Description of Artificial Sequence: Synthetic oligonucleotide
  Target: FXN; (+) strand; PAM type: NRG; PAM sequence: AGG
tcctgagcagcaacaatctt

SEQ ID NO: 17612 - DNA, 20 bp, Artificial Sequence
  Description of Artificial Sequence: Synthetic oligonucleotide
  Target: FXN; (+) strand; PAM type: NRG; PAM sequence: GAG
aggcatctttccatgtgact

SEQ ID NO: 17613 - DNA, 20 bp, Artificial Sequence
  Description of Artificial Sequence: Synthetic oligonucleotide
  Target: FXN; (+) strand; PAM type: NRG; PAM sequence: TAG
ccacattatttttaatgaaa

SEQ ID NO: 17614 - DNA, 20 bp, Artificial Sequence
  Description of Artificial Sequence: Synthetic oligonucleotide
  Target: FXN; (+) strand; PAM type: NRG; PAM sequence: TAG
tatttttaatgaaatagtat

SEQ ID NO: 17615 - DNA, 20 bp, Artificial Sequence
  Description of Artificial Sequence: Synthetic oligonucleotide
  Target: FXN; (+) strand; PAM type: NRG; PAM sequence: TGG
tgaaatagtattagattgca

SEQ ID NO: 17616 - DNA, 20 bp, Artificial Sequence
  Description of Artificial Sequence: Synthetic oligonucleotide
  Target: FXN; (+) strand; PAM type: NRG; PAM sequence: TGG
tttaacccatcccctactgt

SEQ ID NO: 17617 - DNA, 20 bp, Artificial Sequence
  Description of Artificial Sequence: Synthetic oligonucleotide
  Target: FXN; (+) strand; PAM type: NRG; PAM sequence: CAG
atcccctactgttggacatt

SEQ ID NO: 17618 - DNA, 20 bp, Artificial Sequence
  Description of Artificial Sequence: Synthetic oligonucleotide
  Target: FXN; (+) strand; PAM type: NRG; PAM sequence: AGG
tcccctactgttggacattc

SEQ ID NO: 17619 - DNA, 20 bp, Artificial Sequence
  Description of Artificial Sequence: Synthetic oligonucleotide
  Target: FXN; (+) strand; PAM type: NRG; PAM sequence: CAG
ttggacattcaggttgtttc

SEQ ID NO: 17620 - DNA, 20 bp, Artificial Sequence
  Description of Artificial Sequence: Synthetic oligonucleotide
  Target: FXN; (+) strand; PAM type: NRG; PAM sequence: GAG
ggacattcaggttgtttcca

SEQ ID NO: 17621 - DNA, 20 bp, Artificial Sequence
  Description of Artificial Sequence: Synthetic oligonucleotide
  Target: FXN; (+) strand; PAM type: NRG; PAM sequence: TAG
tattttatttaataccctaa

SEQ ID NO: 17622 - DNA, 20 bp, Artificial Sequence
  Description of Artificial Sequence: Synthetic oligonucleotide
  Target: FXN; (+) strand; PAM type: NRG; PAM sequence: TAG
ttatttaataccctaatagt

SEQ ID NO: 17623 - DNA, 20 bp, Artificial Sequence
  Description of Artificial Sequence: Synthetic oligonucleotide
  Target: FXN; (+) strand; PAM type: NRG; PAM sequence: GAG
atttaataccctaatagtta

SEQ ID NO: 17624 - DNA, 20 bp, Artificial Sequence
  Description of Artificial Sequence: Synthetic oligonucleotide
  Target: FXN; (+) strand; PAM type: NRG; PAM sequence: CAG
taataccctaatagttagag

SEQ ID NO: 17625 - DNA, 20 bp, Artificial Sequence
  Description of Artificial Sequence: Synthetic oligonucleotide
  Target: FXN; (+) strand; PAM type: NRG; PAM sequence: AGG
aataccctaatagttagagc

SEQ ID NO: 17626 - DNA, 20 bp, Artificial Sequence
  Description of Artificial Sequence: Synthetic oligonucleotide
  Target: FXN; (+) strand; PAM type: NRG; PAM sequence: TAG
ggccatgctgctatcacaaa

SEQ ID NO: 17627 - DNA, 20 bp, Artificial Sequence
  Description of Artificial Sequence: Synthetic oligonucleotide
  Target: FXN; (+) strand; PAM type: NRG; PAM sequence: TAG
aaatagacccaaatatttaa

SEQ ID NO: 17628 - DNA, 20 bp, Artificial Sequence
  Description of Artificial Sequence: Synthetic oligonucleotide
  Target: FXN; (+) strand; PAM type: NRG; PAM sequence: TGG
aacgtttgtgtcctcctctc

SEQ ID NO: 17629 - DNA, 20 bp, Artificial Sequence
  Description of Artificial Sequence: Synthetic oligonucleotide
  Target: FXN; (+) strand; PAM type: NRG; PAM sequence: GGG
acgtttgtgtcctcctctct

SEQ ID NO: 17630 - DNA, 20 bp, Artificial Sequence
  Description of Artificial Sequence: Synthetic oligonucleotide
  Target: FXN; (+) strand; PAM type: NRG; PAM sequence: CAG
tttgtgtcctcctctctggg

SEQ ID NO: 17631 - DNA, 20 bp, Artificial Sequence
  Description of Artificial Sequence: Synthetic oligonucleotide
  Target: FXN; (+) strand; PAM type: NRG; PAM sequence: CAG
gtcctcctctctgggcagta

SEQ ID NO: 17632 - DNA, 20 bp, Artificial Sequence
  Description of Artificial Sequence: Synthetic oligonucleotide
  Target: FXN; (+) strand; PAM type: NRG; PAM sequence: AGG
tcctcctctctgggcagtac

SEQ ID NO: 17633 - DNA, 20 bp, Artificial Sequence
  Description of Artificial Sequence: Synthetic oligonucleotide
  Target: FXN; (+) strand; PAM type: NRG; PAM sequence: GGG
cctcctctctgggcagtaca

SEQ ID NO: 17634 - DNA, 20 bp, Artificial Sequence
  Description of Artificial Sequence: Synthetic oligonucleotide
  Target: FXN; (+) strand; PAM type: NRG; PAM sequence: TGG
ctctctgggcagtacagggt

SEQ ID NO: 17635 - DNA, 20 bp, Artificial Sequence
  Description of Artificial Sequence: Synthetic oligonucleotide
  Target: FXN; (+) strand; PAM type: NRG; PAM sequence: AAG
cagggttggcatacctcctg

SEQ ID NO: 17636 - DNA, 20 bp, Artificial Sequence
  Description of Artificial Sequence: Synthetic oligonucleotide
  Target: FXN; (+) strand; PAM type: NRG; PAM sequence: TAG
gcatacctcctgaagtgaat

SEQ ID NO: 17637 - DNA, 20 bp, Artificial Sequence
  Description of Artificial Sequence: Synthetic oligonucleotide
  Target: FXN; (+) strand; PAM type: NRG; PAM sequence: AGG
catacctcctgaagtgaatt

SEQ ID NO: 17638 - DNA, 20 bp, Artificial Sequence
  Description of Artificial Sequence: Synthetic oligonucleotide
  Target: FXN; (+) strand; PAM type: NRG; PAM sequence: CAG
attaggaactacactcattc

SEQ ID NO: 17639 - DNA, 20 bp, Artificial Sequence
  Description of Artificial Sequence: Synthetic oligonucleotide
  Target: FXN; (+) strand; PAM type: NRG; PAM sequence: CAG
actacactcattccagcttc

SEQ ID NO: 17640 - DNA, 20 bp, Artificial Sequence
  Description of Artificial Sequence: Synthetic oligonucleotide
  Target: FXN; (+) strand; PAM type: NRG; PAM sequence: TGG
actcattccagcttccagtt

SEQ ID NO: 17641 - DNA, 20 bp, Artificial Sequence
  Description of Artificial Sequence: Synthetic oligonucleotide
  Target: FXN; (+) strand; PAM type: NRG; PAM sequence: CAG
ccagtttggtctttatctgt

SEQ ID NO: 17642 - DNA, 20 bp, Artificial Sequence
  Description of Artificial Sequence: Synthetic oligonucleotide
  Target: FXN; (+) strand; PAM type: NRG; PAM sequence: GAG
ttactgtcctctgcattgtt

SEQ ID NO: 17643 - DNA, 20 bp, Artificial Sequence
  Description of Artificial Sequence: Synthetic oligonucleotide
  Target: FXN; (+) strand; PAM type: NRG; PAM sequence: CAG
tcctctgcattgttgagtct

SEQ ID NO: 17644 - DNA, 20 bp, Artificial Sequence
  Description of Artificial Sequence: Synthetic oligonucleotide
  Target: FXN; (+) strand; PAM type: NRG; PAM sequence: AAG
gagtctcagtcaccttgtcc

SEQ ID NO: 17645 - DNA, 20 bp, Artificial Sequence
  Description of Artificial Sequence: Synthetic oligonucleotide
  Target: FXN; (+) strand; PAM type: NRG; PAM sequence: TGG
tcaccttgtccaagttccat

SEQ ID NO: 17646 - DNA, 20 bp, Artificial Sequence
  Description of Artificial Sequence: Synthetic oligonucleotide
  Target: FXN; (+) strand; PAM type: NRG; PAM sequence: CAG
cttgtccaagttccattggc

SEQ ID NO: 17647 - DNA, 20 bp, Artificial Sequence
  Description of Artificial Sequence: Synthetic oligonucleotide
  Target: FXN; (+) strand; PAM type: NRG; PAM sequence: AAG
tccaagttccattggccaga

SEQ ID NO: 17648 - DNA, 20 bp, Artificial Sequence
  Description of Artificial Sequence: Synthetic oligonucleotide
  Target: FXN; (+) strand; PAM type: NRG; PAM sequence: AGG
ccaagttccattggccagaa

SEQ ID NO: 17649 - DNA, 20 bp, Artificial Sequence
  Description of Artificial Sequence: Synthetic oligonucleotide
  Target: FXN; (+) strand; PAM type: NRG; PAM sequence: GGG
caagttccattggccagaaa

SEQ ID NO: 17650 - DNA, 20 bp, Artificial Sequence
  Description of Artificial Sequence: Synthetic oligonucleotide
  Target: FXN; (+) strand; PAM type: NRG; PAM sequence: TAG
ttccattggccagaaagggc

SEQ ID NO: 17651 - DNA, 20 bp, Artificial Sequence
  Description of Artificial Sequence: Synthetic oligonucleotide
  Target: FXN; (+) strand; PAM type: NRG; PAM sequence: AAG
cattggccagaaagggctag

SEQ ID NO: 17652 - DNA, 20 bp, Artificial Sequence
  Description of Artificial Sequence: Synthetic oligonucleotide
  Target: FXN; (+) strand; PAM type: NRG; PAM sequence: CAG
gccagaaagggctagaagca

SEQ ID NO: 17653 - DNA, 20 bp, Artificial Sequence
  Description of Artificial Sequence: Synthetic oligonucleotide
  Target: FXN; (+) strand; PAM type: NRG; PAM sequence: AAG
agaaagggctagaagcacag

SEQ ID NO: 17654 - DNA, 20 bp, Artificial Sequence
  Description of Artificial Sequence: Synthetic oligonucleotide
  Target: FXN; (+) strand; PAM type: NRG; PAM sequence: AGG
gaaagggctagaagcacaga

SEQ ID NO: 17655 - DNA, 20 bp, Artificial Sequence
  Description of Artificial Sequence: Synthetic oligonucleotide
  Target: FXN; (+) strand; PAM type: NRG; PAM sequence: GGG
aaagggctagaagcacagaa

SEQ ID NO: 17656 - DNA, 20 bp, Artificial Sequence
  Description of Artificial Sequence: Synthetic oligonucleotide
  Target: FXN; (+) strand; PAM type: NRG; PAM sequence: TGG
ggctagaagcacagaagggc

SEQ ID NO: 17657 - DNA, 20 bp, Artificial Sequence
  Description of Artificial Sequence: Synthetic oligonucleotide
  Target: FXN; (+) strand; PAM type: NRG; PAM sequence: AAG
tagaagcacagaagggctgg

SEQ ID NO: 17658 - DNA, 20 bp, Artificial Sequence
  Description of Artificial Sequence: Synthetic oligonucleotide
  Target: FXN; (+) strand; PAM type: NRG; PAM sequence: TGG
aagcacagaagggctggaag

SEQ ID NO: 17659 - DNA, 20 bp, Artificial Sequence
  Description of Artificial Sequence: Synthetic oligonucleotide
  Target: FXN; (+) strand; PAM type: NRG; PAM sequence: TGG
tttgttcctcactcacattc

SEQ ID NO: 17660 - DNA, 20 bp, Artificial Sequence
  Description of Artificial Sequence: Synthetic oligonucleotide
  Target: FXN; (+) strand; PAM type: NRG; PAM sequence: TGG
gttcctcactcacattctgg

SEQ ID NO: 17661 - DNA, 20 bp, Artificial Sequence
  Description of Artificial Sequence: Synthetic oligonucleotide
  Target: FXN; (+) strand; PAM type: NRG; PAM sequence: GGG
ttcctcactcacattctggt

SEQ ID NO: 17662 - DNA, 20 bp, Artificial Sequence
  Description of Artificial Sequence: Synthetic oligonucleotide
  Target: FXN; (+) strand; PAM type: NRG; PAM sequence: AAG
ctcactcacattctggtggg

SEQ ID NO: 17663 - DNA, 20 bp, Artificial Sequence
  Description of Artificial Sequence: Synthetic oligonucleotide
  Target: FXN; (+) strand; PAM type: NRG; PAM sequence: TAG
acattctggtgggaagaact

SEQ ID NO: 17664 - DNA, 20 bp, Artificial Sequence
  Description of Artificial Sequence: Synthetic oligonucleotide
  Target: FXN; (+) strand; PAM type: NRG; PAM sequence: TGG
ttctggtgggaagaacttag

SEQ ID NO: 17665 - DNA, 20 bp, Artificial Sequence
  Description of Artificial Sequence: Synthetic oligonucleotide
  Target: FXN; (+) strand; PAM type: NRG; PAM sequence: TGG
gtgggaagaacttagtggtg

SEQ ID NO: 17666 - DNA, 20 bp, Artificial Sequence
  Description of Artificial Sequence: Synthetic oligonucleotide
  Target: FXN; (+) strand; PAM type: NRG; PAM sequence: TAG
agaacttagtggtgtggcct

SEQ ID NO: 17667 - DNA, 20 bp, Artificial Sequence
  Description of Artificial Sequence: Synthetic oligonucleotide
  Target: FXN; (+) strand; PAM type: NRG; PAM sequence: AAG
gtgtggccttagctgactgt

SEQ ID NO: 17668 - DNA, 20 bp, Artificial Sequence
  Description of Artificial Sequence: Synthetic oligonucleotide
  Target: FXN; (+) strand; PAM type: NRG; PAM sequence: AGG
tgtggccttagctgactgta

SEQ ID NO: 17669 - DNA, 20 bp, Artificial Sequence
  Description of Artificial Sequence: Synthetic oligonucleotide
  Target: FXN; (+) strand; PAM type: NRG; PAM sequence: GGG
gtggccttagctgactgtaa

SEQ ID NO: 17670 - DNA, 20 bp, Artificial Sequence
  Description of Artificial Sequence: Synthetic oligonucleotide
  Target: FXN; (+) strand; PAM type: NRG; PAM sequence: GAG
ggccttagctgactgtaagg

SEQ ID NO: 17671 - DNA, 20 bp, Artificial Sequence
  Description of Artificial Sequence: Synthetic oligonucleotide
  Target: FXN; (+) strand; PAM type: NRG; PAM sequence: AGG
gccttagctgactgtaaggg

SEQ ID NO: 17672 - DNA, 20 bp, Artificial Sequence
  Description of Artificial Sequence: Synthetic oligonucleotide
  Target: FXN; (+) strand; PAM type: NRG; PAM sequence: TGG
tagctgactgtaagggaggc

SEQ ID NO: 17673 - DNA, 20 bp, Artificial Sequence
  Description of Artificial Sequence: Synthetic oligonucleotide
  Target: FXN; (+) strand; PAM type: NRG; PAM sequence: GGG
agctgactgtaagggaggct

SEQ ID NO: 17674 - DNA, 20 bp, Artificial Sequence
  Description of Artificial Sequence: Synthetic oligonucleotide
  Target: FXN; (+) strand; PAM type: NRG; PAM sequence: TAG
gtaagggaggctgggaaata

SEQ ID NO: 17675 - DNA, 20 bp, Artificial Sequence
  Description of Artificial Sequence: Synthetic oligonucleotide
  Target: FXN; (+) strand; PAM type: NRG; PAM sequence: TAG
ggaggctgggaaatatagtc

SEQ ID NO: 17676 - DNA, 20 bp, Artificial Sequence
  Description of Artificial Sequence: Synthetic oligonucleotide
  Target: FXN; (+) strand; PAM type: NRG; PAM sequence: GAG
gctgggaaatatagtctagc

SEQ ID NO: 17677 - DNA, 20 bp, Artificial Sequence
  Description of Artificial Sequence: Synthetic oligonucleotide
  Target: FXN; (+) strand; PAM type: NRG; PAM sequence: TGG
atatagtctagcgagtgccc

SEQ ID NO: 17678 - DNA, 20 bp, Artificial Sequence
  Description of Artificial Sequence: Synthetic oligonucleotide
  Target: FXN; (+) strand; PAM type: NRG; PAM sequence: AAG
tctagcgagtgccctggaaa

SEQ ID NO: 17679 - DNA, 20 bp, Artificial Sequence
  Description of Artificial Sequence: Synthetic oligonucleotide
  Target: FXN; (+) strand; PAM type: NRG; PAM sequence: CGG
gcgagtgccctggaaaaagc

SEQ ID NO: 17680 - DNA, 20 bp, Artificial Sequence
  Description of Artificial Sequence: Synthetic oligonucleotide
  Target: FXN; (+) strand; PAM type: NRG; PAM sequence: CGG
tgccctggaaaaagccggca

SEQ ID NO: 17681 - DNA, 20 bp, Artificial Sequence
  Description of Artificial Sequence: Synthetic oligonucleotide
  Target: FXN; (+) strand; PAM type: NRG; PAM sequence: TGG
agccggcacggcattcccca

SEQ ID NO: 17682 - DNA, 20 bp, Artificial Sequence
  Description of Artificial Sequence: Synthetic oligonucleotide
  Target: FXN; (+) strand; PAM type: NRG; PAM sequence: AAG
ggcacggcattccccatgga

SEQ ID NO: 17683 - DNA, 20 bp, Artificial Sequence
  Description of Artificial Sequence: Synthetic oligonucleotide
  Target: FXN; (+) strand; PAM type: NRG; PAM sequence: CAG
cattccccatggaaagctgt

SEQ ID NO: 17684 - DNA, 20 bp, Artificial Sequence
  Description of Artificial Sequence: Synthetic oligonucleotide
  Target: FXN; (+) strand; PAM type: NRG; PAM sequence: AGG
attccccatggaaagctgtc

SEQ ID NO: 17685 - DNA, 20 bp, Artificial Sequence
  Description of Artificial Sequence: Synthetic oligonucleotide
  Target: FXN; (+) strand; PAM type: NRG; PAM sequence: CGG
ccatggaaagctgtcaggca

SEQ ID NO: 17686 - DNA, 20 bp, Artificial Sequence
  Description of Artificial Sequence: Synthetic oligonucleotide
  Target: FXN; (+) strand; PAM type: NRG; PAM sequence: CAG
aaagctgtcaggcacggcta

SEQ ID NO: 17687 - DNA, 20 bp, Artificial Sequence
  Description of Artificial Sequence: Synthetic oligonucleotide
  Target: FXN; (+) strand; PAM type: NRG; PAM sequence: CAG
acagtctaccccctgccaac

SEQ ID NO: 17688 - DNA, 20 bp, Artificial Sequence
  Description of Artificial Sequence: Synthetic oligonucleotide
  Target: FXN; (+) strand; PAM type: NRG; PAM sequence: TGG
cctgccaaccagtatctgca

SEQ ID NO: 17689 - DNA, 20 bp, Artificial Sequence
  Description of Artificial Sequence: Synthetic oligonucleotide
  Target: FXN; (+) strand; PAM type: NRG; PAM sequence: CAG
atggaccctccttccacact

SEQ ID NO: 17690 - DNA, 20 bp, Artificial Sequence
  Description of Artificial Sequence: Synthetic oligonucleotide
  Target: FXN; (+) strand; PAM type: NRG; PAM sequence: CAG
cactcagatgcatttacccc

SEQ ID NO: 17691 - DNA, 20 bp, Artificial Sequence
  Description of Artificial Sequence: Synthetic oligonucleotide
  Target: FXN; (+) strand; PAM type: NRG; PAM sequence: AAG
atgcatttacccccagcccc

SEQ ID NO: 17692 - DNA, 20 bp, Artificial Sequence
  Description of Artificial Sequence: Synthetic oligonucleotide
  Target: FXN; (+) strand; PAM type: NRG; PAM sequence: GAG
gcatttacccccagccccaa

SEQ ID NO: 17693 - DNA, 20 bp, Artificial Sequence
  Description of Artificial Sequence: Synthetic oligonucleotide
  Target: FXN; (+) strand; PAM type: NRG; PAM sequence: GAG
atttacccccagccccaaga

SEQ ID NO: 17694 - DNA, 20 bp, Artificial Sequence
  Description of Artificial Sequence: Synthetic oligonucleotide
  Target: FXN; (+) strand; PAM type: NRG; PAM sequence: TGG
agagccaaccgatgcccatg

SEQ ID NO: 17695 - DNA, 20 bp, Artificial Sequence
  Description of Artificial Sequence: Synthetic oligonucleotide
  Target: FXN; (+) strand; PAM type: NRG; PAM sequence: CAG
cgatgcccatgtggtcacca

SEQ ID NO: 17696 - DNA, 20 bp, Artificial Sequence
  Description of Artificial Sequence: Synthetic oligonucleotide
  Target: FXN; (+) strand; PAM type: NRG; PAM sequence: GAG
tggtcaccacagccacctcc

SEQ ID NO: 17697 - DNA, 20 bp, Artificial Sequence
  Description of Artificial Sequence: Synthetic oligonucleotide
  Target: FXN; (+) strand; PAM type: NRG; PAM sequence: AAG
ccacagccacctccgagtcc

SEQ ID NO: 17698 - DNA, 20 bp, Artificial Sequence
  Description of Artificial Sequence: Synthetic oligonucleotide
  Target: FXN; (+) strand; PAM type: NRG; PAM sequence: CAG
acctccgagtccaagatttc

SEQ ID NO: 17699 - DNA, 20 bp, Artificial Sequence
  Description of Artificial Sequence: Synthetic oligonucleotide
  Target: FXN; (+) strand; PAM type: NRG; PAM sequence: AGG
cctccgagtccaagatttcc

SEQ ID NO: 17700 - DNA, 20 bp, Artificial Sequence
  Description of Artificial Sequence: Synthetic oligonucleotide
  Target: FXN; (+) strand; PAM type: NRG; PAM sequence: CAG
caagatttccaggtgacatg

SEQ ID NO: 17701 - DNA, 20 bp, Artificial Sequence
  Description of Artificial Sequence: Synthetic oligonucleotide
  Target: FXN; (+) strand; PAM type: NRG; PAM sequence: CAG
acatgcagtctcctctctcc

SEQ ID NO: 17702 - DNA, 20 bp, Artificial Sequence
  Description of Artificial Sequence: Synthetic oligonucleotide
  Target: FXN; (+) strand; PAM type: NRG; PAM sequence: TAG
agtctcctctctcccagctt

SEQ ID NO: 17703 - DNA, 20 bp, Artificial Sequence
  Description of Artificial Sequence: Synthetic oligonucleotide
  Target: FXN; (+) strand; PAM type: NRG; PAM sequence: AGG
gtctcctctctcccagcttt

SEQ ID NO: 17704 - DNA, 20 bp, Artificial Sequence
  Description of Artificial Sequence: Synthetic oligonucleotide
  Target: FXN; (+) strand; PAM type: NRG; PAM sequence: TGG
ctctctcccagctttaggaa

SEQ ID NO: 17705 - DNA, 20 bp, Artificial Sequence
  Description of Artificial Sequence: Synthetic oligonucleotide
  Target: FXN; (+) strand; PAM type: NRG; PAM sequence: CAG
ggcttcttctgatctacaca

SEQ ID NO: 17706 - DNA, 20 bp, Artificial Sequence
  Description of Artificial Sequence: Synthetic oligonucleotide
  Target: FXN; (+) strand; PAM type: NRG; PAM sequence: CAG
ttctgatctacacacagaca

SEQ ID NO: 17707 - DNA, 20 bp, Artificial Sequence
  Description of Artificial Sequence: Synthetic oligonucleotide
  Target: FXN; (+) strand; PAM type: NRG; PAM sequence: CAG
cagacacagacacacacaca

SEQ ID NO: 17708 - DNA, 20 bp, Artificial Sequence
  Description of Artificial Sequence: Synthetic oligonucleotide
  Target: FXN; (+) strand; PAM type: NRG; PAM sequence: TGG
acacacacacacacacacga

SEQ ID NO: 17709 - DNA, 20 bp, Artificial Sequence
  Description of Artificial Sequence: Synthetic oligonucleotide
  Target: FXN; (+) strand; PAM type: NRG; PAM sequence: GAG
acacacacacacacacgatg

SEQ ID NO: 17710 - DNA, 20 bp, Artificial Sequence
  Description of Artificial Sequence: Synthetic oligonucleotide
  Target: FXN; (+) strand; PAM type: NRG; PAM sequence: GAG
acacacacacacacgatgga

SEQ ID NO: 17711 - DNA, 20 bp, Artificial Sequence
  Description of Artificial Sequence: Synthetic oligonucleotide
  Target: FXN; (+) strand; PAM type: NRG; PAM sequence: AGG
cacacacacacacgatggag

SEQ ID NO: 17712 - DNA, 20 bp, Artificial Sequence
  Description of Artificial Sequence: Synthetic oligonucleotide
  Target: FXN; (+) strand; PAM type: NRG; PAM sequence: GGG
acacacacacacgatggaga

SEQ ID NO: 17713 - DNA, 20 bp, Artificial Sequence
  Description of Artificial Sequence: Synthetic oligonucleotide
  Target: FXN; (+) strand; PAM type: NRG; PAM sequence: GGG
cacacacacacgatggagag

SEQ ID NO: 17714 - DNA, 20 bp, Artificial Sequence
  Description of Artificial Sequence: Synthetic oligonucleotide
  Target: FXN; (+) strand; PAM type: NRG; PAM sequence: CAG
acacacacgatggagagggg

SEQ ID NO: 17715 - DNA, 20 bp, Artificial Sequence
  Description of Artificial Sequence: Synthetic oligonucleotide
  Target: FXN; (+) strand; PAM type: NRG; PAM sequence: AGG
cacacacgatggagaggggc

SEQ ID NO: 17716 - DNA, 20 bp, Artificial Sequence
  Description of Artificial Sequence: Synthetic oligonucleotide
  Target: FXN; (+) strand; PAM type: NRG; PAM sequence: CAG
actgcaactgtaactccatt

SEQ ID NO: 17717 - DNA, 20 bp, Artificial Sequence
  Description of Artificial Sequence: Synthetic oligonucleotide
  Target: FXN; (+) strand; PAM type: NRG; PAM sequence: AAG
aactgtaactccattcagaa

SEQ ID NO: 17718 - DNA, 20 bp, Artificial Sequence
  Description of Artificial Sequence: Synthetic oligonucleotide
  Target: FXN; (+) strand; PAM type: NRG; PAM sequence: GAG
ctgtaactccattcagaaaa

SEQ ID NO: 17719 - DNA, 20 bp, Artificial Sequence
  Description of Artificial Sequence: Synthetic oligonucleotide
  Target: FXN; (+) strand; PAM type: NRG; PAM sequence: AGG
tgtaactccattcagaaaag

SEQ ID NO: 17720 - DNA, 20 bp, Artificial Sequence
  Description of Artificial Sequence: Synthetic oligonucleotide
  Target: FXN; (+) strand; PAM type: NRG; PAM sequence: CAG
ctccattcagaaaagaggca

SEQ ID NO: 17721 - DNA, 20 bp, Artificial Sequence
  Description of Artificial Sequence: Synthetic oligonucleotide
  Target: FXN; (+) strand; PAM type: NRG; PAM sequence: TAG
tcagaaaagaggcacagcac

SEQ ID NO: 17722 - DNA, 20 bp, Artificial Sequence
  Description of Artificial Sequence: Synthetic oligonucleotide
  Target: FXN; (+) strand; PAM type: NRG; PAM sequence: CAG
ggcacagcactagctgcccg

SEQ ID NO: 17723 - DNA, 20 bp, Artificial Sequence
  Description of Artificial Sequence: Synthetic oligonucleotide
  Target: FXN; (+) strand; PAM type: NRG; PAM sequence: TGG
gcactagctgcccgcagcac

SEQ ID NO: 17724 - DNA, 20 bp, Artificial Sequence
  Description of Artificial Sequence: Synthetic oligonucleotide
  Target: FXN; (+) strand; PAM type: NRG; PAM sequence: GAG
actagctgcccgcagcactg

SEQ ID NO: 17725 - DNA, 20 bp, Artificial Sequence
  Description of Artificial Sequence: Synthetic oligonucleotide
  Target: FXN; (+) strand; PAM type: NRG; PAM sequence: TGG
ccgcagcactggagccctgc

SEQ ID NO: 17726 - DNA, 20 bp, Artificial Sequence
  Description of Artificial Sequence: Synthetic oligonucleotide
  Target: FXN; (+) strand; PAM type: NRG; PAM sequence: GGG
cgcagcactggagccctgct

SEQ ID NO: 17727 - DNA, 20 bp, Artificial Sequence
  Description of Artificial Sequence: Synthetic oligonucleotide
  Target: FXN; (+) strand; PAM type: NRG; PAM sequence: CAG
agcactggagccctgctggg

SEQ ID NO: 17728 - DNA, 20 bp, Artificial Sequence
  Description of Artificial Sequence: Synthetic oligonucleotide
  Target: FXN; (+) strand; PAM type: NRG; PAM sequence: TGG
ggagccctgctgggcagcac

SEQ ID NO: 17729 - DNA, 20 bp, Artificial Sequence
  Description of Artificial Sequence: Synthetic oligonucleotide
  Target: FXN; (+) strand; PAM type: NRG; PAM sequence: TGG
cactggatcaacctctgccc

SEQ ID NO: 17730 - DNA, 20 bp, Artificial Sequence
  Description of Artificial Sequence: Synthetic oligonucleotide
  Target: FXN; (+) strand; PAM type: NRG; PAM sequence: CAG
tggatcaacctctgccctgg

SEQ ID NO: 17731 - DNA, 20 bp, Artificial Sequence
  Description of Artificial Sequence: Synthetic oligonucleotide
  Target: FXN; (+) strand; PAM type: NRG; PAM sequence: GAG
gatcaacctctgccctggca

SEQ ID NO: 17732 - DNA, 20 bp, Artificial Sequence
  Description of Artificial Sequence: Synthetic oligonucleotide
  Target: FXN; (+) strand; PAM type: NRG; PAM sequence: AGG
atcaacctctgccctggcag

SEQ ID NO: 17733 - DNA, 20 bp, Artificial Sequence
  Description of Artificial Sequence: Synthetic oligonucleotide
  Target: FXN; (+) strand; PAM type: NRG; PAM sequence: GAG
caacctctgccctggcagag

SEQ ID NO: 17734 - DNA, 20 bp, Artificial Sequence
  Description of Artificial Sequence: Synthetic oligonucleotide
  Target: FXN; (+) strand; PAM type: NRG; PAM sequence: CAG
tcctccacaaatccctgctt

SEQ ID NO: 17735 - DNA, 20 bp, Artificial Sequence
  Description of Artificial Sequence: Synthetic oligonucleotide
  Target: FXN; (+) strand; PAM type: NRG; PAM sequence: GAG
aatccctgcttcagcctctc

SEQ ID NO: 17736 - DNA, 20 bp, Artificial Sequence
  Description of Artificial Sequence: Synthetic oligonucleotide
  Target: FXN; (+) strand; PAM type: NRG; PAM sequence: GAG
tccctgcttcagcctctcga

SEQ ID NO: 17737 - DNA, 20 bp, Artificial Sequence
  Description of Artificial Sequence: Synthetic oligonucleotide
  Target: FXN; (+) strand; PAM type: NRG; PAM sequence: AGG
ccctgcttcagcctctcgag

SEQ ID NO: 17738 - DNA, 20 bp, Artificial Sequence
  Description of Artificial Sequence: Synthetic oligonucleotide
  Target: FXN; (+) strand; PAM type: NRG; PAM sequence: TGG
tccttgtctgttattttcct

SEQ ID NO: 17739 - DNA, 20 bp, Artificial Sequence
  Description of Artificial Sequence: Synthetic oligonucleotide
  Target: FXN; (+) strand; PAM type: NRG; PAM sequence: AAG
ctgttattttccttggccac

SEQ ID NO: 17740 - DNA, 20 bp, Artificial Sequence
  Description of Artificial Sequence: Synthetic oligonucleotide
  Target: FXN; (+) strand; PAM type: NRG; PAM sequence: AGG
tgttattttccttggccaca

SEQ ID NO: 17741 - DNA, 20 bp, Artificial Sequence
  Description of Artificial Sequence: Synthetic oligonucleotide
  Target: FXN; (+) strand; PAM type: NRG; PAM sequence: CAG
tattttccttggccacaagg

SEQ ID NO: 17742 - DNA, 20 bp, Artificial Sequence
  Description of Artificial Sequence: Synthetic oligonucleotide
  Target: FXN; (+) strand; PAM type: NRG; PAM sequence: AGG
attttccttggccacaaggc

SEQ ID NO: 17743 - DNA, 20 bp, Artificial Sequence
  Description of Artificial Sequence: Synthetic oligonucleotide
  Target: FXN; (+) strand; PAM type: NRG; PAM sequence: CAG
ttccttggccacaaggcagg

SEQ ID NO: 17744 - DNA, 20 bp, Artificial Sequence
  Description of Artificial Sequence: Synthetic oligonucleotide
  Target: FXN; (+) strand; PAM type: NRG; PAM sequence: AGG
tccttggccacaaggcaggc

SEQ ID NO: 17745 - DNA, 20 bp, Artificial Sequence
  Description of Artificial Sequence: Synthetic oligonucleotide
  Target: FXN; (+) strand; PAM type: NRG; PAM sequence: CAG
ttggccacaaggcaggcagg

SEQ ID NO: 17746 - DNA, 20 bp, Artificial Sequence
  Description of Artificial Sequence: Synthetic oligonucleotide
  Target: FXN; (+) strand; PAM type: NRG; PAM sequence: TGG
gccacaaggcaggcaggcag

SEQ ID NO: 17747 - DNA, 20 bp, Artificial Sequence
  Description of Artificial Sequence: Synthetic oligonucleotide
  Target: FXN; (+) strand; PAM type: NRG; PAM sequence: GGG
ccacaaggcaggcaggcagt

SEQ ID NO: 17748 - DNA, 20 bp, Artificial Sequence
  Description of Artificial Sequence: Synthetic oligonucleotide
  Target: FXN; (+) strand; PAM type: NRG; PAM sequence: AAG
caaggcaggcaggcagtggg

SEQ ID NO: 17749 - DNA, 20 bp, Artificial Sequence
  Description of Artificial Sequence: Synthetic oligonucleotide
  Target: FXN; (+) strand; PAM type: NRG; PAM sequence: CGG
gtgggaagtgtgccctcctc

SEQ ID NO: 17750 - DNA, 20 bp, Artificial Sequence
  Description of Artificial Sequence: Synthetic oligonucleotide
  Target: FXN; (+) strand; PAM type: NRG; PAM sequence: GGG
tgggaagtgtgccctcctcc

SEQ ID NO: 17751 - DNA, 20 bp, Artificial Sequence
  Description of Artificial Sequence: Synthetic oligonucleotide
  Target: FXN; (+) strand; PAM type: NRG; PAM sequence: GGG
gggaagtgtgccctcctccg

SEQ ID NO: 17752 - DNA, 20 bp, Artificial Sequence
  Description of Artificial Sequence: Synthetic oligonucleotide
  Target: FXN; (+) strand; PAM type: NRG; PAM sequence: AAG
agtgtgccctcctccggggc

SEQ ID NO: 17753 - DNA, 20 bp, Artificial Sequence
  Description of Artificial Sequence: Synthetic oligonucleotide
  Target: FXN; (+) strand; PAM type: NRG; PAM sequence: AGG
gtgtgccctcctccggggca

SEQ ID NO: 17754 - DNA, 20 bp, Artificial Sequence
  Description of Artificial Sequence: Synthetic oligonucleotide
  Target: FXN; (+) strand; PAM type: NRG; PAM sequence: GAG
gtgccctcctccggggcaag

SEQ ID NO: 17755 - DNA, 20 bp, Artificial Sequence
  Description of Artificial Sequence: Synthetic oligonucleotide
  Target: FXN; (+) strand; PAM type: NRG; PAM sequence: CAG
tccggggcaaggagccttca

SEQ ID NO: 17756 - DNA, 20 bp, Artificial Sequence
  Description of Artificial Sequence: Synthetic oligonucleotide
  Target: FXN; (+) strand; PAM type: NRG; PAM sequence: CAG
agcccacttcctgctaataa

SEQ ID NO: 17757 - DNA, 20 bp, Artificial Sequence
  Description of Artificial Sequence: Synthetic oligonucleotide
  Target: FXN; (+) strand; PAM type: NRG; PAM sequence: TGG
acttcctgctaataacagtt

SEQ ID NO: 17758 - DNA, 20 bp, Artificial Sequence
  Description of Artificial Sequence: Synthetic oligonucleotide
  Target: FXN; (+) strand; PAM type: NRG; PAM sequence: GGG
cttcctgctaataacagttt

SEQ ID NO: 17759 - DNA, 20 bp, Artificial Sequence
  Description of Artificial Sequence: Synthetic oligonucleotide
  Target: FXN; (+) strand; PAM type: NRG; PAM sequence: GGG
ttcctgctaataacagtttg

SEQ ID NO: 17760 - DNA, 20 bp, Artificial Sequence
  Description of Artificial Sequence: Synthetic oligonucleotide
  Target: FXN; (+) strand; PAM type: NRG; PAM sequence: CAG
aataacagtttggggttcca

SEQ ID NO: 17761 - DNA, 20 bp, Artificial Sequence
  Description of Artificial Sequence: Synthetic oligonucleotide
  Target: FXN; (+) strand; PAM type: NRG; PAM sequence: AGG
ataacagtttggggttccac

SEQ ID NO: 17762 - DNA, 20 bp, Artificial Sequence
  Description of Artificial Sequence: Synthetic oligonucleotide
  Target: FXN; (+) strand; PAM type: NRG; PAM sequence: GGG
taacagtttggggttccaca

SEQ ID NO: 17763 - DNA, 20 bp, Artificial Sequence
  Description of Artificial Sequence: Synthetic oligonucleotide
  Target: FXN; (+) strand; PAM type: NRG; PAM sequence: AAG
ggggttccacagggtgtttt

SEQ ID NO: 17764 - DNA, 20 bp, Artificial Sequence
  Description of Artificial Sequence: Synthetic oligonucleotide
  Target: FXN; (+) strand; PAM type: NRG; PAM sequence: CAG
cacagggtgttttaagactc

SEQ ID NO: 17765 - DNA, 20 bp, Artificial Sequence
  Description of Artificial Sequence: Synthetic oligonucleotide
  Target: FXN; (+) strand; PAM type: NRG; PAM sequence: CAG
gggtgttttaagactccagt

SEQ ID NO: 17766 - DNA, 20 bp, Artificial Sequence
  Description of Artificial Sequence: Synthetic oligonucleotide
  Target: FXN; (+) strand; PAM type: NRG; PAM sequence: TAG
aagactccagtcagctattt

SEQ ID NO: 17767 - DNA, 20 bp, Artificial Sequence
  Description of Artificial Sequence: Synthetic oligonucleotide
  Target: FXN; (+) strand; PAM type: NRG; PAM sequence: AGG
agactccagtcagctatttt

SEQ ID NO: 17768 - DNA, 20 bp, Artificial Sequence
  Description of Artificial Sequence: Synthetic oligonucleotide
  Target: FXN; (+) strand; PAM type: NRG; PAM sequence: CAG
tccagtcagctattttaggc

SEQ ID NO: 17769 - DNA, 20 bp, Artificial Sequence
  Description of Artificial Sequence: Synthetic oligonucleotide
  Target: FXN; (+) strand; PAM type: NRG; PAM sequence: GAG
cttttatgaaatcacaccct

SEQ ID NO: 17770 - DNA, 20 bp, Artificial Sequence
  Description of Artificial Sequence: Synthetic oligonucleotide
  Target: FXN; (+) strand; PAM type: NRG; PAM sequence: CAG
tgaaatcacaccctgagacc

SEQ ID NO: 17771 - DNA, 20 bp, Artificial Sequence
  Description of Artificial Sequence: Synthetic oligonucleotide
  Target: FXN; (+) strand; PAM type: NRG; PAM sequence: AGG
gaaatcacaccctgagaccc

SEQ ID NO: 17772 - DNA, 20 bp, Artificial Sequence
  Description of Artificial Sequence: Synthetic oligonucleotide
  Target: FXN; (+) strand; PAM type: NRG; PAM sequence: TGG
tcacaccctgagacccaggc

SEQ ID NO: 17773 - DNA, 20 bp, Artificial Sequence
  Description of Artificial Sequence: Synthetic oligonucleotide
  Target: FXN; (+) strand; PAM type: NRG; PAM sequence: GAG
acaccctgagacccaggctg

SEQ ID NO: 17774 - DNA, 20 bp, Artificial Sequence
  Description of Artificial Sequence: Synthetic oligonucleotide
  Target: FXN; (+) strand; PAM type: NRG; PAM sequence: CAG
ctgagacccaggctggagtg

SEQ ID NO: 17775 - DNA, 20 bp, Artificial Sequence
  Description of Artificial Sequence: Synthetic oligonucleotide
  Target: FXN; (+) strand; PAM type: NRG; PAM sequence: TGG
agacccaggctggagtgcag

SEQ ID NO: 17776 - DNA, 20 bp, Artificial Sequence
  Description of Artificial Sequence: Synthetic oligonucleotide
  Target: FXN; (+) strand; PAM type: NRG; PAM sequence: CGG
ggagtgcagtggtgcgatct

SEQ ID NO: 17777 - DNA, 20 bp, Artificial Sequence
  Description of Artificial Sequence: Synthetic oligonucleotide
  Target: FXN; (+) strand; PAM type: NRG; PAM sequence: CAG
ggtgcgatctcggctcactg

SEQ ID NO: 17778 - DNA, 20 bp, Artificial Sequence
  Description of Artificial Sequence: Synthetic oligonucleotide
  Target: FXN; (+) strand; PAM type: NRG; PAM sequence: CGG
tcactgcagcctccgcctcc

SEQ ID NO: 17779 - DNA, 20 bp, Artificial Sequence
  Description of Artificial Sequence: Synthetic oligonucleotide
  Target: FXN; (+) strand; PAM type: NRG; PAM sequence: GGG
cactgcagcctccgcctccc

SEQ ID NO: 17780 - DNA, 20 bp, Artificial Sequence
  Description of Artificial Sequence: Synthetic oligonucleotide
  Target: FXN; (+) strand; PAM type: NRG; PAM sequence: AAG
agcctccgcctcccgggttc

SEQ ID NO: 17781 - DNA, 20 bp, Artificial Sequence
  Description of Artificial Sequence: Synthetic oligonucleotide
  Target: FXN; (+) strand; PAM type: NRG; PAM sequence: CAG
ttcaagcaatcctcctgcct

SEQ ID NO: 17782 - DNA, 20 bp, Artificial Sequence
  Description of Artificial Sequence: Synthetic oligonucleotide
  Target: FXN; (+) strand; PAM type: NRG; PAM sequence: GAG
tcctcctgcctcagcctcct

SEQ ID NO: 17783 - DNA, 20 bp, Artificial Sequence
  Description of Artificial Sequence: Synthetic oligonucleotide
  Target: FXN; (+) strand; PAM type: NRG; PAM sequence: TAG
tcctgcctcagcctcctgag

SEQ ID NO: 17784 - DNA, 20 bp, Artificial Sequence
  Description of Artificial Sequence: Synthetic oligonucleotide
  Target: FXN; (+) strand; PAM type: NRG; PAM sequence: TGG
gcctcagcctcctgagtagc

SEQ ID NO: 17785 - DNA, 20 bp, Artificial Sequence
  Description of Artificial Sequence: Synthetic oligonucleotide
  Target: FXN; (+) strand; PAM type: NRG; PAM sequence: GGG
cctcagcctcctgagtagct

SEQ ID NO: 17786 - DNA, 20 bp, Artificial Sequence
  Description of Artificial Sequence: Synthetic oligonucleotide
  Target: FXN; (+) strand; PAM type: NRG; PAM sequence: TAG
ctcctgagtagctgggacta

SEQ ID NO: 17787 - DNA, 20 bp, Artificial Sequence
  Description of Artificial Sequence: Synthetic oligonucleotide
  Target: FXN; (+) strand; PAM type: NRG; PAM sequence: AGG
tcctgagtagctgggactat

SEQ ID NO: 17788 - DNA, 20 bp, Artificial Sequence
  Description of Artificial Sequence: Synthetic oligonucleotide
  Target: FXN; (+) strand; PAM type: NRG; PAM sequence: CAG
tagctgggactataggcgtg

SEQ ID NO: 17789 - DNA, 20 bp, Artificial Sequence
  Description of Artificial Sequence: Synthetic oligonucleotide
  Target: FXN; (+) strand; PAM type: NRG; PAM sequence: TAG
taggcgtgcagtgccacacc

SEQ ID NO: 17790 - DNA, 20 bp, Artificial Sequence
  Description of Artificial Sequence: Synthetic oligonucleotide
  Target: FXN; (+) strand; PAM type: NRG; PAM sequence: TAG
ctagctaatttttgtatttt

SEQ ID NO: 17791 - DNA, 20 bp, Artificial Sequence
  Description of Artificial Sequence: Synthetic oligonucleotide
  Target: FXN; (+) strand; PAM type: NRG; PAM sequence: AAG
taatttttgtatttttagta

SEQ ID NO: 17792 - DNA, 20 bp, Artificial Sequence
  Description of Artificial Sequence: Synthetic oligonucleotide
  Target: FXN; (+) strand; PAM type: NRG; PAM sequence: CGG
ttttgtatttttagtaaaga

SEQ ID NO: 17793 - DNA, 20 bp, Artificial Sequence
  Description of Artificial Sequence: Synthetic oligonucleotide
  Target: FXN; (+) strand; PAM type: NRG; PAM sequence: GGG
tttgtatttttagtaaagac

SEQ ID NO: 17794 - DNA, 20 bp, Artificial Sequence
  Description of Artificial Sequence: Synthetic oligonucleotide
  Target: FXN; (+) strand; PAM type: NRG; PAM sequence: GGG
ttgtatttttagtaaagacg

SEQ ID NO: 17795 - DNA, 20 bp, Artificial Sequence
  Description of Artificial Sequence: Synthetic oligonucleotide
  Target: FXN; (+) strand; PAM type: NRG; PAM sequence: TGG
aagacggggtttcaccatgt

SEQ ID NO: 17796 - DNA, 20 bp, Artificial Sequence
  Description of Artificial Sequence: Synthetic oligonucleotide
  Target: FXN; (+) strand; PAM type: NRG; PAM sequence: CAG
cggggtttcaccatgttggc

SEQ ID NO: 17797 - DNA, 20 bp, Artificial Sequence
  Description of Artificial Sequence: Synthetic oligonucleotide
  Target: FXN; (+) strand; PAM type: NRG; PAM sequence: AGG
ggggtttcaccatgttggcc

SEQ ID NO: 17798 - DNA, 20 bp, Artificial Sequence
  Description of Artificial Sequence: Synthetic oligonucleotide
  Target: FXN; (+) strand; PAM type: NRG; PAM sequence: TGG
tttcaccatgttggccaggc

SEQ ID NO: 17799 - DNA, 20 bp, Artificial Sequence
  Description of Artificial Sequence: Synthetic oligonucleotide
  Target: FXN; (+) strand; PAM type: NRG; PAM sequence: CAG
tggtcttgaactcctgacct

SEQ ID NO: 17800 - DNA, 20 bp, Artificial Sequence
  Description of Artificial Sequence: Synthetic oligonucleotide
  Target: FXN; (+) strand; PAM type: NRG; PAM sequence: CGG
ctcagatgatccgcccgcct

SEQ ID NO: 17801 - DNA, 20 bp, Artificial Sequence
  Description of Artificial Sequence: Synthetic oligonucleotide
  Target: FXN; (+) strand; PAM type: NRG; PAM sequence: AAG
ccgcccgcctcggcctccca

SEQ ID NO: 17802 - DNA, 20 bp, Artificial Sequence
  Description of Artificial Sequence: Synthetic oligonucleotide
  Target: FXN; (+) strand; PAM type: NRG; PAM sequence: TGG
gcctcggcctcccaaagtgc

SEQ ID NO: 17803 - DNA, 20 bp, Artificial Sequence
  Description of Artificial Sequence: Synthetic oligonucleotide
  Target: FXN; (+) strand; PAM type: NRG; PAM sequence: GGG
cctcggcctcccaaagtgct

SEQ ID NO: 17804 - DNA, 20 bp, Artificial Sequence
  Description of Artificial Sequence: Synthetic oligonucleotide
  Target: FXN; (+) strand; PAM type: NRG; PAM sequence: TGG
tcccaaagtgctgggattac

SEQ ID NO: 17805 - DNA, 20 bp, Artificial Sequence
  Description of Artificial Sequence: Synthetic oligonucleotide
  Target: FXN; (+) strand; PAM type: NRG; PAM sequence: GAG
agtgctgggattactggcat

SEQ ID NO: 17806 - DNA, 20 bp, Artificial Sequence
  Description of Artificial Sequence: Synthetic oligonucleotide
  Target: FXN; (+) strand; PAM type: NRG; PAM sequence: CAG
ctggcatgagccactgcgcc

SEQ ID NO: 17807 - DNA, 20 bp, Artificial Sequence
  Description of Artificial Sequence: Synthetic oligonucleotide
  Target: FXN; (+) strand; PAM type: NRG; PAM sequence: CAG
atgagccactgcgcccagcc

SEQ ID NO: 17808 - DNA, 20 bp, Artificial Sequence
  Description of Artificial Sequence: Synthetic oligonucleotide
  Target: FXN; (+) strand; PAM type: NRG; PAM sequence: GAG
gcccagactcatttttcttt

SEQ ID NO: 17809 - DNA, 20 bp, Artificial Sequence
  Description of Artificial Sequence: Synthetic oligonucleotide
  Target: FXN; (+) strand; PAM type: NRG; PAM sequence: GAG
ccagactcatttttctttga

SEQ ID NO: 17810 - DNA, 20 bp, Artificial Sequence
  Description of Artificial Sequence: Synthetic oligonucleotide
  Target: FXN; (+) strand; PAM type: NRG; PAM sequence: TAG
gactcatttttctttgagag

SEQ ID NO: 17811 - DNA, 20 bp, Artificial Sequence
  Description of Artificial Sequence: Synthetic oligonucleotide
  Target: FXN; (+) strand; PAM type: NRG; PAM sequence: AGG
actcatttttctttgagagt

SEQ ID NO: 17812 - DNA, 20 bp, Artificial Sequence
  Description of Artificial Sequence: Synthetic oligonucleotide
  Target: FXN; (+) strand; PAM type: NRG; PAM sequence: AAG
tgagagtaggcttttcccaa

SEQ ID NO: 17813 - DNA, 20 bp, Artificial Sequence
  Description of Artificial Sequence: Synthetic oligonucleotide
  Target: FXN; (+) strand; PAM type: NRG; PAM sequence: TAG
gagtaggcttttcccaaaag

SEQ ID NO: 17814 - DNA, 20 bp, Artificial Sequence
  Description of Artificial Sequence: Synthetic oligonucleotide
  Target: FXN; (+) strand; PAM type: NRG; PAM sequence: AGG
agtaggcttttcccaaaagt

SEQ ID NO: 17815 - DNA, 20 bp, Artificial Sequence
  Description of Artificial Sequence: Synthetic oligonucleotide
  Target: FXN; (+) strand; PAM type: NRG; PAM sequence: GAG
tttcccaaaagtaggcttct

SEQ ID NO: 17816 - DNA, 20 bp, Artificial Sequence
  Description of Artificial Sequence: Synthetic oligonucleotide
  Target: FXN; (+) strand; PAM type: NRG; PAM sequence: CAG
gcttctgagctattcacttt

SEQ ID NO: 17817 - DNA, 20 bp, Artificial Sequence
  Description of Artificial Sequence: Synthetic oligonucleotide
  Target: FXN; (+) strand; PAM type: NRG; PAM sequence: AGG
cttctgagctattcactttc

SEQ ID NO: 17818 - DNA, 20 bp, Artificial Sequence
  Description of Artificial Sequence: Synthetic oligonucleotide
  Target: FXN; (+) strand; PAM type: NRG; PAM sequence: CAG
ctgagctattcactttcagg

SEQ ID NO: 17819 - DNA, 20 bp, Artificial Sequence
  Description of Artificial Sequence: Synthetic oligonucleotide
  Target: FXN; (+) strand; PAM type: NRG; PAM sequence: CAG
tttcaggcagtcccatgtgc

SEQ ID NO: 17820 - DNA, 20 bp, Artificial Sequence
  Description of Artificial Sequence: Synthetic oligonucleotide
  Target: FXN; (+) strand; PAM type: NRG; PAM sequence: AGG
ttcaggcagtcccatgtgcc

SEQ ID NO: 17821 - DNA, 20 bp, Artificial Sequence
  Description of Artificial Sequence: Synthetic oligonucleotide
  Target: FXN; (+) strand; PAM type: NRG; PAM sequence: TGG
ccacatccaaatttcctccg

SEQ ID NO: 17822 - DNA, 20 bp, Artificial Sequence
  Description of Artificial Sequence: Synthetic oligonucleotide
  Target: FXN; (+) strand; PAM type: NRG; PAM sequence: TGG
atccaaatttcctccgtgga

SEQ ID NO: 17823 - DNA, 20 bp, Artificial Sequence
  Description of Artificial Sequence: Synthetic oligonucleotide
  Target: FXN; (+) strand; PAM type: NRG; PAM sequence: GGG
tccaaatttcctccgtggat

SEQ ID NO: 17824 - DNA, 20 bp, Artificial Sequence
  Description of Artificial Sequence: Synthetic oligonucleotide
  Target: FXN; (+) strand; PAM type: NRG; PAM sequence: GAG
caaatttcctccgtggatgg

SEQ ID NO: 17825 - DNA, 20 bp, Artificial Sequence
  Description of Artificial Sequence: Synthetic oligonucleotide
  Target: FXN; (+) strand; PAM type: NRG; PAM sequence: CAG
tcctccgtggatgggagtct

SEQ ID NO: 17826 - DNA, 20 bp, Artificial Sequence
  Description of Artificial Sequence: Synthetic oligonucleotide
  Target: FXN; (+) strand; PAM type: NRG; PAM sequence: AGG
cctccgtggatgggagtctc

SEQ ID NO: 17827 - DNA, 20 bp, Artificial Sequence
  Description of Artificial Sequence: Synthetic oligonucleotide
  Target: FXN; (+) strand; PAM type: NRG; PAM sequence: CAG
tccttgcatgtccccatgcc

SEQ ID NO: 17828 - DNA, 20 bp, Artificial Sequence
  Description of Artificial Sequence: Synthetic oligonucleotide
  Target: FXN; (+) strand; PAM type: NRG; PAM sequence: CAG
gtccccatgcccagctgtct

SEQ ID NO: 17829 - DNA, 20 bp, Artificial Sequence
  Description of Artificial Sequence: Synthetic oligonucleotide
  Target: FXN; (+) strand; PAM type: NRG; PAM sequence: AAG
atgcccagctgtctcagcct

SEQ ID NO: 17830 - DNA, 20 bp, Artificial Sequence
  Description of Artificial Sequence: Synthetic oligonucleotide
  Target: FXN; (+) strand; PAM type: NRG; PAM sequence: AGG
tgcccagctgtctcagccta

SEQ ID NO: 17831 - DNA, 20 bp, Artificial Sequence
  Description of Artificial Sequence: Synthetic oligonucleotide
  Target: FXN; (+) strand; PAM type: NRG; PAM sequence: GGG
gcccagctgtctcagcctaa

SEQ ID NO: 17832 - DNA, 20 bp, Artificial Sequence
  Description of Artificial Sequence: Synthetic oligonucleotide
  Target: FXN; (+) strand; PAM type: NRG; PAM sequence: CAG
cagctgtctcagcctaaggg

SEQ ID NO: 17833 - DNA, 20 bp, Artificial Sequence
  Description of Artificial Sequence: Synthetic oligonucleotide
  Target: FXN; (+) strand; PAM type: NRG; PAM sequence: AGG
agctgtctcagcctaagggc

SEQ ID NO: 17834 - DNA, 20 bp, Artificial Sequence
  Description of Artificial Sequence: Synthetic oligonucleotide
  Target: FXN; (+) strand; PAM type: NRG; PAM sequence: AAG
gcctaagggcaggtaccttg

SEQ ID NO: 17835 - DNA, 20 bp, Artificial Sequence
  Description of Artificial Sequence: Synthetic oligonucleotide
  Target: FXN; (+) strand; PAM type: NRG; PAM sequence: AAG
agggcaggtaccttgaagtc

SEQ ID NO: 17836 - DNA, 20 bp, Artificial Sequence
  Description of Artificial Sequence: Synthetic oligonucleotide
  Target: FXN; (+) strand; PAM type: NRG; PAM sequence: AAG
ttgaagtcaagttaaacaat

SEQ ID NO: 17837 - DNA, 20 bp, Artificial Sequence
  Description of Artificial Sequence: Synthetic oligonucleotide
  Target: FXN; (+) strand; PAM type: NRG; PAM sequence: TGG
gtcaagttaaacaataagat

SEQ ID NO: 17838 - DNA, 20 bp, Artificial Sequence
  Description of Artificial Sequence: Synthetic oligonucleotide
  Target: FXN; (+) strand; PAM type: NRG; PAM sequence: GAG
caagttaaacaataagattg

SEQ ID NO: 17839 - DNA, 20 bp, Artificial Sequence
  Description of Artificial Sequence: Synthetic oligonucleotide
  Target: FXN; (+) strand; PAM type: NRG; PAM sequence: CAG
taaacaataagattggagac

SEQ ID NO: 17840 - DNA, 20 bp, Artificial Sequence
  Description of Artificial Sequence: Synthetic oligonucleotide
  Target: FXN; (+) strand; PAM type: NRG; PAM sequence: CAG
ttggagaccagcaatgccct

SEQ ID NO: 17841 - DNA, 20 bp, Artificial Sequence
  Description of Artificial Sequence: Synthetic oligonucleotide
  Target: FXN; (+) strand; PAM type: NRG; PAM sequence: TGG
gaccagcaatgccctcagcc

SEQ ID NO: 17842 - DNA, 20 bp, Artificial Sequence
  Description of Artificial Sequence: Synthetic oligonucleotide
  Target: FXN; (+) strand; PAM type: NRG; PAM sequence: CAG
tgccctcagcctggtttttg

SEQ ID NO: 17843 - DNA, 20 bp, Artificial Sequence
  Description of Artificial Sequence: Synthetic oligonucleotide
  Target: FXN; (+) strand; PAM type: NRG; PAM sequence: CAG
cctcagcctggtttttgcag

SEQ ID NO: 17844 - DNA, 20 bp, Artificial Sequence
  Description of Artificial Sequence: Synthetic oligonucleotide
  Target: FXN; (+) strand; PAM type: NRG; PAM sequence: AGG
ctcagcctggtttttgcagc

SEQ ID NO: 17845 - DNA, 20 bp, Artificial Sequence
  Description of Artificial Sequence: Synthetic oligonucleotide
  Target: FXN; (+) strand; PAM type: NRG; PAM sequence: GAG
ctggtttttgcagcaggact

SEQ ID NO: 17846 - DNA, 20 bp, Artificial Sequence
  Description of Artificial Sequence: Synthetic oligonucleotide
  Target: FXN; (+) strand; PAM type: NRG; PAM sequence: TGG
caggactgagtcccttgttt

SEQ ID NO: 17847 - DNA, 20 bp, Artificial Sequence
  Description of Artificial Sequence: Synthetic oligonucleotide
  Target: FXN; (+) strand; PAM type: NRG; PAM sequence: TGG
agtcccttgttttggctcaa

SEQ ID NO: 17848 - DNA, 20 bp, Artificial Sequence
  Description of Artificial Sequence: Synthetic oligonucleotide
  Target: FXN; (+) strand; PAM type: NRG; PAM sequence: GGG
gtcccttgttttggctcaat

SEQ ID NO: 17849 - DNA, 20 bp, Artificial Sequence
  Description of Artificial Sequence: Synthetic oligonucleotide
  Target: FXN; (+) strand; PAM type: NRG; PAM sequence: AAG
ccttgttttggctcaatggg

SEQ ID NO: 17850 - DNA, 20 bp, Artificial Sequence
  Description of Artificial Sequence: Synthetic oligonucleotide
  Target: FXN; (+) strand; PAM type: NRG; PAM sequence: AAG
tgggaagtctttgctgttca

SEQ ID NO: 17851 - DNA, 20 bp, Artificial Sequence
  Description of Artificial Sequence: Synthetic oligonucleotide
  Target: FXN; (+) strand; PAM type: NRG; PAM sequence: TAG
gtctttgctgttcaaagcct

SEQ ID NO: 17852 - DNA, 20 bp, Artificial Sequence
  Description of Artificial Sequence: Synthetic oligonucleotide
  Target: FXN; (+) strand; PAM type: NRG; PAM sequence: TGG
gttcaaagccttagcttctc

SEQ ID NO: 17853 - DNA, 20 bp, Artificial Sequence
  Description of Artificial Sequence: Synthetic oligonucleotide
  Target: FXN; (+) strand; PAM type: NRG; PAM sequence: GAG
aagccttagcttctctggct

SEQ ID NO: 17854 - DNA, 20 bp, Artificial Sequence
  Description of Artificial Sequence: Synthetic oligonucleotide
  Target: FXN; (+) strand; PAM type: NRG; PAM sequence: CGG
ttagcttctctggctgagtg

SEQ ID NO: 17855 - DNA, 20 bp, Artificial Sequence
  Description of Artificial Sequence: Synthetic oligonucleotide
  Target: FXN; (+) strand; PAM type: NRG; PAM sequence: TGG
gcttctctggctgagtgcgg

SEQ ID NO: 17856 - DNA, 20 bp, Artificial Sequence
  Description of Artificial Sequence: Synthetic oligonucleotide
  Target: FXN; (+) strand; PAM type: NRG; PAM sequence: TAG
gtggctcacgcctgtcatcc

SEQ ID NO: 17857 - DNA, 20 bp, Artificial Sequence
  Description of Artificial Sequence: Synthetic oligonucleotide
  Target: FXN; (+) strand; PAM type: NRG; PAM sequence: TGG
cgcctgtcatcctagctctt

SEQ ID NO: 17858 - DNA, 20 bp, Artificial Sequence
  Description of Artificial Sequence: Synthetic oligonucleotide
  Target: FXN; (+) strand; PAM type: NRG; PAM sequence: GGG
gcctgtcatcctagctcttt

SEQ ID NO: 17859 - DNA, 20 bp, Artificial Sequence
  Description of Artificial Sequence: Synthetic oligonucleotide
  Target: FXN; (+) strand; PAM type: NRG; PAM sequence: GAG
ctgtcatcctagctctttgg

SEQ ID NO: 17860 - DNA, 20 bp, Artificial Sequence
  Description of Artificial Sequence: Synthetic oligonucleotide
  Target: FXN; (+) strand; PAM type: NRG; PAM sequence: AGG
tgtcatcctagctctttggg

SEQ ID NO: 17861 - DNA, 20 bp, Artificial Sequence
  Description of Artificial Sequence: Synthetic oligonucleotide
  Target: FXN; (+) strand; PAM type: NRG; PAM sequence: GAG
tcctagctctttgggaggcc

SEQ ID NO: 17862 - DNA, 20 bp, Artificial Sequence
  Description of Artificial Sequence: Synthetic oligonucleotide
  Target: FXN; (+) strand; PAM type: NRG; PAM sequence: AGG
cctagctctttgggaggccg

SEQ ID NO: 17863 - DNA, 20 bp, Artificial Sequence
  Description of Artificial Sequence: Synthetic oligonucleotide
  Target: FXN; (+) strand; PAM type: NRG; PAM sequence: GAG
gctctttgggaggccgaggt

SEQ ID NO: 17864 - DNA, 20 bp, Artificial Sequence
  Description of Artificial Sequence: Synthetic oligonucleotide
  Target: FXN; (+) strand; PAM type: NRG; PAM sequence: CAG
ctttgggaggccgaggtgag

SEQ ID NO: 17865 - DNA, 20 bp, Artificial Sequence
  Description of Artificial Sequence: Synthetic oligonucleotide
  Target: FXN; (+) strand; PAM type: NRG; PAM sequence: GAG
gccgaggtgagcagatcact

SEQ ID NO: 17866 - DNA, 20 bp, Artificial Sequence
  Description of Artificial Sequence: Synthetic oligonucleotide
  Target: FXN; (+) strand; PAM type: NRG; PAM sequence: AGG
ccgaggtgagcagatcactg

SEQ ID NO: 17867 - DNA, 20 bp, Artificial Sequence
  Description of Artificial Sequence: Synthetic oligonucleotide
  Target: FXN; (+) strand; PAM type: NRG; PAM sequence: CAG
ggtgagcagatcactgaggc

SEQ ID NO: 17868 - DNA, 20 bp, Artificial Sequence
  Description of Artificial Sequence: Synthetic oligonucleotide
  Target: FXN; (+) strand; PAM type: NRG; PAM sequence: AGG
gtgagcagatcactgaggcc

SEQ ID NO: 17869 - DNA, 20 bp, Artificial Sequence
  Description of Artificial Sequence: Synthetic oligonucleotide
  Target: FXN; (+) strand; PAM type: NRG; PAM sequence: GAG
gagcagatcactgaggccag

SEQ ID NO: 17870 - DNA, 20 bp, Artificial Sequence
  Description of Artificial Sequence: Synthetic oligonucleotide
  Target: FXN; (+) strand; PAM type: NRG; PAM sequence: AAG
atcactgaggccaggagttc

SEQ ID NO: 17871 - DNA, 20 bp, Artificial Sequence
  Description of Artificial Sequence: Synthetic oligonucleotide
  Target: FXN; (+) strand; PAM type: NRG; PAM sequence: CAG
tgaggccaggagttcaagac

SEQ ID NO: 17872 - DNA, 20 bp, Artificial Sequence
  Description of Artificial Sequence: Synthetic oligonucleotide
  Target: FXN; (+) strand; PAM type: NRG; PAM sequence: TGG
ccaggagttcaagaccagcc

SEQ ID NO: 17873 - DNA, 20 bp, Artificial Sequence
  Description of Artificial Sequence: Synthetic oligonucleotide
  Target: FXN; (+) strand; PAM type: NRG; PAM sequence: TGG
caagaccagcctggccaaca

SEQ ID NO: 17874 - DNA, 20 bp, Artificial Sequence
  Description of Artificial Sequence: Synthetic oligonucleotide
  Target: FXN; (+) strand; PAM type: NRG; PAM sequence: AAG
gtctctactaaaaatacaaa

SEQ ID NO: 17875 - DNA, 20 bp, Artificial Sequence
  Description of Artificial Sequence: Synthetic oligonucleotide
  Target: FXN; (+) strand; PAM type: NRG; PAM sequence: TAG
ctactaaaaatacaaaaagt

SEQ ID NO: 17876 - DNA, 20 bp, Artificial Sequence
  Description of Artificial Sequence: Synthetic oligonucleotide
  Target: FXN; (+) strand; PAM type: NRG; PAM sequence: CAG
taaaaatacaaaaagttagc

SEQ ID NO: 17877 - DNA, 20 bp, Artificial Sequence
  Description of Artificial Sequence: Synthetic oligonucleotide
  Target: FXN; (+) strand; PAM type: NRG; PAM sequence: AGG
aaaaatacaaaaagttagcc

SEQ ID NO: 17878 - DNA, 20 bp, Artificial Sequence
  Description of Artificial Sequence: Synthetic oligonucleotide
  Target: FXN; (+) strand; PAM type: NRG; PAM sequence: TGG
tacaaaaagttagccaggcg

SEQ ID NO: 17879 - DNA, 20 bp, Artificial Sequence
  Description of Artificial Sequence: Synthetic oligonucleotide
  Target: FXN; (+) strand; PAM type: NRG; PAM sequence: TGG
aaaaagttagccaggcgtgg

SEQ ID NO: 17880 - DNA, 20 bp, Artificial Sequence
  Description of Artificial Sequence: Synthetic oligonucleotide
  Target: FXN; (+) strand; PAM type: NRG; PAM sequence: CAG
aagttagccaggcgtggtgg

SEQ ID NO: 17881 - DNA, 20 bp, Artificial Sequence
  Description of Artificial Sequence: Synthetic oligonucleotide
  Target: FXN; (+) strand; PAM type: NRG; PAM sequence: AGG
agttagccaggcgtggtggc

SEQ ID NO: 17882 - DNA, 20 bp, Artificial Sequence
  Description of Artificial Sequence: Synthetic oligonucleotide
  Target: FXN; (+) strand; PAM type: NRG; PAM sequence: CAG
gtggcaggcacctgtaatcc

SEQ ID NO: 17883 - DNA, 20 bp, Artificial Sequence
  Description of Artificial Sequence: Synthetic oligonucleotide
  Target: FXN; (+) strand; PAM type: NRG; PAM sequence: CGG
cacctgtaatcccagctact

SEQ ID NO: 17884 - DNA, 20 bp, Artificial Sequence
  Description of Artificial Sequence: Synthetic oligonucleotide
  Target: FXN; (+) strand; PAM type: NRG; PAM sequence: GGG
acctgtaatcccagctactc

SEQ ID NO: 17885 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagctactcgg

SEQ ID NO: 17886 - DNA, 20 bp, Artificial Sequence
  Description of Artificial Sequence: Synthetic oligonucleotide
  Target: FXN; (+) strand; PAM type: NRG; PAM sequence: GAG
tcccagctactcgggagcct

SEQ ID NO: 17887 - DNA, 20 bp, Artificial Sequence
  Description of Artificial Sequence: Synthetic oligonucleotide
  Target: FXN; (+) strand; PAM type: NRG; PAM sequence: AGG
cccagctactcgggagcctg

SEQ ID NO: 17888 - DNA, 20 bp, Artificial Sequence
  Description of Artificial Sequence: Synthetic oligonucleotide
  Target: FXN; (+) strand; PAM type: NRG; PAM sequence: CAG
agctactcgggagcctgagg

SEQ ID NO: 17889 - DNA, 20 bp, Artificial Sequence
  Description of Artificial Sequence: Synthetic oligonucleotide
  Target: FXN; (+) strand; PAM type: NRG; PAM sequence: AGG
gctactcgggagcctgaggc

SEQ ID NO: 17890 - DNA, 20 bp, Artificial Sequence
  Description of Artificial Sequence: Synthetic oligonucleotide
  Target: FXN; (+) strand; PAM type: NRG; PAM sequence: GAG
tactcgggagcctgaggcag

SEQ ID NO: 17891 - DNA, 20 bp, Artificial Sequence
  Description of Artificial Sequence: Synthetic oligonucleotide
  Target: FXN; (+) strand; PAM type: NRG; PAM sequence: CAG
gcaggagaatcgcttaaacc

SEQ ID NO: 17892 - DNA, 20 bp, Artificial Sequence
  Description of Artificial Sequence: Synthetic oligonucleotide
  Target: FXN; (+) strand; PAM type: NRG; PAM sequence: AGG
caggagaatcgcttaaaccc

SEQ ID NO: 17893 - DNA, 20 bp, Artificial Sequence
  Description of Artificial Sequence: Synthetic oligonucleotide
  Target: FXN; (+) strand; PAM type: NRG; PAM sequence: GAG
ggagaatcgcttaaacccag

SEQ ID NO: 17894 - DNA, 20 bp, Artificial Sequence
  Description of Artificial Sequence: Synthetic oligonucleotide
  Target: FXN; (+) strand; PAM type: NRG; PAM sequence: TGG
aatcgcttaaacccaggaga

SEQ ID NO: 17895 - DNA, 20 bp, Artificial Sequence
  Description of Artificial Sequence: Synthetic oligonucleotide
  Target: FXN; (+) strand; PAM type: NRG; PAM sequence: GAG
tcgcttaaacccaggagatg

SEQ ID NO: 17896 - DNA, 20 bp, Artificial Sequence
  Description of Artificial Sequence: Synthetic oligonucleotide
  Target: FXN; (+) strand; PAM type: NRG; PAM sequence: AGG
cgcttaaacccaggagatgg

SEQ ID NO: 17897 - DNA, 20 bp, Artificial Sequence
  Description of Artificial Sequence: Synthetic oligonucleotide
  Target: FXN; (+) strand; PAM type: NRG; PAM sequence: CAG
aacccaggagatggaggctg

SEQ ID NO: 17898 - DNA, 20 bp, Artificial Sequence
  Description of Artificial Sequence: Synthetic oligonucleotide
  Target: FXN; (+) strand; PAM type: NRG; PAM sequence: GAG
caggagatggaggctgcagt

SEQ ID NO: 17899 - DNA, 20 bp, Artificial Sequence
  Description of Artificial Sequence: Synthetic oligonucleotide
  Target: FXN; (+) strand; PAM type: NRG; PAM sequence: GAG
gatggaggctgcagtgagct

SEQ ID NO: 17900 - DNA, 20 bp, Artificial Sequence
  Description of Artificial Sequence: Synthetic oligonucleotide
  Target: FXN; (+) strand; PAM type: NRG; PAM sequence: CAG
gagatcatgccattgcactc

SEQ ID NO: 17901 - DNA, 20 bp, Artificial Sequence
  Description of Artificial Sequence: Synthetic oligonucleotide
  Target: FXN; (+) strand; PAM type: NRG; PAM sequence: TGG
catgccattgcactccagcc

SEQ ID NO: 17902 - DNA, 20 bp, Artificial Sequence
  Description of Artificial Sequence: Synthetic oligonucleotide
  Target: FXN; (+) strand; PAM type: NRG; PAM sequence: GGG
atgccattgcactccagcct

SEQ ID NO: 17903 - DNA, 20 bp, Artificial Sequence
  Description of Artificial Sequence: Synthetic oligonucleotide
  Target: FXN; (+) strand; PAM type: NRG; PAM sequence: GAG
tgcactccagcctgggtaac

SEQ ID NO: 17904 - DNA, 20 bp, Artificial Sequence
  Description of Artificial Sequence: Synthetic oligonucleotide
  Target: FXN; (+) strand; PAM type: NRG; PAM sequence: AAG
gaaattccatctctaaaaaa

SEQ ID NO: 17905 - DNA, 20 bp, Artificial Sequence
  Description of Artificial Sequence: Synthetic oligonucleotide
  Target: FXN; (+) strand; PAM type: NRG; PAM sequence: AAG
tctaaaaaaaagaaaaaaaa

SEQ ID NO: 17906 - DNA, 20 bp, Artificial Sequence
  Description of Artificial Sequence: Synthetic oligonucleotide
  Target: FXN; (+) strand; PAM type: NRG; PAM sequence: AGG
ctaaaaaaaagaaaaaaaaa

SEQ ID NO: 17907 - DNA, 20 bp, Artificial Sequence
  Description of Artificial Sequence: Synthetic oligonucleotide
  Target: FXN; (+) strand; PAM type: NRG; PAM sequence: TAG
aaaagaaaaaaaaaaggcct

SEQ ID NO: 17908 - DNA, 20 bp, Artificial Sequence
  Description of Artificial Sequence: Synthetic oligonucleotide
  Target: FXN; (+) strand; PAM type: NRG; PAM sequence: CAG
tttgactttccacgtttgtg

SEQ ID NO: 17909 - DNA, 20 bp, Artificial Sequence
  Description of Artificial Sequence: Synthetic oligonucleotide
  Target: FXN; (+) strand; PAM type: NRG; PAM sequence: TGG
ctccatttcattccatctcc

SEQ ID NO: 17910 - DNA, 20 bp, Artificial Sequence
  Description of Artificial Sequence: Synthetic oligonucleotide
  Target: FXN; (+) strand; PAM type: NRG; PAM sequence: AAG
tttcttgtcacatctactaa

SEQ ID NO: 17911 - DNA, 20 bp, Artificial Sequence
  Description of Artificial Sequence: Synthetic oligonucleotide
  Target: FXN; (+) strand; PAM type: NRG; PAM sequence: AAG
tcacatctactaaaagcaac

SEQ ID NO: 17912 - DNA, 20 bp, Artificial Sequence
  Description of Artificial Sequence: Synthetic oligonucleotide
  Target: FXN; (+) strand; PAM type: NRG; PAM sequence: AAG
catctactaaaagcaacaag

SEQ ID NO: 17913 - DNA, 20 bp, Artificial Sequence
  Description of Artificial Sequence: Synthetic oligonucleotide
  Target: FXN; (+) strand; PAM type: NRG; PAM sequence: CGG
taaaagcaacaagaagccac

SEQ ID NO: 17914 - DNA, 20 bp, Artificial Sequence
  Description of Artificial Sequence: Synthetic oligonucleotide
  Target: FXN; (+) strand; PAM type: NRG; PAM sequence: CAG
aacaagaagccaccggtatt

SEQ ID NO: 17915 - DNA, 20 bp, Artificial Sequence
  Description of Artificial Sequence: Synthetic oligonucleotide
  Target: FXN; (+) strand; PAM type: NRG; PAM sequence: AGG
acaagaagccaccggtattc

SEQ ID NO: 17916 - DNA, 20 bp, Artificial Sequence
  Description of Artificial Sequence: Synthetic oligonucleotide
  Target: FXN; (+) strand; PAM type: NRG; PAM sequence: CAG
aggaacattctacctgtccc

SEQ ID NO: 17917 - DNA, 20 bp, Artificial Sequence
  Description of Artificial Sequence: Synthetic oligonucleotide
  Target: FXN; (+) strand; PAM type: NRG; PAM sequence: GAG
gaacattctacctgtcccca

SEQ ID NO: 17918 - DNA, 20 bp, Artificial Sequence
  Description of Artificial Sequence: Synthetic oligonucleotide
  Target: FXN; (+) strand; PAM type: NRG; PAM sequence: CAG
tgtccccagagctatatgct

SEQ ID NO: 17919 - DNA, 20 bp, Artificial Sequence
  Description of Artificial Sequence: Synthetic oligonucleotide
  Target: FXN; (+) strand; PAM type: NRG; PAM sequence: TAG
ccccagagctatatgctcag

SEQ ID NO: 17920 - DNA, 20 bp, Artificial Sequence
  Description of Artificial Sequence: Synthetic oligonucleotide
  Target: FXN; (+) strand; PAM type: NRG; PAM sequence: AGG
cccagagctatatgctcagt

SEQ ID NO: 17921 - DNA, 20 bp, Artificial Sequence
  Description of Artificial Sequence: Synthetic oligonucleotide
  Target: FXN; (+) strand; PAM type: NRG; PAM sequence: CAG
ctatatgctcagtaggcata

SEQ ID NO: 17922 - DNA, 20 bp, Artificial Sequence
  Description of Artificial Sequence: Synthetic oligonucleotide
  Target: FXN; (+) strand; PAM type: NRG; PAM sequence: TGG
atgctcagtaggcatacagt

SEQ ID NO: 17923 - DNA, 20 bp, Artificial Sequence
  Description of Artificial Sequence: Synthetic oligonucleotide
  Target: FXN; (+) strand; PAM type: NRG; PAM sequence: CAG
taggcatacagttggccctc

SEQ ID NO: 17924 - DNA, 20 bp, Artificial Sequence
  Description of Artificial Sequence: Synthetic oligonucleotide
  Target: FXN; (+) strand; PAM type: NRG; PAM sequence: AGG
aggcatacagttggccctcc

SEQ ID NO: 17925 - DNA, 20 bp, Artificial Sequence
  Description of Artificial Sequence: Synthetic oligonucleotide
  Target: FXN; (+) strand; PAM type: NRG; PAM sequence: GAG
gttggccctccaggttatct

SEQ ID NO: 17926 - DNA, 20 bp, Artificial Sequence
  Description of Artificial Sequence: Synthetic oligonucleotide
  Target: FXN; (+) strand; PAM type: NRG; PAM sequence: CAG
cctccaggttatctgagact

SEQ ID NO: 17927 - DNA, 20 bp, Artificial Sequence
  Description of Artificial Sequence: Synthetic oligonucleotide
  Target: FXN; (+) strand; PAM type: NRG; PAM sequence: CAG
ttatctgagactcagatttc

SEQ ID NO: 17928 - DNA, 20 bp, Artificial Sequence
  Description of Artificial Sequence: Synthetic oligonucleotide
  Target: FXN; (+) strand; PAM type: NRG; PAM sequence: GAG
atctgagactcagatttcca

SEQ ID NO: 17929 - DNA, 20 bp, Artificial Sequence
  Description of Artificial Sequence: Synthetic oligonucleotide
  Target: FXN; (+) strand; PAM type: NRG; PAM sequence: AGG
tctgagactcagatttccag

SEQ ID NO: 17930 - DNA, 20 bp, Artificial Sequence
  Description of Artificial Sequence: Synthetic oligonucleotide
  Target: FXN; (+) strand; PAM type: NRG; PAM sequence: GGG
ctgagactcagatttccaga

SEQ ID NO: 17931 - DNA, 20 bp, Artificial Sequence
  Description of Artificial Sequence: Synthetic oligonucleotide
  Target: FXN; (+) strand; PAM type: NRG; PAM sequence: TGG
gatttccagagggctttgca

SEQ ID NO: 17932 - DNA, 20 bp, Artificial Sequence
  Description of Artificial Sequence: Synthetic oligonucleotide
  Target: FXN; (+) strand; PAM type: NRG; PAM sequence: AAG
gagggctttgcatggctcac

SEQ ID NO: 17933 - DNA, 20 bp, Artificial Sequence
  Description of Artificial Sequence: Synthetic oligonucleotide
  Target: FXN; (+) strand; PAM type: NRG; PAM sequence: AGG
agggctttgcatggctcaca

SEQ ID NO: 17934 - DNA, 20 bp, Artificial Sequence
  Description of Artificial Sequence: Synthetic oligonucleotide
  Target: FXN; (+) strand; PAM type: NRG; PAM sequence: AAG
tgcatggctcacaaggtctg

SEQ ID NO: 17935 - DNA, 20 bp, Artificial Sequence
  Description of Artificial Sequence: Synthetic oligonucleotide
  Target: FXN; (+) strand; PAM type: NRG; PAM sequence: GAG
acaaggtctgaagaacctct

SEQ ID NO: 17936 - DNA, 20 bp, Artificial Sequence
  Description of Artificial Sequence: Synthetic oligonucleotide
  Target: FXN; (+) strand; PAM type: NRG; PAM sequence: CGG
acctctgagcctcccgcctg

SEQ ID NO: 17937 - DNA, 20 bp, Artificial Sequence
  Description of Artificial Sequence: Synthetic oligonucleotide
  Target: FXN; (+) strand; PAM type: NRG; PAM sequence: CAG
tctgttcattgactttgcca

SEQ ID NO: 17938 - DNA, 20 bp, Artificial Sequence
  Description of Artificial Sequence: Synthetic oligonucleotide
  Target: FXN; (+) strand; PAM type: NRG; PAM sequence: AAG
ttgactttgccacagtctca

SEQ ID NO: 17939 - DNA, 20 bp, Artificial Sequence
  Description of Artificial Sequence: Synthetic oligonucleotide
  Target: FXN; (+) strand; PAM type: NRG; PAM sequence: GAG
gactttgccacagtctcaaa

SEQ ID NO: 17940 - DNA, 20 bp, Artificial Sequence
  Description of Artificial Sequence: Synthetic oligonucleotide
  Target: FXN; (+) strand; PAM type: NRG; PAM sequence: AGG
actttgccacagtctcaaag

SEQ ID NO: 17941 - DNA, 20 bp, Artificial Sequence
  Description of Artificial Sequence: Synthetic oligonucleotide
  Target: FXN; (+) strand; PAM type: NRG; PAM sequence: GAG
gcactgcatgctgcatgttt

SEQ ID NO: 17942 - DNA, 20 bp, Artificial Sequence
  Description of Artificial Sequence: Synthetic oligonucleotide
  Target: FXN; (+) strand; PAM type: NRG; PAM sequence: AGG
cactgcatgctgcatgtttg

SEQ ID NO: 17943 - DNA, 20 bp, Artificial Sequence
  Description of Artificial Sequence: Synthetic oligonucleotide
  Target: FXN; (+) strand; PAM type: NRG; PAM sequence: TGG
catgtttgaggtttttgctt

SEQ ID NO: 17944 - DNA, 20 bp, Artificial Sequence
  Description of Artificial Sequence: Synthetic oligonucleotide
  Target: FXN; (+) strand; PAM type: NRG; PAM sequence: TGG
gtttgaggtttttgctttgg

SEQ ID NO: 17945 - DNA, 20 bp, Artificial Sequence
  Description of Artificial Sequence: Synthetic oligonucleotide
  Target: FXN; (+) strand; PAM type: NRG; PAM sequence: CAG
gctttggtggcatccatttc

SEQ ID NO: 17946 - DNA, 20 bp, Artificial Sequence
  Description of Artificial Sequence: Synthetic oligonucleotide
  Target: FXN; (+) strand; PAM type: NRG; PAM sequence: CGG
gtggcatccatttccagcct

SEQ ID NO: 17947 - DNA, 20 bp, Artificial Sequence
  Description of Artificial Sequence: Synthetic oligonucleotide
  Target: FXN; (+) strand; PAM type: NRG; PAM sequence: CGG
ccatttccagcctcggcttc

SEQ ID NO: 17948 - DNA, 20 bp, Artificial Sequence
  Description of Artificial Sequence: Synthetic oligonucleotide
  Target: FXN; (+) strand; PAM type: NRG; PAM sequence: CAG
ggcttccggcattcctcccc

SEQ ID NO: 17949 - DNA, 20 bp, Artificial Sequence
  Description of Artificial Sequence: Synthetic oligonucleotide
  Target: FXN; (+) strand; PAM type: NRG; PAM sequence: CAG
ttccggcattcctcccccag

SEQ ID NO: 17950 - DNA, 20 bp, Artificial Sequence
  Description of Artificial Sequence: Synthetic oligonucleotide
  Target: FXN; (+) strand; PAM type: NRG; PAM sequence: TGG
tgctttccccttactccttc

SEQ ID NO: 17951 - DNA, 20 bp, Artificial Sequence
  Description of Artificial Sequence: Synthetic oligonucleotide
  Target: FXN; (+) strand; PAM type: NRG; PAM sequence: CAG
tttccccttactccttctgg

SEQ ID NO: 17952 - DNA, 20 bp, Artificial Sequence
  Description of Artificial Sequence: Synthetic oligonucleotide
  Target: FXN; (+) strand; PAM type: NRG; PAM sequence: TGG
cttactccttctggcagttc

SEQ ID NO: 17953 - DNA, 20 bp, Artificial Sequence
  Description of Artificial Sequence: Synthetic oligonucleotide
  Target: FXN; (+) strand; PAM type: NRG; PAM sequence: GGG
ttactccttctggcagttct

SEQ ID NO: 17954 - DNA, 20 bp, Artificial Sequence
  Description of Artificial Sequence: Synthetic oligonucleotide
  Target: FXN; (+) strand; PAM type: NRG; PAM sequence: GAG
actccttctggcagttctgg

SEQ ID NO: 17955 - DNA, 20 bp, Artificial Sequence
  Description of Artificial Sequence: Synthetic oligonucleotide
  Target: FXN; (+) strand; PAM type: NRG; PAM sequence: AGG
ctccttctggcagttctggg

SEQ ID NO: 17956 - DNA, 20 bp, Artificial Sequence
  Description of Artificial Sequence: Synthetic oligonucleotide
  Target: FXN; (+) strand; PAM type: NRG; PAM sequence: TAG
ggcagttctgggaggttgca

SEQ ID NO: 17957 - DNA, 20 bp, Artificial Sequence
  Description of Artificial Sequence: Synthetic oligonucleotide
  Target: FXN; (+) strand; PAM type: NRG; PAM sequence: AGG
gcagttctgggaggttgcat

SEQ ID NO: 17958 - DNA, 20 bp, Artificial Sequence
  Description of Artificial Sequence: Synthetic oligonucleotide
  Target: FXN; (+) strand; PAM type: NRG; PAM sequence: GGG
cagttctgggaggttgcata

SEQ ID NO: 17959 - DNA, 20 bp, Artificial Sequence
  Description of Artificial Sequence: Synthetic oligonucleotide
  Target: FXN; (+) strand; PAM type: NRG; PAM sequence: CAG
gaggttgcatagggcccttg

SEQ ID NO: 17960 - DNA, 20 bp, Artificial Sequence
  Description of Artificial Sequence: Synthetic oligonucleotide
  Target: FXN; (+) strand; PAM type: NRG; PAM sequence: AGG
aggttgcatagggcccttgc

SEQ ID NO: 17961 - DNA, 20 bp, Artificial Sequence
  Description of Artificial Sequence: Synthetic oligonucleotide
  Target: FXN; (+) strand; PAM type: NRG; PAM sequence: AAG
gggcccttgcaggatgcccc

SEQ ID NO: 17962 - DNA, 20 bp, Artificial Sequence
  Description of Artificial Sequence: Synthetic oligonucleotide
  Target: FXN; (+) strand; PAM type: NRG; PAM sequence: CAG
cttgcaggatgccccaagtc

SEQ ID NO: 17963 - DNA, 20 bp, Artificial Sequence
  Description of Artificial Sequence: Synthetic oligonucleotide
  Target: FXN; (+) strand; PAM type: NRG; PAM sequence: TGG
gccccaagtccagctgcctc

SEQ ID NO: 17964 - DNA, 20 bp, Artificial Sequence
  Description of Artificial Sequence: Synthetic oligonucleotide
  Target: FXN; (+) strand; PAM type: NRG; PAM sequence: TGG
gtccagctgcctctggcctc

SEQ ID NO: 17965 - DNA, 20 bp, Artificial Sequence
  Description of Artificial Sequence: Synthetic oligonucleotide
  Target: FXN; (+) strand; PAM type: NRG; PAM sequence: GGG
tccagctgcctctggcctct

SEQ ID NO: 17966 - DNA, 20 bp, Artificial Sequence
  Description of Artificial Sequence: Synthetic oligonucleotide
  Target: FXN; (+) strand; PAM type: NRG; PAM sequence: AAG
agctgcctctggcctctggg

SEQ ID NO: 17967 - DNA, 20 bp, Artificial Sequence
  Description of Artificial Sequence: Synthetic oligonucleotide
  Target: FXN; (+) strand; PAM type: NRG; PAM sequence: TAG
cacccttgacctgccatgtg

SEQ ID NO: 17968 - DNA, 20 bp, Artificial Sequence
  Description of Artificial Sequence: Synthetic oligonucleotide
  Target: FXN; (+) strand; PAM type: NRG; PAM sequence: AGG
acccttgacctgccatgtgt

SEQ ID NO: 17969 - DNA, 20 bp, Artificial Sequence
  Description of Artificial Sequence: Synthetic oligonucleotide
  Target: FXN; (+) strand; PAM type: NRG; PAM sequence: AAG
cttgacctgccatgtgtagg

SEQ ID NO: 17970 - DNA, 20 bp, Artificial Sequence
  Description of Artificial Sequence: Synthetic oligonucleotide
  Target: FXN; (+) strand; PAM type: NRG; PAM sequence: CAG
acctgccatgtgtaggaaga

SEQ ID NO: 17971 - DNA, 20 bp, Artificial Sequence
  Description of Artificial Sequence: Synthetic oligonucleotide
  Target: FXN; (+) strand; PAM type: NRG; PAM sequence: CAG
ggaagacagcccgcttctgc

SEQ ID NO: 17972 - DNA, 20 bp, Artificial Sequence
  Description of Artificial Sequence: Synthetic oligonucleotide
  Target: FXN; (+) strand; PAM type: NRG; PAM sequence: AGG
gaagacagcccgcttctgcc

SEQ ID NO: 17973 - DNA, 20 bp, Artificial Sequence
  Description of Artificial Sequence: Synthetic oligonucleotide
  Target: FXN; (+) strand; PAM type: NRG; PAM sequence: GGG
aagacagcccgcttctgcca

SEQ ID NO: 17974 - DNA, 20 bp, Artificial Sequence
  Description of Artificial Sequence: Synthetic oligonucleotide
  Target: FXN; (+) strand; PAM type: NRG; PAM sequence: CGG
ctgccagggcccaactctgc

SEQ ID NO: 17975 - DNA, 20 bp, Artificial Sequence
  Description of Artificial Sequence: Synthetic oligonucleotide
  Target: FXN; (+) strand; PAM type: NRG; PAM sequence: CAG
ccagggcccaactctgccgg

SEQ ID NO: 17976 - DNA, 20 bp, Artificial Sequence
  Description of Artificial Sequence: Synthetic oligonucleotide
  Target: FXN; (+) strand; PAM type: NRG; PAM sequence: AGG
cagggcccaactctgccggc

SEQ ID NO: 17977 - DNA, 20 bp, Artificial Sequence
  Description of Artificial Sequence: Synthetic oligonucleotide
  Target: FXN; (+) strand; PAM type: NRG; PAM sequence: TAG
ggcccaactctgccggcagg

SEQ ID NO: 17978 - DNA, 20 bp, Artificial Sequence
  Description of Artificial Sequence: Synthetic oligonucleotide
  Target: FXN; (+) strand; PAM type: NRG; PAM sequence: TGG
accttccaacctcttcactt

SEQ ID NO: 17979 - DNA, 20 bp, Artificial Sequence
  Description of Artificial Sequence: Synthetic oligonucleotide
  Target: FXN; (+) strand; PAM type: NRG; PAM sequence: CAG
actttggactttataactgt

SEQ ID NO: 17980 - DNA, 20 bp, Artificial Sequence
  Description of Artificial Sequence: Synthetic oligonucleotide
  Target: FXN; (+) strand; PAM type: NRG; PAM sequence: AGG
ctttggactttataactgtc

SEQ ID NO: 17981 - DNA, 20 bp, Artificial Sequence
  Description of Artificial Sequence: Synthetic oligonucleotide
  Target: FXN; (+) strand; PAM type: NRG; PAM sequence: AAG
ctttataactgtcaggtata

SEQ ID NO: 17982 - DNA, 20 bp, Artificial Sequence
  Description of Artificial Sequence: Synthetic oligonucleotide
  Target: FXN; (+) strand; PAM type: NRG; PAM sequence: CGG
ataactgtcaggtataaagt

SEQ ID NO: 17983 - DNA, 20 bp, Artificial Sequence
  Description of Artificial Sequence: Synthetic oligonucleotide
  Target: FXN; (+) strand; PAM type: NRG; PAM sequence: AAG
ttacgtttctcaaattcttc

SEQ ID NO: 17984 - DNA, 20 bp, Artificial Sequence
  Description of Artificial Sequence: Synthetic oligonucleotide
  Target: FXN; (+) strand; PAM type: NRG; PAM sequence: CAG
attcttcaagacacgtcaac

SEQ ID NO: 17985 - DNA, 20 bp, Artificial Sequence
  Description of Artificial Sequence: Synthetic oligonucleotide
  Target: FXN; (+) strand; PAM type: NRG; PAM sequence: CAG
cctctcctacgcattctctc

SEQ ID NO: 17986 - DNA, 20 bp, Artificial Sequence
  Description of Artificial Sequence: Synthetic oligonucleotide
  Target: FXN; (+) strand; PAM type: NRG; PAM sequence: CAG
cctacgcattctctccagct

SEQ ID NO: 17987 - DNA, 20 bp, Artificial Sequence
  Description of Artificial Sequence: Synthetic oligonucleotide
  Target: FXN; (+) strand; PAM type: NRG; PAM sequence: CAG
caaaacacaccctttctctc

SEQ ID NO: 17988 - DNA, 20 bp, Artificial Sequence
  Description of Artificial Sequence: Synthetic oligonucleotide
  Target: FXN; (+) strand; PAM type: NRG; PAM sequence: CAG
actctcaaaacacaccctat

SEQ ID NO: 17989 - DNA, 20 bp, Artificial Sequence
  Description of Artificial Sequence: Synthetic oligonucleotide
  Target: FXN; (+) strand; PAM type: NRG; PAM sequence: AGG
ctctcaaaacacaccctatc

SEQ ID NO: 17990 - DNA, 20 bp, Artificial Sequence
  Description of Artificial Sequence: Synthetic oligonucleotide
  Target: FXN; (+) strand; PAM type: NRG; PAM sequence: AAG
caggccaaccactcttttta

SEQ ID NO: 17991 - DNA, 20 bp, Artificial Sequence
  Description of Artificial Sequence: Synthetic oligonucleotide
  Target: FXN; (+) strand; PAM type: NRG; PAM sequence: AGG
aggccaaccactctttttaa

SEQ ID NO: 17992 - DNA, 20 bp, Artificial Sequence
  Description of Artificial Sequence: Synthetic oligonucleotide
  Target: FXN; (+) strand; PAM type: NRG; PAM sequence: CAG
caaccactctttttaaagga

SEQ ID NO: 17993 - DNA, 20 bp, Artificial Sequence
  Description of Artificial Sequence: Synthetic oligonucleotide
  Target: FXN; (+) strand; PAM type: NRG; PAM sequence: CAG
aggacagctcctcaccaatc

SEQ ID NO: 17994 - DNA, 20 bp, Artificial Sequence
  Description of Artificial Sequence: Synthetic oligonucleotide
  Target: FXN; (+) strand; PAM type: NRG; PAM sequence: CAG
cagctcctcaccaatccagt

SEQ ID NO: 17995 - DNA, 20 bp, Artificial Sequence
  Description of Artificial Sequence: Synthetic oligonucleotide
  Target: FXN; (+) strand; PAM type: NRG; PAM sequence: AGG
agctcctcaccaatccagtc

SEQ ID NO: 17996 - DNA, 20 bp, Artificial Sequence
  Description of Artificial Sequence: Synthetic oligonucleotide
  Target: FXN; (+) strand; PAM type: NRG; PAM sequence: TAG
tcctcaccaatccagtcagg

SEQ ID NO: 17997 - DNA, 20 bp, Artificial Sequence
  Description of Artificial Sequence: Synthetic oligonucleotide
  Target: FXN; (+) strand; PAM type: NRG; PAM sequence: TGG
gccttccccacattgtatcc

SEQ ID NO: 17998 - DNA, 20 bp, Artificial Sequence
  Description of Artificial Sequence: Synthetic oligonucleotide
  Target: FXN; (+) strand; PAM type: NRG; PAM sequence: AAG
ttccccacattgtatcctgg

SEQ ID NO: 17999 - DNA, 20 bp, Artificial Sequence
  Description of Artificial Sequence: Synthetic oligonucleotide
  Target: FXN; (+) strand; PAM type: NRG; PAM sequence: TGG
cccacattgtatcctggaag

SEQ ID NO: 18000 - DNA, 20 bp, Artificial Sequence
  Description of Artificial Sequence: Synthetic oligonucleotide
  Target: FXN; (+) strand; PAM type: NRG; PAM sequence: GGG
ccacattgtatcctggaagt

SEQ ID NO: 18001 - DNA, 20 bp, Artificial Sequence
  Description of Artificial Sequence: Synthetic oligonucleotide
  Target: FXN; (+) strand; PAM type: NRG; PAM sequence: TGG
tgtatcctggaagtgggtga

SEQ ID NO: 18002 - DNA, 20 bp, Artificial Sequence
  Description of Artificial Sequence: Synthetic oligonucleotide
  Target: FXN; (+) strand; PAM type: NRG; PAM sequence: TGG
cctggaagtgggtgatggac

SEQ ID NO: 18003 - DNA, 20 bp, Artificial Sequence
  Description of Artificial Sequence: Synthetic oligonucleotide
  Target: FXN; (+) strand; PAM type: NRG; PAM sequence: GGG
ctggaagtgggtgatggact

SEQ ID NO: 18004 - DNA, 20 bp, Artificial Sequence
  Description of Artificial Sequence: Synthetic oligonucleotide
  Target: FXN; (+) strand; PAM type: NRG; PAM sequence: TGG
gaagtgggtgatggactggg

SEQ ID NO: 18005 - DNA, 20 bp, Artificial Sequence
  Description of Artificial Sequence: Synthetic oligonucleotide
  Target: FXN; (+) strand; PAM type: NRG; PAM sequence: GGG
aagtgggtgatggactgggt

SEQ ID NO: 18006 - DNA, 20 bp, Artificial Sequence
  Description of Artificial Sequence: Synthetic oligonucleotide
  Target: FXN; (+) strand; PAM type: NRG; PAM sequence: GGG
agtgggtgatggactgggtg

SEQ ID NO: 18007 - DNA, 20 bp, Artificial Sequence
  Description of Artificial Sequence: Synthetic oligonucleotide
  Target: FXN; (+) strand; PAM type: NRG; PAM sequence: AAG
gggtgatggactgggtgggg

SEQ ID NO: 18008 - DNA, 20 bp, Artificial Sequence
  Description of Artificial Sequence: Synthetic oligonucleotide
  Target: FXN; (+) strand; PAM type: NRG; PAM sequence: GAG
gtgatggactgggtggggaa

SEQ ID NO: 18009 - DNA, 20 bp, Artificial Sequence
  Description of Artificial Sequence: Synthetic oligonucleotide
  Target: FXN; (+) strand; PAM type: NRG; PAM sequence: AGG
tgatggactgggtggggaag

SEQ ID NO: 18010 - DNA, 20 bp, Artificial Sequence
  Description of Artificial Sequence: Synthetic oligonucleotide
  Target: FXN; (+) strand; PAM type: NRG; PAM sequence: GGG
gatggactgggtggggaaga

SEQ ID NO: 18011 - DNA, 20 bp, Artificial Sequence
  Description of Artificial Sequence: Synthetic oligonucleotide
  Target: FXN; (+) strand; PAM type: NRG; PAM sequence: TGG
gggtggggaagagggtcata

SEQ ID NO: 18012 - DNA, 20 bp, Artificial Sequence
  Description of Artificial Sequence: Synthetic oligonucleotide
  Target: FXN; (+) strand; PAM type: NRG; PAM sequence: CAG
tggcaaatctgtatgtctta

SEQ ID NO: 18013 - DNA, 20 bp, Artificial Sequence
  Description of Artificial Sequence: Synthetic oligonucleotide
  Target: FXN; (+) strand; PAM type: NRG; PAM sequence: TAG
tatgtcttacagtaattgtc

SEQ ID NO: 18014 - DNA, 20 bp, Artificial Sequence
  Description of Artificial Sequence: Synthetic oligonucleotide
  Target: FXN; (+) strand; PAM type: NRG; PAM sequence: CAG
gtcttacagtaattgtctag

SEQ ID NO: 18015 - DNA, 20 bp, Artificial Sequence
  Description of Artificial Sequence: Synthetic oligonucleotide
  Target: FXN; (+) strand; PAM type: NRG; PAM sequence: TGG
agtaattgtctagcagcccc

SEQ ID NO: 18016 - DNA, 20 bp, Artificial Sequence
  Description of Artificial Sequence: Synthetic oligonucleotide
  Target: FXN; (+) strand; PAM type: NRG; PAM sequence: TAG
cagcccctggtgtcttactt

SEQ ID NO: 18017 - DNA, 20 bp, Artificial Sequence
  Description of Artificial Sequence: Synthetic oligonucleotide
  Target: FXN; (+) strand; PAM type: NRG; PAM sequence: AGG
agcccctggtgtcttacttt

SEQ ID NO: 18018 - DNA, 20 bp, Artificial Sequence
  Description of Artificial Sequence: Synthetic oligonucleotide
  Target: FXN; (+) strand; PAM type: NRG; PAM sequence: TGG
gtgtcttactttaggccccc

SEQ ID NO: 18019 - DNA, 20 bp, Artificial Sequence
  Description of Artificial Sequence: Synthetic oligonucleotide
  Target: FXN; (+) strand; PAM type: NRG; PAM sequence: CAG
ttaggccccctggaaacttt

SEQ ID NO: 18020 - DNA, 20 bp, Artificial Sequence
  Description of Artificial Sequence: Synthetic oligonucleotide
  Target: FXN; (+) strand; PAM type: NRG; PAM sequence: TAG
gccccctggaaactttcaga

SEQ ID NO: 18021 - DNA, 20 bp, Artificial Sequence
  Description of Artificial Sequence: Synthetic oligonucleotide
  Target: FXN; (+) strand; PAM type: NRG; PAM sequence: TGG
ccctggaaactttcagatag

SEQ ID NO: 18022 - DNA, 20 bp, Artificial Sequence
  Description of Artificial Sequence: Synthetic oligonucleotide
  Target: FXN; (+) strand; PAM type: NRG; PAM sequence: GAG
ctggaaactttcagatagtg

SEQ ID NO: 18023 - DNA, 20 bp, Artificial Sequence
  Description of Artificial Sequence: Synthetic oligonucleotide
  Target: FXN; (+) strand; PAM type: NRG; PAM sequence: CAG
gatacatatcttataaccta

SEQ ID NO: 18024 - DNA, 20 bp, Artificial Sequence
  Description of Artificial Sequence: Synthetic oligonucleotide
  Target: FXN; (+) strand; PAM type: NRG; PAM sequence: CAG
cagatattaatatatcctca

SEQ ID NO: 18025 - DNA, 20 bp, Artificial Sequence
  Description of Artificial Sequence: Synthetic oligonucleotide
  Target: FXN; (+) strand; PAM type: NRG; PAM sequence: AGG
agatattaatatatcctcac

SEQ ID NO: 18026 - DNA, 20 bp, Artificial Sequence
  Description of Artificial Sequence: Synthetic oligonucleotide
  Target: FXN; (+) strand; PAM type: NRG; PAM sequence: GGG
gatattaatatatcctcaca

SEQ ID NO: 18027 - DNA, 20 bp, Artificial Sequence
  Description of Artificial Sequence: Synthetic oligonucleotide
  Target: FXN; (+) strand; PAM type: NRG; PAM sequence: GGG
atattaatatatcctcacag

SEQ ID NO: 18028 - DNA, 20 bp, Artificial Sequence
  Description of Artificial Sequence: Synthetic oligonucleotide
  Target: FXN; (+) strand; PAM type: NRG; PAM sequence: AAG
atatcctcacaggggcacaa

SEQ ID NO: 18029 - DNA, 20 bp, Artificial Sequence
  Description of Artificial Sequence: Synthetic oligonucleotide
  Target: FXN; (+) strand; PAM type: NRG; PAM sequence: AAG
aggggcacaaaagctcttac

SEQ ID NO: 18030 - DNA, 20 bp, Artificial Sequence
  Description of Artificial Sequence: Synthetic oligonucleotide
  Target: FXN; (+) strand; PAM type: NRG; PAM sequence: AGG
ggggcacaaaagctcttaca

SEQ ID NO: 18031 - DNA, 20 bp, Artificial Sequence
  Description of Artificial Sequence: Synthetic oligonucleotide
  Target: FXN; (+) strand; PAM type: NRG; PAM sequence: AAG
cattttaaaatgtataatgc

SEQ ID NO: 18032 - DNA, 20 bp, Artificial Sequence
  Description of Artificial Sequence: Synthetic oligonucleotide
  Target: FXN; (+) strand; PAM type: NRG; PAM sequence: AGG
attttaaaatgtataatgca

SEQ ID NO: 18033 - DNA, 20 bp, Artificial Sequence
  Description of Artificial Sequence: Synthetic oligonucleotide
  Target: FXN; (+) strand; PAM type: NRG; PAM sequence: GGG
ttttaaaatgtataatgcaa

SEQ ID NO: 18034 - DNA, 20 bp, Artificial Sequence
  Description of Artificial Sequence: Synthetic oligonucleotide
  Target: FXN; (+) strand; PAM type: NRG; PAM sequence: TAG
atgtataatgcaagggtttt

SEQ ID NO: 18035 - DNA, 20 bp, Artificial Sequence
  Description of Artificial Sequence: Synthetic oligonucleotide
  Target: FXN; (+) strand; PAM type: NRG; PAM sequence: AAG
agggtttttagtatattcac

SEQ ID NO: 18036 - DNA, 20 bp, Artificial Sequence
  Description of Artificial Sequence: Synthetic oligonucleotide
  Target: FXN; (+) strand; PAM type: NRG; PAM sequence: CAG
agtatattcacaagattgtg

SEQ ID NO: 18037 - DNA, 20 bp, Artificial Sequence
  Description of Artificial Sequence: Synthetic oligonucleotide
  Target: FXN; (+) strand; PAM type: NRG; PAM sequence: CAG
gcagctgtcactactaattc

SEQ ID NO: 18038 - DNA, 20 bp, Artificial Sequence
  Description of Artificial Sequence: Synthetic oligonucleotide
  Target: FXN; (+) strand; PAM type: NRG; PAM sequence: CAG
ccagaacattttcattattc

SEQ ID NO: 18039 - DNA, 20 bp, Artificial Sequence
  Description of Artificial Sequence: Synthetic oligonucleotide
  Target: FXN; (+) strand; PAM type: NRG; PAM sequence: AAG
gaacattttcattattccag

SEQ ID NO: 18040 - DNA, 20 bp, Artificial Sequence
  Description of Artificial Sequence: Synthetic oligonucleotide
  Target: FXN; (+) strand; PAM type: NRG; PAM sequence: AGG
aacattttcattattccaga

SEQ ID NO: 18041 - DNA, 20 bp, Artificial Sequence
  Description of Artificial Sequence: Synthetic oligonucleotide
  Target: FXN; (+) strand; PAM type: NRG; PAM sequence: TAG
gaaggaaaccctattcatat

SEQ ID NO: 18042 - DNA, 20 bp, Artificial Sequence
  Description of Artificial Sequence: Synthetic oligonucleotide
  Target: FXN; (+) strand; PAM type: NRG; PAM sequence: CAG
ttccgcctttccctaaaacc

SEQ ID NO: 18043 - DNA, 20 bp, Artificial Sequence
  Description of Artificial Sequence: Synthetic oligonucleotide
  Target: FXN; (+) strand; PAM type: NRG; PAM sequence: TGG
taatctactttctgtctctg

SEQ ID NO: 18044 - DNA, 20 bp, Artificial Sequence
  Description of Artificial Sequence: Synthetic oligonucleotide
  Target: FXN; (+) strand; PAM type: NRG; PAM sequence: AAG
tttctgtctctgtggattta

SEQ ID NO: 18045 - DNA, 20 bp, Artificial Sequence
  Description of Artificial Sequence: Synthetic oligonucleotide
  Target: FXN; (+) strand; PAM type: NRG; PAM sequence: TAG
gtaattttaaatttgaaaaa

SEQ ID NO: 18046 - DNA, 20 bp, Artificial Sequence
  Description of Artificial Sequence: Synthetic oligonucleotide
  Target: FXN; (+) strand; PAM type: NRG; PAM sequence: AAG
atttgaaaaatagtatctat

SEQ ID NO: 18047 - DNA, 20 bp, Artificial Sequence
  Description of Artificial Sequence: Synthetic oligonucleotide
  Target: FXN; (+) strand; PAM type: NRG; PAM sequence: AGG
tttgaaaaatagtatctata

SEQ ID NO: 18048 - DNA, 20 bp, Artificial Sequence
  Description of Artificial Sequence: Synthetic oligonucleotide
  Target: FXN; (+) strand; PAM type: NRG; PAM sequence: TAG
tatctataaggaaatgtatc

SEQ ID NO: 18049 - DNA, 20 bp, Artificial Sequence
  Description of Artificial Sequence: Synthetic oligonucleotide
  Target: FXN; (+) strand; PAM type: NRG; PAM sequence: AAG
aaggaaatgtatctagtcac

SEQ ID NO: 18050 - DNA, 20 bp, Artificial Sequence
  Description of Artificial Sequence: Synthetic oligonucleotide
  Target: FXN; (+) strand; PAM type: NRG; PAM sequence: CAG
tgtatctagtcacaagcata

SEQ ID NO: 18051 - DNA, 20 bp, Artificial Sequence
  Description of Artificial Sequence: Synthetic oligonucleotide
  Target: FXN; (+) strand; PAM type: NRG; PAM sequence: CAG
atgaatttgtaaaaattgaa

SEQ ID NO: 18052 - DNA, 20 bp, Artificial Sequence
  Description of Artificial Sequence: Synthetic oligonucleotide
  Target: FXN; (+) strand; PAM type: NRG; PAM sequence: AAG
gtcctatgaacataccctgt

SEQ ID NO: 18053 - DNA, 20 bp, Artificial Sequence
  Description of Artificial Sequence: Synthetic oligonucleotide
  Target: FXN; (+) strand; PAM type: NRG; PAM sequence: AAG
tgaacataccctgtaagctc

SEQ ID NO: 18054 - DNA, 20 bp, Artificial Sequence
  Description of Artificial Sequence: Synthetic oligonucleotide
  Target: FXN; (+) strand; PAM type: NRG; PAM sequence: TAG
taccctgtaagctcaagaca

SEQ ID NO: 18055 - DNA, 20 bp, Artificial Sequence
  Description of Artificial Sequence: Synthetic oligonucleotide
  Target: FXN; (+) strand; PAM type: NRG; PAM sequence: CAG
ctcaagacatagaatgttac

SEQ ID NO: 18056 - DNA, 20 bp, Artificial Sequence
  Description of Artificial Sequence: Synthetic oligonucleotide
  Target: FXN; (+) strand; PAM type: NRG; PAM sequence: AAG
agaatgttaccagcccctgc

SEQ ID NO: 18057 - DNA, 20 bp, Artificial Sequence
  Description of Artificial Sequence: Synthetic oligonucleotide
  Target: FXN; (+) strand; PAM type: NRG; PAM sequence: AAG
tgttaccagcccctgcaagc

SEQ ID NO: 18058 - DNA, 20 bp, Artificial Sequence
  Description of Artificial Sequence: Synthetic oligonucleotide
  Target: FXN; (+) strand; PAM type: NRG; PAM sequence: TAG
gcaagctgcctgctcacttc

SEQ ID NO: 18059 - DNA, 20 bp, Artificial Sequence
  Description of Artificial Sequence: Synthetic oligonucleotide
  Target: FXN; (+) strand; PAM type: NRG; PAM sequence: TAG
acccctccctcttttccttc

SEQ ID NO: 18060 - DNA, 20 bp, Artificial Sequence
  Description of Artificial Sequence: Synthetic oligonucleotide
  Target: FXN; (+) strand; PAM type: NRG; PAM sequence: CAG
ccttctagtcattaaccctt

SEQ ID NO: 18061 - DNA, 20 bp, Artificial Sequence
  Description of Artificial Sequence: Synthetic oligonucleotide
  Target: FXN; (+) strand; PAM type: NRG; PAM sequence: GAG
ttctagtcattaacccttca

SEQ ID NO: 18062 - DNA, 20 bp, Artificial Sequence
  Description of Artificial Sequence: Synthetic oligonucleotide
  Target: FXN; (+) strand; PAM type: NRG; PAM sequence: TAG
gtaactattctgattaccaa

SEQ ID NO: 18063 - DNA, 20 bp, Artificial Sequence
  Description of Artificial Sequence: Synthetic oligonucleotide
  Target: FXN; (+) strand; PAM type: NRG; PAM sequence: TAG
tattctgattaccaatagca

SEQ ID NO: 18064 - DNA, 20 bp, Artificial Sequence
  Description of Artificial Sequence: Synthetic oligonucleotide
  Target: FXN; (+) strand; PAM type: NRG; PAM sequence: TAG
tgattaccaatagcatagat

SEQ ID NO: 18065 - DNA, 20 bp, Artificial Sequence
  Description of Artificial Sequence: Synthetic oligonucleotide
  Target: FXN; (+) strand; PAM type: NRG; PAM sequence: AAG
tttatataaactgtctcatt

SEQ ID NO: 18066 - DNA, 20 bp, Artificial Sequence
  Description of Artificial Sequence: Synthetic oligonucleotide
  Target: FXN; (+) strand; PAM type: NRG; PAM sequence: GAG
tctatcacaatgatgtttgt

SEQ ID NO: 18067 - DNA, 20 bp, Artificial Sequence
  Description of Artificial Sequence: Synthetic oligonucleotide
  Target: FXN; (+) strand; PAM type: NRG; PAM sequence: TAG
attcatccatgctgttccta

SEQ ID NO: 18068 - DNA, 20 bp, Artificial Sequence
  Description of Artificial Sequence: Synthetic oligonucleotide
  Target: FXN; (+) strand; PAM type: NRG; PAM sequence: CAG
ctatagacaattctattttg

SEQ ID NO: 18069 - DNA, 20 bp, Artificial Sequence
  Description of Artificial Sequence: Synthetic oligonucleotide
  Target: FXN; (+) strand; PAM type: NRG; PAM sequence: TAG
gacaattctattttgcagcg

SEQ ID NO: 18070 - DNA, 20 bp, Artificial Sequence
  Description of Artificial Sequence: Synthetic oligonucleotide
  Target: FXN; (+) strand; PAM type: NRG; PAM sequence: AAG
aatttatctgtgatattaca

SEQ ID NO: 18071 - DNA, 20 bp, Artificial Sequence
  Description of Artificial Sequence: Synthetic oligonucleotide
  Target: FXN; (+) strand; PAM type: NRG; PAM sequence: AGG
atttatctgtgatattacaa

SEQ ID NO: 18072 - DNA, 20 bp, Artificial Sequence
  Description of Artificial Sequence: Synthetic oligonucleotide
  Target: FXN; (+) strand; PAM type: NRG; PAM sequence: TGG
tgatattacaaaggaatact

SEQ ID NO: 18073 - DNA, 20 bp, Artificial Sequence
  Description of Artificial Sequence: Synthetic oligonucleotide
  Target: FXN; (+) strand; PAM type: NRG; PAM sequence: GGG
gatattacaaaggaatactt

SEQ ID NO: 18074 - DNA, 20 bp, Artificial Sequence
  Description of Artificial Sequence: Synthetic oligonucleotide
  Target: FXN; (+) strand; PAM type: NRG; PAM sequence: CAG
attacaaaggaatacttggg

SEQ ID NO: 18075 - DNA, 20 bp, Artificial Sequence
  Description of Artificial Sequence: Synthetic oligonucleotide
  Target: FXN; (+) strand; PAM type: NRG; PAM sequence: CAG
aggaatacttgggcagtttc

SEQ ID NO: 18076 - DNA, 20 bp, Artificial Sequence
  Description of Artificial Sequence: Synthetic oligonucleotide
  Target: FXN; (+) strand; PAM type: NRG; PAM sequence: TGG
tacttgggcagtttccagtt

SEQ ID NO: 18077 - DNA, 20 bp, Artificial Sequence
  Description of Artificial Sequence: Synthetic oligonucleotide
  Target: FXN; (+) strand; PAM type: NRG; PAM sequence: GGG
acttgggcagtttccagttt

SEQ ID NO: 18078 - DNA, 20 bp, Artificial Sequence
  Description of Artificial Sequence: Synthetic oligonucleotide
  Target: FXN; (+) strand; PAM type: NRG; PAM sequence: GGG
cttgggcagtttccagtttg

SEQ ID NO: 18079 - DNA, 20 bp, Artificial Sequence
  Description of Artificial Sequence: Synthetic oligonucleotide
  Target: FXN; (+) strand; PAM type: NRG; PAM sequence: TAG
cagtttccagtttggggcta

SEQ ID NO: 18080 - DNA, 20 bp, Artificial Sequence
  Description of Artificial Sequence: Synthetic oligonucleotide
  Target: FXN; (+) strand; PAM type: NRG; PAM sequence: AGG
agtttccagtttggggctat

SEQ ID NO: 18081 - DNA, 20 bp, Artificial Sequence
  Description of Artificial Sequence: Synthetic oligonucleotide
  Target: FXN; (+) strand; PAM type: NRG; PAM sequence: TAG
tccagtttggggctatagga

SEQ ID NO: 18082 - DNA, 20 bp, Artificial Sequence
  Description of Artificial Sequence: Synthetic oligonucleotide
  Target: FXN; (+) strand; PAM type: NRG; PAM sequence: TAG
tagttgtgatacaaatattt

SEQ ID NO: 18083 - DNA, 20 bp, Artificial Sequence
  Description of Artificial Sequence: Synthetic oligonucleotide
  Target: FXN; (+) strand; PAM type: NRG; PAM sequence: TAG
gtgatacaaatattttagta

SEQ ID NO: 18084 - DNA, 20 bp, Artificial Sequence
  Description of Artificial Sequence: Synthetic oligonucleotide
  Target: FXN; (+) strand; PAM type: NRG; PAM sequence: TGG
ttagtatagtacatgtcttt

SEQ ID NO: 18085 - DNA, 20 bp, Artificial Sequence
  Description of Artificial Sequence: Synthetic oligonucleotide
  Target: FXN; (+) strand; PAM type: NRG; PAM sequence: TGG
tacatgtcttttggtgaacc

SEQ ID NO: 18086 - DNA, 20 bp, Artificial Sequence
  Description of Artificial Sequence: Synthetic oligonucleotide
  Target: FXN; (+) strand; PAM type: NRG; PAM sequence: GGG
acatgtcttttggtgaacct

SEQ ID NO: 18087 - DNA, 20 bp, Artificial Sequence
  Description of Artificial Sequence: Synthetic oligonucleotide
  Target: FXN; (+) strand; PAM type: NRG; PAM sequence: AAG
ttctgttgtgtatacccctt

SEQ ID NO: 18088 - DNA, 20 bp, Artificial Sequence
  Description of Artificial Sequence: Synthetic oligonucleotide
  Target: FXN; (+) strand; PAM type: NRG; PAM sequence: GAG
ctgttgtgtataccccttaa

SEQ ID NO: 18089 - DNA, 20 bp, Artificial Sequence
  Description of Artificial Sequence: Synthetic oligonucleotide
  Target: FXN; (+) strand; PAM type: NRG; PAM sequence: TGG
ttgtgtataccccttaagag

SEQ ID NO: 18090 - DNA, 20 bp, Artificial Sequence
  Description of Artificial Sequence: Synthetic oligonucleotide
  Target: FXN; (+) strand; PAM type: NRG; PAM sequence: GAG
gtgtataccccttaagagtg

SEQ ID NO: 18091 - DNA, 20 bp, Artificial Sequence
  Description of Artificial Sequence: Synthetic oligonucleotide
  Target: FXN; (+) strand; PAM type: NRG; PAM sequence: TGG
aagagtggagctgatgatcc

SEQ ID NO: 18092 - DNA, 20 bp, Artificial Sequence
  Description of Artificial Sequence: Synthetic oligonucleotide
  Target: FXN; (+) strand; PAM type: NRG; PAM sequence: AAG
agctgatgatcctggctaac

SEQ ID NO: 18093 - DNA, 20 bp, Artificial Sequence
  Description of Artificial Sequence: Synthetic oligonucleotide
  Target: FXN; (+) strand; PAM type: NRG; PAM sequence: AGG
gctgatgatcctggctaaca

SEQ ID NO: 18094 - DNA, 20 bp, Artificial Sequence
  Description of Artificial Sequence: Synthetic oligonucleotide
  Target: FXN; (+) strand; PAM type: NRG; PAM sequence: TAG
ctactaaaaatacaaaaaat

SEQ ID NO: 18095 - DNA, 20 bp, Artificial Sequence
  Description of Artificial Sequence: Synthetic oligonucleotide
  Target: FXN; (+) strand; PAM type: NRG; PAM sequence: CGG
taaaaatacaaaaaattagc

SEQ ID NO: 18096 - DNA, 20 bp, Artificial Sequence
  Description of Artificial Sequence: Synthetic oligonucleotide
  Target: FXN; (+) strand; PAM type: NRG; PAM sequence: GGG
aaaaatacaaaaaattagcc

SEQ ID NO: 18097 - DNA, 20 bp, Artificial Sequence
  Description of Artificial Sequence: Synthetic oligonucleotide
  Target: FXN; (+) strand; PAM type: NRG; PAM sequence: TGG
tacaaaaaattagccgggcg

SEQ ID NO: 18098 - DNA, 20 bp, Artificial Sequence
  Description of Artificial Sequence: Synthetic oligonucleotide
  Target: FXN; (+) strand; PAM type: NRG; PAM sequence: TAG
aaaaaattagccgggcgtgg

SEQ ID NO: 18099 - DNA, 20 bp, Artificial Sequence
  Description of Artificial Sequence: Synthetic oligonucleotide
  Target: FXN; (+) strand; PAM type: NRG; PAM sequence: CGG
aaattagccgggcgtggtag

SEQ ID NO: 18100 - DNA, 20 bp, Artificial Sequence
  Description of Artificial Sequence: Synthetic oligonucleotide
  Target: FXN; (+) strand; PAM type: NRG; PAM sequence: GGG
aattagccgggcgtggtagc

SEQ ID NO: 18101 - DNA, 20 bp, Artificial Sequence
  Description of Artificial Sequence: Synthetic oligonucleotide
  Target: FXN; (+) strand; PAM type: NRG; PAM sequence: TAG
ggcgtggtagcgggcgcctg

SEQ ID NO: 18102 - DNA, 20 bp, Artificial Sequence
  Description of Artificial Sequence: Synthetic oligonucleotide
  Target: FXN; (+) strand; PAM type: NRG; PAM sequence: CAG
gtagcgggcgcctgtagtcc

SEQ ID NO: 18103 - DNA, 20 bp, Artificial Sequence
  Description of Artificial Sequence: Synthetic oligonucleotide
  Target: FXN; (+) strand; PAM type: NRG; PAM sequence: CGG
cgcctgtagtcccagctact

SEQ ID NO: 18104 - DNA, 20 bp, Artificial Sequence
  Description of Artificial Sequence: Synthetic oligonucleotide
  Target: FXN; (+) strand; PAM type: NRG; PAM sequence: GGG
gcctgtagtcccagctactc

SEQ ID NO: 18105 - DNA, 20 bp, Artificial Sequence
  Description of Artificial Sequence: Synthetic oligonucleotide
  Target: FXN; (+) strand; PAM type: NRG; PAM sequence: GAG
ctgtagtcccagctactcgg

SEQ ID NO: 18106 - DNA, 20 bp, Artificial Sequence
  Description of Artificial Sequence: Synthetic oligonucleotide
  Target: FXN; (+) strand; PAM type: NRG; PAM sequence: AGG
tgtagtcccagctactcggg

SEQ ID NO: 18107 - DNA, 20 bp, Artificial Sequence
  Description of Artificial Sequence: Synthetic oligonucleotide
  Target: FXN; (+) strand; PAM type: NRG; PAM sequence: GAG
tcccagctactcgggaggct

SEQ ID NO: 18108 - DNA, 20 bp, Artificial Sequence
  Description of Artificial Sequence: Synthetic oligonucleotide
  Target: FXN; (+) strand; PAM type: NRG; PAM sequence: AGG
cccagctactcgggaggctg

SEQ ID NO: 18109 - DNA, 20 bp, Artificial Sequence
  Description of Artificial Sequence: Synthetic oligonucleotide
  Target: FXN; (+) strand; PAM type: NRG; PAM sequence: CAG
agctactcgggaggctgagg

SEQ ID NO: 18110 - DNA, 20 bp, Artificial Sequence
  Description of Artificial Sequence: Synthetic oligonucleotide
  Target: FXN; (+) strand; PAM type: NRG; PAM sequence: AGG
gctactcgggaggctgaggc

SEQ ID NO: 18111 - DNA, 20 bp, Artificial Sequence
  Description of Artificial Sequence: Synthetic oligonucleotide
  Target: FXN; (+) strand; PAM type: NRG; PAM sequence: GAG
tactcgggaggctgaggcag

SEQ ID NO: 18112 - DNA, 20 bp, Artificial Sequence
  Description of Artificial Sequence: Synthetic oligonucleotide
  Target: FXN; (+) strand; PAM type: NRG; PAM sequence: TGG
gggaggctgaggcaggagaa

SEQ ID NO: 18113 - DNA, 20 bp, Artificial Sequence
  Description of Artificial Sequence: Synthetic oligonucleotide
  Target: FXN; (+) strand; PAM type: NRG; PAM sequence: CGG
gcaggagaatggcgtgaacc

SEQ ID NO: 18114 - DNA, 20 bp, Artificial Sequence
  Description of Artificial Sequence: Synthetic oligonucleotide
  Target: FXN; (+) strand; PAM type: NRG; PAM sequence: GGG
caggagaatggcgtgaaccc

SEQ ID NO: 18115 - DNA, 20 bp, Artificial Sequence
  Description of Artificial Sequence: Synthetic oligonucleotide
  Target: FXN; (+) strand; PAM type: NRG; PAM sequence: GAG
ggagaatggcgtgaacccgg

SEQ ID NO: 18116 - DNA, 20 bp, Artificial Sequence
  Description of Artificial Sequence: Synthetic oligonucleotide
  Target: FXN; (+) strand; PAM type: NRG; PAM sequence: AGG
gagaatggcgtgaacccggg

SEQ ID NO: 18117 - DNA, 20 bp, Artificial Sequence
  Description of Artificial Sequence: Synthetic oligonucleotide
  Target: FXN; (+) strand; PAM type: NRG; PAM sequence: CGG
aatggcgtgaacccgggagg

SEQ ID NO: 18118 - DNA, 20 bp, Artificial Sequence
  Description of Artificial Sequence: Synthetic oligonucleotide
  Target: FXN; (+) strand; PAM type: NRG; PAM sequence: GAG
tggcgtgaacccgggaggcg

SEQ ID NO: 18119 - DNA, 20 bp, Artificial Sequence
  Description of Artificial Sequence: Synthetic oligonucleotide
  Target: FXN; (+) strand; PAM type: NRG; PAM sequence: CAG
cgggaggcggagcttgcttg

SEQ ID NO: 18120 - DNA, 20 bp, Artificial Sequence
  Description of Artificial Sequence: Synthetic oligonucleotide
  Target: FXN; (+) strand; PAM type: NRG; PAM sequence: GAG
aggcggagcttgcttgcagt

SEQ ID NO: 18121 - DNA, 20 bp, Artificial Sequence
  Description of Artificial Sequence: Synthetic oligonucleotide
  Target: FXN; (+) strand; PAM type: NRG; PAM sequence: GAG
gagcttgcttgcagtgagcc

SEQ ID NO: 18122 - DNA, 20 bp, Artificial Sequence
  Description of Artificial Sequence: Synthetic oligonucleotide
  Target: FXN; (+) strand; PAM type: NRG; PAM sequence: CAG
gagatcgcgccactgcactc

SEQ ID NO: 18123 - DNA, 20 bp, Artificial Sequence
  Description of Artificial Sequence: Synthetic oligonucleotide
  Target: FXN; (+) strand; PAM type: NRG; PAM sequence: TGG
cgcgccactgcactccagcc

SEQ ID NO: 18124 - DNA, 20 bp, Artificial Sequence
  Description of Artificial Sequence: Synthetic oligonucleotide
  Target: FXN; (+) strand; PAM type: NRG; PAM sequence: GGG
gcgccactgcactccagcct

SEQ ID NO: 18125 - DNA, 20 bp, Artificial Sequence
  Description of Artificial Sequence: Synthetic oligonucleotide
  Target: FXN; (+) strand; PAM type: NRG; PAM sequence: CAG
ctgcactccagcctgggcga

SEQ ID NO: 18126 - DNA, 20 bp, Artificial Sequence
  Description of Artificial Sequence: Synthetic oligonucleotide
  Target: FXN; (+) strand; PAM type: NRG; PAM sequence: GAG
gcactccagcctgggcgaca

SEQ ID NO: 18127 - DNA, 20 bp, Artificial Sequence
  Description of Artificial Sequence: Synthetic oligonucleotide
  Target: FXN; (+) strand; PAM type: NRG; PAM sequence: GAG
tccagcctgggcgacagagc

SEQ ID NO: 18128 - DNA, 20 bp, Artificial Sequence
  Description of Artificial Sequence: Synthetic oligonucleotide
  Target: FXN; (+) strand; PAM type: NRG; PAM sequence: AAG
ctcaaaaaaaaaaaaaaaaa

SEQ ID NO: 18129 - DNA, 20 bp, Artificial Sequence
  Description of Artificial Sequence: Synthetic oligonucleotide
  Target: FXN; (+) strand; PAM type: NRG; PAM sequence: GAG
caaaaaaaaaaaaaaaaaaa

SEQ ID NO: 18130 - DNA, 20 bp, Artificial Sequence
  Description of Artificial Sequence: Synthetic oligonucleotide
  Target: FXN; (+) strand; PAM type: NRG; PAM sequence: TGG
aaaaaaaaaaaaaaaaagag

SEQ ID NO: 18131 - DNA, 20 bp, Artificial Sequence
  Description of Artificial Sequence: Synthetic oligonucleotide
  Target: FXN; (+) strand; PAM type: NRG; PAM sequence: GAG
aaaaaaaaaaaaaaagagtg

SEQ ID NO: 18132 - DNA, 20 bp, Artificial Sequence
  Description of Artificial Sequence: Synthetic oligonucleotide
  Target: FXN; (+) strand; PAM type: NRG; PAM sequence: TGG
aaaaaaaagagtggagctga

SEQ ID NO: 18133 - DNA, 20 bp, Artificial Sequence
  Description of Artificial Sequence: Synthetic oligonucleotide
  Target: FXN; (+) strand; PAM type: NRG; PAM sequence: GGG
aaaaaaagagtggagctgat

SEQ ID NO: 18134 - DNA, 20 bp, Artificial Sequence
  Description of Artificial Sequence: Synthetic oligonucleotide
  Target: FXN; (+) strand; PAM type: NRG; PAM sequence: TAG
agagtggagctgatgggtca

SEQ ID NO: 18135 - DNA, 20 bp, Artificial Sequence
  Description of Artificial Sequence: Synthetic oligonucleotide
  Target: FXN; (+) strand; PAM type: NRG; PAM sequence: TAG
catgtaaatgcattcaactt

SEQ ID NO: 18136 - DNA, 20 bp, Artificial Sequence
  Description of Artificial Sequence: Synthetic oligonucleotide
  Target: FXN; (+) strand; PAM type: NRG; PAM sequence: TAG
gtaaatgcattcaactttag

SEQ ID NO: 18137 - DNA, 20 bp, Artificial Sequence
  Description of Artificial Sequence: Synthetic oligonucleotide
  Target: FXN; (+) strand; PAM type: NRG; PAM sequence: CAG
ctttagtagatactgtccaa

SEQ ID NO: 18138 - DNA, 20 bp, Artificial Sequence
  Description of Artificial Sequence: Synthetic oligonucleotide
  Target: FXN; (+) strand; PAM type: NRG; PAM sequence: AAG
tactgtccaacagttttcca

SEQ ID NO: 18139 - DNA, 20 bp, Artificial Sequence
  Description of Artificial Sequence: Synthetic oligonucleotide
  Target: FXN; (+) strand; PAM type: NRG; PAM sequence: CAG
tgtccaacttacttgcctat

SEQ ID NO: 18140 - DNA, 20 bp, Artificial Sequence
  Description of Artificial Sequence: Synthetic oligonucleotide
  Target: FXN; (+) strand; PAM type: NRG; PAM sequence: CAG
ccaacttacttgcctatcag

SEQ ID NO: 18141 - DNA, 20 bp, Artificial Sequence
  Description of Artificial Sequence: Synthetic oligonucleotide
  Target: FXN; (+) strand; PAM type: NRG; PAM sequence: AAG
gcctatcagcagtatctgaa

SEQ ID NO: 18142 - DNA, 20 bp, Artificial Sequence
  Description of Artificial Sequence: Synthetic oligonucleotide
  Target: FXN; (+) strand; PAM type: NRG; PAM sequence: TAG
tcagcagtatctgaaaagtc

SEQ ID NO: 18143 - DNA, 20 bp, Artificial Sequence
  Description of Artificial Sequence: Synthetic oligonucleotide
  Target: FXN; (+) strand; PAM type: NRG; PAM sequence: TGG
agtctagttgcttcttttct

SEQ ID NO: 18144 - DNA, 20 bp, Artificial Sequence
  Description of Artificial Sequence: Synthetic oligonucleotide
  Target: FXN; (+) strand; PAM type: NRG; PAM sequence: GAG
ccaactcttttttttttttt

SEQ ID NO: 18145 - DNA, 20 bp, Artificial Sequence
  Description of Artificial Sequence: Synthetic oligonucleotide
  Target: FXN; (+) strand; PAM type: NRG; PAM sequence: TGG
ctctttttttttttttgaga

SEQ ID NO: 18146 - DNA, 20 bp, Artificial Sequence
  Description of Artificial Sequence: Synthetic oligonucleotide
  Target: FXN; (+) strand; PAM type: NRG; PAM sequence: GAG
ctttttttttttttgagatg

SEQ ID NO: 18147 - DNA, 20 bp, Artificial Sequence
  Description of Artificial Sequence: Synthetic oligonucleotide
  Target: FXN; (+) strand; PAM type: NRG; PAM sequence: CAG
ggagttttgctcttgttgcc

SEQ ID NO: 18148 - DNA, 20 bp, Artificial Sequence
  Description of Artificial Sequence: Synthetic oligonucleotide
  Target: FXN; (+) strand; PAM type: NRG; PAM sequence: AGG
gagttttgctcttgttgccc

SEQ ID NO: 18149 - DNA, 20 bp, Artificial Sequence
  Description of Artificial Sequence: Synthetic oligonucleotide
  Target: FXN; (+) strand; PAM type: NRG; PAM sequence: TGG
tttgctcttgttgcccaggc

SEQ ID NO: 18150 - DNA, 20 bp, Artificial Sequence
  Description of Artificial Sequence: Synthetic oligonucleotide
  Target: FXN; (+) strand; PAM type: NRG; PAM sequence: GAG
tgctcttgttgcccaggctg

SEQ ID NO: 18151 - DNA, 20 bp, Artificial Sequence
  Description of Artificial Sequence: Synthetic oligonucleotide
  Target: FXN; (+) strand; PAM type: NRG; PAM sequence: TGG
ttgcccaggctggagcgcaa

SEQ ID NO: 18152 - DNA, 20 bp, Artificial Sequence
  Description of Artificial Sequence: Synthetic oligonucleotide
  Target: FXN; (+) strand; PAM type: NRG; PAM sequence: TGG
tcactgcaacctccgcctcc

SEQ ID NO: 18153 - DNA, 20 bp, Artificial Sequence
  Description of Artificial Sequence: Synthetic oligonucleotide
  Target: FXN; (+) strand; PAM type: NRG; PAM sequence: GGG
cactgcaacctccgcctcct

SEQ ID NO: 18154 - DNA, 20 bp, Artificial Sequence
  Description of Artificial Sequence: Synthetic oligonucleotide
  Target: FXN; (+) strand; PAM type: NRG; PAM sequence: AAG
aacctccgcctcctgggttc

SEQ ID NO: 18155 - DNA, 20 bp, Artificial Sequence
  Description of Artificial Sequence: Synthetic oligonucleotide
  Target: FXN; (+) strand; PAM type: NRG; PAM sequence: CAG
ttcaagcaattctcctgcct

SEQ ID NO: 18156 - DNA, 20 bp, Artificial Sequence
  Description of Artificial Sequence: Synthetic oligonucleotide
  Target: FXN; (+) strand; PAM type: NRG; PAM sequence: GAG
ttctcctgcctcagcctccc

SEQ ID NO: 18157 - DNA, 20 bp, Artificial Sequence
  Description of Artificial Sequence: Synthetic oligonucleotide
  Target: FXN; (+) strand; PAM type: NRG; PAM sequence: TAG
tcctgcctcagcctcccgag

SEQ ID NO: 18158 - DNA, 20 bp, Artificial Sequence
  Description of Artificial Sequence: Synthetic oligonucleotide
  Target: FXN; (+) strand; PAM type: NRG; PAM sequence: TGG
gcctcagcctcccgagtagc

SEQ ID NO: 18159 - DNA, 20 bp, Artificial Sequence
  Description of Artificial Sequence: Synthetic oligonucleotide
  Target: FXN; (+) strand; PAM type: NRG; PAM sequence: GGG
cctcagcctcccgagtagct

SEQ ID NO: 18160 - DNA, 20 bp, Artificial Sequence
  Description of Artificial Sequence: Synthetic oligonucleotide
  Target: FXN; (+) strand; PAM type: NRG; PAM sequence: CAG
ctcccgagtagctgggatta

SEQ ID NO: 18161 - DNA, 20 bp, Artificial Sequence
  Description of Artificial Sequence: Synthetic oligonucleotide
  Target: FXN; (+) strand; PAM type: NRG; PAM sequence: AGG
tcccgagtagctgggattac

SEQ ID NO: 18162 - DNA, 20 bp, Artificial Sequence
  Description of Artificial Sequence: Synthetic oligonucleotide
  Target: FXN; (+) strand; PAM type: NRG; PAM sequence: CGG
caggcatgcgccactatgcc

SEQ ID NO: 18163 - DNA, 20 bp, Artificial Sequence
  Description of Artificial Sequence: Synthetic oligonucleotide
  Target: FXN; (+) strand; PAM type: NRG; PAM sequence: TAG
cccggctaattttgtatttt

SEQ ID NO: 18164 - DNA, 20 bp, Artificial Sequence
  Description of Artificial Sequence: Synthetic oligonucleotide
  Target: FXN; (+) strand; PAM type: NRG; PAM sequence: TAG
ggctaattttgtatttttag

SEQ ID NO: 18165 - DNA, 20 bp, Artificial Sequence
  Description of Artificial Sequence: Synthetic oligonucleotide
  Target: FXN; (+) strand; PAM type: NRG; PAM sequence: GAG
ctaattttgtatttttagta

SEQ ID NO: 18166 - DNA, 20 bp, Artificial Sequence
  Description of Artificial Sequence: Synthetic oligonucleotide
  Target: FXN; (+) strand; PAM type: NRG; PAM sequence: CAG
ttttgtatttttagtagaga

SEQ ID NO: 18167 - DNA, 20 bp, Artificial Sequence
  Description of Artificial Sequence: Synthetic oligonucleotide
  Target: FXN; (+) strand; PAM type: NRG; PAM sequence: AGG
tttgtatttttagtagagac

SEQ ID NO: 18168 - DNA, 20 bp, Artificial Sequence
  Description of Artificial Sequence: Synthetic oligonucleotide
  Target: FXN; (+) strand; PAM type: NRG; PAM sequence: GGG
ttgtatttttagtagagaca

SEQ ID NO: 18169 - DNA, 20 bp, Artificial Sequence
  Description of Artificial Sequence: Synthetic oligonucleotide
  Target: FXN; (+) strand; PAM type: NRG; PAM sequence: TGG
gagacagggtttctccatgt

SEQ ID NO: 18170 - DNA, 20 bp, Artificial Sequence
  Description of Artificial Sequence: Synthetic oligonucleotide
  Target: FXN; (+) strand; PAM type: NRG; PAM sequence: AAG
agggtttctccatgttggtc

SEQ ID NO: 18171 - DNA, 20 bp, Artificial Sequence
  Description of Artificial Sequence: Synthetic oligonucleotide
  Target: FXN; (+) strand; PAM type: NRG; PAM sequence: TGG
tttctccatgttggtcaagc

SEQ ID NO: 18172 - DNA, 20 bp, Artificial Sequence
  Description of Artificial Sequence: Synthetic oligonucleotide
  Target: FXN; (+) strand; PAM type: NRG; PAM sequence: CAG
tggtctcgaactcctaacct

SEQ ID NO: 18173 - DNA, 20 bp, Artificial Sequence
  Description of Artificial Sequence: Synthetic oligonucleotide
  Target: FXN; (+) strand; PAM type: NRG; PAM sequence: AGG
ggtctcgaactcctaacctc

SEQ ID NO: 18174 - DNA, 20 bp, Artificial Sequence
  Description of Artificial Sequence: Synthetic oligonucleotide
  Target: FXN; (+) strand; PAM type: NRG; PAM sequence: CGG
ctcaggtgatccgcccgcct

SEQ ID NO: 18175 - DNA, 20 bp, Artificial Sequence
  Description of Artificial Sequence: Synthetic oligonucleotide
  Target: FXN; (+) strand; PAM type: NRG; PAM sequence: AAG
ccgcccgcctcggcctcccg

SEQ ID NO: 18176 - DNA, 20 bp, Artificial Sequence
  Description of Artificial Sequence: Synthetic oligonucleotide
  Target: FXN; (+) strand; PAM type: NRG; PAM sequence: TGG
gcctcggcctcccgaagtgc

SEQ ID NO: 18177 - DNA, 20 bp, Artificial Sequence
  Description of Artificial Sequence: Synthetic oligonucleotide
  Target: FXN; (+) strand; PAM type: NRG; PAM sequence: GGG
cctcggcctcccgaagtgct

SEQ ID NO: 18178 - DNA, 20 bp, Artificial Sequence
  Description of Artificial Sequence: Synthetic oligonucleotide
  Target: FXN; (+) strand; PAM type: NRG; PAM sequence: CAG
ctcccgaagtgctgggatta

SEQ ID NO: 18179 - DNA, 20 bp, Artificial Sequence
  Description of Artificial Sequence: Synthetic oligonucleotide
  Target: FXN; (+) strand; PAM type: NRG; PAM sequence: AGG
tcccgaagtgctgggattac

SEQ ID NO: 18180 - DNA, 20 bp, Artificial Sequence
  Description of Artificial Sequence: Synthetic oligonucleotide
  Target: FXN; (+) strand; PAM type: NRG; PAM sequence: GAG
agtgctgggattacaggcat

SEQ ID NO: 18181 - DNA, 20 bp, Artificial Sequence
  Description of Artificial Sequence: Synthetic oligonucleotide
  Target: FXN; (+) strand; PAM type: NRG; PAM sequence: CAG
acaggcatgagccaccgcgc

SEQ ID NO: 18182 - DNA, 20 bp, Artificial Sequence
  Description of Artificial Sequence: Synthetic oligonucleotide
  Target: FXN; (+) strand; PAM type: NRG; PAM sequence: AGG
caggcatgagccaccgcgcc

SEQ ID NO: 18183 - DNA, 20 bp, Artificial Sequence
  Description of Artificial Sequence: Synthetic oligonucleotide
  Target: FXN; (+) strand; PAM type: NRG; PAM sequence: CGG
catgagccaccgcgccaggc

SEQ ID NO: 18184 - DNA, 20 bp, Artificial Sequence
  Description of Artificial Sequence: Synthetic oligonucleotide
  Target: FXN; (+) strand; PAM type: NRG; PAM sequence: AAG
ttttattttattttacttta

SEQ ID NO: 18185 - DNA, 20 bp, Artificial Sequence
  Description of Artificial Sequence: Synthetic oligonucleotide
  Target: FXN; (+) strand; PAM type: NRG; PAM sequence: CAG
attttattttactttaaaga

SEQ ID NO: 18186 - DNA, 20 bp, Artificial Sequence
  Description of Artificial Sequence: Synthetic oligonucleotide
  Target: FXN; (+) strand; PAM type: NRG; PAM sequence: AGG
ttttattttactttaaagac

SEQ ID NO: 18187 - DNA, 20 bp, Artificial Sequence
  Description of Artificial Sequence: Synthetic oligonucleotide
  Target: FXN; (+) strand; PAM type: NRG; PAM sequence: GGG
tttattttactttaaagaca

SEQ ID NO: 18188 - DNA, 20 bp, Artificial Sequence
  Description of Artificial Sequence: Synthetic oligonucleotide
  Target: FXN; (+) strand; PAM type: NRG; PAM sequence: CAG
cagggtttcactttgtcacc

SEQ ID NO: 18189 - DNA, 20 bp, Artificial Sequence
  Description of Artificial Sequence: Synthetic oligonucleotide
  Target: FXN; (+) strand; PAM type: NRG; PAM sequence: AGG
agggtttcactttgtcaccc

SEQ ID NO: 18190 - DNA, 20 bp, Artificial Sequence
  Description of Artificial Sequence: Synthetic oligonucleotide
  Target: FXN; (+) strand; PAM type: NRG; PAM sequence: TGG
tttcactttgtcacccagga

SEQ ID NO: 18191 - DNA, 20 bp, Artificial Sequence
  Description of Artificial Sequence: Synthetic oligonucleotide
  Target: FXN; (+) strand; PAM type: NRG; PAM sequence: TGG
tcacccaggatggaatgcaa

SEQ ID NO: 18192 - DNA, 20 bp, Artificial Sequence
  Description of Artificial Sequence: Synthetic oligonucleotide
  Target: FXN; (+) strand; PAM type: NRG; PAM sequence: CAG
ggaatgcaatggcacgatca

SEQ ID NO: 18193 - DNA, 20 bp, Artificial Sequence
  Description of Artificial Sequence: Synthetic oligonucleotide
  Target: FXN; (+) strand; PAM type: NRG; PAM sequence: CAG
ggcacgatcacagctcactg

SEQ ID NO: 18194 - DNA, 20 bp, Artificial Sequence
  Description of Artificial Sequence: Synthetic oligonucleotide
  Target: FXN; (+) strand; PAM type: NRG; PAM sequence: TGG
cactgcagccttgacctccc

SEQ ID NO: 18195 - DNA, 20 bp, Artificial Sequence
  Description of Artificial Sequence: Synthetic oligonucleotide
  Target: FXN; (+) strand; PAM type: NRG; PAM sequence: CGG
cagccttgacctccctggct

SEQ ID NO: 18196 - DNA, 20 bp, Artificial Sequence
  Description of Artificial Sequence: Synthetic oligonucleotide
  Target: FXN; (+) strand; PAM type: NRG; PAM sequence: GGG
agccttgacctccctggctc

SEQ ID NO: 18197 - DNA, 20 bp, Artificial Sequence
  Description of Artificial Sequence: Synthetic oligonucleotide
  Target: FXN; (+) strand; PAM type: NRG; PAM sequence: CAG
tcgggtgatccctcccacct

SEQ ID NO: 18198 - DNA, 20 bp, Artificial Sequence
  Description of Artificial Sequence: Synthetic oligonucleotide
  Target: FXN; (+) strand; PAM type: NRG; PAM sequence: AGG
cgggtgatccctcccacctc

SEQ ID NO: 18199 - DNA, 20 bp, Artificial Sequence
  Description of Artificial Sequence: Synthetic oligonucleotide
  Target: FXN; (+) strand; PAM type: NRG; PAM sequence: GAG
ccctcccacctcaggctcct

SEQ ID NO: 18200 - DNA, 20 bp, Artificial Sequence
  Description of Artificial Sequence: Synthetic oligonucleotide
  Target: FXN; (+) strand; PAM type: NRG; PAM sequence: AGG
cctcccacctcaggctcctg

SEQ ID NO: 18201 - DNA, 20 bp, Artificial Sequence
  Description of Artificial Sequence: Synthetic oligonucleotide
  Target: FXN; (+) strand; PAM type: NRG; PAM sequence: GAG
tcccacctcaggctcctgag

SEQ ID NO: 18202 - DNA, 20 bp, Artificial Sequence
  Description of Artificial Sequence: Synthetic oligonucleotide
  Target: FXN; (+) strand; PAM type: NRG; PAM sequence: TAG
acctcaggctcctgaggagc

SEQ ID NO: 18203 - DNA, 20 bp, Artificial Sequence
  Description of Artificial Sequence: Synthetic oligonucleotide
  Target: FXN; (+) strand; PAM type: NRG; PAM sequence: CAG
ctcctgaggagctagaacta

SEQ ID NO: 18204 - DNA, 20 bp, Artificial Sequence
  Description of Artificial Sequence: Synthetic oligonucleotide
  Target: FXN; (+) strand; PAM type: NRG; PAM sequence: AGG
tcctgaggagctagaactac

SEQ ID NO: 18205 - DNA, 20 bp, Artificial Sequence
  Description of Artificial Sequence: Synthetic oligonucleotide
  Target: FXN; (+) strand; PAM type: NRG; PAM sequence: TGG
aggagctagaactacaggca

SEQ ID NO: 18206 - DNA, 20 bp, Artificial Sequence
  Description of Artificial Sequence: Synthetic oligonucleotide
  Target: FXN; (+) strand; PAM type: NRG; PAM sequence: GGG
ggagctagaactacaggcat

SEQ ID NO: 18207 - DNA, 20 bp, Artificial Sequence
  Description of Artificial Sequence: Synthetic oligonucleotide
  Target: FXN; (+) strand; PAM type: NRG; PAM sequence: CAG
ctacaggcatgggccatgcc

SEQ ID NO: 18208 - DNA, 20 bp, Artificial Sequence
  Description of Artificial Sequence: Synthetic oligonucleotide
  Target: FXN; (+) strand; PAM type: NRG; PAM sequence: TGG
ccagctaattttttaatttt

SEQ ID NO: 18209 - DNA, 20 bp, Artificial Sequence
  Description of Artificial Sequence: Synthetic oligonucleotide
  Target: FXN; (+) strand; PAM type: NRG; PAM sequence: TAG
gctaattttttaatttttgg

SEQ ID NO: 18210 - DNA, 20 bp, Artificial Sequence
  Description of Artificial Sequence: Synthetic oligonucleotide
  Target: FXN; (+) strand; PAM type: NRG; PAM sequence: GAG
taattttttaatttttggta

SEQ ID NO: 18211 - DNA, 20 bp, Artificial Sequence
  Description of Artificial Sequence: Synthetic oligonucleotide
  Target: FXN; (+) strand; PAM type: NRG; PAM sequence: CGG
tttttaatttttggtagaga

SEQ ID NO: 18212 - DNA, 20 bp, Artificial Sequence
  Description of Artificial Sequence: Synthetic oligonucleotide
  Target: FXN; (+) strand; PAM type: NRG; PAM sequence: GGG
ttttaatttttggtagagac

SEQ ID NO: 18213 - DNA, 20 bp, Artificial Sequence
  Description of Artificial Sequence: Synthetic oligonucleotide
  Target: FXN; (+) strand; PAM type: NRG; PAM sequence: GGG
tttaatttttggtagagacg

SEQ ID NO: 18214 - DNA, 20 bp, Artificial Sequence
  Description of Artificial Sequence: Synthetic oligonucleotide
  Target: FXN; (+) strand; PAM type: NRG; PAM sequence: CAG
agacggggtctctgttgtct

SEQ ID NO: 18215 - DNA, 20 bp, Artificial Sequence
  Description of Artificial Sequence: Synthetic oligonucleotide
  Target: FXN; (+) strand; PAM type: NRG; PAM sequence: TGG
tctctgttgtctcagattcc

SEQ ID NO: 18216 - DNA, 20 bp, Artificial Sequence
  Description of Artificial Sequence: Synthetic oligonucleotide
  Target: FXN; (+) strand; PAM type: NRG; PAM sequence: GGG
ctctgttgtctcagattcct

SEQ ID NO: 18217 - DNA, 20 bp, Artificial Sequence
  Description of Artificial Sequence: Synthetic oligonucleotide
  Target: FXN; (+) strand; PAM type: NRG; PAM sequence: AAG
tgtctcagattcctgggttc

SEQ ID NO: 18218 - DNA, 20 bp, Artificial Sequence
  Description of Artificial Sequence: Synthetic oligonucleotide
  Target: FXN; (+) strand; PAM type: NRG; PAM sequence: TGG
ttcaagtgatccttctccct

SEQ ID NO: 18219 - DNA, 20 bp, Artificial Sequence
  Description of Artificial Sequence: Synthetic oligonucleotide
  Target: FXN; (+) strand; PAM type: NRG; PAM sequence: AAG
ccttctcccttggcctccca

SEQ ID NO: 18220 - DNA, 20 bp, Artificial Sequence
  Description of Artificial Sequence: Synthetic oligonucleotide
  Target: FXN; (+) strand; PAM type: NRG; PAM sequence: TGG
cccttggcctcccaaagttc

SEQ ID NO: 18221 - DNA, 20 bp, Artificial Sequence
  Description of Artificial Sequence: Synthetic oligonucleotide
  Target: FXN; (+) strand; PAM type: NRG; PAM sequence: CAG
ctcccaaagttctggtatta

SEQ ID NO: 18222 - DNA, 20 bp, Artificial Sequence
  Description of Artificial Sequence: Synthetic oligonucleotide
  Target: FXN; (+) strand; PAM type: NRG; PAM sequence: AGG
tcccaaagttctggtattac

SEQ ID NO: 18223 - DNA, 20 bp, Artificial Sequence
  Description of Artificial Sequence: Synthetic oligonucleotide
  Target: FXN; (+) strand; PAM type: NRG; PAM sequence: GAG
agttctggtattacaggcat

SEQ ID NO: 18224 - DNA, 20 bp, Artificial Sequence
  Description of Artificial Sequence: Synthetic oligonucleotide
  Target: FXN; (+) strand; PAM type: NRG; PAM sequence: CAG
caggcatgagccactgcacc

SEQ ID NO: 18225 - DNA, 20 bp, Artificial Sequence
  Description of Artificial Sequence: Synthetic oligonucleotide
  Target: FXN; (+) strand; PAM type: NRG; PAM sequence: TGG
gagccactgcacccagccca

SEQ ID NO: 18226 - DNA, 20 bp, Artificial Sequence
  Description of Artificial Sequence: Synthetic oligonucleotide
  Target: FXN; (+) strand; PAM type: NRG; PAM sequence: CAG
cactgcacccagcccatggc

SEQ ID NO: 18227 - DNA, 20 bp, Artificial Sequence
  Description of Artificial Sequence: Synthetic oligonucleotide
  Target: FXN; (+) strand; PAM type: NRG; PAM sequence: GAG
tctttttttttttttaattt

SEQ ID NO: 18228 - DNA, 20 bp, Artificial Sequence
  Description of Artificial Sequence: Synthetic oligonucleotide
  Target: FXN; (+) strand; PAM type: NRG; PAM sequence: AAG
ttttttttttttaatttgag

SEQ ID NO: 18229 - DNA, 20 bp, Artificial Sequence
  Description of Artificial Sequence: Synthetic oligonucleotide
  Target: FXN; (+) strand; PAM type: NRG; PAM sequence: CAG
aaccacaccaaaatgtcttt

SEQ ID NO: 18230 - DNA, 20 bp, Artificial Sequence
  Description of Artificial Sequence: Synthetic oligonucleotide
  Target: FXN; (+) strand; PAM type: NRG; PAM sequence: AAG
acaccaaaatgtctttcagt

SEQ ID NO: 18231 - DNA, 20 bp, Artificial Sequence
  Description of Artificial Sequence: Synthetic oligonucleotide
  Target: FXN; (+) strand; PAM type: NRG; PAM sequence: TAG
gtaagtaaaatgaaccattt

SEQ ID NO: 18232 - DNA, 20 bp, Artificial Sequence
  Description of Artificial Sequence: Synthetic oligonucleotide
  Target: FXN; (+) strand; PAM type: NRG; PAM sequence: CAG
aaaatgaaccattttagata

SEQ ID NO: 18233 - DNA, 20 bp, Artificial Sequence
  Description of Artificial Sequence: Synthetic oligonucleotide
  Target: FXN; (+) strand; PAM type: NRG; PAM sequence: TAG
tagatacagaaaattctaat

SEQ ID NO: 18234 - DNA, 20 bp, Artificial Sequence
  Description of Artificial Sequence: Synthetic oligonucleotide
  Target: FXN; (+) strand; PAM type: NRG; PAM sequence: TGG
acagaaaattctaattagat

SEQ ID NO: 18235 - DNA, 20 bp, Artificial Sequence
  Description of Artificial Sequence: Synthetic oligonucleotide
  Target: FXN; (+) strand; PAM type: NRG; PAM sequence: TAG
aaattctaattagattggca

SEQ ID NO: 18236 - DNA, 20 bp, Artificial Sequence
  Description of Artificial Sequence: Synthetic oligonucleotide
  Target: FXN; (+) strand; PAM type: NRG; PAM sequence: AAG
ctaattagattggcatagtt

SEQ ID NO: 18237 - DNA, 20 bp, Artificial Sequence
  Description of Artificial Sequence: Synthetic oligonucleotide
  Target: FXN; (+) strand; PAM type: NRG; PAM sequence: AGG
taattagattggcatagtta

SEQ ID NO: 18238 - DNA, 20 bp, Artificial Sequence
  Description of Artificial Sequence: Synthetic oligonucleotide
  Target: FXN; (+) strand; PAM type: NRG; PAM sequence: AAG
tagttaaggccaaaaatata

SEQ ID NO: 18239 - DNA, 20 bp, Artificial Sequence
  Description of Artificial Sequence: Synthetic oligonucleotide
  Target: FXN; (+) strand; PAM type: NRG; PAM sequence: CAG
tgacattgctaccttatctt

SEQ ID NO: 18240 - DNA, 20 bp, Artificial Sequence
  Description of Artificial Sequence: Synthetic oligonucleotide
  Target: FXN; (+) strand; PAM type: NRG; PAM sequence: AAG
tatcttcagcccttgccttt

SEQ ID NO: 18241 - DNA, 20 bp, Artificial Sequence
  Description of Artificial Sequence: Synthetic oligonucleotide
  Target: FXN; (+) strand; PAM type: NRG; PAM sequence: GAG
tcttcagcccttgcctttaa

SEQ ID NO: 18242 - DNA, 20 bp, Artificial Sequence
  Description of Artificial Sequence: Synthetic oligonucleotide
  Target: FXN; (+) strand; PAM type: NRG; PAM sequence: AGG
cttcagcccttgcctttaag

SEQ ID NO: 18243 - DNA, 20 bp, Artificial Sequence
  Description of Artificial Sequence: Synthetic oligonucleotide
  Target: FXN; (+) strand; PAM type: NRG; PAM sequence: CAG
aggcaaatgaacacaaaata

SEQ ID NO: 18244 - DNA, 20 bp, Artificial Sequence
  Description of Artificial Sequence: Synthetic oligonucleotide
  Target: FXN; (+) strand; PAM type: NRG; PAM sequence: AGG
ggcaaatgaacacaaaatac

SEQ ID NO: 18245 - DNA, 20 bp, Artificial Sequence
  Description of Artificial Sequence: Synthetic oligonucleotide
  Target: FXN; (+) strand; PAM type: NRG; PAM sequence: TGG
aaatacaggtgaatcttgct

SEQ ID NO: 18246 - DNA, 20 bp, Artificial Sequence
  Description of Artificial Sequence: Synthetic oligonucleotide
  Target: FXN; (+) strand; PAM type: NRG; PAM sequence: GAG
ggtgaatcttgcttggttct

SEQ ID NO: 18247 - DNA, 20 bp, Artificial Sequence
  Description of Artificial Sequence: Synthetic oligonucleotide
  Target: FXN; (+) strand; PAM type: NRG; PAM sequence: CAG
aatcttgcttggttctgaga

SEQ ID NO: 18248 - DNA, 20 bp, Artificial Sequence
  Description of Artificial Sequence: Synthetic oligonucleotide
  Target: FXN; (+) strand; PAM type: NRG; PAM sequence: AAG
tgcttggttctgagacagtg

SEQ ID NO: 18249 - DNA, 20 bp, Artificial Sequence
  Description of Artificial Sequence: Synthetic oligonucleotide
  Target: FXN; (+) strand; PAM type: NRG; PAM sequence: AGG
gcttggttctgagacagtga

SEQ ID NO: 18250 - DNA, 20 bp, Artificial Sequence
  Description of Artificial Sequence: Synthetic oligonucleotide
  Target: FXN; (+) strand; PAM type: NRG; PAM sequence: CAG
gacagtgaaggactttcccc

SEQ ID NO: 18251 - DNA, 20 bp, Artificial Sequence
  Description of Artificial Sequence: Synthetic oligonucleotide
  Target: FXN; (+) strand; PAM type: NRG; PAM sequence: CAG
tttaaatatatttacataac

SEQ ID NO: 18252 - DNA, 20 bp, Artificial Sequence
  Description of Artificial Sequence: Synthetic oligonucleotide
  Target: FXN; (+) strand; PAM type: NRG; PAM sequence: TAG
aatattaaaaaaatctccaa

SEQ ID NO: 18253 - DNA, 20 bp, Artificial Sequence
  Description of Artificial Sequence: Synthetic oligonucleotide
  Target: FXN; (+) strand; PAM type: NRG; PAM sequence: TAG
aaaaaatctccaatagattt

SEQ ID NO: 18254 - DNA, 20 bp, Artificial Sequence
  Description of Artificial Sequence: Synthetic oligonucleotide
  Target: FXN; (+) strand; PAM type: NRG; PAM sequence: TGG
aatctccaatagattttaga

SEQ ID NO: 18255 - DNA, 20 bp, Artificial Sequence
  Description of Artificial Sequence: Synthetic oligonucleotide
  Target: FXN; (+) strand; PAM type: NRG; PAM sequence: AAG
gcattcaccatctttgtgaa

SEQ ID NO: 18256 - DNA, 20 bp, Artificial Sequence
  Description of Artificial Sequence: Synthetic oligonucleotide
  Target: FXN; (+) strand; PAM type: NRG; PAM sequence: TAG
atgaaatctgatcatatctt

SEQ ID NO: 18257 - DNA, 20 bp, Artificial Sequence
  Description of Artificial Sequence: Synthetic oligonucleotide
  Target: FXN; (+) strand; PAM type: NRG; PAM sequence: AAG
aaatctgatcatatctttag

SEQ ID NO: 18258 - DNA, 20 bp, Artificial Sequence
  Description of Artificial Sequence: Synthetic oligonucleotide
  Target: FXN; (+) strand; PAM type: NRG; PAM sequence: AGG
aatctgatcatatctttaga

SEQ ID NO: 18259 - DNA, 20 bp, Artificial Sequence
  Description of Artificial Sequence: Synthetic oligonucleotide
  Target: FXN; (+) strand; PAM type: NRG; PAM sequence: CAG
catatctttagaaggataaa

SEQ ID NO: 18260 - DNA, 20 bp, Artificial Sequence
  Description of Artificial Sequence: Synthetic oligonucleotide
  Target: FXN; (+) strand; PAM type: NRG; PAM sequence: TAG
tttagaaggataaacagtga

SEQ ID NO: 18261 - DNA, 20 bp, Artificial Sequence
  Description of Artificial Sequence: Synthetic oligonucleotide
  Target: FXN; (+) strand; PAM type: NRG; PAM sequence: CAG
agtgatagcatttactgaat

SEQ ID NO: 18262 - DNA, 20 bp, Artificial Sequence
  Description of Artificial Sequence: Synthetic oligonucleotide
  Target: FXN; (+) strand; PAM type: NRG; PAM sequence: TGG
gaatcagaataactgttttt

SEQ ID NO: 18263 - DNA, 20 bp, Artificial Sequence
  Description of Artificial Sequence: Synthetic oligonucleotide
  Target: FXN; (+) strand; PAM type: NRG; PAM sequence: GGG
aatcagaataactgtttttt

SEQ ID NO: 18264 - DNA, 20 bp, Artificial Sequence
  Description of Artificial Sequence: Synthetic oligonucleotide
  Target: FXN; (+) strand; PAM type: NRG; PAM sequence: GGG
atcagaataactgttttttg

SEQ ID NO: 18265 - DNA, 20 bp, Artificial Sequence
  Description of Artificial Sequence: Synthetic oligonucleotide
  Target: FXN; (+) strand; PAM type: NRG; PAM sequence: GAG
tgttttttggggttttcttt

SEQ ID NO: 18266 - DNA, 20 bp, Artificial Sequence
  Description of Artificial Sequence: Synthetic oligonucleotide
  Target: FXN; (+) strand; PAM type: NRG; PAM sequence: CGG
ttttggggttttctttgaga

SEQ ID NO: 18267 - DNA, 20 bp, Artificial Sequence
  Description of Artificial Sequence: Synthetic oligonucleotide
  Target: FXN; (+) strand; PAM type: NRG; PAM sequence: GAG
ttggggttttctttgagacg

SEQ ID NO: 18268 - DNA, 20 bp, Artificial Sequence
  Description of Artificial Sequence: Synthetic oligonucleotide
  Target: FXN; (+) strand; PAM type: NRG; PAM sequence: CAG
ggagttttgctcttgttgcc

SEQ ID NO: 18269 - DNA, 20 bp, Artificial Sequence
  Description of Artificial Sequence: Synthetic oligonucleotide
  Target: FXN; (+) strand; PAM type: NRG; PAM sequence: AGG
gagttttgctcttgttgccc

SEQ ID NO: 18270 - DNA, 20 bp, Artificial Sequence
  Description of Artificial Sequence: Synthetic oligonucleotide
  Target: FXN; (+) strand; PAM type: NRG; PAM sequence: TGG
tttgctcttgttgcccaggc

SEQ ID NO: 18271 - DNA, 20 bp, Artificial Sequence
  Description of Artificial Sequence: Synthetic oligonucleotide
  Target: FXN; (+) strand; PAM type: NRG; PAM sequence: GAG
tgctcttgttgcccaggctg

SEQ ID NO: 18272 - DNA, 20 bp, Artificial Sequence
  Description of Artificial Sequence: Synthetic oligonucleotide
  Target: FXN; (+) strand; PAM type: NRG; PAM sequence: CAG
ttgttgcccaggctggagtg

SEQ ID NO: 18273 - DNA, 20 bp, Artificial Sequence
  Description of Artificial Sequence: Synthetic oligonucleotide
  Target: FXN; (+) strand; PAM type: NRG; PAM sequence: TGG
ttgcccaggctggagtgcag

SEQ ID NO: 18274 - DNA, 20 bp, Artificial Sequence
  Description of Artificial Sequence: Synthetic oligonucleotide
  Target: FXN; (+) strand; PAM type: NRG; PAM sequence: CAG
ggagtgcagtggtgccacct

SEQ ID NO: 18275 - DNA, 20 bp, Artificial Sequence
  Description of Artificial Sequence: Synthetic oligonucleotide
  Target: FXN; (+) strand; PAM type: NRG; PAM sequence: TGG
tcactgcaacctccgccccc

SEQ ID NO: 18276 - DNA, 20 bp, Artificial Sequence
  Description of Artificial Sequence: Synthetic oligonucleotide
  Target: FXN; (+) strand; PAM type: NRG; PAM sequence: AAG
aacctccgccccctggattc

SEQ ID NO: 18277 - DNA, 20 bp, Artificial Sequence
  Description of Artificial Sequence: Synthetic oligonucleotide
  Target: FXN; (+) strand; PAM type: NRG; PAM sequence: GAG
cctccgccccctggattcaa

SEQ ID NO: 18278 - DNA, 20 bp, Artificial Sequence
  Description of Artificial Sequence: Synthetic oligonucleotide
  Target: FXN; (+) strand; PAM type: NRG; PAM sequence: CAG
ttcaagagattatcctgcct

SEQ ID NO: 18279 - DNA, 20 bp, Artificial Sequence
  Description of Artificial Sequence: Synthetic oligonucleotide
  Target: FXN; (+) strand; PAM type: NRG; PAM sequence: GAG
ttatcctgcctcagcctccc

SEQ ID NO: 18280 - DNA, 20 bp, Artificial Sequence
  Description of Artificial Sequence: Synthetic oligonucleotide
  Target: FXN; (+) strand; PAM type: NRG; PAM sequence: TAG
tcctgcctcagcctcccgag

SEQ ID NO: 18281 - DNA, 20 bp, Artificial Sequence
  Description of Artificial Sequence: Synthetic oligonucleotide
  Target: FXN; (+) strand; PAM type: NRG; PAM sequence: TGG
gcctcagcctcccgagtagc

SEQ ID NO: 18282 - DNA, 20 bp, Artificial Sequence
  Description of Artificial Sequence: Synthetic oligonucleotide
  Target: FXN; (+) strand; PAM type: NRG; PAM sequence: GGG
cctcagcctcccgagtagct

SEQ ID NO: 18283 - DNA, 20 bp, Artificial Sequence
  Description of Artificial Sequence: Synthetic oligonucleotide
  Target: FXN; (+) strand; PAM type: NRG; PAM sequence: CAG
ctcccgagtagctgggatta

SEQ ID NO: 18284 - DNA, 20 bp, Artificial Sequence
  Description of Artificial Sequence: Synthetic oligonucleotide
  Target: FXN; (+) strand; PAM type: NRG; PAM sequence: AGG
tcccgagtagctgggattac

SEQ ID NO: 18285 - DNA, 20 bp, Artificial Sequence
  Description of Artificial Sequence: Synthetic oligonucleotide
  Target: FXN; (+) strand; PAM type: NRG; PAM sequence: CAG
caggctcgccccaccatgcc

SEQ ID NO: 18286 - DNA, 20 bp, Artificial Sequence
  Description of Artificial Sequence: Synthetic oligonucleotide
  Target: FXN; (+) strand; PAM type: NRG; PAM sequence: TAG
ccagctaatttttgtatttt

SEQ ID NO: 18287 - DNA, 20 bp, Artificial Sequence
  Description of Artificial Sequence: Synthetic oligonucleotide
  Target: FXN; (+) strand; PAM type: NRG; PAM sequence: TAG
gctaatttttgtatttttag

SEQ ID NO: 18288 - DNA, 20 bp, Artificial Sequence
  Description of Artificial Sequence: Synthetic oligonucleotide
  Target: FXN; (+) strand; PAM type: NRG; PAM sequence: GAG
taatttttgtatttttagta

SEQ ID NO: 18289 - DNA, 20 bp, Artificial Sequence
  Description of Artificial Sequence: Synthetic oligonucleotide
  Target: FXN; (+) strand; PAM type: NRG; PAM sequence: AGG
aatttttgtatttttagtag

SEQ ID NO: 18290 - DNA, 20 bp, Artificial Sequence
  Description of Artificial Sequence: Synthetic oligonucleotide
  Target: FXN; (+) strand; PAM type: NRG; PAM sequence: GAG
tttgtatttttagtagaggc

SEQ ID NO: 18291 - DNA, 20 bp, Artificial Sequence
  Description of Artificial Sequence: Synthetic oligonucleotide
  Target: FXN; (+) strand; PAM type: NRG; PAM sequence: AGG
ttgtatttttagtagaggcg

SEQ ID NO: 18292 - DNA, 20 bp, Artificial Sequence
  Description of Artificial Sequence: Synthetic oligonucleotide
  Target: FXN; (+) strand; PAM type: NRG; PAM sequence: CAG
gaggcgaggtttcaccatgt

SEQ ID NO: 18293 - DNA, 20 bp, Artificial Sequence
  Description of Artificial Sequence: Synthetic oligonucleotide
  Target: FXN; (+) strand; PAM type: NRG; PAM sequence: CAG
cgaggtttcaccatgtcagc

SEQ ID NO: 18294 - DNA, 20 bp, Artificial Sequence
  Description of Artificial Sequence: Synthetic oligonucleotide
  Target: FXN; (+) strand; PAM type: NRG; PAM sequence: AGG
gaggtttcaccatgtcagcc

SEQ ID NO: 18295 - DNA, 20 bp, Artificial Sequence
  Description of Artificial Sequence: Synthetic oligonucleotide
  Target: FXN; (+) strand; PAM type: NRG; PAM sequence: TGG
tttcaccatgtcagccaggc

SEQ ID NO: 18296 - DNA, 20 bp, Artificial Sequence
  Description of Artificial Sequence: Synthetic oligonucleotide
  Target: FXN; (+) strand; PAM type: NRG; PAM sequence: CAG
tggtcttgaactcctgacct

SEQ ID NO: 18297 - DNA, 20 bp, Artificial Sequence
  Description of Artificial Sequence: Synthetic oligonucleotide
  Target: FXN; (+) strand; PAM type: NRG; PAM sequence: AGG
ggtcttgaactcctgacctc

SEQ ID NO: 18298 - DNA, 20 bp, Artificial Sequence
  Description of Artificial Sequence: Synthetic oligonucleotide
  Target: FXN; (+) strand; PAM type: NRG; PAM sequence: CAG
ctcaggtgatccacccgcct

SEQ ID NO: 18299 - DNA, 20 bp, Artificial Sequence
  Description of Artificial Sequence: Synthetic oligonucleotide
  Target: FXN; (+) strand; PAM type: NRG; PAM sequence: TAG
gcctcagcctcccaaaatgc

SEQ ID NO: 18300 - DNA, 20 bp, Artificial Sequence
  Description of Artificial Sequence: Synthetic oligonucleotide
  Target: FXN; (+) strand; PAM type: NRG; PAM sequence: AGG
cctcagcctcccaaaatgct

SEQ ID NO: 18301 - DNA, 20 bp, Artificial Sequence
  Description of Artificial Sequence: Synthetic oligonucleotide
  Target: FXN; (+) strand; PAM type: NRG; PAM sequence: CAG
ctcccaaaatgctaggatta

SEQ ID NO: 18302 - DNA, 20 bp, Artificial Sequence
  Description of Artificial Sequence: Synthetic oligonucleotide
  Target: FXN; (+) strand; PAM type: NRG; PAM sequence: AGG
tcccaaaatgctaggattac

SEQ ID NO: 18303 - DNA, 20 bp, Artificial Sequence
  Description of Artificial Sequence: Synthetic oligonucleotide
  Target: FXN; (+) strand; PAM type: NRG; PAM sequence: GAG
aatgctaggattacaggcgt

SEQ ID NO: 18304 - DNA, 20 bp, Artificial Sequence
  Description of Artificial Sequence: Synthetic oligonucleotide
  Target: FXN; (+) strand; PAM type: NRG; PAM sequence: CAG
ggattacaggcgtgagccac

SEQ ID NO: 18305 - DNA, 20 bp, Artificial Sequence
  Description of Artificial Sequence: Synthetic oligonucleotide
  Target: FXN; (+) strand; PAM type: NRG; PAM sequence: AGG
gattacaggcgtgagccacc

SEQ ID NO: 18306 - DNA, 20 bp, Artificial Sequence
  Description of Artificial Sequence: Synthetic oligonucleotide
  Target: FXN; (+) strand; PAM type: NRG; PAM sequence: CAG
caggcgtgagccaccaggcc

SEQ ID NO: 18307 - DNA, 20 bp, Artificial Sequence
  Description of Artificial Sequence: Synthetic oligonucleotide
  Target: FXN; (+) strand; PAM type: NRG; PAM sequence: GAG
ttttttttttttcttttttt

SEQ ID NO: 18308 - DNA, 20 bp, Artificial Sequence
  Description of Artificial Sequence: Synthetic oligonucleotide
  Target: FXN; (+) strand; PAM type: NRG; PAM sequence: CGG
ttttttttctttttttgaga

SEQ ID NO: 18309 - DNA, 20 bp, Artificial Sequence
  Description of Artificial Sequence: Synthetic oligonucleotide
  Target: FXN; (+) strand; PAM type: NRG; PAM sequence: GAG
ttttttctttttttgagacg

SEQ ID NO: 18310 - DNA, 20 bp, Artificial Sequence
  Description of Artificial Sequence: Synthetic oligonucleotide
  Target: FXN; (+) strand; PAM type: NRG; PAM sequence: CAG
cggagtctcactctgtcacc

SEQ ID NO: 18311 - DNA, 20 bp, Artificial Sequence
  Description of Artificial Sequence: Synthetic oligonucleotide
  Target: FXN; (+) strand; PAM type: NRG; PAM sequence: AGG
ggagtctcactctgtcaccc

SEQ ID NO: 18312 - DNA, 20 bp, Artificial Sequence
  Description of Artificial Sequence: Synthetic oligonucleotide
  Target: FXN; (+) strand; PAM type: NRG; PAM sequence: TGG
tctcactctgtcacccaggc

SEQ ID NO: 18313 - DNA, 20 bp, Artificial Sequence
  Description of Artificial Sequence: Synthetic oligonucleotide
  Target: FXN; (+) strand; PAM type: NRG; PAM sequence: GAG
tcactctgtcacccaggctg

SEQ ID NO: 18314 - DNA, 20 bp, Artificial Sequence
  Description of Artificial Sequence: Synthetic oligonucleotide
  Target: FXN; (+) strand; PAM type: NRG; PAM sequence: CAG
ctgtcacccaggctggagtg

SEQ ID NO: 18315 - DNA, 20 bp, Artificial Sequence
  Description of Artificial Sequence: Synthetic oligonucleotide
  Target: FXN; (+) strand; PAM type: NRG; PAM sequence: TGG
tcacccaggctggagtgcag

SEQ ID NO: 18316 - DNA, 20 bp, Artificial Sequence
  Description of Artificial Sequence: Synthetic oligonucleotide
  Target: FXN; (+) strand; PAM type: NRG; PAM sequence: CAG
ggagtgcagtggcacaatgt

SEQ ID NO: 18317 - DNA, 20 bp, Artificial Sequence
  Description of Artificial Sequence: Synthetic oligonucleotide
  Target: FXN; (+) strand; PAM type: NRG; PAM sequence: CGG
ctcattgcaacctccacctc

SEQ ID NO: 18318 - DNA, 20 bp, Artificial Sequence
  Description of Artificial Sequence: Synthetic oligonucleotide
  Target: FXN; (+) strand; PAM type: NRG; PAM sequence: GGG
tcattgcaacctccacctcc

SEQ ID NO: 18319 - DNA, 20 bp, Artificial Sequence
  Description of Artificial Sequence: Synthetic oligonucleotide
  Target: FXN; (+) strand; PAM type: NRG; PAM sequence: GGG
cattgcaacctccacctccg

SEQ ID NO: 18320 - DNA, 20 bp, Artificial Sequence
  Description of Artificial Sequence: Synthetic oligonucleotide
  Target: FXN; (+) strand; PAM type: NRG; PAM sequence: CAG
aacctccacctccggggttt

SEQ ID NO: 18321 - DNA, 20 bp, Artificial Sequence
  Description of Artificial Sequence: Synthetic oligonucleotide
  Target: FXN; (+) strand; PAM type: NRG; PAM sequence: CAG
tttcagtgattctcctgtct

SEQ ID NO: 18322 - DNA, 20 bp, Artificial Sequence
  Description of Artificial Sequence: Synthetic oligonucleotide
  Target: FXN; (+) strand; PAM type: NRG; PAM sequence: AAG
ttctcctgtctcagcctccc

SEQ ID NO: 18323 - DNA, 20 bp, Artificial Sequence
  Description of Artificial Sequence: Synthetic oligonucleotide
  Target: FXN; (+) strand; PAM type: NRG; PAM sequence: TAG
tcctgtctcagcctcccaag

SEQ ID NO: 18324 - DNA, 20 bp, Artificial Sequence
  Description of Artificial Sequence: Synthetic oligonucleotide
  Target: FXN; (+) strand; PAM type: NRG; PAM sequence: TGG
gtctcagcctcccaagtagc

SEQ ID NO: 18325 - DNA, 20 bp, Artificial Sequence
  Description of Artificial Sequence: Synthetic oligonucleotide
  Target: FXN; (+) strand; PAM type: NRG; PAM sequence: GGG
tctcagcctcccaagtagct

SEQ ID NO: 18326 - DNA, 20 bp, Artificial Sequence
  Description of Artificial Sequence: Synthetic oligonucleotide
  Target: FXN; (+) strand; PAM type: NRG; PAM sequence: CAG
tcccaagtagctgggaacta

SEQ ID NO: 18327 - DNA, 20 bp, Artificial Sequence
  Description of Artificial Sequence: Synthetic oligonucleotide
  Target: FXN; (+) strand; PAM type: NRG; PAM sequence: AGG
cccaagtagctgggaactac

SEQ ID NO: 18328 - DNA, 20 bp, Artificial Sequence
  Description of Artificial Sequence: Synthetic oligonucleotide
  Target: FXN; (+) strand; PAM type: NRG; PAM sequence: AAG
gaactacaggcgtgcaccac

SEQ ID NO: 18329 - DNA, 20 bp, Artificial Sequence
  Description of Artificial Sequence: Synthetic oligonucleotide
  Target: FXN; (+) strand; PAM type: NRG; PAM sequence: CAG
acaggcgtgcaccacaagcc

SEQ ID NO: 18330 - DNA, 20 bp, Artificial Sequence
  Description of Artificial Sequence: Synthetic oligonucleotide
  Target: FXN; (+) strand; PAM type: NRG; PAM sequence: TAG
ccagctaatttttgtatttt

SEQ ID NO: 18331 - DNA, 20 bp, Artificial Sequence
  Description of Artificial Sequence: Synthetic oligonucleotide
  Target: FXN; (+) strand; PAM type: NRG; PAM sequence: TAG
gctaatttttgtatttttag

SEQ ID NO: 18332 - DNA, 20 bp, Artificial Sequence
  Description of Artificial Sequence: Synthetic oligonucleotide
  Target: FXN; (+) strand; PAM type: NRG; PAM sequence: GAG
taatttttgtatttttagta

SEQ ID NO: 18333 - DNA, 20 bp, Artificial Sequence
  Description of Artificial Sequence: Synthetic oligonucleotide
  Target: FXN; (+) strand; PAM type: NRG; PAM sequence: CAG
ttttgtatttttagtagaga

SEQ ID NO: 18334 - DNA, 20 bp, Artificial Sequence
  Description of Artificial Sequence: Synthetic oligonucleotide
  Target: FXN; (+) strand; PAM type: NRG; PAM sequence: AGG
tttgtatttttagtagagac

SEQ ID NO: 18335 - DNA, 20 bp, Artificial Sequence
  Description of Artificial Sequence: Synthetic oligonucleotide
  Target: FXN; (+) strand; PAM type: NRG; PAM sequence: GGG
ttgtatttttagtagagaca

SEQ ID NO: 18336 - DNA, 20 bp, Artificial Sequence
  Description of Artificial Sequence: Synthetic oligonucleotide
  Target: FXN; (+) strand; PAM type: NRG; PAM sequence: TGG
gagacagggttttgccatat

SEQ ID NO: 18337 - DNA, 20 bp, Artificial Sequence
  Description of Artificial Sequence: Synthetic oligonucleotide
  Target: FXN; (+) strand; PAM type: NRG; PAM sequence: TGG
agggttttgccatattggcc

SEQ ID NO: 18338 - DNA, 20 bp, Artificial Sequence
  Description of Artificial Sequence: Synthetic oligonucleotide
  Target: FXN; (+) strand; PAM type: NRG; PAM sequence: TAG
ttttgccatattggcctggc

SEQ ID NO: 18339 - DNA, 20 bp, Artificial Sequence
  Description of Artificial Sequence: Synthetic oligonucleotide
  Target: FXN; (+) strand; PAM type: NRG; PAM sequence: CAG
tagtttcaaactcctgacct

SEQ ID NO: 18340 - DNA, 20 bp, Artificial Sequence
  Description of Artificial Sequence: Synthetic oligonucleotide
  Target: FXN; (+) strand; PAM type: NRG; PAM sequence: AGG
agtttcaaactcctgacctc

SEQ ID NO: 18341 - DNA, 20 bp, Artificial Sequence
  Description of Artificial Sequence: Synthetic oligonucleotide
  Target: FXN; (+) strand; PAM type: NRG; PAM sequence: GAG
tcaaactcctgacctcaggt

SEQ ID NO: 18342 - DNA, 20 bp, Artificial Sequence
  Description of Artificial Sequence: Synthetic oligonucleotide
  Target: FXN; (+) strand; PAM type: NRG; PAM sequence: CGG
ctcaggtgagccacctacct

SEQ ID NO: 18343 - DNA, 20 bp, Artificial Sequence
  Description of Artificial Sequence: Synthetic oligonucleotide
  Target: FXN; (+) strand; PAM type: NRG; PAM sequence: AAG
ccacctacctcggcctccga

SEQ ID NO: 18344 - DNA, 20 bp, Artificial Sequence
  Description of Artificial Sequence: Synthetic oligonucleotide
  Target: FXN; (+) strand; PAM type: NRG; PAM sequence: TGG
acctcggcctccgaaagtcc

SEQ ID NO: 18345 - DNA, 20 bp, Artificial Sequence
  Description of Artificial Sequence: Synthetic oligonucleotide
  Target: FXN; (+) strand; PAM type: NRG; PAM sequence: GGG
cctcggcctccgaaagtcct

SEQ ID NO: 18346 - DNA, 20 bp, Artificial Sequence
  Description of Artificial Sequence: Synthetic oligonucleotide
  Target: FXN; (+) strand; PAM type: NRG; PAM sequence: CAG
ctccgaaagtcctgggatta

SEQ ID NO: 18347 - DNA, 20 bp, Artificial Sequence
  Description of Artificial Sequence: Synthetic oligonucleotide
  Target: FXN; (+) strand; PAM type: NRG; PAM sequence: GAG
agtcctgggattacagacgt

SEQ ID NO: 18348 - DNA, 20 bp, Artificial Sequence
  Description of Artificial Sequence: Synthetic oligonucleotide
  Target: FXN; (+) strand; PAM type: NRG; PAM sequence: TGG
acgtgagccactgcactgcc

SEQ ID NO: 18349 - DNA, 20 bp, Artificial Sequence
  Description of Artificial Sequence: Synthetic oligonucleotide
  Target: FXN; (+) strand; PAM type: NRG; PAM sequence: CAG
agccactgcactgcctggcc

SEQ ID NO: 18350 - DNA, 20 bp, Artificial Sequence
  Description of Artificial Sequence: Synthetic oligonucleotide
  Target: FXN; (+) strand; PAM type: NRG; PAM sequence: AAG
actgcactgcctggcccaga

SEQ ID NO: 18351 - DNA, 20 bp, Artificial Sequence
  Description of Artificial Sequence: Synthetic oligonucleotide
  Target: FXN; (+) strand; PAM type: NRG; PAM sequence: AGG
ctgcactgcctggcccagaa

SEQ ID NO: 18352 - DNA, 20 bp, Artificial Sequence
  Description of Artificial Sequence: Synthetic oligonucleotide
  Target: FXN; (+) strand; PAM type: NRG; PAM sequence: TAG
ccagaaaggactattaattg

SEQ ID NO: 18353 - DNA, 20 bp, Artificial Sequence
  Description of Artificial Sequence: Synthetic oligonucleotide
  Target: FXN; (+) strand; PAM type: NRG; PAM sequence: TGG
ctattaattgtagttgcctc

SEQ ID NO: 18354 - DNA, 20 bp, Artificial Sequence
  Description of Artificial Sequence: Synthetic oligonucleotide
  Target: FXN; (+) strand; PAM type: NRG; PAM sequence: GGG
tattaattgtagttgcctct

SEQ ID NO: 18355 - DNA, 20 bp, Artificial Sequence
  Description of Artificial Sequence: Synthetic oligonucleotide
  Target: FXN; (+) strand; PAM type: NRG; PAM sequence: TGG
attgtagttgcctctgggaa

SEQ ID NO: 18356 - DNA, 20 bp, Artificial Sequence
  Description of Artificial Sequence: Synthetic oligonucleotide
  Target: FXN; (+) strand; PAM type: NRG; PAM sequence: GGG
ttgtagttgcctctgggaat

SEQ ID NO: 18357 - DNA, 20 bp, Artificial Sequence
  Description of Artificial Sequence: Synthetic oligonucleotide
  Target: FXN; (+) strand; PAM type: NRG; PAM sequence: GGG
tgtagttgcctctgggaatg

SEQ ID NO: 18358 - DNA, 20 bp, Artificial Sequence
  Description of Artificial Sequence: Synthetic oligonucleotide
  Target: FXN; (+) strand; PAM type: NRG; PAM sequence: GGG
gtagttgcctctgggaatgg

SEQ ID NO: 18359 - DNA, 20 bp, Artificial Sequence
  Description of Artificial Sequence: Synthetic oligonucleotide
  Target: FXN; (+) strand; PAM type: NRG; PAM sequence: GAG
tttttttttttttttttttt

SEQ ID NO: 18360 - DNA, 20 bp, Artificial Sequence
  Description of Artificial Sequence: Synthetic oligonucleotide
  Target: FXN; (+) strand; PAM type: NRG; PAM sequence: CAG
ttttttttttttttttgaga

SEQ ID NO: 18361 - DNA, 20 bp, Artificial Sequence
  Description of Artificial Sequence: Synthetic oligonucleotide
  Target: FXN; (+) strand; PAM type: NRG; PAM sequence: GAG
ttttttttttttttgagaca

SEQ ID NO: 18362 - DNA, 20 bp, Artificial Sequence
  Description of Artificial Sequence: Synthetic oligonucleotide
  Target: FXN; (+) strand; PAM type: NRG; PAM sequence: CAG
cagagtctcgctctgtcgcc

SEQ ID NO: 18363 - DNA, 20 bp, Artificial Sequence
  Description of Artificial Sequence: Synthetic oligonucleotide
  Target: FXN; (+) strand; PAM type: NRG; PAM sequence: AGG
agagtctcgctctgtcgccc

SEQ ID NO: 18364 - DNA, 20 bp, Artificial Sequence
  Description of Artificial Sequence: Synthetic oligonucleotide
  Target: FXN; (+) strand; PAM type: NRG; PAM sequence: TGG
tctcgctctgtcgcccaggc

SEQ ID NO: 18365 - DNA, 20 bp, Artificial Sequence
  Description of Artificial Sequence: Synthetic oligonucleotide
  Target: FXN; (+) strand; PAM type: NRG; PAM sequence: GAG
tcgctctgtcgcccaggctg

SEQ ID NO: 18366 - DNA, 20 bp, Artificial Sequence
  Description of Artificial Sequence: Synthetic oligonucleotide
  Target: FXN; (+) strand; PAM type: NRG; PAM sequence: CAG
ctgtcgcccaggctggagtg

SEQ ID NO: 18367 - DNA, 20 bp, Artificial Sequence
  Description of Artificial Sequence: Synthetic oligonucleotide
  Target: FXN; (+) strand; PAM type: NRG; PAM sequence: TGG
tcgcccaggctggagtgcag

SEQ ID NO: 18368 - DNA, 20 bp, Artificial Sequence
  Description of Artificial Sequence: Synthetic oligonucleotide
  Target: FXN; (+) strand; PAM type: NRG; PAM sequence: CGG
ggagtgcagtggcgcaatct

SEQ ID NO: 18369 - DNA, 20 bp, Artificial Sequence
  Description of Artificial Sequence: Synthetic oligonucleotide
  Target: FXN; (+) strand; PAM type: NRG; PAM sequence: AAG
gcgcaatctcggctcactgc

SEQ ID NO: 18370 - DNA, 20 bp, Artificial Sequence
  Description of Artificial Sequence: Synthetic oligonucleotide
  Target: FXN; (+) strand; PAM type: NRG; PAM sequence: CAG
tcactgcaagctccgcctcc

SEQ ID NO: 18371 - DNA, 20 bp, Artificial Sequence
  Description of Artificial Sequence: Synthetic oligonucleotide
  Target: FXN; (+) strand; PAM type: NRG; PAM sequence: AGG
cactgcaagctccgcctccc

SEQ ID NO: 18372 - DNA, 20 bp, Artificial Sequence
  Description of Artificial Sequence: Synthetic oligonucleotide
  Target: FXN; (+) strand; PAM type: NRG; PAM sequence: CAG
ttcacgccattctcctgcct

SEQ ID NO: 18373 - DNA, 20 bp, Artificial Sequence
  Description of Artificial Sequence: Synthetic oligonucleotide
  Target: FXN; (+) strand; PAM type: NRG; PAM sequence: GAG
ttctcctgcctcagcctcct

SEQ ID NO: 18374 - DNA, 20 bp, Artificial Sequence
  Description of Artificial Sequence: Synthetic oligonucleotide
  Target: FXN; (+) strand; PAM type: NRG; PAM sequence: TAG
tcctgcctcagcctcctgag

SEQ ID NO: 18375 - DNA, 20 bp, Artificial Sequence
  Description of Artificial Sequence: Synthetic oligonucleotide
  Target: FXN; (+) strand; PAM type: NRG; PAM sequence: TGG
gcctcagcctcctgagtagc

SEQ ID NO: 18376 - DNA, 20 bp, Artificial Sequence
  Description of Artificial Sequence: Synthetic oligonucleotide
  Target: FXN; (+) strand; PAM type: NRG; PAM sequence: GGG
cctcagcctcctgagtagct

SEQ ID NO: 18377 - DNA, 20 bp, Artificial Sequence
  Description of Artificial Sequence: Synthetic oligonucleotide
  Target: FXN; (+) strand; PAM type: NRG; PAM sequence: CAG
ctcctgagtagctgggacta

SEQ ID NO: 18378 - DNA, 20 bp, Artificial Sequence
  Description of Artificial Sequence: Synthetic oligonucleotide
  Target: FXN; (+) strand; PAM type: NRG; PAM sequence: AGG
tcctgagtagctgggactac

SEQ ID NO: 18379 - DNA, 20 bp, Artificial Sequence
  Description of Artificial Sequence: Synthetic oligonucleotide
  Target: FXN; (+) strand; PAM type: NRG; PAM sequence: CGG
caggcacccgtcaccacgcc

SEQ ID NO: 18380 - DNA, 20 bp, Artificial Sequence
  Description of Artificial Sequence: Synthetic oligonucleotide
  Target: FXN; (+) strand; PAM type: NRG; PAM sequence: CAG
cggctaattttttgtatttt

SEQ ID NO: 18381 - DNA, 20 bp, Artificial Sequence
  Description of Artificial Sequence: Synthetic oligonucleotide
  Target: FXN; (+) strand; PAM type: NRG; PAM sequence: TAG
ctaattttttgtattttcag

SEQ ID NO: 18382 - DNA, 20 bp, Artificial Sequence
  Description of Artificial Sequence: Synthetic oligonucleotide
  Target: FXN; (+) strand; PAM type: NRG; PAM sequence: GAG
aattttttgtattttcagta

SEQ ID NO: 18383 - DNA, 20 bp, Artificial Sequence
  Description of Artificial Sequence: Synthetic oligonucleotide
  Target: FXN; (+) strand; PAM type: NRG; PAM sequence: CGG
ttttgtattttcagtagaga

SEQ ID NO: 18384 - DNA, 20 bp, Artificial Sequence
  Description of Artificial Sequence: Synthetic oligonucleotide
  Target: FXN; (+) strand; PAM type: NRG; PAM sequence: GGG
tttgtattttcagtagagac

SEQ ID NO: 18385 - DNA, 20 bp, Artificial Sequence
  Description of Artificial Sequence: Synthetic oligonucleotide
  Target: FXN; (+) strand; PAM type: NRG; PAM sequence: GGG
ttgtattttcagtagagacg

SEQ ID NO: 18386 - DNA, 20 bp, Artificial Sequence
  Description of Artificial Sequence: Synthetic oligonucleotide
  Target: FXN; (+) strand; PAM type: NRG; PAM sequence: TAG
gagacggggtttcaccatgt

SEQ ID NO: 18387 - DNA, 20 bp, Artificial Sequence
  Description of Artificial Sequence: Synthetic oligonucleotide
  Target: FXN; (+) strand; PAM type: NRG; PAM sequence: CAG
cggggtttcaccatgttagc

SEQ ID NO: 18388 - DNA, 20 bp, Artificial Sequence
  Description of Artificial Sequence: Synthetic oligonucleotide
  Target: FXN; (+) strand; PAM type: NRG; PAM sequence: AGG
ggggtttcaccatgttagcc

SEQ ID NO: 18389 - DNA, 20 bp, Artificial Sequence
  Description of Artificial Sequence: Synthetic oligonucleotide
  Target: FXN; (+) strand; PAM type: NRG; PAM sequence: TGG
tttcaccatgttagccagga

SEQ ID NO: 18390 - DNA, 20 bp, Artificial Sequence
  Description of Artificial Sequence: Synthetic oligonucleotide
  Target: FXN; (+) strand; PAM type: NRG; PAM sequence: CGG
accgtgttatctgcctgcct

SEQ ID NO: 18391 - DNA, 20 bp, Artificial Sequence
  Description of Artificial Sequence: Synthetic oligonucleotide
  Target: FXN; (+) strand; PAM type: NRG; PAM sequence: CAG
atctgcctgcctcggcctcc

SEQ ID NO: 18392 - DNA, 20 bp, Artificial Sequence
  Description of Artificial Sequence: Synthetic oligonucleotide
  Target: FXN; (+) strand; PAM type: NRG; PAM sequence: GAG
ctgcctgcctcggcctccca

SEQ ID NO: 18393 - DNA, 20 bp, Artificial Sequence
  Description of Artificial Sequence: Synthetic oligonucleotide
  Target: FXN; (+) strand; PAM type: NRG; PAM sequence: TGG
gcctcggcctcccagagtgc

SEQ ID NO: 18394 - DNA, 20 bp, Artificial Sequence
  Description of Artificial Sequence: Synthetic oligonucleotide
  Target: FXN; (+) strand; PAM type: NRG; PAM sequence: GGG
cctcggcctcccagagtgct

SEQ ID NO: 18395 - DNA, 20 bp, Artificial Sequence
  Description of Artificial Sequence: Synthetic oligonucleotide
  Target: FXN; (+) strand; PAM type: NRG; PAM sequence: CAG
ctcccagagtgctgggatta

SEQ ID NO: 18396 - DNA, 20 bp, Artificial Sequence
  Description of Artificial Sequence: Synthetic oligonucleotide
  Target: FXN; (+) strand; PAM type: NRG; PAM sequence: AGG
tcccagagtgctgggattac

SEQ ID NO: 18397 - DNA, 20 bp, Artificial Sequence
  Description of Artificial Sequence: Synthetic oligonucleotide
  Target: FXN; (+) strand; PAM type: NRG; PAM sequence: GAG
agtgctgggattacaggcat

SEQ ID NO: 18398 - DNA, 20 bp, Artificial Sequence
  Description of Artificial Sequence: Synthetic oligonucleotide
  Target: FXN; (+) strand; PAM type: NRG; PAM sequence: CGG
caggcatgagctaccacgcc

SEQ ID NO: 18399 - DNA, 20 bp, Artificial Sequence
  Description of Artificial Sequence: Synthetic oligonucleotide
  Target: FXN; (+) strand; PAM type: NRG; PAM sequence: TGG
cggcctttaaatttttactt

SEQ ID NO: 18400 - DNA, 20 bp, Artificial Sequence
  Description of Artificial Sequence: Synthetic oligonucleotide
  Target: FXN; (+) strand; PAM type: NRG; PAM sequence: GGG
ggcctttaaatttttacttt

SEQ ID NO: 18401 - DNA, 20 bp, Artificial Sequence
  Description of Artificial Sequence: Synthetic oligonucleotide
  Target: FXN; (+) strand; PAM type: NRG; PAM sequence: CGG
tttaaatttttactttgggc

SEQ ID NO: 18402 - DNA, 20 bp, Artificial Sequence
  Description of Artificial Sequence: Synthetic oligonucleotide
  Target: FXN; (+) strand; PAM type: NRG; PAM sequence: GGG
ttaaatttttactttgggcc

SEQ ID NO: 18403 - DNA, 20 bp, Artificial Sequence
  Description of Artificial Sequence: Synthetic oligonucleotide
  Target: FXN; (+) strand; PAM type: NRG; PAM sequence: CGG
tttttactttgggccgggca

SEQ ID NO: 18404 - DNA, 20 bp, Artificial Sequence
  Description of Artificial Sequence: Synthetic oligonucleotide
  Target: FXN; (+) strand; PAM type: NRG; PAM sequence: GAG
gcctgtaatcctaacatttc

SEQ ID NO: 18405 - DNA, 20 bp, Artificial Sequence
  Description of Artificial Sequence: Synthetic oligonucleotide
  Target: FXN; (+) strand; PAM type: NRG; PAM sequence: AAG
tgtaatcctaacatttcgag

SEQ ID NO: 18406 - DNA, 20 bp, Artificial Sequence
  Description of Artificial Sequence: Synthetic oligonucleotide
  Target: FXN; (+) strand; PAM type: NRG; PAM sequence: GAG
tcctaacatttcgagaagct

SEQ ID NO: 18407 - DNA, 20 bp, Artificial Sequence
  Description of Artificial Sequence: Synthetic oligonucleotide
  Target: FXN; (+) strand; PAM type: NRG; PAM sequence: AGG
cctaacatttcgagaagctg

SEQ ID NO: 18408 - DNA, 20 bp, Artificial Sequence
  Description of Artificial Sequence: Synthetic oligonucleotide
  Target: FXN; (+) strand; PAM type: NRG; PAM sequence: TGG
tttcgagaagctgaggcacg

SEQ ID NO: 18409 - DNA, 20 bp, Artificial Sequence
  Description of Artificial Sequence: Synthetic oligonucleotide
  Target: FXN; (+) strand; PAM type: NRG; PAM sequence: TGG
cgagaagctgaggcacgtgg

SEQ ID NO: 18410 - DNA, 20 bp, Artificial Sequence
  Description of Artificial Sequence: Synthetic oligonucleotide
  Target: FXN; (+) strand; PAM type: NRG; PAM sequence: GAG
ggtggatcacttgatgtcac

SEQ ID NO: 18411 - DNA, 20 bp, Artificial Sequence
  Description of Artificial Sequence: Synthetic oligonucleotide
  Target: FXN; (+) strand; PAM type: NRG; PAM sequence: CAG
atcacttgatgtcacgagtt

SEQ ID NO: 18412 - DNA, 20 bp, Artificial Sequence
  Description of Artificial Sequence: Synthetic oligonucleotide
  Target: FXN; (+) strand; PAM type: NRG; PAM sequence: CAG
ttgatgtcacgagttcagac

SEQ ID NO: 18413 - DNA, 20 bp, Artificial Sequence
  Description of Artificial Sequence: Synthetic oligonucleotide
  Target: FXN; (+) strand; PAM type: NRG; PAM sequence: CAG
tcagaccagccactgcactc

SEQ ID NO: 18414 - DNA, 20 bp, Artificial Sequence
  Description of Artificial Sequence: Synthetic oligonucleotide
  Target: FXN; (+) strand; PAM type: NRG; PAM sequence: TGG
ccagccactgcactccagcc

SEQ ID NO: 18415 - DNA, 20 bp, Artificial Sequence
  Description of Artificial Sequence: Synthetic oligonucleotide
  Target: FXN; (+) strand; PAM type: NRG; PAM sequence: GGG
cagccactgcactccagcct

SEQ ID NO: 18416 - DNA, 20 bp, Artificial Sequence
  Description of Artificial Sequence: Synthetic oligonucleotide
  Target: FXN; (+) strand; PAM type: NRG; PAM sequence: CAG
ctgcactccagcctgggtga

SEQ ID NO: 18417 - DNA, 20 bp, Artificial Sequence
  Description of Artificial Sequence: Synthetic oligonucleotide
  Target: FXN; (+) strand; PAM type: NRG; PAM sequence: GAG
gcactccagcctgggtgaca

SEQ ID NO: 18418 - DNA, 20 bp, Artificial Sequence
  Description of Artificial Sequence: Synthetic oligonucleotide
  Target: FXN; (+) strand; PAM type: NRG; PAM sequence: GAG
tccagcctgggtgacagagt

SEQ ID NO: 18419 - DNA, 20 bp, Artificial Sequence
  Description of Artificial Sequence: Synthetic oligonucleotide
  Target: FXN; (+) strand; PAM type: NRG; PAM sequence: AAG
tgtctcaaaaaaaaaaaaaa

SEQ ID NO: 18420 - DNA, 20 bp, Artificial Sequence
  Description of Artificial Sequence: Synthetic oligonucleotide
  Target: FXN; (+) strand; PAM type: NRG; PAM sequence: AAG
tcaaaaaaaaaaaaaaaaga

SEQ ID NO: 18421 - DNA, 20 bp, Artificial Sequence
  Description of Artificial Sequence: Synthetic oligonucleotide
  Target: FXN; (+) strand; PAM type: NRG; PAM sequence: TGG
taaatttgatattaataaaa

SEQ ID NO: 18422 - DNA, 20 bp, Artificial Sequence
  Description of Artificial Sequence: Synthetic oligonucleotide
  Target: FXN; (+) strand; PAM type: NRG; PAM sequence: AAG
atttgatattaataaaatgg

SEQ ID NO: 18423 - DNA, 20 bp, Artificial Sequence
  Description of Artificial Sequence: Synthetic oligonucleotide
  Target: FXN; (+) strand; PAM type: NRG; PAM sequence: TGG
attaataaaatggaagcatt

SEQ ID NO: 18424 - DNA, 20 bp, Artificial Sequence
  Description of Artificial Sequence: Synthetic oligonucleotide
  Target: FXN; (+) strand; PAM type: NRG; PAM sequence: TGG
agcatttggtaatcatgttt

SEQ ID NO: 18425 - DNA, 20 bp, Artificial Sequence
  Description of Artificial Sequence: Synthetic oligonucleotide
  Target: FXN; (+) strand; PAM type: NRG; PAM sequence: GGG
gcatttggtaatcatgtttt

SEQ ID NO: 18426 - DNA, 20 bp, Artificial Sequence
  Description of Artificial Sequence: Synthetic oligonucleotide
  Target: FXN; (+) strand; PAM type: NRG; PAM sequence: CAG
tgggttttgtgcttcctctg

SEQ ID NO: 18427 - DNA, 20 bp, Artificial Sequence
  Description of Artificial Sequence: Synthetic oligonucleotide
  Target: FXN; (+) strand; PAM type: NRG; PAM sequence: TAG
gtgcttcctctgcagctctc

SEQ ID NO: 18428 - DNA, 20 bp, Artificial Sequence
  Description of Artificial Sequence: Synthetic oligonucleotide
  Target: FXN; (+) strand; PAM type: NRG; PAM sequence: GAG
tcctctgcagctctctagat

SEQ ID NO: 18429 - DNA, 20 bp, Artificial Sequence
  Description of Artificial Sequence: Synthetic oligonucleotide
  Target: FXN; (+) strand; PAM type: NRG; PAM sequence: AAG
ctagatgagaccacctatga

SEQ ID NO: 18430 - DNA, 20 bp, Artificial Sequence
  Description of Artificial Sequence: Synthetic oligonucleotide
  Target: FXN; (+) strand; PAM type: NRG; PAM sequence: TAG
tgagaccacctatgaaagac

SEQ ID NO: 18431 - DNA, 20 bp, Artificial Sequence
  Description of Artificial Sequence: Synthetic oligonucleotide
  Target: FXN; (+) strand; PAM type: NRG; PAM sequence: CAG
gaccacctatgaaagactag

SEQ ID NO: 18432 - DNA, 20 bp, Artificial Sequence
  Description of Artificial Sequence: Synthetic oligonucleotide
  Target: FXN; (+) strand; PAM type: NRG; PAM sequence: GAG
ccacctatgaaagactagca

SEQ ID NO: 18433 - DNA, 20 bp, Artificial Sequence
  Description of Artificial Sequence: Synthetic oligonucleotide
  Target: FXN; (+) strand; PAM type: NRG; PAM sequence: AGG
cacctatgaaagactagcag

SEQ ID NO: 18434 - DNA, 20 bp, Artificial Sequence
  Description of Artificial Sequence: Synthetic oligonucleotide
  Target: FXN; (+) strand; PAM type: NRG; PAM sequence: TGG
aagactagcagaggaaacgc

SEQ ID NO: 18435 - DNA, 20 bp, Artificial Sequence
  Description of Artificial Sequence: Synthetic oligonucleotide
  Target: FXN; (+) strand; PAM type: NRG; PAM sequence: TAG
agaggaaacgctggactctt

SEQ ID NO: 18436 - DNA, 20 bp, Artificial Sequence
  Description of Artificial Sequence: Synthetic oligonucleotide
  Target: FXN; (+) strand; PAM type: NRG; PAM sequence: CAG
ggaaacgctggactctttag

SEQ ID NO: 18437 - DNA, 20 bp, Artificial Sequence
  Description of Artificial Sequence: Synthetic oligonucleotide
  Target: FXN; (+) strand; PAM type: NRG; PAM sequence: GAG
aaacgctggactctttagca

SEQ ID NO: 18438 - DNA, 20 bp, Artificial Sequence
  Description of Artificial Sequence: Synthetic oligonucleotide
  Target: FXN; (+) strand; PAM type: NRG; PAM sequence: AAG
ctctttagcagagttttttg

SEQ ID NO: 18439 - DNA, 20 bp, Artificial Sequence
  Description of Artificial Sequence: Synthetic oligonucleotide
  Target: FXN; (+) strand; PAM type: NRG; PAM sequence: CAG
agagttttttgaagaccttg

SEQ ID NO: 18440 - DNA, 20 bp, Artificial Sequence
  Description of Artificial Sequence: Synthetic oligonucleotide
  Target: FXN; (+) strand; PAM type: NRG; PAM sequence: AAG
tttttgaagaccttgcagac

SEQ ID NO: 18441 - DNA, 20 bp, Artificial Sequence
  Description of Artificial Sequence: Synthetic oligonucleotide
  Target: FXN; (+) strand; PAM type: NRG; PAM sequence: GAG
cagacaagccatacacgttt

SEQ ID NO: 18442 - DNA, 20 bp, Artificial Sequence
  Description of Artificial Sequence: Synthetic oligonucleotide
  Target: FXN; (+) strand; PAM type: NRG; PAM sequence: AGG
agacaagccatacacgtttg

SEQ ID NO: 18443 - DNA, 20 bp, Artificial Sequence
  Description of Artificial Sequence: Synthetic oligonucleotide
  Target: FXN; (+) strand; PAM type: NRG; PAM sequence: TGG
gaggactatgatgtctcctt

SEQ ID NO: 18444 - DNA, 20 bp, Artificial Sequence
  Description of Artificial Sequence: Synthetic oligonucleotide
  Target: FXN; (+) strand; PAM type: NRG; PAM sequence: GGG
aggactatgatgtctccttt

SEQ ID NO: 18445 - DNA, 20 bp, Artificial Sequence
  Description of Artificial Sequence: Synthetic oligonucleotide
  Target: FXN; (+) strand; PAM type: NRG; PAM sequence: GGG
ggactatgatgtctcctttg

SEQ ID NO: 18446 - DNA, 20 bp, Artificial Sequence
  Description of Artificial Sequence: Synthetic oligonucleotide
  Target: FXN; (+) strand; PAM type: NRG; PAM sequence: AAG
atttttctgtttccccctct

SEQ ID NO: 18447 - DNA, 20 bp, Artificial Sequence
  Description of Artificial Sequence: Synthetic oligonucleotide
  Target: FXN; (+) strand; PAM type: NRG; PAM sequence: TAG
gtttccccctctaagaattt

SEQ ID NO: 18448 - DNA, 20 bp, Artificial Sequence
  Description of Artificial Sequence: Synthetic oligonucleotide
  Target: FXN; (+) strand; PAM type: NRG; PAM sequence: AAG
aattttagttcactaaaatg

SEQ ID NO: 18449 - DNA, 20 bp, Artificial Sequence
  Description of Artificial Sequence: Synthetic oligonucleotide
  Target: FXN; (+) strand; PAM type: NRG; PAM sequence: CAG
taaaatgaagaatttccctc

SEQ ID NO: 18450 - DNA, 20 bp, Artificial Sequence
  Description of Artificial Sequence: Synthetic oligonucleotide
  Target: FXN; (+) strand; PAM type: NRG; PAM sequence: CAG
aatgaagaatttccctccag

SEQ ID NO: 18451 - DNA, 20 bp, Artificial Sequence
  Description of Artificial Sequence: Synthetic oligonucleotide
  Target: FXN; (+) strand; PAM type: NRG; PAM sequence: GAG
tgaagaatttccctccagca

SEQ ID NO: 18452 - DNA, 20 bp, Artificial Sequence
  Description of Artificial Sequence: Synthetic oligonucleotide
  Target: FXN; (+) strand; PAM type: NRG; PAM sequence: AAG
aatttccctccagcagagct

SEQ ID NO: 18453 - DNA, 20 bp, Artificial Sequence
  Description of Artificial Sequence: Synthetic oligonucleotide
  Target: FXN; (+) strand; PAM type: NRG; PAM sequence: AAG
ctccagcagagctaagcatc

SEQ ID NO: 18454 - DNA, 20 bp, Artificial Sequence
  Description of Artificial Sequence: Synthetic oligonucleotide
  Target: FXN; (+) strand; PAM type: NRG; PAM sequence: TAG
cagcagagctaagcatcaag

SEQ ID NO: 18455 - DNA, 20 bp, Artificial Sequence
  Description of Artificial Sequence: Synthetic oligonucleotide
  Target: FXN; (+) strand; PAM type: NRG; PAM sequence: TAG
gctaagcatcaagtagcatg

SEQ ID NO: 18456 - DNA, 20 bp, Artificial Sequence
  Description of Artificial Sequence: Synthetic oligonucleotide
  Target: FXN; (+) strand; PAM type: NRG; PAM sequence: TAG
catcaagtagcatgtagttg

SEQ ID NO: 18457 - DNA, 20 bp, Artificial Sequence
  Description of Artificial Sequence: Synthetic oligonucleotide
  Target: FXN; (+) strand; PAM type: NRG; PAM sequence: AGG
atcaagtagcatgtagttgt

SEQ ID NO: 18458 - DNA, 20 bp, Artificial Sequence
  Description of Artificial Sequence: Synthetic oligonucleotide
  Target: FXN; (+) strand; PAM type: NRG; PAM sequence: TAG
aagtagcatgtagttgtagg

SEQ ID NO: 18459 - DNA, 20 bp, Artificial Sequence
  Description of Artificial Sequence: Synthetic oligonucleotide
  Target: FXN; (+) strand; PAM type: NRG; PAM sequence: AGG
agtagcatgtagttgtaggt

SEQ ID NO: 18460 - DNA, 20 bp, Artificial Sequence
  Description of Artificial Sequence: Synthetic oligonucleotide
  Target: FXN; (+) strand; PAM type: NRG; PAM sequence: AAG
gtagttgtaggtaggattaa

SEQ ID NO: 18461 - DNA, 20 bp, Artificial Sequence
  Description of Artificial Sequence: Synthetic oligonucleotide
  Target: FXN; (+) strand; PAM type: NRG; PAM sequence: TAG
tgtaggtaggattaaaagac

SEQ ID NO: 18462 - DNA, 20 bp, Artificial Sequence
  Description of Artificial Sequence: Synthetic oligonucleotide
  Target: FXN; (+) strand; PAM type: NRG; PAM sequence: AGG
gtaggtaggattaaaagact

SEQ ID NO: 18463 - DNA, 20 bp, Artificial Sequence
  Description of Artificial Sequence: Synthetic oligonucleotide
  Target: FXN; (+) strand; PAM type: NRG; PAM sequence: GGG
taggtaggattaaaagacta

SEQ ID NO: 18464 - DNA, 20 bp, Artificial Sequence
  Description of Artificial Sequence: Synthetic oligonucleotide
  Target: FXN; (+) strand; PAM type: NRG; PAM sequence: CGG
ggattaaaagactagggttc

SEQ ID NO: 18465 - DNA, 20 bp, Artificial Sequence
  Description of Artificial Sequence: Synthetic oligonucleotide
  Target: FXN; (+) strand; PAM type: NRG; PAM sequence: GGG
gattaaaagactagggttcc

SEQ ID NO: 18466 - DNA, 20 bp, Artificial Sequence
  Description of Artificial Sequence: Synthetic oligonucleotide
  Target: FXN; (+) strand; PAM type: NRG; PAM sequence: GAG
ttaaaagactagggttccgg

SEQ ID NO: 18467 - DNA, 20 bp, Artificial Sequence
  Description of Artificial Sequence: Synthetic oligonucleotide
  Target: FXN; (+) strand; PAM type: NRG; PAM sequence: AGG
taaaagactagggttccggg

SEQ ID NO: 18468 - DNA, 20 bp, Artificial Sequence
  Description of Artificial Sequence: Synthetic oligonucleotide
  Target: FXN; (+) strand; PAM type: NRG; PAM sequence: AAG
gactagggttccgggaggtg

SEQ ID NO: 18469 - DNA, 20 bp, Artificial Sequence
  Description of Artificial Sequence: Synthetic oligonucleotide
  Target: FXN; (+) strand; PAM type: NRG; PAM sequence: AGG
actagggttccgggaggtga

SEQ ID NO: 18470 - DNA, 20 bp, Artificial Sequence
  Description of Artificial Sequence: Synthetic oligonucleotide
  Target: FXN; (+) strand; PAM type: NRG; PAM sequence: CAG
gttccgggaggtgaaggttg

SEQ ID NO: 18471 - DNA, 20 bp, Artificial Sequence
  Description of Artificial Sequence: Synthetic oligonucleotide
  Target: FXN; (+) strand; PAM type: NRG; PAM sequence: GAG
cgggaggtgaaggttgcagt

SEQ ID NO: 18472 - DNA, 20 bp, Artificial Sequence
  Description of Artificial Sequence: Synthetic oligonucleotide
  Target: FXN; (+) strand; PAM type: NRG; PAM sequence: CAG
aaaatcacgccactgcactc

SEQ ID NO: 18473 - DNA, 20 bp, Artificial Sequence
  Description of Artificial Sequence: Synthetic oligonucleotide
  Target: FXN; (+) strand; PAM type: NRG; PAM sequence: TGG
cacgccactgcactccagcc

SEQ ID NO: 18474 - DNA, 20 bp, Artificial Sequence
  Description of Artificial Sequence: Synthetic oligonucleotide
  Target: FXN; (+) strand; PAM type: NRG; PAM sequence: GGG
acgccactgcactccagcct

SEQ ID NO: 18475 - DNA, 20 bp, Artificial Sequence
  Description of Artificial Sequence: Synthetic oligonucleotide
  Target: FXN; (+) strand; PAM type: NRG; PAM sequence: CAG
ctgcactccagcctgggtga

SEQ ID NO: 18476 - DNA, 20 bp, Artificial Sequence
  Description of Artificial Sequence: Synthetic oligonucleotide
  Target: FXN; (+) strand; PAM type: NRG; PAM sequence: GAG
gcactccagcctgggtgaca

SEQ ID NO: 18477 - DNA, 20 bp, Artificial Sequence
  Description of Artificial Sequence: Synthetic oligonucleotide
  Target: FXN; (+) strand; PAM type: NRG; PAM sequence: GAG
tccagcctgggtgacagagc

SEQ ID NO: 18478 - DNA, 20 bp, Artificial Sequence
  Description of Artificial Sequence: Synthetic oligonucleotide
  Target: FXN; (+) strand; PAM type: NRG; PAM sequence: TAG
gacagagcgagactctgtca

SEQ ID NO: 18479 - DNA, 20 bp, Artificial Sequence
  Description of Artificial Sequence: Synthetic oligonucleotide
  Target: FXN; (+) strand; PAM type: NRG; PAM sequence: TGG
gagcgagactctgtcataga

SEQ ID NO: 18480 - DNA, 20 bp, Artificial Sequence
  Description of Artificial Sequence: Synthetic oligonucleotide
  Target: FXN; (+) strand; PAM type: NRG; PAM sequence: TGG
gagactctgtcatagatgga

SEQ ID NO: 18481 - DNA, 20 bp, Artificial Sequence
  Description of Artificial Sequence: Synthetic oligonucleotide
  Target: FXN; (+) strand; PAM type: NRG; PAM sequence: TGG
ctctgtcatagatggatgga

SEQ ID NO: 18482 - DNA, 20 bp, Artificial Sequence
  Description of Artificial Sequence: Synthetic oligonucleotide
  Target: FXN; (+) strand; PAM type: NRG; PAM sequence: TGG
gtcatagatggatggatgga

SEQ ID NO: 18483 - DNA, 20 bp, Artificial Sequence
  Description of Artificial Sequence: Synthetic oligonucleotide
  Target: FXN; (+) strand; PAM type: NRG; PAM sequence: TGG
tagatggatggatggatgga

SEQ ID NO: 18484 - DNA, 20 bp, Artificial Sequence
  Description of Artificial Sequence: Synthetic oligonucleotide
  Target: FXN; (+) strand; PAM type: NRG; PAM sequence: TGG
tggatggatggatggatgga

SEQ ID NO: 18485 - DNA, 20 bp, Artificial Sequence
  Description of Artificial Sequence: Synthetic oligonucleotide
  Target: FXN; (+) strand; PAM type: NRG; PAM sequence: TGG
tggatggatggatggatgga

SEQ ID NO: 18486 - DNA, 20 bp, Artificial Sequence
  Description of Artificial Sequence: Synthetic oligonucleotide
  Target: FXN; (+) strand; PAM type: NRG; PAM sequence: TGG
tggatggatggatggatgga

SEQ ID NO: 18487 - DNA, 20 bp, Artificial Sequence
  Description of Artificial Sequence: Synthetic oligonucleotide
  Target: FXN; (+) strand; PAM type: NRG; PAM sequence: TGG
tggatggatggatggatgga

SEQ ID NO: 18488 - DNA, 20 bp, Artificial Sequence
  Description of Artificial Sequence: Synthetic oligonucleotide
  Target: FXN; (+) strand; PAM type: NRG; PAM sequence: TAG
tggatggatggatggatgga

SEQ ID NO: 18489 - DNA, 20 bp, Artificial Sequence
  Description of Artificial Sequence: Synthetic oligonucleotide
  Target: FXN; (+) strand; PAM type: NRG; PAM sequence: TAG
tggatggatggatggataga

SEQ ID NO: 18490 - DNA, 20 bp, Artificial Sequence
  Description of Artificial Sequence: Synthetic oligonucleotide
  Target: FXN; (+) strand; PAM type: NRG; PAM sequence: TAG
tggatggatggatagataga

SEQ ID NO: 18491 - DNA, 20 bp, Artificial Sequence
  Description of Artificial Sequence: Synthetic oligonucleotide
  Target: FXN; (+) strand; PAM type: NRG; PAM sequence: TAG
tggatggatagatagataga

SEQ ID NO: 18492 - DNA, 20 bp, Artificial Sequence
  Description of Artificial Sequence: Synthetic oligonucleotide
  Target: FXN; (+) strand; PAM type: NRG; PAM sequence: TAG
tggatagatagatagataga

SEQ ID NO: 18493 - DNA, 20 bp, Artificial Sequence
  Description of Artificial Sequence: Synthetic oligonucleotide
  Target: FXN; (+) strand; PAM type: NRG; PAM sequence: TAG
tagatagatagatagataga

SEQ ID NO: 18494 - DNA, 20 bp, Artificial Sequence
  Description of Artificial Sequence: Synthetic oligonucleotide
  Target: FXN; (+) strand; PAM type: NRG; PAM sequence: TAG
tagatagatagatagataga

SEQ ID NO: 18495 - DNA, 20 bp, Artificial Sequence
  Description of Artificial Sequence: Synthetic oligonucleotide
  Target: FXN; (+) strand; PAM type: NRG; PAM sequence: TGG
tagatagatagatagatagc

SEQ ID NO: 18496 - DNA, 20 bp, Artificial Sequence
  Description of Artificial Sequence: Synthetic oligonucleotide
  Target: FXN; (+) strand; PAM type: NRG; PAM sequence: TAG
tagatagatagatagctgga

SEQ ID NO: 18497 - DNA, 20 bp, Artificial Sequence
  Description of Artificial Sequence: Synthetic oligonucleotide
  Target: FXN; (+) strand; PAM type: NRG; PAM sequence: TAG
tagatagatagctggataga

SEQ ID NO: 18498 - DNA, 20 bp, Artificial Sequence
  Description of Artificial Sequence: Synthetic oligonucleotide
  Target: FXN; (+) strand; PAM type: NRG; PAM sequence: AAG
agatagctggatagatagat

SEQ ID NO: 18499 - DNA, 20 bp, Artificial Sequence
  Description of Artificial Sequence: Synthetic oligonucleotide
  Target: FXN; (+) strand; PAM type: NRG; PAM sequence: TAG
agctggatagatagataaga

SEQ ID NO: 18500 - DNA, 20 bp, Artificial Sequence
  Description of Artificial Sequence: Synthetic oligonucleotide
  Target: FXN; (+) strand; PAM type: NRG; PAM sequence: AAG
gatagatagataagatagat

SEQ ID NO: 18501 - DNA, 20 bp, Artificial Sequence
  Description of Artificial Sequence: Synthetic oligonucleotide
  Target: FXN; (+) strand; PAM type: NRG; PAM sequence: AAG
atagataagatagataagac

SEQ ID NO: 18502 - DNA, 20 bp, Artificial Sequence
  Description of Artificial Sequence: Synthetic oligonucleotide
  Target: FXN; (+) strand; PAM type: NRG; PAM sequence: TAG
taagatagataagacaagac

SEQ ID NO: 18503 - DNA, 20 bp, Artificial Sequence
  Description of Artificial Sequence: Synthetic oligonucleotide
  Target: FXN; (+) strand; PAM type: NRG; PAM sequence: AGG
aagatagataagacaagact

SEQ ID NO: 18504 - DNA, 20 bp, Artificial Sequence
  Description of Artificial Sequence: Synthetic oligonucleotide
  Target: FXN; (+) strand; PAM type: NRG; PAM sequence: AAG
ataagacaagactaggcttc

SEQ ID NO: 18505 - DNA, 20 bp, Artificial Sequence
  Description of Artificial Sequence: Synthetic oligonucleotide
  Target: FXN; (+) strand; PAM type: NRG; PAM sequence: CAG
caagactaggcttcaagctg

SEQ ID NO: 18506 - DNA, 20 bp, Artificial Sequence
  Description of Artificial Sequence: Synthetic oligonucleotide
  Target: FXN; (+) strand; PAM type: NRG; PAM sequence: CAG
ctaggcttcaagctgcagtc

SEQ ID NO: 18507 - DNA, 20 bp, Artificial Sequence
  Description of Artificial Sequence: Synthetic oligonucleotide
  Target: FXN; (+) strand; PAM type: NRG; PAM sequence: CAG
aagctgcagtccagctctac

SEQ ID NO: 18508 - DNA, 20 bp, Artificial Sequence
  Description of Artificial Sequence: Synthetic oligonucleotide
  Target: FXN; (+) strand; PAM type: NRG; PAM sequence: AGG
agctgcagtccagctctacc

SEQ ID NO: 18509 - DNA, 20 bp, Artificial Sequence
  Description of Artificial Sequence: Synthetic oligonucleotide
  Target: FXN; (+) strand; PAM type: NRG; PAM sequence: TGG
taccaggcttgttgtgactc

SEQ ID NO: 18510 - DNA, 20 bp, Artificial Sequence
  Description of Artificial Sequence: Synthetic oligonucleotide
  Target: FXN; (+) strand; PAM type: NRG; PAM sequence: GGG
accaggcttgttgtgactct

SEQ ID NO: 18511 - DNA, 20 bp, Artificial Sequence
  Description of Artificial Sequence: Synthetic oligonucleotide
  Target: FXN; (+) strand; PAM type: NRG; PAM sequence: AAG
ggcttgttgtgactctgggc

SEQ ID NO: 18512 - DNA, 20 bp, Artificial Sequence
  Description of Artificial Sequence: Synthetic oligonucleotide
  Target: FXN; (+) strand; PAM type: NRG; PAM sequence: CAG
gtgactctgggcaagtcact

SEQ ID NO: 18513 - DNA, 20 bp, Artificial Sequence
  Description of Artificial Sequence: Synthetic oligonucleotide
  Target: FXN; (+) strand; PAM type: NRG; PAM sequence: GAG
gcaagtcactcagcctctct

SEQ ID NO: 18514 - DNA, 20 bp, Artificial Sequence
  Description of Artificial Sequence: Synthetic oligonucleotide
  Target: FXN; (+) strand; PAM type: NRG; PAM sequence: CAG
cctctctgagcctcattttc

SEQ ID NO: 18515 - DNA, 20 bp, Artificial Sequence
  Description of Artificial Sequence: Synthetic oligonucleotide
  Target: FXN; (+) strand; PAM type: NRG; PAM sequence: CAG
tgagcctcattttccagctt

SEQ ID NO: 18516 - DNA, 20 bp, Artificial Sequence
  Description of Artificial Sequence: Synthetic oligonucleotide
  Target: FXN; (+) strand; PAM type: NRG; PAM sequence: TGG
gcctcattttccagcttcag

SEQ ID NO: 18517 - DNA, 20 bp, Artificial Sequence
  Description of Artificial Sequence: Synthetic oligonucleotide
  Target: FXN; (+) strand; PAM type: NRG; PAM sequence: AAG
agcttcagtggatacccatg

SEQ ID NO: 18518 - DNA, 20 bp, Artificial Sequence
  Description of Artificial Sequence: Synthetic oligonucleotide
  Target: FXN; (+) strand; PAM type: NRG; PAM sequence: AGG
gcttcagtggatacccatga

SEQ ID NO: 18519 - DNA, 20 bp, Artificial Sequence
  Description of Artificial Sequence: Synthetic oligonucleotide
  Target: FXN; (+) strand; PAM type: NRG; PAM sequence: CAG
ggatacccatgaaggcaaat

SEQ ID NO: 18520 - DNA, 20 bp, Artificial Sequence
  Description of Artificial Sequence: Synthetic oligonucleotide
  Target: FXN; (+) strand; PAM type: NRG; PAM sequence: GAG
atacccatgaaggcaaatca

SEQ ID NO: 18521 - DNA, 20 bp, Artificial Sequence
  Description of Artificial Sequence: Synthetic oligonucleotide
  Target: FXN; (+) strand; PAM type: NRG; PAM sequence: GAG
acccatgaaggcaaatcaga

SEQ ID NO: 18522 - DNA, 20 bp, Artificial Sequence
  Description of Artificial Sequence: Synthetic oligonucleotide
  Target: FXN; (+) strand; PAM type: NRG; PAM sequence: AGG
cccatgaaggcaaatcagag

SEQ ID NO: 18523 - DNA, 20 bp, Artificial Sequence
  Description of Artificial Sequence: Synthetic oligonucleotide
  Target: FXN; (+) strand; PAM type: NRG; PAM sequence: GGG
ccatgaaggcaaatcagaga

SEQ ID NO: 18524 - DNA, 20 bp, Artificial Sequence
  Description of Artificial Sequence: Synthetic oligonucleotide
  Target: FXN; (+) strand; PAM type: NRG; PAM sequence: GGG
catgaaggcaaatcagagag

SEQ ID NO: 18525 - DNA, 20 bp, Artificial Sequence
  Description of Artificial Sequence: Synthetic oligonucleotide
  Target: FXN; (+) strand; PAM type: NRG; PAM sequence: GAG
ggcaaatcagagaggggcct

SEQ ID NO: 18526 - DNA, 20 bp, Artificial Sequence
  Description of Artificial Sequence: Synthetic oligonucleotide
  Target: FXN; (+) strand; PAM type: NRG; PAM sequence: CAG
ggcctgagtgtgtatttgtc

SEQ ID NO: 18527 - DNA, 20 bp, Artificial Sequence
  Description of Artificial Sequence: Synthetic oligonucleotide
  Target: FXN; (+) strand; PAM type: NRG; PAM sequence: CAG
ctgagtgtgtatttgtccag

SEQ ID NO: 18528 - DNA, 20 bp, Artificial Sequence
  Description of Artificial Sequence: Synthetic oligonucleotide
  Target: FXN; (+) strand; PAM type: NRG; PAM sequence: AGG
tgagtgtgtatttgtccagc

SEQ ID NO: 18529 - DNA, 20 bp, Artificial Sequence
  Description of Artificial Sequence: Synthetic oligonucleotide
  Target: FXN; (+) strand; PAM type: NRG; PAM sequence: CAG
gtgtgtatttgtccagcagg

SEQ ID NO: 18530 - DNA, 20 bp, Artificial Sequence
  Description of Artificial Sequence: Synthetic oligonucleotide
  Target: FXN; (+) strand; PAM type: NRG; PAM sequence: TGG
gtatttgtccagcaggcaga

SEQ ID NO: 18531 - DNA, 20 bp, Artificial Sequence
  Description of Artificial Sequence: Synthetic oligonucleotide
  Target: FXN; (+) strand; PAM type: NRG; PAM sequence: GAG
atttgtccagcaggcagatg

SEQ ID NO: 18532 - DNA, 20 bp, Artificial Sequence
  Description of Artificial Sequence: Synthetic oligonucleotide
  Target: FXN; (+) strand; PAM type: NRG; PAM sequence: AGG
tttgtccagcaggcagatgg

SEQ ID NO: 18533 - DNA, 20 bp, Artificial Sequence
  Description of Artificial Sequence: Synthetic oligonucleotide
  Target: FXN; (+) strand; PAM type: NRG; PAM sequence: GGG
ttgtccagcaggcagatgga

SEQ ID NO: 18534 - DNA, 20 bp, Artificial Sequence
  Description of Artificial Sequence: Synthetic oligonucleotide
  Target: FXN; (+) strand; PAM type: NRG; PAM sequence: TAG
agatggagggaacaacaaac

SEQ ID NO: 18535 - DNA, 20 bp, Artificial Sequence
  Description of Artificial Sequence: Synthetic oligonucleotide
  Target: FXN; (+) strand; PAM type: NRG; PAM sequence: TAG
ggaacaacaaactagacccg

SEQ ID NO: 18536 - DNA, 20 bp, Artificial Sequence
  Description of Artificial Sequence: Synthetic oligonucleotide
  Target: FXN; (+) strand; PAM type: NRG; PAM sequence: CAG
aaactagacccgtagttctt

SEQ ID NO: 18537 - DNA, 20 bp, Artificial Sequence
  Description of Artificial Sequence: Synthetic oligonucleotide
  Target: FXN; (+) strand; PAM type: NRG; PAM sequence: TAG
ctagacccgtagttcttcag

SEQ ID NO: 18538 - DNA, 20 bp, Artificial Sequence
  Description of Artificial Sequence: Synthetic oligonucleotide
  Target: FXN; (+) strand; PAM type: NRG; PAM sequence: AGG
tagacccgtagttcttcagt

SEQ ID NO: 18539 - DNA, 20 bp, Artificial Sequence
  Description of Artificial Sequence: Synthetic oligonucleotide
  Target: FXN; (+) strand; PAM type: NRG; PAM sequence: GGG
agacccgtagttcttcagta

SEQ ID NO: 18540 - DNA, 20 bp, Artificial Sequence
  Description of Artificial Sequence: Synthetic oligonucleotide
  Target: FXN; (+) strand; PAM type: NRG; PAM sequence: AAG
cgtagttcttcagtagggat

SEQ ID NO: 18541 - DNA, 20 bp, Artificial Sequence
  Description of Artificial Sequence: Synthetic oligonucleotide
  Target: FXN; (+) strand; PAM type: NRG; PAM sequence: AAG
gggataagataactgcccaa

SEQ ID NO: 18542 - DNA, 20 bp, Artificial Sequence
  Description of Artificial Sequence: Synthetic oligonucleotide
  Target: FXN; (+) strand; PAM type: NRG; PAM sequence: TAG
ataactgcccaaaagttatt

SEQ ID NO: 18543 - DNA, 20 bp, Artificial Sequence
  Description of Artificial Sequence: Synthetic oligonucleotide
  Target: FXN; (+) strand; PAM type: NRG; PAM sequence: AAG
caaaagttatttagattaca

SEQ ID NO: 18544 - DNA, 20 bp, Artificial Sequence
  Description of Artificial Sequence: Synthetic oligonucleotide
  Target: FXN; (+) strand; PAM type: NRG; PAM sequence: GAG
tatttagattacaaagactt

SEQ ID NO: 18545 - DNA, 20 bp, Artificial Sequence
  Description of Artificial Sequence: Synthetic oligonucleotide
  Target: FXN; (+) strand; PAM type: NRG; PAM sequence: GAG
gacttgagccctgctcctgt

SEQ ID NO: 18546 - DNA, 20 bp, Artificial Sequence
  Description of Artificial Sequence: Synthetic oligonucleotide
  Target: FXN; (+) strand; PAM type: NRG; PAM sequence: CAG
tgagccctgctcctgtgaga

SEQ ID NO: 18547 - DNA, 20 bp, Artificial Sequence
  Description of Artificial Sequence: Synthetic oligonucleotide
  Target: FXN; (+) strand; PAM type: NRG; PAM sequence: TGG
ctgctcctgtgagacagtga

SEQ ID NO: 18548 - DNA, 20 bp, Artificial Sequence
  Description of Artificial Sequence: Synthetic oligonucleotide
  Target: FXN; (+) strand; PAM type: NRG; PAM sequence: GGG
tgctcctgtgagacagtgat

SEQ ID NO: 18549 - DNA, 20 bp, Artificial Sequence
  Description of Artificial Sequence: Synthetic oligonucleotide
  Target: FXN; (+) strand; PAM type: NRG; PAM sequence: GGG
gctcctgtgagacagtgatg

SEQ ID NO: 18550 - DNA, 20 bp, Artificial Sequence
  Description of Artificial Sequence: Synthetic oligonucleotide
  Target: FXN; (+) strand; PAM type: NRG; PAM sequence: TAG
cctgtgagacagtgatgggg

SEQ ID NO: 18551 - DNA, 20 bp, Artificial Sequence
  Description of Artificial Sequence: Synthetic oligonucleotide
  Target: FXN; (+) strand; PAM type: NRG; PAM sequence: AGG
ctgtgagacagtgatggggt

SEQ ID NO: 18552 - DNA, 20 bp, Artificial Sequence
  Description of Artificial Sequence: Synthetic oligonucleotide
  Target: FXN; (+) strand; PAM type: NRG; PAM sequence: CGG
gagacagtgatggggtaggt

SEQ ID NO: 18553 - DNA, 20 bp, Artificial Sequence
  Description of Artificial Sequence: Synthetic oligonucleotide
  Target: FXN; (+) strand; PAM type: NRG; PAM sequence: GGG
agacagtgatggggtaggtc

SEQ ID NO: 18554 - DNA, 20 bp, Artificial Sequence
  Description of Artificial Sequence: Synthetic oligonucleotide
  Target: FXN; (+) strand; PAM type: NRG; PAM sequence: TGG
gggtaggtcgggtgcattcc

SEQ ID NO: 18555 - DNA, 20 bp, Artificial Sequence
  Description of Artificial Sequence: Synthetic oligonucleotide
  Target: FXN; (+) strand; PAM type: NRG; PAM sequence: GGG
ggtaggtcgggtgcattcct

SEQ ID NO: 18556 - DNA, 20 bp, Artificial Sequence
  Description of Artificial Sequence: Synthetic oligonucleotide
  Target: FXN; (+) strand; PAM type: NRG; PAM sequence: AAG
aggtcgggtgcattcctggg

SEQ ID NO: 18557 - DNA, 20 bp, Artificial Sequence
  Description of Artificial Sequence: Synthetic oligonucleotide
  Target: FXN; (+) strand; PAM type: NRG; PAM sequence: AAG
ctgggaagcatatttttgaa

SEQ ID NO: 18558 - DNA, 20 bp, Artificial Sequence
  Description of Artificial Sequence: Synthetic oligonucleotide
  Target: FXN; (+) strand; PAM type: NRG; PAM sequence: TGG
atatttttgaaaagctcacc

SEQ ID NO: 18559 - DNA, 20 bp, Artificial Sequence
  Description of Artificial Sequence: Synthetic oligonucleotide
  Target: FXN; (+) strand; PAM type: NRG; PAM sequence: GGG
tatttttgaaaagctcacct

SEQ ID NO: 18560 - DNA, 20 bp, Artificial Sequence
  Description of Artificial Sequence: Synthetic oligonucleotide
  Target: FXN; (+) strand; PAM type: NRG; PAM sequence: TAG
gggattctaatgtgtatccc

SEQ ID NO: 18561 - DNA, 20 bp, Artificial Sequence
  Description of Artificial Sequence: Synthetic oligonucleotide
  Target: FXN; (+) strand; PAM type: NRG; PAM sequence: AGG
ggattctaatgtgtatccct

SEQ ID NO: 18562 - DNA, 20 bp, Artificial Sequence
  Description of Artificial Sequence: Synthetic oligonucleotide
  Target: FXN; (+) strand; PAM type: NRG; PAM sequence: TAG
gtatccctaggtcttattcc

SEQ ID NO: 18563 - DNA, 20 bp, Artificial Sequence
  Description of Artificial Sequence: Synthetic oligonucleotide
  Target: FXN; (+) strand; PAM type: NRG; PAM sequence: GAG
atccctaggtcttattccta

SEQ ID NO: 18564 - DNA, 20 bp, Artificial Sequence
  Description of Artificial Sequence: Synthetic oligonucleotide
  Target: FXN; (+) strand; PAM type: NRG; PAM sequence: TGG
tcctagagattttgattact

SEQ ID NO: 18565 - DNA, 20 bp, Artificial Sequence
  Description of Artificial Sequence: Synthetic oligonucleotide
  Target: FXN; (+) strand; PAM type: NRG; PAM sequence: TGG
gagattttgattacttggtc

SEQ ID NO: 18566 - DNA, 20 bp, Artificial Sequence
  Description of Artificial Sequence: Synthetic oligonucleotide
  Target: FXN; (+) strand; PAM type: NRG; PAM sequence: GGG
agattttgattacttggtct

SEQ ID NO: 18567 - DNA, 20 bp, Artificial Sequence
  Description of Artificial Sequence: Synthetic oligonucleotide
  Target: FXN; (+) strand; PAM type: NRG; PAM sequence: GGG
gattttgattacttggtctg

SEQ ID NO: 18568 - DNA, 20 bp, Artificial Sequence
  Description of Artificial Sequence: Synthetic oligonucleotide
  Target: FXN; (+) strand; PAM type: NRG; PAM sequence: TGG
tgattacttggtctggggtg

SEQ ID NO: 18569 - DNA, 20 bp, Artificial Sequence
  Description of Artificial Sequence: Synthetic oligonucleotide
  Target: FXN; (+) strand; PAM type: NRG; PAM sequence: TGG
gtctggggtgtggcatgacc

SEQ ID NO: 18570 - DNA, 20 bp, Artificial Sequence
  Description of Artificial Sequence: Synthetic oligonucleotide
  Target: FXN; (+) strand; PAM type: NRG; PAM sequence: GGG
tctggggtgtggcatgacct

SEQ ID NO: 18571 - DNA, 20 bp, Artificial Sequence
  Description of Artificial Sequence: Synthetic oligonucleotide
  Target: FXN; (+) strand; PAM type: NRG; PAM sequence: CAG
ggggtgtggcatgacctggg

SEQ ID NO: 18572 - DNA, 20 bp, Artificial Sequence
  Description of Artificial Sequence: Synthetic oligonucleotide
  Target: FXN; (+) strand; PAM type: NRG; PAM sequence: AGG
gggtgtggcatgacctgggc

SEQ ID NO: 18573 - DNA, 20 bp, Artificial Sequence
  Description of Artificial Sequence: Synthetic oligonucleotide
  Target: FXN; (+) strand; PAM type: NRG; PAM sequence: GGG
ggtgtggcatgacctgggca

SEQ ID NO: 18574 - DNA, 20 bp, Artificial Sequence
  Description of Artificial Sequence: Synthetic oligonucleotide
  Target: FXN; (+) strand; PAM type: NRG; PAM sequence: TGG
gcatgacctgggcagggcac

SEQ ID NO: 18575 - DNA, 20 bp, Artificial Sequence
  Description of Artificial Sequence: Synthetic oligonucleotide
  Target: FXN; (+) strand; PAM type: NRG; PAM sequence: GGG
catgacctgggcagggcact

SEQ ID NO: 18576 - DNA, 20 bp, Artificial Sequence
  Description of Artificial Sequence: Synthetic oligonucleotide
  Target: FXN; (+) strand; PAM type: NRG; PAM sequence: AAG
ggcagggcactgggattttt

SEQ ID NO: 18577 - DNA, 20 bp, Artificial Sequence
  Description of Artificial Sequence: Synthetic oligonucleotide
  Target: FXN; (+) strand; PAM type: NRG; PAM sequence: CAG
actgggatttttaagctcca

SEQ ID NO: 18578 - DNA, 20 bp, Artificial Sequence
  Description of Artificial Sequence: Synthetic oligonucleotide
  Target: FXN; (+) strand; PAM type: NRG; PAM sequence: CAG
ccacagatgattccaatatg

SEQ ID NO: 18579 - DNA, 20 bp, Artificial Sequence
  Description of Artificial Sequence: Synthetic oligonucleotide
  Target: FXN; (+) strand; PAM type: NRG; PAM sequence: TAG
agatgattccaatatgcagc

SEQ ID NO: 18580 - DNA, 20 bp, Artificial Sequence
  Description of Artificial Sequence: Synthetic oligonucleotide
  Target: FXN; (+) strand; PAM type: NRG; PAM sequence: GAG
ttccaatatgcagctagtat

SEQ ID NO: 18581 - DNA, 20 bp, Artificial Sequence
  Description of Artificial Sequence: Synthetic oligonucleotide
  Target: FXN; (+) strand; PAM type: NRG; PAM sequence: AAG
tgagaacttgtttttttttg

SEQ ID NO: 18582 - DNA, 20 bp, Artificial Sequence
  Description of Artificial Sequence: Synthetic oligonucleotide
  Target: FXN; (+) strand; PAM type: NRG; PAM sequence: AGG
gagaacttgtttttttttga

SEQ ID NO: 18583 - DNA, 20 bp, Artificial Sequence
  Description of Artificial Sequence: Synthetic oligonucleotide
  Target: FXN; (+) strand; PAM type: NRG; PAM sequence: GAG
gaacttgtttttttttgaag

SEQ ID NO: 18584 - DNA, 20 bp, Artificial Sequence
  Description of Artificial Sequence: Synthetic oligonucleotide
  Target: FXN; (+) strand; PAM type: NRG; PAM sequence: CAG
aggagtctcactctgtcacc

SEQ ID NO: 18585 - DNA, 20 bp, Artificial Sequence
  Description of Artificial Sequence: Synthetic oligonucleotide
  Target: FXN; (+) strand; PAM type: NRG; PAM sequence: AGG
ggagtctcactctgtcaccc

SEQ ID NO: 18586 - DNA, 20 bp, Artificial Sequence
  Description of Artificial Sequence: Synthetic oligonucleotide
  Target: FXN; (+) strand; PAM type: NRG; PAM sequence: TGG
tctcactctgtcacccaggc

SEQ ID NO: 18587 - DNA, 20 bp, Artificial Sequence
  Description of Artificial Sequence: Synthetic oligonucleotide
  Target: FXN; (+) strand; PAM type: NRG; PAM sequence: GAG
tcactctgtcacccaggctg

SEQ ID NO: 18588 - DNA, 20 bp, Artificial Sequence
  Description of Artificial Sequence: Synthetic oligonucleotide
  Target: FXN; (+) strand; PAM type: NRG; PAM sequence: CAG
ctgtcacccaggctggagtg

SEQ ID NO: 18589 - DNA, 20 bp, Artificial Sequence
  Description of Artificial Sequence: Synthetic oligonucleotide
  Target: FXN; (+) strand; PAM type: NRG; PAM sequence: TGG
tcacccaggctggagtgcag

SEQ ID NO: 18590 - DNA, 20 bp, Artificial Sequence
  Description of Artificial Sequence: Synthetic oligonucleotide
  Target: FXN; (+) strand; PAM type: NRG; PAM sequence: CGG
ggagtgcagtggcgcaatct

SEQ ID NO: 18591 - DNA, 20 bp, Artificial Sequence
  Description of Artificial Sequence: Synthetic oligonucleotide
  Target: FXN; (+) strand; PAM type: NRG; PAM sequence: TGG
cggctcactgctccgcttcc

SEQ ID NO: 18592 - DNA, 20 bp, Artificial Sequence
  Description of Artificial Sequence: Synthetic oligonucleotide
  Target: FXN; (+) strand; PAM type: NRG; PAM sequence: GGG
ggctcactgctccgcttcct

SEQ ID NO: 18593 - DNA, 20 bp, Artificial Sequence
  Description of Artificial Sequence: Synthetic oligonucleotide
  Target: FXN; (+) strand; PAM type: NRG; PAM sequence: AAG
ctgctccgcttcctgggttc

SEQ ID NO: 18594 - DNA, 20 bp, Artificial Sequence
  Description of Artificial Sequence: Synthetic oligonucleotide
  Target: FXN; (+) strand; PAM type: NRG; PAM sequence: CAG
ctccgcttcctgggttcaag

SEQ ID NO: 18595 - DNA, 20 bp, Artificial Sequence
  Description of Artificial Sequence: Synthetic oligonucleotide
  Target: FXN; (+) strand; PAM type: NRG; PAM sequence: CAG
ttcaagcagttctcctgcct

SEQ ID NO: 18596 - DNA, 20 bp, Artificial Sequence
  Description of Artificial Sequence: Synthetic oligonucleotide
  Target: FXN; (+) strand; PAM type: NRG; PAM sequence: GAG
ttctcctgcctcagcctccc

SEQ ID NO: 18597 - DNA, 20 bp, Artificial Sequence
  Description of Artificial Sequence: Synthetic oligonucleotide
  Target: FXN; (+) strand; PAM type: NRG; PAM sequence: TAG
tcctgcctcagcctcccgag

SEQ ID NO: 18598 - DNA, 20 bp, Artificial Sequence
  Description of Artificial Sequence: Synthetic oligonucleotide
  Target: FXN; (+) strand; PAM type: NRG; PAM sequence: TGG
gcctcagcctcccgagtagc

SEQ ID NO: 18599 - DNA, 20 bp, Artificial Sequence
  Description of Artificial Sequence: Synthetic oligonucleotide
  Target: FXN; (+) strand; PAM type: NRG; PAM sequence: GGG
cctcagcctcccgagtagct

SEQ ID NO: 18600 - DNA, 20 bp, Artificial Sequence
  Description of Artificial Sequence: Synthetic oligonucleotide
  Target: FXN; (+) strand; PAM type: NRG; PAM sequence: TAG
ctcccgagtagctgggatta

SEQ ID NO: 18601 - DNA, 20 bp, Artificial Sequence
  Description of Artificial Sequence: Synthetic oligonucleotide
  Target: FXN; (+) strand; PAM type: NRG; PAM sequence: AGG
tcccgagtagctgggattat

SEQ ID NO: 18602 - DNA, 20 bp, Artificial Sequence
  Description of Artificial Sequence: Synthetic oligonucleotide
  Target: FXN; (+) strand; PAM type: NRG; PAM sequence: CAG
taggcatctgccaccatgcc

SEQ ID NO: 18603 - DNA, 20 bp, Artificial Sequence
  Description of Artificial Sequence: Synthetic oligonucleotide
  Target: FXN; (+) strand; PAM type: NRG; PAM sequence: TAG
cccagctaatttttgcattt

SEQ ID NO: 18604 - DNA, 20 bp, Artificial Sequence
  Description of Artificial Sequence: Synthetic oligonucleotide
  Target: FXN; (+) strand; PAM type: NRG; PAM sequence: AAG
ctaatttttgcattttagta

SEQ ID NO: 18605 - DNA, 20 bp, Artificial Sequence
  Description of Artificial Sequence: Synthetic oligonucleotide
  Target: FXN; (+) strand; PAM type: NRG; PAM sequence: CGG
tttttgcattttagtaaaga

SEQ ID NO: 18606 - DNA, 20 bp, Artificial Sequence
  Description of Artificial Sequence: Synthetic oligonucleotide
  Target: FXN; (+) strand; PAM type: NRG; PAM sequence: GGG
ttttgcattttagtaaagac

SEQ ID NO: 18607 - DNA, 20 bp, Artificial Sequence
  Description of Artificial Sequence: Synthetic oligonucleotide
  Target: FXN; (+) strand; PAM type: NRG; PAM sequence: GGG
tttgcattttagtaaagacg

SEQ ID NO: 18608 - DNA, 20 bp, Artificial Sequence
  Description of Artificial Sequence: Synthetic oligonucleotide
  Target: FXN; (+) strand; PAM type: NRG; PAM sequence: TGG
aagacggggtttcaccatgt

SEQ ID NO: 18609 - DNA, 20 bp, Artificial Sequence
  Description of Artificial Sequence: Synthetic oligonucleotide
  Target: FXN; (+) strand; PAM type: NRG; PAM sequence: TAG
cggggtttcaccatgttggt

SEQ ID NO: 18610 - DNA, 20 bp, Artificial Sequence
  Description of Artificial Sequence: Synthetic oligonucleotide
  Target: FXN; (+) strand; PAM type: NRG; PAM sequence: AGG
ggggtttcaccatgttggtt

SEQ ID NO: 18611 - DNA, 20 bp, Artificial Sequence
  Description of Artificial Sequence: Synthetic oligonucleotide
  Target: FXN; (+) strand; PAM type: NRG; PAM sequence: TGG
tttcaccatgttggttaggc

SEQ ID NO: 18612 - DNA, 20 bp, Artificial Sequence
  Description of Artificial Sequence: Synthetic oligonucleotide
  Target: FXN; (+) strand; PAM type: NRG; PAM sequence: TGG
ctcgatctcctgacctcaaa

SEQ ID NO: 18613 - DNA, 20 bp, Artificial Sequence
  Description of Artificial Sequence: Synthetic oligonucleotide
  Target: FXN; (+) strand; PAM type: NRG; PAM sequence: CAG
ctcaaatggtccacccccat

SEQ ID NO: 18614 - DNA, 20 bp, Artificial Sequence
  Description of Artificial Sequence: Synthetic oligonucleotide
  Target: FXN; (+) strand; PAM type: NRG; PAM sequence: AAG
ccacccccatcagccttcca

SEQ ID NO: 18615 - DNA, 20 bp, Artificial Sequence
  Description of Artificial Sequence: Synthetic oligonucleotide
  Target: FXN; (+) strand; PAM type: NRG; PAM sequence: TGG
ccatcagccttccaaagttt

SEQ ID NO: 18616 - DNA, 20 bp, Artificial Sequence
  Description of Artificial Sequence: Synthetic oligonucleotide
  Target: FXN; (+) strand; PAM type: NRG; PAM sequence: GGG
catcagccttccaaagtttt

SEQ ID NO: 18617 - DNA, 20 bp, Artificial Sequence
  Description of Artificial Sequence: Synthetic oligonucleotide
  Target: FXN; (+) strand; PAM type: NRG; PAM sequence: CAG
cttccaaagttttgggataa

SEQ ID NO: 18618 - DNA, 20 bp, Artificial Sequence
  Description of Artificial Sequence: Synthetic oligonucleotide
  Target: FXN; (+) strand; PAM type: NRG; PAM sequence: AGG
ttccaaagttttgggataac

SEQ ID NO: 18619 - DNA, 20 bp, Artificial Sequence
  Description of Artificial Sequence: Synthetic oligonucleotide
  Target: FXN; (+) strand; PAM type: NRG; PAM sequence: GAG
agttttgggataacaggcgt

SEQ ID NO: 18620 - DNA, 20 bp, Artificial Sequence
  Description of Artificial Sequence: Synthetic oligonucleotide
  Target: FXN; (+) strand; PAM type: NRG; PAM sequence: CAG
ggataacaggcgtgagccac

SEQ ID NO: 18621 - DNA, 20 bp, Artificial Sequence
  Description of Artificial Sequence: Synthetic oligonucleotide
  Target: FXN; (+) strand; PAM type: NRG; PAM sequence: AGG
gataacaggcgtgagccacc

SEQ ID NO: 18622 - DNA, 20 bp, Artificial Sequence
  Description of Artificial Sequence: Synthetic oligonucleotide
  Target: FXN; (+) strand; PAM type: NRG; PAM sequence: CGG
caggcgtgagccaccaggtc

SEQ ID NO: 18623 - DNA, 20 bp, Artificial Sequence
  Description of Artificial Sequence: Synthetic oligonucleotide
  Target: FXN; (+) strand; PAM type: NRG; PAM sequence: TGG
gtgagccaccaggtccggcc

SEQ ID NO: 18624 - DNA, 20 bp, Artificial Sequence
  Description of Artificial Sequence: Synthetic oligonucleotide
  Target: FXN; (+) strand; PAM type: NRG; PAM sequence: GAG
caccaggtccggcctggtgt

SEQ ID NO: 18625 - DNA, 20 bp, Artificial Sequence
  Description of Artificial Sequence: Synthetic oligonucleotide
  Target: FXN; (+) strand; PAM type: NRG; PAM sequence: GAG
ggcctggtgtgagaacttct

SEQ ID NO: 18626 - DNA, 20 bp, Artificial Sequence
  Description of Artificial Sequence: Synthetic oligonucleotide
  Target: FXN; (+) strand; PAM type: NRG; PAM sequence: TGG
tggtgtgagaacttctgagt

SEQ ID NO: 18627 - DNA, 20 bp, Artificial Sequence
  Description of Artificial Sequence: Synthetic oligonucleotide
  Target: FXN; (+) strand; PAM type: NRG; PAM sequence: TAG
ttctgagttggatgaaacat

SEQ ID NO: 18628 - DNA, 20 bp, Artificial Sequence
  Description of Artificial Sequence: Synthetic oligonucleotide
  Target: FXN; (+) strand; PAM type: NRG; PAM sequence: CAG
gttggatgaaacattagccc

SEQ ID NO: 18629 - DNA, 20 bp, Artificial Sequence
  Description of Artificial Sequence: Synthetic oligonucleotide
  Target: FXN; (+) strand; PAM type: NRG; PAM sequence: TAG
gaaacattagccccagatcc

SEQ ID NO: 18630 - DNA, 20 bp, Artificial Sequence
  Description of Artificial Sequence: Synthetic oligonucleotide
  Target: FXN; (+) strand; PAM type: NRG; PAM sequence: AAG
acattagccccagatcctag

SEQ ID NO: 18631 - DNA, 20 bp, Artificial Sequence
  Description of Artificial Sequence: Synthetic oligonucleotide
  Target: FXN; (+) strand; PAM type: NRG; PAM sequence: CAG
tagccccagatcctagaagc

SEQ ID NO: 18632 - DNA, 20 bp, Artificial Sequence
  Description of Artificial Sequence: Synthetic oligonucleotide
  Target: FXN; (+) strand; PAM type: NRG; PAM sequence: AGG
agccccagatcctagaagcc

SEQ ID NO: 18633 - DNA, 20 bp, Artificial Sequence
  Description of Artificial Sequence: Synthetic oligonucleotide
  Target: FXN; (+) strand; PAM type: NRG; PAM sequence: GGG
gccccagatcctagaagcca

SEQ ID NO: 18634 - DNA, 20 bp, Artificial Sequence
  Description of Artificial Sequence: Synthetic oligonucleotide
  Target: FXN; (+) strand; PAM type: NRG; PAM sequence: AAG
ccagatcctagaagccaggg

SEQ ID NO: 18635 - DNA, 20 bp, Artificial Sequence
  Description of Artificial Sequence: Synthetic oligonucleotide
  Target: FXN; (+) strand; PAM type: NRG; PAM sequence: TGG
cctagaagccagggaagtgc

SEQ ID NO: 18636 - DNA, 20 bp, Artificial Sequence
  Description of Artificial Sequence: Synthetic oligonucleotide
  Target: FXN; (+) strand; PAM type: NRG; PAM sequence: TGG
aagtgctggtctttatcgac

SEQ ID NO: 18637 - DNA, 20 bp, Artificial Sequence
  Description of Artificial Sequence: Synthetic oligonucleotide
  Target: FXN; (+) strand; PAM type: NRG; PAM sequence: CAG
ggtctttatcgactggccac

SEQ ID NO: 18638 - DNA, 20 bp, Artificial Sequence
  Description of Artificial Sequence: Synthetic oligonucleotide
  Target: FXN; (+) strand; PAM type: NRG; PAM sequence: AGG
gtctttatcgactggccacc

SEQ ID NO: 18639 - DNA, 20 bp, Artificial Sequence
  Description of Artificial Sequence: Synthetic oligonucleotide
  Target: FXN; (+) strand; PAM type: NRG; PAM sequence: TGG
tttatcgactggccaccagg

SEQ ID NO: 18640 - DNA, 20 bp, Artificial Sequence
  Description of Artificial Sequence: Synthetic oligonucleotide
  Target: FXN; (+) strand; PAM type: NRG; PAM sequence: CAG
atcgactggccaccaggtgg

SEQ ID NO: 18641 - DNA, 20 bp, Artificial Sequence
  Description of Artificial Sequence: Synthetic oligonucleotide
  Target: FXN; (+) strand; PAM type: NRG; PAM sequence: TGG
tggccaccaggtggcagatt

SEQ ID NO: 18642 - DNA, 20 bp, Artificial Sequence
  Description of Artificial Sequence: Synthetic oligonucleotide
  Target: FXN; (+) strand; PAM type: NRG; PAM sequence: GGG
ggccaccaggtggcagattt

SEQ ID NO: 18643 - DNA, 20 bp, Artificial Sequence
  Description of Artificial Sequence: Synthetic oligonucleotide
  Target: FXN; (+) strand; PAM type: NRG; PAM sequence: AAG
accaggtggcagatttgggc

SEQ ID NO: 18644 - DNA, 20 bp, Artificial Sequence
  Description of Artificial Sequence: Synthetic oligonucleotide
  Target: FXN; (+) strand; PAM type: NRG; PAM sequence: AGG
ccaggtggcagatttgggca

SEQ ID NO: 18645 - DNA, 20 bp, Artificial Sequence
  Description of Artificial Sequence: Synthetic oligonucleotide
  Target: FXN; (+) strand; PAM type: NRG; PAM sequence: GGG
caggtggcagatttgggcaa

SEQ ID NO: 18646 - DNA, 20 bp, Artificial Sequence
  Description of Artificial Sequence: Synthetic oligonucleotide
  Target: FXN; (+) strand; PAM type: NRG; PAM sequence: TGG
tttgggcaagggtctgcctt

SEQ ID NO: 18647 - DNA, 20 bp, Artificial Sequence
  Description of Artificial Sequence: Synthetic oligonucleotide
  Target: FXN; (+) strand; PAM type: NRG; PAM sequence: GGG
ttgggcaagggtctgccttt

SEQ ID NO: 18648 - DNA, 20 bp, Artificial Sequence
  Description of Artificial Sequence: Synthetic oligonucleotide
  Target: FXN; (+) strand; PAM type: NRG; PAM sequence: TAG
caagggtctgcctttgggtt

SEQ ID NO: 18649 - DNA, 20 bp, Artificial Sequence
  Description of Artificial Sequence: Synthetic oligonucleotide
  Target: FXN; (+) strand; PAM type: NRG; PAM sequence: TAG
ttgggtttagaattattgct

SEQ ID NO: 18650 - DNA, 20 bp, Artificial Sequence
  Description of Artificial Sequence: Synthetic oligonucleotide
  Target: FXN; (+) strand; PAM type: NRG; PAM sequence: AGG
tgggtttagaattattgctt

SEQ ID NO: 18651 - DNA, 20 bp, Artificial Sequence
  Description of Artificial Sequence: Synthetic oligonucleotide
  Target: FXN; (+) strand; PAM type: NRG; PAM sequence: AAG
gaattattgcttaggcctta

SEQ ID NO: 18652 - DNA, 20 bp, Artificial Sequence
  Description of Artificial Sequence: Synthetic oligonucleotide
  Target: FXN; (+) strand; PAM type: NRG; PAM sequence: TAG
ttattgcttaggccttaaag

SEQ ID NO: 18653 - DNA, 20 bp, Artificial Sequence
  Description of Artificial Sequence: Synthetic oligonucleotide
  Target: FXN; (+) strand; PAM type: NRG; PAM sequence: CAG
ttaaagtagttcttttttgc

SEQ ID NO: 18654 - DNA, 20 bp, Artificial Sequence
  Description of Artificial Sequence: Synthetic oligonucleotide
  Target: FXN; (+) strand; PAM type: NRG; PAM sequence: TGG
aagtagttcttttttgccag

SEQ ID NO: 18655 - DNA, 20 bp, Artificial Sequence
  Description of Artificial Sequence: Synthetic oligonucleotide
  Target: FXN; (+) strand; PAM type: NRG; PAM sequence: GGG
agtagttcttttttgccagt

SEQ ID NO: 18656 - DNA, 20 bp, Artificial Sequence
  Description of Artificial Sequence: Synthetic oligonucleotide
  Target: FXN; (+) strand; PAM type: NRG; PAM sequence: GAG
tagttcttttttgccagtgg

SEQ ID NO: 18657 - DNA, 20 bp, Artificial Sequence
  Description of Artificial Sequence: Synthetic oligonucleotide
  Target: FXN; (+) strand; PAM type: NRG; PAM sequence: AAG
cagtgggagaaaatccctca

SEQ ID NO: 18658 - DNA, 20 bp, Artificial Sequence
  Description of Artificial Sequence: Synthetic oligonucleotide
  Target: FXN; (+) strand; PAM type: NRG; PAM sequence: TGG
gggagaaaatccctcaaaga

SEQ ID NO: 18659 - DNA, 20 bp, Artificial Sequence
  Description of Artificial Sequence: Synthetic oligonucleotide
  Target: FXN; (+) strand; PAM type: NRG; PAM sequence: TGG
atccctcaaagatggttttc

SEQ ID NO: 18660 - DNA, 20 bp, Artificial Sequence
  Description of Artificial Sequence: Synthetic oligonucleotide
  Target: FXN; (+) strand; PAM type: NRG; PAM sequence: GGG
tccctcaaagatggttttct

SEQ ID NO: 18661 - DNA, 20 bp, Artificial Sequence
  Description of Artificial Sequence: Synthetic oligonucleotide
  Target: FXN; (+) strand; PAM type: NRG; PAM sequence: TGG
tcaaagatggttttctgggt

SEQ ID NO: 18662 - DNA, 20 bp, Artificial Sequence
  Description of Artificial Sequence: Synthetic oligonucleotide
  Target: FXN; (+) strand; PAM type: NRG; PAM sequence: TGG
agatggttttctgggttggt

SEQ ID NO: 18663 - DNA, 20 bp, Artificial Sequence
  Description of Artificial Sequence: Synthetic oligonucleotide
  Target: FXN; (+) strand; PAM type: NRG; PAM sequence: GAG
tgtctgtttgtttgtttttt

SEQ ID NO: 18664 - DNA, 20 bp, Artificial Sequence
  Description of Artificial Sequence: Synthetic oligonucleotide
  Target: FXN; (+) strand; PAM type: NRG; PAM sequence: CAG
tgtttgtttgttttttgaga

SEQ ID NO: 18665 - DNA, 20 bp, Artificial Sequence
  Description of Artificial Sequence: Synthetic oligonucleotide
  Target: FXN; (+) strand; PAM type: NRG; PAM sequence: GAG
tttgtttgttttttgagaca

SEQ ID NO: 18666 - DNA, 20 bp, Artificial Sequence
  Description of Artificial Sequence: Synthetic oligonucleotide
  Target: FXN; (+) strand; PAM type: NRG; PAM sequence: CAG
cagagtctccctctgttatt

SEQ ID NO: 18667 - DNA, 20 bp, Artificial Sequence
  Description of Artificial Sequence: Synthetic oligonucleotide
  Target: FXN; (+) strand; PAM type: NRG; PAM sequence: TGG
tctccctctgttattcagcc

SEQ ID NO: 18668 - DNA, 20 bp, Artificial Sequence
  Description of Artificial Sequence: Synthetic oligonucleotide
  Target: FXN; (+) strand; PAM type: NRG; PAM sequence: GAG
tccctctgttattcagcctg

SEQ ID NO: 18669 - DNA, 20 bp, Artificial Sequence
  Description of Artificial Sequence: Synthetic oligonucleotide
  Target: FXN; (+) strand; PAM type: NRG; PAM sequence: CAG
ctgttattcagcctggagtg

SEQ ID NO: 18670 - DNA, 20 bp, Artificial Sequence
  Description of Artificial Sequence: Synthetic oligonucleotide
  Target: FXN; (+) strand; PAM type: NRG; PAM sequence: TGG
ttattcagcctggagtgcag

SEQ ID NO: 18671 - DNA, 20 bp, Artificial Sequence
  Description of Artificial Sequence: Synthetic oligonucleotide
  Target: FXN; (+) strand; PAM type: NRG; PAM sequence: CGG
tcactgcaacctctgcctct

SEQ ID NO: 18672 - DNA, 20 bp, Artificial Sequence
  Description of Artificial Sequence: Synthetic oligonucleotide
  Target: FXN; (+) strand; PAM type: NRG; PAM sequence: GGG
cactgcaacctctgcctctc

SEQ ID NO: 18673 - DNA, 20 bp, Artificial Sequence
  Description of Artificial Sequence: Synthetic oligonucleotide
  Target: FXN; (+) strand; PAM type: NRG; PAM sequence: AAG
aacctctgcctctcgggttc

SEQ ID NO: 18674 - DNA, 20 bp, Artificial Sequence
  Description of Artificial Sequence: Synthetic oligonucleotide
  Target: FXN; (+) strand; PAM type: NRG; PAM sequence: CAG
ctctgcctctcgggttcaag

SEQ ID NO: 18675 - DNA, 20 bp, Artificial Sequence
  Description of Artificial Sequence: Synthetic oligonucleotide
  Target: FXN; (+) strand; PAM type: NRG; PAM sequence: AAG
ttctcctgcctcaacctccc

SEQ ID NO: 18676 - DNA, 20 bp, Artificial Sequence
  Description of Artificial Sequence: Synthetic oligonucleotide
  Target: FXN; (+) strand; PAM type: NRG; PAM sequence: TAG
tcctgcctcaacctcccaag

SEQ ID NO: 18677 - DNA, 20 bp, Artificial Sequence
  Description of Artificial Sequence: Synthetic oligonucleotide
  Target: FXN; (+) strand; PAM type: NRG; PAM sequence: TGG
gcctcaacctcccaagtagc

SEQ ID NO: 18678 - DNA, 20 bp, Artificial Sequence
  Description of Artificial Sequence: Synthetic oligonucleotide
  Target: FXN; (+) strand; PAM type: NRG; PAM sequence: TAG
ctcccaagtagctggaatta

SEQ ID NO: 18679 - DNA, 20 bp, Artificial Sequence
  Description of Artificial Sequence: Synthetic oligonucleotide
  Target: FXN; (+) strand; PAM type: NRG; PAM sequence: AGG
tcccaagtagctggaattat

SEQ ID NO: 18680 - DNA, 20 bp, Artificial Sequence
  Description of Artificial Sequence: Synthetic oligonucleotide
  Target: FXN; (+) strand; PAM type: NRG; PAM sequence: CAG
taggcacacgcccccacacc

SEQ ID NO: 18681 - DNA, 20 bp, Artificial Sequence
  Description of Artificial Sequence: Synthetic oligonucleotide
  Target: FXN; (+) strand; PAM type: NRG; PAM sequence: TAG
ccagctaatttttgtatttt

SEQ ID NO: 18682 - DNA, 20 bp, Artificial Sequence
  Description of Artificial Sequence: Synthetic oligonucleotide
  Target: FXN; (+) strand; PAM type: NRG; PAM sequence: TAG
gctaatttttgtatttttag

SEQ ID NO: 18683 - DNA, 20 bp, Artificial Sequence
  Description of Artificial Sequence: Synthetic oligonucleotide
  Target: FXN; (+) strand; PAM type: NRG; PAM sequence: GAG
taatttttgtatttttagta

SEQ ID NO: 18684 - DNA, 20 bp, Artificial Sequence
  Description of Artificial Sequence: Synthetic oligonucleotide
  Target: FXN; (+) strand; PAM type: NRG; PAM sequence: CAG
ttttgtatttttagtagaga

SEQ ID NO: 18685 - DNA, 20 bp, Artificial Sequence
  Description of Artificial Sequence: Synthetic oligonucleotide
  Target: FXN; (+) strand; PAM type: NRG; PAM sequence: TGG
gagacagtgtttcaccacgt

SEQ ID NO: 18686 - DNA, 20 bp, Artificial Sequence
  Description of Artificial Sequence: Synthetic oligonucleotide
  Target: FXN; (+) strand; PAM type: NRG; PAM sequence: CAG
cagtgtttcaccacgttggc

SEQ ID NO: 18687 - DNA, 20 bp, Artificial Sequence
  Description of Artificial Sequence: Synthetic oligonucleotide
  Target: FXN; (+) strand; PAM type: NRG; PAM sequence: AGG
agtgtttcaccacgttggcc

SEQ ID NO: 18688 - DNA, 20 bp, Artificial Sequence
  Description of Artificial Sequence: Synthetic oligonucleotide
  Target: FXN; (+) strand; PAM type: NRG; PAM sequence: TGG
tttcaccacgttggccaggc

SEQ ID NO: 18689 - DNA, 20 bp, Artificial Sequence
  Description of Artificial Sequence: Synthetic oligonucleotide
  Target: FXN; (+) strand; PAM type: NRG; PAM sequence: AAG
ggttttgaactcctgaactc

SEQ ID NO: 18690 - DNA, 20 bp, Artificial Sequence
  Description of Artificial Sequence: Synthetic oligonucleotide
  Target: FXN; (+) strand; PAM type: NRG; PAM sequence: CAG
ctcaagtaatcctcccacct

SEQ ID NO: 18691 - DNA, 20 bp, Artificial Sequence
  Description of Artificial Sequence: Synthetic oligonucleotide
  Target: FXN; (+) strand; PAM type: NRG; PAM sequence: AAG
cctcccacctcagcctccca

SEQ ID NO: 18692 - DNA, 20 bp, Artificial Sequence
  Description of Artificial Sequence: Synthetic oligonucleotide
  Target: FXN; (+) strand; PAM type: NRG; PAM sequence: TAG
acctcagcctcccaaagtgc

SEQ ID NO: 18693 - DNA, 20 bp, Artificial Sequence
  Description of Artificial Sequence: Synthetic oligonucleotide
  Target: FXN; (+) strand; PAM type: NRG; PAM sequence: AGG
cctcagcctcccaaagtgct

SEQ ID NO: 18694 - DNA, 20 bp, Artificial Sequence
  Description of Artificial Sequence: Synthetic oligonucleotide
  Target: FXN; (+) strand; PAM type: NRG; PAM sequence: CAG
ctcccaaagtgctaggatta

SEQ ID NO: 18695 - DNA, 20 bp, Artificial Sequence
  Description of Artificial Sequence: Synthetic oligonucleotide
  Target: FXN; (+) strand; PAM type: NRG; PAM sequence: AGG
tcccaaagtgctaggattac

SEQ ID NO: 18696 - DNA, 20 bp, Artificial Sequence
  Description of Artificial Sequence: Synthetic oligonucleotide
  Target: FXN; (+) strand; PAM type: NRG; PAM sequence: GAG
agtgctaggattacaggtgt

SEQ ID NO: 18697 - DNA, 20 bp, Artificial Sequence
  Description of Artificial Sequence: Synthetic oligonucleotide
  Target: FXN; (+) strand; PAM type: NRG; PAM sequence: TGG
caggtgtgagccaccgcgcc

SEQ ID NO: 18698 - DNA, 20 bp, Artificial Sequence
  Description of Artificial Sequence: Synthetic oligonucleotide
  Target: FXN; (+) strand; PAM type: NRG; PAM sequence: AAG
ccaccgcgcctggctcctca

SEQ ID NO: 18699 - DNA, 20 bp, Artificial Sequence
  Description of Artificial Sequence: Synthetic oligonucleotide
  Target: FXN; (+) strand; PAM type: NRG; PAM sequence: TGG
aaagatgttaatcctcttga

SEQ ID NO: 18700 - DNA, 20 bp, Artificial Sequence
  Description of Artificial Sequence: Synthetic oligonucleotide
  Target: FXN; (+) strand; PAM type: NRG; PAM sequence: CAG
tgatggcaattgactaatac

SEQ ID NO: 18701 - DNA, 20 bp, Artificial Sequence
  Description of Artificial Sequence: Synthetic oligonucleotide
  Target: FXN; (+) strand; PAM type: NRG; PAM sequence: AAG
taataccagaaaatgtcacg

SEQ ID NO: 18702 - DNA, 20 bp, Artificial Sequence
  Description of Artificial Sequence: Synthetic oligonucleotide
  Target: FXN; (+) strand; PAM type: NRG; PAM sequence: TGG
atgtcacgaagcgtgcattt

SEQ ID NO: 18703 - DNA, 20 bp, Artificial Sequence
  Description of Artificial Sequence: Synthetic oligonucleotide
  Target: FXN; (+) strand; PAM type: NRG; PAM sequence: TGG
gtgcattttggattcaatca

SEQ ID NO: 18704 - DNA, 20 bp, Artificial Sequence
  Description of Artificial Sequence: Synthetic oligonucleotide
  Target: FXN; (+) strand; PAM type: NRG; PAM sequence: GAG
gattcaatcatggaattgtt

SEQ ID NO: 18705 - DNA, 20 bp, Artificial Sequence
  Description of Artificial Sequence: Synthetic oligonucleotide
  Target: FXN; (+) strand; PAM type: NRG; PAM sequence: AGG
attcaatcatggaattgttg

SEQ ID NO: 18706 - DNA, 20 bp, Artificial Sequence
  Description of Artificial Sequence: Synthetic oligonucleotide
  Target: FXN; (+) strand; PAM type: NRG; PAM sequence: CAG
atggaattgttgaggacaat

SEQ ID NO: 18707 - DNA, 20 bp, Artificial Sequence
  Description of Artificial Sequence: Synthetic oligonucleotide
  Target: FXN; (+) strand; PAM type: NRG; PAM sequence: CAG
tgttgaggacaatcagccat

SEQ ID NO: 18708 - DNA, 20 bp, Artificial Sequence
  Description of Artificial Sequence: Synthetic oligonucleotide
  Target: FXN; (+) strand; PAM type: NRG; PAM sequence: AAG
gacaatcagccatcagacta

SEQ ID NO: 18709 - DNA, 20 bp, Artificial Sequence
  Description of Artificial Sequence: Synthetic oligonucleotide
  Target: FXN; (+) strand; PAM type: NRG; PAM sequence: TAG
cagccatcagactaaagcga

SEQ ID NO: 18710 - DNA, 20 bp, Artificial Sequence
  Description of Artificial Sequence: Synthetic oligonucleotide
  Target: FXN; (+) strand; PAM type: NRG; PAM sequence: TAG
tcagactaaagcgatagaaa

SEQ ID NO: 18711 - DNA, 20 bp, Artificial Sequence
  Description of Artificial Sequence: Synthetic oligonucleotide
  Target: FXN; (+) strand; PAM type: NRG; PAM sequence: TGG
taaagcgatagaaatagtat

SEQ ID NO: 18712 - DNA, 20 bp, Artificial Sequence
  Description of Artificial Sequence: Synthetic oligonucleotide
  Target: FXN; (+) strand; PAM type: NRG; PAM sequence: CAG
agaaatagtattggaaattg

SEQ ID NO: 18713 - DNA, 20 bp, Artificial Sequence
  Description of Artificial Sequence: Synthetic oligonucleotide
  Target: FXN; (+) strand; PAM type: NRG; PAM sequence: CGG
aatagtattggaaattgcag

SEQ ID NO: 18714 - DNA, 20 bp, Artificial Sequence
  Description of Artificial Sequence: Synthetic oligonucleotide
  Target: FXN; (+) strand; PAM type: NRG; PAM sequence: GGG
atagtattggaaattgcagc

SEQ ID NO: 18715 - DNA, 20 bp, Artificial Sequence
  Description of Artificial Sequence: Synthetic oligonucleotide
  Target: FXN; (+) strand; PAM type: NRG; PAM sequence: GAG
agtattggaaattgcagcgg

SEQ ID NO: 18716 - DNA, 20 bp, Artificial Sequence
  Description of Artificial Sequence: Synthetic oligonucleotide
  Target: FXN; (+) strand; PAM type: NRG; PAM sequence: TGG
attgcagcgggagcactgaa

SEQ ID NO: 18717 - DNA, 20 bp, Artificial Sequence
  Description of Artificial Sequence: Synthetic oligonucleotide
  Target: FXN; (+) strand; PAM type: NRG; PAM sequence: GAG
tgcagcgggagcactgaatg

SEQ ID NO: 18718 - DNA, 20 bp, Artificial Sequence
  Description of Artificial Sequence: Synthetic oligonucleotide
  Target: FXN; (+) strand; PAM type: NRG; PAM sequence: AAG
agcgggagcactgaatggag

SEQ ID NO: 18719 - DNA, 20 bp, Artificial Sequence
  Description of Artificial Sequence: Synthetic oligonucleotide
  Target: FXN; (+) strand; PAM type: NRG; PAM sequence: AGG
gcgggagcactgaatggaga

SEQ ID NO: 18720 - DNA, 20 bp, Artificial Sequence
  Description of Artificial Sequence: Synthetic oligonucleotide
  Target: FXN; (+) strand; PAM type: NRG; PAM sequence: TGG
ggagaaggcactccacataa

SEQ ID NO: 18721 - DNA, 20 bp, Artificial Sequence
  Description of Artificial Sequence: Synthetic oligonucleotide
  Target: FXN; (+) strand; PAM type: NRG; PAM sequence: GAG
agaaggcactccacataatg

SEQ ID NO: 18722 - DNA, 20 bp, Artificial Sequence
  Description of Artificial Sequence: Synthetic oligonucleotide
  Target: FXN; (+) strand; PAM type: NRG; PAM sequence: AGG
gaaggcactccacataatgg

SEQ ID NO: 18723 - DNA, 20 bp, Artificial Sequence
  Description of Artificial Sequence: Synthetic oligonucleotide
  Target: FXN; (+) strand; PAM type: NRG; PAM sequence: GAG
aggcactccacataatggag

SEQ ID NO: 18724 - DNA, 20 bp, Artificial Sequence
  Description of Artificial Sequence: Synthetic oligonucleotide
  Target: FXN; (+) strand; PAM type: NRG; PAM sequence: AGG
ggcactccacataatggagg

SEQ ID NO: 18725 - DNA, 20 bp, Artificial Sequence
  Description of Artificial Sequence: Synthetic oligonucleotide
  Target: FXN; (+) strand; PAM type: NRG; PAM sequence: AAG
acataatggaggaggcaacc

SEQ ID NO: 18726 - DNA, 20 bp, Artificial Sequence
  Description of Artificial Sequence: Synthetic oligonucleotide
  Target: FXN; (+) strand; PAM type: NRG; PAM sequence: TAG
tggaggaggcaaccaagtct

SEQ ID NO: 18727 - DNA, 20 bp, Artificial Sequence
  Description of Artificial Sequence: Synthetic oligonucleotide
  Target: FXN; (+) strand; PAM type: NRG; PAM sequence: GAG
gaggaggcaaccaagtctta

SEQ ID NO: 18728 - DNA, 20 bp, Artificial Sequence
  Description of Artificial Sequence: Synthetic oligonucleotide
  Target: FXN; (+) strand; PAM type: NRG; PAM sequence: AAG
gaggcaaccaagtcttagag

SEQ ID NO: 18729 - DNA, 20 bp, Artificial Sequence
  Description of Artificial Sequence: Synthetic oligonucleotide
  Target: FXN; (+) strand; PAM type: NRG; PAM sequence: AGG
aggcaaccaagtcttagaga

SEQ ID NO: 18730 - DNA, 20 bp, Artificial Sequence
  Description of Artificial Sequence: Synthetic oligonucleotide
  Target: FXN; (+) strand; PAM type: NRG; PAM sequence: AAG
caagtcttagagaaggtatc

SEQ ID NO: 18731 - DNA, 20 bp, Artificial Sequence
  Description of Artificial Sequence: Synthetic oligonucleotide
  Target: FXN; (+) strand; PAM type: NRG; PAM sequence: AAG
aaggtatcaagcctgactat

SEQ ID NO: 18732 - DNA, 20 bp, Artificial Sequence
  Description of Artificial Sequence: Synthetic oligonucleotide
  Target: FXN; (+) strand; PAM type: NRG; PAM sequence: AGG
aggtatcaagcctgactata

SEQ ID NO: 18733 - DNA, 20 bp, Artificial Sequence
  Description of Artificial Sequence: Synthetic oligonucleotide
  Target: FXN; (+) strand; PAM type: NRG; PAM sequence: CAG
atcaagcctgactataagga

SEQ ID NO: 18734 - DNA, 20 bp, Artificial Sequence
  Description of Artificial Sequence: Synthetic oligonucleotide
  Target: FXN; (+) strand; PAM type: NRG; PAM sequence: GAG
agcctgactataaggacagt

SEQ ID NO: 18735 - DNA, 20 bp, Artificial Sequence
  Description of Artificial Sequence: Synthetic oligonucleotide
  Target: FXN; (+) strand; PAM type: NRG; PAM sequence: AGG
gcctgactataaggacagtg

SEQ ID NO: 18736 - DNA, 20 bp, Artificial Sequence
  Description of Artificial Sequence: Synthetic oligonucleotide
  Target: FXN; (+) strand; PAM type: NRG; PAM sequence: GGG
cctgactataaggacagtga

SEQ ID NO: 18737 - DNA, 20 bp, Artificial Sequence
  Description of Artificial Sequence: Synthetic oligonucleotide
  Target: FXN; (+) strand; PAM type: NRG; PAM sequence: AAG
agggaattgaaaaaacaaaa

SEQ ID NO: 18738 - DNA, 20 bp, Artificial Sequence
  Description of Artificial Sequence: Synthetic oligonucleotide
  Target: FXN; (+) strand; PAM type: NRG; PAM sequence: AGG
gggaattgaaaaaacaaaaa

SEQ ID NO: 18739 - DNA, 20 bp, Artificial Sequence
  Description of Artificial Sequence: Synthetic oligonucleotide
  Target: FXN; (+) strand; PAM type: NRG; PAM sequence: GAG
gaattgaaaaaacaaaaaag

SEQ ID NO: 18740 - DNA, 20 bp, Artificial Sequence
  Description of Artificial Sequence: Synthetic oligonucleotide
  Target: FXN; (+) strand; PAM type: NRG; PAM sequence: TGG
aaaaaacaaaaaaggagcaa

SEQ ID NO: 18741 - DNA, 20 bp, Artificial Sequence
  Description of Artificial Sequence: Synthetic oligonucleotide
  Target: FXN; (+) strand; PAM type: NRG; PAM sequence: GAG
aaaacaaaaaaggagcaatg

SEQ ID NO: 18742 - DNA, 20 bp, Artificial Sequence
  Description of Artificial Sequence: Synthetic oligonucleotide
  Target: FXN; (+) strand; PAM type: NRG; PAM sequence: CAG
acaaaaaaggagcaatggag

SEQ ID NO: 18743 - DNA, 20 bp, Artificial Sequence
  Description of Artificial Sequence: Synthetic oligonucleotide
  Target: FXN; (+) strand; PAM type: NRG; PAM sequence: AGG
caaaaaaggagcaatggagc

SEQ ID NO: 18744 - DNA, 20 bp, Artificial Sequence
  Description of Artificial Sequence: Synthetic oligonucleotide
  Target: FXN; (+) strand; PAM type: NRG; PAM sequence: GGG
aaaaaaggagcaatggagca

SEQ ID NO: 18745 - DNA, 20 bp, Artificial Sequence
  Description of Artificial Sequence: Synthetic oligonucleotide
  Target: FXN; (+) strand; PAM type: NRG; PAM sequence: AAG
aaaggagcaatggagcaggg

SEQ ID NO: 18746 - DNA, 20 bp, Artificial Sequence
  Description of Artificial Sequence: Synthetic oligonucleotide
  Target: FXN; (+) strand; PAM type: NRG; PAM sequence: AGG
aaggagcaatggagcaggga

SEQ ID NO: 18747 - DNA, 20 bp, Artificial Sequence
  Description of Artificial Sequence: Synthetic oligonucleotide
  Target: FXN; (+) strand; PAM type: NRG; PAM sequence: AAG
ggaaggattgaatgcctttc

SEQ ID NO: 18748 - DNA, 20 bp, Artificial Sequence
  Description of Artificial Sequence: Synthetic oligonucleotide
  Target: FXN; (+) strand; PAM type: NRG; PAM sequence: TAG
aggattgaatgcctttcaag

SEQ ID NO: 18749 - DNA, 20 bp, Artificial Sequence
  Description of Artificial Sequence: Synthetic oligonucleotide
  Target: FXN; (+) strand; PAM type: NRG; PAM sequence: CAG
gaatgcctttcaagtagatt

SEQ ID NO: 18750 - DNA, 20 bp, Artificial Sequence
  Description of Artificial Sequence: Synthetic oligonucleotide
  Target: FXN; (+) strand; PAM type: NRG; PAM sequence: TAG
gtagattcagtaattgctgt

SEQ ID NO: 18751 - DNA, 20 bp, Artificial Sequence
  Description of Artificial Sequence: Synthetic oligonucleotide
  Target: FXN; (+) strand; PAM type: NRG; PAM sequence: CAG
gattcagtaattgctgttag

SEQ ID NO: 18752 - DNA, 20 bp, Artificial Sequence
  Description of Artificial Sequence: Synthetic oligonucleotide
  Target: FXN; (+) strand; PAM type: NRG; PAM sequence: CAG
gctgttagcagcaaaaaatg

SEQ ID NO: 18753 - DNA, 20 bp, Artificial Sequence
  Description of Artificial Sequence: Synthetic oligonucleotide
  Target: FXN; (+) strand; PAM type: NRG; PAM sequence: TAG
gttagcagcaaaaaatgcag

SEQ ID NO: 18754 - DNA, 20 bp, Artificial Sequence
  Description of Artificial Sequence: Synthetic oligonucleotide
  Target: FXN; (+) strand; PAM type: NRG; PAM sequence: TGG
gcaaaaaatgcagtagtgcc

SEQ ID NO: 18755 - DNA, 20 bp, Artificial Sequence
  Description of Artificial Sequence: Synthetic oligonucleotide
  Target: FXN; (+) strand; PAM type: NRG; PAM sequence: GGG
caaaaaatgcagtagtgcct

SEQ ID NO: 18756 - DNA, 20 bp, Artificial Sequence
  Description of Artificial Sequence: Synthetic oligonucleotide
  Target: FXN; (+) strand; PAM type: NRG; PAM sequence: CAG
aaaatgcagtagtgcctggg

SEQ ID NO: 18757 - DNA, 20 bp, Artificial Sequence
  Description of Artificial Sequence: Synthetic oligonucleotide
  Target: FXN; (+) strand; PAM type: NRG; PAM sequence: AGG
aaatgcagtagtgcctgggc

SEQ ID NO: 18758 - DNA, 20 bp, Artificial Sequence
  Description of Artificial Sequence: Synthetic oligonucleotide
  Target: FXN; (+) strand; PAM type: NRG; PAM sequence: GGG
aatgcagtagtgcctgggca

SEQ ID NO: 18759 - DNA, 20 bp, Artificial Sequence
  Description of Artificial Sequence: Synthetic oligonucleotide
  Target: FXN; (+) strand; PAM type: NRG; PAM sequence: AAG
agtgcctgggcagggcttta

SEQ ID NO: 18760 - DNA, 20 bp, Artificial Sequence
  Description of Artificial Sequence: Synthetic oligonucleotide
  Target: FXN; (+) strand; PAM type: NRG; PAM sequence: CAG
agggctttaaagtgcttgca

SEQ ID NO: 18761 - DNA, 20 bp, Artificial Sequence
  Description of Artificial Sequence: Synthetic oligonucleotide
  Target: FXN; (+) strand; PAM type: NRG; PAM sequence: AGG
gggctttaaagtgcttgcac

SEQ ID NO: 18762 - DNA, 20 bp, Artificial Sequence
  Description of Artificial Sequence: Synthetic oligonucleotide
  Target: FXN; (+) strand; PAM type: NRG; PAM sequence: CAG
ctttaaagtgcttgcacagg

SEQ ID NO: 18763 - DNA, 20 bp, Artificial Sequence
  Description of Artificial Sequence: Synthetic oligonucleotide
  Target: FXN; (+) strand; PAM type: NRG; PAM sequence: TAG
agtgcttgcacaggcagccc

SEQ ID NO: 18764 - DNA, 20 bp, Artificial Sequence
  Description of Artificial Sequence: Synthetic oligonucleotide
  Target: FXN; (+) strand; PAM type: NRG; PAM sequence: GAG
tgcttgcacaggcagcccta

SEQ ID NO: 18765 - DNA, 20 bp, Artificial Sequence
  Description of Artificial Sequence: Synthetic oligonucleotide
  Target: FXN; (+) strand; PAM type: NRG; PAM sequence: AGG
gcttgcacaggcagccctag

SEQ ID NO: 18766 - DNA, 20 bp, Artificial Sequence
  Description of Artificial Sequence: Synthetic oligonucleotide
  Target: FXN; (+) strand; PAM type: NRG; PAM sequence: GGG
cttgcacaggcagccctaga

SEQ ID NO: 18767 - DNA, 20 bp, Artificial Sequence
  Description of Artificial Sequence: Synthetic oligonucleotide
  Target: FXN; (+) strand; PAM type: NRG; PAM sequence: CGG
cacaggcagccctagagggc

SEQ ID NO: 18768 - DNA, 20 bp, Artificial Sequence
  Description of Artificial Sequence: Synthetic oligonucleotide
  Target: FXN; (+) strand; PAM type: NRG; PAM sequence: GGG
acaggcagccctagagggcc

SEQ ID NO: 18769 - DNA, 20 bp, Artificial Sequence
  Description of Artificial Sequence: Synthetic oligonucleotide
  Target: FXN; (+) strand; PAM type: NRG; PAM sequence: TGG
ccctagagggccgggctgct

SEQ ID NO: 18770 - DNA, 20 bp, Artificial Sequence
  Description of Artificial Sequence: Synthetic oligonucleotide
  Target: FXN; (+) strand; PAM type: NRG; PAM sequence: GGG
cctagagggccgggctgctt

SEQ ID NO: 18771 - DNA, 20 bp, Artificial Sequence
  Description of Artificial Sequence: Synthetic oligonucleotide
  Target: FXN; (+) strand; PAM type: NRG; PAM sequence: GAG
acaaactgacctaccaactt

SEQ ID NO: 18772 - DNA, 20 bp, Artificial Sequence
  Description of Artificial Sequence: Synthetic oligonucleotide
  Target: FXN; (+) strand; PAM type: NRG; PAM sequence: CAG
cctaccaacttgagcatcca

SEQ ID NO: 18773 - DNA, 20 bp, Artificial Sequence
  Description of Artificial Sequence: Synthetic oligonucleotide
  Target: FXN; (+) strand; PAM type: NRG; PAM sequence: CAG
ttgagcatccacagcctgat

SEQ ID NO: 18774 - DNA, 20 bp, Artificial Sequence
  Description of Artificial Sequence: Synthetic oligonucleotide
  Target: FXN; (+) strand; PAM type: NRG; PAM sequence: GAG
gagcatccacagcctgatca

SEQ ID NO: 18775 - DNA, 20 bp, Artificial Sequence
  Description of Artificial Sequence: Synthetic oligonucleotide
  Target: FXN; (+) strand; PAM type: NRG; PAM sequence: AGG
agcatccacagcctgatcag

SEQ ID NO: 18776 - DNA, 20 bp, Artificial Sequence
  Description of Artificial Sequence: Synthetic oligonucleotide
  Target: FXN; (+) strand; PAM type: NRG; PAM sequence: TGG
atccacagcctgatcagagg

SEQ ID NO: 18777 - DNA, 20 bp, Artificial Sequence
  Description of Artificial Sequence: Synthetic oligonucleotide
  Target: FXN; (+) strand; PAM type: NRG; PAM sequence: GGG
tccacagcctgatcagaggt

SEQ ID NO: 18778 - DNA, 20 bp, Artificial Sequence
  Description of Artificial Sequence: Synthetic oligonucleotide
  Target: FXN; (+) strand; PAM type: NRG; PAM sequence: GGG
ccacagcctgatcagaggtg

SEQ ID NO: 18779 - DNA, 20 bp, Artificial Sequence
  Description of Artificial Sequence: Synthetic oligonucleotide
  Target: FXN; (+) strand; PAM type: NRG; PAM sequence: GGG
cacagcctgatcagaggtgg

SEQ ID NO: 18780 - DNA, 20 bp, Artificial Sequence
  Description of Artificial Sequence: Synthetic oligonucleotide
  Target: FXN; (+) strand; PAM type: NRG; PAM sequence: GAG
cagcctgatcagaggtgggg

SEQ ID NO: 18781 - DNA, 20 bp, Artificial Sequence
  Description of Artificial Sequence: Synthetic oligonucleotide
  Target: FXN; (+) strand; PAM type: NRG; PAM sequence: AAG
tgatcagaggtgggggagtt

SEQ ID NO: 18782 - DNA, 20 bp, Artificial Sequence
  Description of Artificial Sequence: Synthetic oligonucleotide
  Target: FXN; (+) strand; PAM type: NRG; PAM sequence: AGG
gatcagaggtgggggagtta

SEQ ID NO: 18783 - DNA, 20 bp, Artificial Sequence
  Description of Artificial Sequence: Synthetic oligonucleotide
  Target: FXN; (+) strand; PAM type: NRG; PAM sequence: GGG
atcagaggtgggggagttaa

SEQ ID NO: 18784 - DNA, 20 bp, Artificial Sequence
  Description of Artificial Sequence: Synthetic oligonucleotide
  Target: FXN; (+) strand; PAM type: NRG; PAM sequence: TAG
gttaagggccttctctcccc

SEQ ID NO: 18785 - DNA, 20 bp, Artificial Sequence
  Description of Artificial Sequence: Synthetic oligonucleotide
  Target: FXN; (+) strand; PAM type: NRG; PAM sequence: TAG
ttctctcccctagcctctac

SEQ ID NO: 18786 - DNA, 20 bp, Artificial Sequence
  Description of Artificial Sequence: Synthetic oligonucleotide
  Target: FXN; (+) strand; PAM type: NRG; PAM sequence: GAG
ctctcccctagcctctacta

SEQ ID NO: 18787 - DNA, 20 bp, Artificial Sequence
  Description of Artificial Sequence: Synthetic oligonucleotide
  Target: FXN; (+) strand; PAM type: NRG; PAM sequence: CAG
tctactagagcctgtaactg

SEQ ID NO: 18788 - DNA, 20 bp, Artificial Sequence
  Description of Artificial Sequence: Synthetic oligonucleotide
  Target: FXN; (+) strand; PAM type: NRG; PAM sequence: AGG
ctactagagcctgtaactgc

SEQ ID NO: 18789 - DNA, 20 bp, Artificial Sequence
  Description of Artificial Sequence: Synthetic oligonucleotide
  Target: FXN; (+) strand; PAM type: NRG; PAM sequence: GGG
tactagagcctgtaactgca

SEQ ID NO: 18790 - DNA, 20 bp, Artificial Sequence
  Description of Artificial Sequence: Synthetic oligonucleotide
  Target: FXN; (+) strand; PAM type: NRG; PAM sequence: AAG
cctgtaactgcagggaaacc

SEQ ID NO: 18791 - DNA, 20 bp, Artificial Sequence
  Description of Artificial Sequence: Synthetic oligonucleotide
  Target: FXN; (+) strand; PAM type: NRG; PAM sequence: CAG
actgcagggaaaccaagttg

SEQ ID NO: 18792 - DNA, 20 bp, Artificial Sequence
  Description of Artificial Sequence: Synthetic oligonucleotide
  Target: FXN; (+) strand; PAM type: NRG; PAM sequence: AGG
ctgcagggaaaccaagttgc

SEQ ID NO: 18793 - DNA, 20 bp, Artificial Sequence
  Description of Artificial Sequence: Synthetic oligonucleotide
  Target: FXN; (+) strand; PAM type: NRG; PAM sequence: CAG
ctaaactctgcccacacatg

SEQ ID NO: 18794 - DNA, 20 bp, Artificial Sequence
  Description of Artificial Sequence: Synthetic oligonucleotide
  Target: FXN; (+) strand; PAM type: NRG; PAM sequence: TAG
ccacacatgcagacattgat

SEQ ID NO: 18795 - DNA, 20 bp, Artificial Sequence
  Description of Artificial Sequence: Synthetic oligonucleotide
  Target: FXN; (+) strand; PAM type: NRG; PAM sequence: AAG
acatgcagacattgattagc

SEQ ID NO: 18796 - DNA, 20 bp, Artificial Sequence
  Description of Artificial Sequence: Synthetic oligonucleotide
  Target: FXN; (+) strand; PAM type: NRG; PAM sequence: CAG
tgattagcaagctacaaaaa

SEQ ID NO: 18797 - DNA, 20 bp, Artificial Sequence
  Description of Artificial Sequence: Synthetic oligonucleotide
  Target: FXN; (+) strand; PAM type: NRG; PAM sequence: TAG
agtcatgaaacctgttttta

SEQ ID NO: 18798 - DNA, 20 bp, Artificial Sequence
  Description of Artificial Sequence: Synthetic oligonucleotide
  Target: FXN; (+) strand; PAM type: NRG; PAM sequence: AGG
gtcatgaaacctgtttttat

SEQ ID NO: 18799 - DNA, 20 bp, Artificial Sequence
  Description of Artificial Sequence: Synthetic oligonucleotide
  Target: FXN; (+) strand; PAM type: NRG; PAM sequence: TAG
gaaacctgtttttataggat

SEQ ID NO: 18800 - DNA, 20 bp, Artificial Sequence
  Description of Artificial Sequence: Synthetic oligonucleotide
  Target: FXN; (+) strand; PAM type: NRG; PAM sequence: AAG
ctgtttttataggattagtg

SEQ ID NO: 18801 - DNA, 20 bp, Artificial Sequence
  Description of Artificial Sequence: Synthetic oligonucleotide
  Target: FXN; (+) strand; PAM type: NRG; PAM sequence: CAG
ttataggattagtgaagccc

SEQ ID NO: 18802 - DNA, 20 bp, Artificial Sequence
  Description of Artificial Sequence: Synthetic oligonucleotide
  Target: FXN; (+) strand; PAM type: NRG; PAM sequence: CAG
tagtgaagccccagtttgac

SEQ ID NO: 18803 - DNA, 20 bp, Artificial Sequence
  Description of Artificial Sequence: Synthetic oligonucleotide
  Target: FXN; (+) strand; PAM type: NRG; PAM sequence: GAG
gtgaagccccagtttgacca

SEQ ID NO: 18804 - DNA, 20 bp, Artificial Sequence
  Description of Artificial Sequence: Synthetic oligonucleotide
  Target: FXN; (+) strand; PAM type: NRG; PAM sequence: TAG
actttgcatgaatgttttgt

SEQ ID NO: 18805 - DNA, 20 bp, Artificial Sequence
  Description of Artificial Sequence: Synthetic oligonucleotide
  Target: FXN; (+) strand; PAM type: NRG; PAM sequence: AAG
ttgcatgaatgttttgttag

SEQ ID NO: 18806 - DNA, 20 bp, Artificial Sequence
  Description of Artificial Sequence: Synthetic oligonucleotide
  Target: FXN; (+) strand; PAM type: NRG; PAM sequence: TAG
aagcaaatgtgccaatattc

SEQ ID NO: 18807 - DNA, 20 bp, Artificial Sequence
  Description of Artificial Sequence: Synthetic oligonucleotide
  Target: FXN; (+) strand; PAM type: NRG; PAM sequence: CAG
caaatgtgccaatattctag

SEQ ID NO: 18808 - DNA, 20 bp, Artificial Sequence
  Description of Artificial Sequence: Synthetic oligonucleotide
  Target: FXN; (+) strand; PAM type: NRG; PAM sequence: TGG
aatattctagcagctgcgtt

SEQ ID NO: 18809 - DNA, 20 bp, Artificial Sequence
  Description of Artificial Sequence: Synthetic oligonucleotide
  Target: FXN; (+) strand; PAM type: NRG; PAM sequence: GAG
tcttcttttttttttttttt

SEQ ID NO: 18810 - DNA, 20 bp, Artificial Sequence
  Description of Artificial Sequence: Synthetic oligonucleotide
  Target: FXN; (+) strand; PAM type: NRG; PAM sequence: AAG
ttttttttttttttgagttg

SEQ ID NO: 18811 - DNA, 20 bp, Artificial Sequence
  Description of Artificial Sequence: Synthetic oligonucleotide
  Target: FXN; (+) strand; PAM type: NRG; PAM sequence: TAG
tttttttttgagttgaagcc

SEQ ID NO: 18812 - DNA, 20 bp, Artificial Sequence
  Description of Artificial Sequence: Synthetic oligonucleotide
  Target: FXN; (+) strand; PAM type: NRG; PAM sequence: CAG
tgaagcctagctctgtcacc

SEQ ID NO: 18813 - DNA, 20 bp, Artificial Sequence
  Description of Artificial Sequence: Synthetic oligonucleotide
  Target: FXN; (+) strand; PAM type: NRG; PAM sequence: AGG
gaagcctagctctgtcaccc

SEQ ID NO: 18814 - DNA, 20 bp, Artificial Sequence
  Description of Artificial Sequence: Synthetic oligonucleotide
  Target: FXN; (+) strand; PAM type: NRG; PAM sequence: TGG
cctagctctgtcacccaggc

SEQ ID NO: 18815 - DNA, 20 bp, Artificial Sequence
  Description of Artificial Sequence: Synthetic oligonucleotide
  Target: FXN; (+) strand; PAM type: NRG; PAM sequence: GAG
tagctctgtcacccaggctg

SEQ ID NO: 18816 - DNA, 20 bp, Artificial Sequence
  Description of Artificial Sequence: Synthetic oligonucleotide
  Target: FXN; (+) strand; PAM type: NRG; PAM sequence: CAG
ctgtcacccaggctggagtg

SEQ ID NO: 18817 - DNA, 20 bp, Artificial Sequence
  Description of Artificial Sequence: Synthetic oligonucleotide
  Target: FXN; (+) strand; PAM type: NRG; PAM sequence: CAG
ggagtgcagttgtgtgatct

SEQ ID NO: 18818 - DNA, 20 bp, Artificial Sequence
  Description of Artificial Sequence: Synthetic oligonucleotide
  Target: FXN; (+) strand; PAM type: NRG; PAM sequence: CAG
tcactgcaacctctgcctcc

SEQ ID NO: 18819 - DNA, 20 bp, Artificial Sequence
  Description of Artificial Sequence: Synthetic oligonucleotide
  Target: FXN; (+) strand; PAM type: NRG; PAM sequence: AGG
cactgcaacctctgcctccc

SEQ ID NO: 18820 - DNA, 20 bp, Artificial Sequence
  Description of Artificial Sequence: Synthetic oligonucleotide
  Target: FXN; (+) strand; PAM type: NRG; PAM sequence: AAG
aacctctgcctcccaggttc

SEQ ID NO: 18821 - DNA, 20 bp, Artificial Sequence
  Description of Artificial Sequence: Synthetic oligonucleotide
  Target: FXN; (+) strand; PAM type: NRG; PAM sequence: GAG
ttctcccgcctcaacctcct

SEQ ID NO: 18822 - DNA, 20 bp, Artificial Sequence
  Description of Artificial Sequence: Synthetic oligonucleotide
  Target: FXN; (+) strand; PAM type: NRG; PAM sequence: TAG
tcccgcctcaacctcctgag

SEQ ID NO: 18823 - DNA, 20 bp, Artificial Sequence
  Description of Artificial Sequence: Synthetic oligonucleotide
  Target: FXN; (+) strand; PAM type: NRG; PAM sequence: TGG
gcctcaacctcctgagtagc

SEQ ID NO: 18824 - DNA, 20 bp, Artificial Sequence
  Description of Artificial Sequence: Synthetic oligonucleotide
  Target: FXN; (+) strand; PAM type: NRG; PAM sequence: GGG
cctcaacctcctgagtagct

SEQ ID NO: 18825 - DNA, 20 bp, Artificial Sequence
  Description of Artificial Sequence: Synthetic oligonucleotide
  Target: FXN; (+) strand; PAM type: NRG; PAM sequence: CAG
ctcctgagtagctgggatta

SEQ ID NO: 18826 - DNA, 20 bp, Artificial Sequence
  Description of Artificial Sequence: Synthetic oligonucleotide
  Target: FXN; (+) strand; PAM type: NRG; PAM sequence: CAG
tacagacatgtaccacaata

SEQ ID NO: 18827 - DNA, 20 bp, Artificial Sequence
  Description of Artificial Sequence: Synthetic oligonucleotide
  Target: FXN; (+) strand; PAM type: NRG; PAM sequence: AGG
acagacatgtaccacaatac

SEQ ID NO: 18828 - DNA, 20 bp, Artificial Sequence
  Description of Artificial Sequence: Synthetic oligonucleotide
  Target: FXN; (+) strand; PAM type: NRG; PAM sequence: GGG
cagacatgtaccacaataca

SEQ ID NO: 18829 - DNA, 20 bp, Artificial Sequence
  Description of Artificial Sequence: Synthetic oligonucleotide
  Target: FXN; (+) strand; PAM type: NRG; PAM sequence: AAG
atgtaccacaatacagggct

SEQ ID NO: 18830 - DNA, 20 bp, Artificial Sequence
  Description of Artificial Sequence: Synthetic oligonucleotide
  Target: FXN; (+) strand; PAM type: NRG; PAM sequence: TAG
agggctaagttttgtatttt

SEQ ID NO: 18831 - DNA, 20 bp, Artificial Sequence
  Description of Artificial Sequence: Synthetic oligonucleotide
  Target: FXN; (+) strand; PAM type: NRG; PAM sequence: TAG
gctaagttttgtatttttag

SEQ ID NO: 18832 - DNA, 20 bp, Artificial Sequence
  Description of Artificial Sequence: Synthetic oligonucleotide
  Target: FXN; (+) strand; PAM type: NRG; PAM sequence: TGG
ttttgtatttttagtagaaa

SEQ ID NO: 18833 - DNA, 20 bp, Artificial Sequence
  Description of Artificial Sequence: Synthetic oligonucleotide
  Target: FXN; (+) strand; PAM type: NRG; PAM sequence: GGG
tttgtatttttagtagaaat

SEQ ID NO: 18834 - DNA, 20 bp, Artificial Sequence
  Description of Artificial Sequence: Synthetic oligonucleotide
  Target: FXN; (+) strand; PAM type: NRG; PAM sequence: GGG
ttgtatttttagtagaaatg

SEQ ID NO: 18835 - DNA, 20 bp, Artificial Sequence
  Description of Artificial Sequence: Synthetic oligonucleotide
  Target: FXN; (+) strand; PAM type: NRG; PAM sequence: TGG
gaaatggggtttcaccatgt

SEQ ID NO: 18836 - DNA, 20 bp, Artificial Sequence
  Description of Artificial Sequence: Synthetic oligonucleotide
  Target: FXN; (+) strand; PAM type: NRG; PAM sequence: CAG
tggggtttcaccatgttggc

SEQ ID NO: 18837 - DNA, 20 bp, Artificial Sequence
  Description of Artificial Sequence: Synthetic oligonucleotide
  Target: FXN; (+) strand; PAM type: NRG; PAM sequence: AGG
ggggtttcaccatgttggcc

SEQ ID NO: 18838 - DNA, 20 bp, Artificial Sequence
  Description of Artificial Sequence: Synthetic oligonucleotide
  Target: FXN; (+) strand; PAM type: NRG; PAM sequence: TGG
tttcaccatgttggccaggc

SEQ ID NO: 18839 - DNA, 20 bp, Artificial Sequence
  Description of Artificial Sequence: Synthetic oligonucleotide
  Target: FXN; (+) strand; PAM type: NRG; PAM sequence: AAG
ggtctcaaactcctgatctc

SEQ ID NO: 18840 - DNA, 20 bp, Artificial Sequence
  Description of Artificial Sequence: Synthetic oligonucleotide
  Target: FXN; (+) strand; PAM type: NRG; PAM sequence: CAG
ctcaagtgatccacccgcct

SEQ ID NO: 18841 - DNA, 20 bp, Artificial Sequence
  Description of Artificial Sequence: Synthetic oligonucleotide
  Target: FXN; (+) strand; PAM type: NRG; PAM sequence: AAG
ccacccgcctcagcctccta

SEQ ID NO: 18842 - DNA, 20 bp, Artificial Sequence
  Description of Artificial Sequence: Synthetic oligonucleotide
  Target: FXN; (+) strand; PAM type: NRG; PAM sequence: TGG
gcctcagcctcctaaagtgc

SEQ ID NO: 18843 - DNA, 20 bp, Artificial Sequence
  Description of Artificial Sequence: Synthetic oligonucleotide
  Target: FXN; (+) strand; PAM type: NRG; PAM sequence: GGG
cctcagcctcctaaagtgct

SEQ ID NO: 18844 - DNA, 20 bp, Artificial Sequence
  Description of Artificial Sequence: Synthetic oligonucleotide
  Target: FXN; (+) strand; PAM type: NRG; PAM sequence: CAG
ctcctaaagtgctgggttaa

SEQ ID NO: 18845 - DNA, 20 bp, Artificial Sequence
  Description of Artificial Sequence: Synthetic oligonucleotide
  Target: FXN; (+) strand; PAM type: NRG; PAM sequence: AGG
tcctaaagtgctgggttaac

SEQ ID NO: 18846 - DNA, 20 bp, Artificial Sequence
  Description of Artificial Sequence: Synthetic oligonucleotide
  Target: FXN; (+) strand; PAM type: NRG; PAM sequence: GAG
agtgctgggttaacaggcat

SEQ ID NO: 18847 - DNA, 20 bp, Artificial Sequence
  Description of Artificial Sequence: Synthetic oligonucleotide
  Target: FXN; (+) strand; PAM type: NRG; PAM sequence: CGG
gggttaacaggcatgagcca

SEQ ID NO: 18848 - DNA, 20 bp, Artificial Sequence
  Description of Artificial Sequence: Synthetic oligonucleotide
  Target: FXN; (+) strand; PAM type: NRG; PAM sequence: TGG
caggcatgagccacggcacc

SEQ ID NO: 18849 - DNA, 20 bp, Artificial Sequence
  Description of Artificial Sequence: Synthetic oligonucleotide
  Target: FXN; (+) strand; PAM type: NRG; PAM sequence: AAG
tgagccacggcacctggcaa

SEQ ID NO: 18850 - DNA, 20 bp, Artificial Sequence
  Description of Artificial Sequence: Synthetic oligonucleotide
  Target: FXN; (+) strand; PAM type: NRG; PAM sequence: TGG
acctggcaaaagtcatcttt

SEQ ID NO: 18851 - DNA, 20 bp, Artificial Sequence
  Description of Artificial Sequence: Synthetic oligonucleotide
  Target: FXN; (+) strand; PAM type: NRG; PAM sequence: AAG
ttacttctattgaactgaaa

SEQ ID NO: 18852 - DNA, 20 bp, Artificial Sequence
  Description of Artificial Sequence: Synthetic oligonucleotide
  Target: FXN; (+) strand; PAM type: NRG; PAM sequence: TGG
aatatatttatataaaaata

SEQ ID NO: 18853 - DNA, 20 bp, Artificial Sequence
  Description of Artificial Sequence: Synthetic oligonucleotide
  Target: FXN; (+) strand; PAM type: NRG; PAM sequence: TAG
ttatataaaaatatggtatt

SEQ ID NO: 18854 - DNA, 20 bp, Artificial Sequence
  Description of Artificial Sequence: Synthetic oligonucleotide
  Target: FXN; (+) strand; PAM type: NRG; PAM sequence: TAG
gtatttagtattattatttt

SEQ ID NO: 18855 - DNA, 20 bp, Artificial Sequence
  Description of Artificial Sequence: Synthetic oligonucleotide
  Target: FXN; (+) strand; PAM type: NRG; PAM sequence: GAG
atttagtattattattttta

SEQ ID NO: 18856 - DNA, 20 bp, Artificial Sequence
  Description of Artificial Sequence: Synthetic oligonucleotide
  Target: FXN; (+) strand; PAM type: NRG; PAM sequence: CAG
agtattattatttttagaga

SEQ ID NO: 18857 - DNA, 20 bp, Artificial Sequence
  Description of Artificial Sequence: Synthetic oligonucleotide
  Target: FXN; (+) strand; PAM type: NRG; PAM sequence: AGG
gtattattatttttagagac

SEQ ID NO: 18858 - DNA, 20 bp, Artificial Sequence
  Description of Artificial Sequence: Synthetic oligonucleotide
  Target: FXN; (+) strand; PAM type: NRG; PAM sequence: GGG
tattattatttttagagaca

SEQ ID NO: 18859 - DNA, 20 bp, Artificial Sequence
  Description of Artificial Sequence: Synthetic oligonucleotide
  Target: FXN; (+) strand; PAM type: NRG; PAM sequence: CAG
cagggcctcgctctgtcacc

SEQ ID NO: 18860 - DNA, 20 bp, Artificial Sequence
  Description of Artificial Sequence: Synthetic oligonucleotide
  Target: FXN; (+) strand; PAM type: NRG; PAM sequence: AGG
agggcctcgctctgtcaccc

SEQ ID NO: 18861 - DNA, 20 bp, Artificial Sequence
  Description of Artificial Sequence: Synthetic oligonucleotide
  Target: FXN; (+) strand; PAM type: NRG; PAM sequence: TGG
cctcgctctgtcacccaggc

SEQ ID NO: 18862 - DNA, 20 bp, Artificial Sequence
  Description of Artificial Sequence: Synthetic oligonucleotide
  Target: FXN; (+) strand; PAM type: NRG; PAM sequence: GAG
tcgctctgtcacccaggctg

SEQ ID NO: 18863 - DNA, 20 bp, Artificial Sequence
  Description of Artificial Sequence: Synthetic oligonucleotide
  Target: FXN; (+) strand; PAM type: NRG; PAM sequence: CAG
ctgtcacccaggctggagtg

SEQ ID NO: 18864 - DNA, 20 bp, Artificial Sequence
  Description of Artificial Sequence: Synthetic oligonucleotide
  Target: FXN; (+) strand; PAM type: NRG; PAM sequence: TGG
tcacccaggctggagtgcag

SEQ ID NO: 18865 - DNA, 20 bp, Artificial Sequence
  Description of Artificial Sequence: Synthetic oligonucleotide
  Target: FXN; (+) strand; PAM type: NRG; PAM sequence: TAG
ggagtgcagtggcacaatca

SEQ ID NO: 18866 - DNA, 20 bp, Artificial Sequence
  Description of Artificial Sequence: Synthetic oligonucleotide
  Target: FXN; (+) strand; PAM type: NRG; PAM sequence: CAG
ggcacaatcatagctcactg

SEQ ID NO: 18867 - DNA, 20 bp, Artificial Sequence
  Description of Artificial Sequence: Synthetic oligonucleotide
  Target: FXN; (+) strand; PAM type: NRG; PAM sequence: AAG
tcatagctcactgcagcctc

SEQ ID NO: 18868 - DNA, 20 bp, Artificial Sequence
  Description of Artificial Sequence: Synthetic oligonucleotide
  Target: FXN; (+) strand; PAM type: NRG; PAM sequence: TGG
tcactgcagcctcaagcttc

SEQ ID NO: 18869 - DNA, 20 bp, Artificial Sequence
  Description of Artificial Sequence: Synthetic oligonucleotide
  Target: FXN; (+) strand; PAM type: NRG; PAM sequence: GGG
cactgcagcctcaagcttct

SEQ ID NO: 18870 - DNA, 20 bp, Artificial Sequence
  Description of Artificial Sequence: Synthetic oligonucleotide
  Target: FXN; (+) strand; PAM type: NRG; PAM sequence: AAG
agcctcaagcttctgggctc

SEQ ID NO: 18871 - DNA, 20 bp, Artificial Sequence
  Description of Artificial Sequence: Synthetic oligonucleotide
  Target: FXN; (+) strand; PAM type: NRG; PAM sequence: CAG
ctcaagtgatcgttccacct

SEQ ID NO: 18872 - DNA, 20 bp, Artificial Sequence
  Description of Artificial Sequence: Synthetic oligonucleotide
  Target: FXN; (+) strand; PAM type: NRG; PAM sequence: TAG
tcgttccacctcagcctccc

SEQ ID NO: 18873 - DNA, 20 bp, Artificial Sequence
  Description of Artificial Sequence: Synthetic oligonucleotide
  Target: FXN; (+) strand; PAM type: NRG; PAM sequence: TAG
ttccacctcagcctccctag

SEQ ID NO: 18874 - DNA, 20 bp, Artificial Sequence
  Description of Artificial Sequence: Synthetic oligonucleotide
  Target: FXN; (+) strand; PAM type: NRG; PAM sequence: TGG
acctcagcctccctagtagc

SEQ ID NO: 18875 - DNA, 20 bp, Artificial Sequence
  Description of Artificial Sequence: Synthetic oligonucleotide
  Target: FXN; (+) strand; PAM type: NRG; PAM sequence: GGG
cctcagcctccctagtagct

SEQ ID NO: 18876 - DNA, 20 bp, Artificial Sequence
  Description of Artificial Sequence: Synthetic oligonucleotide
  Target: FXN; (+) strand; PAM type: NRG; PAM sequence: CAG
ctccctagtagctgggacta

SEQ ID NO: 18877 - DNA, 20 bp, Artificial Sequence
  Description of Artificial Sequence: Synthetic oligonucleotide
  Target: FXN; (+) strand; PAM type: NRG; PAM sequence: AGG
tccctagtagctgggactac

SEQ ID NO: 18878 - DNA, 20 bp, Artificial Sequence
  Description of Artificial Sequence: Synthetic oligonucleotide
  Target: FXN; (+) strand; PAM type: NRG; PAM sequence: CGG
caggcacatgccaccatact

SEQ ID NO: 18879 - DNA, 20 bp, Artificial Sequence
  Description of Artificial Sequence: Synthetic oligonucleotide
  Target: FXN; (+) strand; PAM type: NRG; PAM sequence: TGG
taattattttattttattta

SEQ ID NO: 18880 - DNA, 20 bp, Artificial Sequence
  Description of Artificial Sequence: Synthetic oligonucleotide
  Target: FXN; (+) strand; PAM type: NRG; PAM sequence: GGG
aattattttattttatttat

SEQ ID NO: 18881 - DNA, 20 bp, Artificial Sequence
  Description of Artificial Sequence: Synthetic oligonucleotide
  Target: FXN; (+) strand; PAM type: NRG; PAM sequence: CAG
atgggtctcgctatgtttcc

SEQ ID NO: 18882 - DNA, 20 bp, Artificial Sequence
  Description of Artificial Sequence: Synthetic oligonucleotide
  Target: FXN; (+) strand; PAM type: NRG; PAM sequence: AGG
tgggtctcgctatgtttccc

SEQ ID NO: 18883 - DNA, 20 bp, Artificial Sequence
  Description of Artificial Sequence: Synthetic oligonucleotide
  Target: FXN; (+) strand; PAM type: NRG; PAM sequence: TGG
tctcgctatgtttcccaggc

SEQ ID NO: 18884 - DNA, 20 bp, Artificial Sequence
  Description of Artificial Sequence: Synthetic oligonucleotide
  Target: FXN; (+) strand; PAM type: NRG; PAM sequence: TGG
ccaggctggtctcaaactcc

SEQ ID NO: 18885 - DNA, 20 bp, Artificial Sequence
  Description of Artificial Sequence: Synthetic oligonucleotide
  Target: FXN; (+) strand; PAM type: NRG; PAM sequence: AAG
ggtctcaaactcctggcctc

SEQ ID NO: 18886 - DNA, 20 bp, Artificial Sequence
  Description of Artificial Sequence: Synthetic oligonucleotide
  Target: FXN; (+) strand; PAM type: NRG; PAM sequence: CGG
ctcaagcgattctctcacct

SEQ ID NO: 18887 - DNA, 20 bp, Artificial Sequence
  Description of Artificial Sequence: Synthetic oligonucleotide
  Target: FXN; (+) strand; PAM type: NRG; PAM sequence: AAG
tctctcacctcggcctccca

SEQ ID NO: 18888 - DNA, 20 bp, Artificial Sequence
  Description of Artificial Sequence: Synthetic oligonucleotide
  Target: FXN; (+) strand; PAM type: NRG; PAM sequence: CGG
acctcggcctcccaaagcac

SEQ ID NO: 18889 - DNA, 20 bp, Artificial Sequence
  Description of Artificial Sequence: Synthetic oligonucleotide
  Target: FXN; (+) strand; PAM type: NRG; PAM sequence: GGG
cctcggcctcccaaagcacc

SEQ ID NO: 18890 - DNA, 20 bp, Artificial Sequence
  Description of Artificial Sequence: Synthetic oligonucleotide
  Target: FXN; (+) strand; PAM type: NRG; PAM sequence: CAG
ctcccaaagcaccgggatta

SEQ ID NO: 18891 - DNA, 20 bp, Artificial Sequence
  Description of Artificial Sequence: Synthetic oligonucleotide
  Target: FXN; (+) strand; PAM type: NRG; PAM sequence: AGG
tcccaaagcaccgggattac

SEQ ID NO: 18892 - DNA, 20 bp, Artificial Sequence
  Description of Artificial Sequence: Synthetic oligonucleotide
  Target: FXN; (+) strand; PAM type: NRG; PAM sequence: CAG
ccgggattacaggtgtgtgc

SEQ ID NO: 18893 - DNA, 20 bp, Artificial Sequence
  Description of Artificial Sequence: Synthetic oligonucleotide
  Target: FXN; (+) strand; PAM type: NRG; PAM sequence: CAG
caggtgtgtgccagcacacc

SEQ ID NO: 18894 - DNA, 20 bp, Artificial Sequence
  Description of Artificial Sequence: Synthetic oligonucleotide
  Target: FXN; (+) strand; PAM type: NRG; PAM sequence: TAG
cagccacaaatctataaatt

SEQ ID NO: 18895 - DNA, 20 bp, Artificial Sequence
  Description of Artificial Sequence: Synthetic oligonucleotide
  Target: FXN; (+) strand; PAM type: NRG; PAM sequence: AAG
cacaaatctataaatttaga

SEQ ID NO: 18896 - DNA, 20 bp, Artificial Sequence
  Description of Artificial Sequence: Synthetic oligonucleotide
  Target: FXN; (+) strand; PAM type: NRG; PAM sequence: AGG
acaaatctataaatttagaa

SEQ ID NO: 18897 - DNA, 20 bp, Artificial Sequence
  Description of Artificial Sequence: Synthetic oligonucleotide
  Target: FXN; (+) strand; PAM type: NRG; PAM sequence: GAG
aaatctataaatttagaaag

SEQ ID NO: 18898 - DNA, 20 bp, Artificial Sequence
  Description of Artificial Sequence: Synthetic oligonucleotide
  Target: FXN; (+) strand; PAM type: NRG; PAM sequence: AGG
aatctataaatttagaaagg

SEQ ID NO: 18899 - DNA, 20 bp, Artificial Sequence
  Description of Artificial Sequence: Synthetic oligonucleotide
  Target: FXN; (+) strand; PAM type: NRG; PAM sequence: AAG
agaaaggaggactatttcta

SEQ ID NO: 18900 - DNA, 20 bp, Artificial Sequence
  Description of Artificial Sequence: Synthetic oligonucleotide
  Target: FXN; (+) strand; PAM type: NRG; PAM sequence: GAG
aaaggaggactatttctaaa

SEQ ID NO: 18901 - DNA, 20 bp, Artificial Sequence
  Description of Artificial Sequence: Synthetic oligonucleotide
  Target: FXN; (+) strand; PAM type: NRG; PAM sequence: AGG
aaggaggactatttctaaag

SEQ ID NO: 18902 - DNA, 20 bp, Artificial Sequence
  Description of Artificial Sequence: Synthetic oligonucleotide
  Target: FXN; (+) strand; PAM type: NRG; PAM sequence: GGG
aggaggactatttctaaaga

SEQ ID NO: 18903 - DNA, 20 bp, Artificial Sequence
  Description of Artificial Sequence: Synthetic oligonucleotide
  Target: FXN; (+) strand; PAM type: NRG; PAM sequence: TAG
aaagagggtcccactacctg

SEQ ID NO: 18904 - DNA, 20 bp, Artificial Sequence
  Description of Artificial Sequence: Synthetic oligonucleotide
  Target: FXN; (+) strand; PAM type: NRG; PAM sequence: AGG
aagagggtcccactacctgt

SEQ ID NO: 18905 - DNA, 20 bp, Artificial Sequence
  Description of Artificial Sequence: Synthetic oligonucleotide
  Target: FXN; (+) strand; PAM type: NRG; PAM sequence: CAG
agggtcccactacctgtagg

SEQ ID NO: 18906 - DNA, 20 bp, Artificial Sequence
  Description of Artificial Sequence: Synthetic oligonucleotide
  Target: FXN; (+) strand; PAM type: NRG; PAM sequence: AGG
gggtcccactacctgtaggc

SEQ ID NO: 18907 - DNA, 20 bp, Artificial Sequence
  Description of Artificial Sequence: Synthetic oligonucleotide
  Target: FXN; (+) strand; PAM type: NRG; PAM sequence: AAG
tcccactacctgtaggcagg

SEQ ID NO: 18908 - DNA, 20 bp, Artificial Sequence
  Description of Artificial Sequence: Synthetic oligonucleotide
  Target: FXN; (+) strand; PAM type: NRG; PAM sequence: CAG
cactacctgtaggcaggaag

SEQ ID NO: 18909 - DNA, 20 bp, Artificial Sequence
  Description of Artificial Sequence: Synthetic oligonucleotide
  Target: FXN; (+) strand; PAM type: NRG; PAM sequence: GAG
ctacctgtaggcaggaagca

SEQ ID NO: 18910 - DNA, 20 bp, Artificial Sequence
  Description of Artificial Sequence: Synthetic oligonucleotide
  Target: FXN; (+) strand; PAM type: NRG; PAM sequence: TGG
taggcaggaagcagagcctc

SEQ ID NO: 18911 - DNA, 20 bp, Artificial Sequence
  Description of Artificial Sequence: Synthetic oligonucleotide
  Target: FXN; (+) strand; PAM type: NRG; PAM sequence: AAG
tctggccataactgaaaaac

SEQ ID NO: 18912 - DNA, 20 bp, Artificial Sequence
  Description of Artificial Sequence: Synthetic oligonucleotide
  Target: FXN; (+) strand; PAM type: NRG; PAM sequence: AAG
actgaaaaacaagcacttcc

SEQ ID NO: 18913 - DNA, 20 bp, Artificial Sequence
  Description of Artificial Sequence: Synthetic oligonucleotide
  Target: FXN; (+) strand; PAM type: NRG; PAM sequence: AAG
gaaaaacaagcacttccaag

SEQ ID NO: 18914 - DNA, 20 bp, Artificial Sequence
  Description of Artificial Sequence: Synthetic oligonucleotide
  Target: FXN; (+) strand; PAM type: NRG; PAM sequence: AGG
aaaaacaagcacttccaaga

SEQ ID NO: 18915 - DNA, 20 bp, Artificial Sequence
  Description of Artificial Sequence: Synthetic oligonucleotide
  Target: FXN; (+) strand; PAM type: NRG; PAM sequence: GGG
aaaacaagcacttccaagaa

SEQ ID NO: 18916 - DNA, 20 bp, Artificial Sequence
  Description of Artificial Sequence: Synthetic oligonucleotide
  Target: FXN; (+) strand; PAM type: NRG; PAM sequence: GGG
aaacaagcacttccaagaag

SEQ ID NO: 18917 - DNA, 20 bp, Artificial Sequence
  Description of Artificial Sequence: Synthetic oligonucleotide
  Target: FXN; (+) strand; PAM type: NRG; PAM sequence: AAG
agcacttccaagaaggggca

SEQ ID NO: 18918 - DNA, 20 bp, Artificial Sequence
  Description of Artificial Sequence: Synthetic oligonucleotide
  Target: FXN; (+) strand; PAM type: NRG; PAM sequence: AGG
gcacttccaagaaggggcaa

SEQ ID NO: 18919 - DNA, 20 bp, Artificial Sequence
  Description of Artificial Sequence: Synthetic oligonucleotide
  Target: FXN; (+) strand; PAM type: NRG; PAM sequence: GGG
cacttccaagaaggggcaaa

SEQ ID NO: 18920 - DNA, 20 bp, Artificial Sequence
  Description of Artificial Sequence: Synthetic oligonucleotide
  Target: FXN; (+) strand; PAM type: NRG; PAM sequence: GAG
agggaacatgaatttatgct

SEQ ID NO: 18921 - DNA, 20 bp, Artificial Sequence
  Description of Artificial Sequence: Synthetic oligonucleotide
  Target: FXN; (+) strand; PAM type: NRG; PAM sequence: GAG
ggaacatgaatttatgctga

SEQ ID NO: 18922 - DNA, 20 bp, Artificial Sequence
  Description of Artificial Sequence: Synthetic oligonucleotide
  Target: FXN; (+) strand; PAM type: NRG; PAM sequence: AGG
gaacatgaatttatgctgag

SEQ ID NO: 18923 - DNA, 20 bp, Artificial Sequence
  Description of Artificial Sequence: Synthetic oligonucleotide
  Target: FXN; (+) strand; PAM type: NRG; PAM sequence: TAG
tgaatttatgctgagaggcg

SEQ ID NO: 18924 - DNA, 20 bp, Artificial Sequence
  Description of Artificial Sequence: Synthetic oligonucleotide
  Target: FXN; (+) strand; PAM type: NRG; PAM sequence: AAG
ttatgctgagaggcgtagct

SEQ ID NO: 18925 - DNA, 20 bp, Artificial Sequence
  Description of Artificial Sequence: Synthetic oligonucleotide
  Target: FXN; (+) strand; PAM type: NRG; PAM sequence: CAG
agctaagcatacatattcaa

SEQ ID NO: 18926 - DNA, 20 bp, Artificial Sequence
  Description of Artificial Sequence: Synthetic oligonucleotide
  Target: FXN; (+) strand; PAM type: NRG; PAM sequence: TGG
catacatattcaacagatta

SEQ ID NO: 18927 - DNA, 20 bp, Artificial Sequence
  Description of Artificial Sequence: Synthetic oligonucleotide
  Target: FXN; (+) strand; PAM type: NRG; PAM sequence: GGG
atacatattcaacagattat

SEQ ID NO: 18928 - DNA, 20 bp, Artificial Sequence
  Description of Artificial Sequence: Synthetic oligonucleotide
  Target: FXN; (+) strand; PAM type: NRG; PAM sequence: GAG
acatattcaacagattatgg

SEQ ID NO: 18929 - DNA, 20 bp, Artificial Sequence
  Description of Artificial Sequence: Synthetic oligonucleotide
  Target: FXN; (+) strand; PAM type: NRG; PAM sequence: AGG
catattcaacagattatggg

SEQ ID NO: 18930 - DNA, 20 bp, Artificial Sequence
  Description of Artificial Sequence: Synthetic oligonucleotide
  Target: FXN; (+) strand; PAM type: NRG; PAM sequence: AAG
aggatctatgaatattcaca

SEQ ID NO: 18931 - DNA, 20 bp, Artificial Sequence
  Description of Artificial Sequence: Synthetic oligonucleotide
  Target: FXN; (+) strand; PAM type: NRG; PAM sequence: AGG
ggatctatgaatattcacaa

SEQ ID NO: 18932 - DNA, 20 bp, Artificial Sequence
  Description of Artificial Sequence: Synthetic oligonucleotide
  Target: FXN; (+) strand; PAM type: NRG; PAM sequence: GGG
gatctatgaatattcacaaa

SEQ ID NO: 18933 - DNA, 20 bp, Artificial Sequence
  Description of Artificial Sequence: Synthetic oligonucleotide
  Target: FXN; (+) strand; PAM type: NRG; PAM sequence: GAG
tctatgaatattcacaaagg

SEQ ID NO: 18934 - DNA, 20 bp, Artificial Sequence
  Description of Artificial Sequence: Synthetic oligonucleotide
  Target: FXN; (+) strand; PAM type: NRG; PAM sequence: AGG
ctatgaatattcacaaaggg

SEQ ID NO: 18935 - DNA, 20 bp, Artificial Sequence
  Description of Artificial Sequence: Synthetic oligonucleotide
  Target: FXN; (+) strand; PAM type: NRG; PAM sequence: TGG
tctatgaatatgcacacatg

SEQ ID NO: 18936 - DNA, 20 bp, Artificial Sequence
  Description of Artificial Sequence: Synthetic oligonucleotide
  Target: FXN; (+) strand; PAM type: NRG; PAM sequence: GAG
tatgaatatgcacacatgtg

SEQ ID NO: 18937 - DNA, 20 bp, Artificial Sequence
  Description of Artificial Sequence: Synthetic oligonucleotide
  Target: FXN; (+) strand; PAM type: NRG; PAM sequence: AAG
aatatgcacacatgtggagt

SEQ ID NO: 18938 - DNA, 20 bp, Artificial Sequence
  Description of Artificial Sequence: Synthetic oligonucleotide
  Target: FXN; (+) strand; PAM type: NRG; PAM sequence: CAG
gtggagtaagctaacgtgtg

SEQ ID NO: 18939 - DNA, 20 bp, Artificial Sequence
  Description of Artificial Sequence: Synthetic oligonucleotide
  Target: FXN; (+) strand; PAM type: NRG; PAM sequence: TAG
catgtctcccatgttcacct

SEQ ID NO: 18940 - DNA, 20 bp, Artificial Sequence
  Description of Artificial Sequence: Synthetic oligonucleotide
  Target: FXN; (+) strand; PAM type: NRG; PAM sequence: AGG
atgtctcccatgttcacctt

SEQ ID NO: 18941 - DNA, 20 bp, Artificial Sequence
  Description of Artificial Sequence: Synthetic oligonucleotide
  Target: FXN; (+) strand; PAM type: NRG; PAM sequence: CAG
tctcccatgttcaccttagg

SEQ ID NO: 18942 - DNA, 20 bp, Artificial Sequence
  Description of Artificial Sequence: Synthetic oligonucleotide
  Target: FXN; (+) strand; PAM type: NRG; PAM sequence: CAG
cttaacactaacatgtatta

SEQ ID NO: 18943 - DNA, 20 bp, Artificial Sequence
  Description of Artificial Sequence: Synthetic oligonucleotide
  Target: FXN; (+) strand; PAM type: NRG; PAM sequence: AGG
ttaacactaacatgtattac

SEQ ID NO: 18944 - DNA, 20 bp, Artificial Sequence
  Description of Artificial Sequence: Synthetic oligonucleotide
  Target: FXN; (+) strand; PAM type: NRG; PAM sequence: GGG
taacactaacatgtattaca

SEQ ID NO: 18945 - DNA, 20 bp, Artificial Sequence
  Description of Artificial Sequence: Synthetic oligonucleotide
  Target: FXN; (+) strand; PAM type: NRG; PAM sequence: GAG
gtattacagggcaacaaaat

SEQ ID NO: 18946 - DNA, 20 bp, Artificial Sequence
  Description of Artificial Sequence: Synthetic oligonucleotide
  Target: FXN; (+) strand; PAM type: NRG; PAM sequence: TAG
gactgcatatctacataacc

SEQ ID NO: 18947 - DNA, 20 bp, Artificial Sequence
  Description of Artificial Sequence: Synthetic oligonucleotide
  Target: FXN; (+) strand; PAM type: NRG; PAM sequence: TGG
atctacataacctagctatt

SEQ ID NO: 18948 - DNA, 20 bp, Artificial Sequence
  Description of Artificial Sequence: Synthetic oligonucleotide
  Target: FXN; (+) strand; PAM type: NRG; PAM sequence: TAG
tacataacctagctatttgg

SEQ ID NO: 18949 - DNA, 20 bp, Artificial Sequence
  Description of Artificial Sequence: Synthetic oligonucleotide
  Target: FXN; (+) strand; PAM type: NRG; PAM sequence: AGG
acataacctagctatttggt

SEQ ID NO: 18950 - DNA, 20 bp, Artificial Sequence
  Description of Artificial Sequence: Synthetic oligonucleotide
  Target: FXN; (+) strand; PAM type: NRG; PAM sequence: AAG
cctagctatttggtaggctg

SEQ ID NO: 18951 - DNA, 20 bp, Artificial Sequence
  Description of Artificial Sequence: Synthetic oligonucleotide
  Target: FXN; (+) strand; PAM type: NRG; PAM sequence: CAG
agctatttggtaggctgaag

SEQ ID NO: 18952 - DNA, 20 bp, Artificial Sequence
  Description of Artificial Sequence: Synthetic oligonucleotide
  Target: FXN; (+) strand; PAM type: NRG; PAM sequence: AGG
gctatttggtaggctgaagc

SEQ ID NO: 18953 - DNA, 20 bp, Artificial Sequence
  Description of Artificial Sequence: Synthetic oligonucleotide
  Target: FXN; (+) strand; PAM type: NRG; PAM sequence: GAG
tatttggtaggctgaagcag

SEQ ID NO: 18954 - DNA, 20 bp, Artificial Sequence
  Description of Artificial Sequence: Synthetic oligonucleotide
  Target: FXN; (+) strand; PAM type: NRG; PAM sequence: AAG
ctgaagcaggagcatcactt

SEQ ID NO: 18955 - DNA, 20 bp, Artificial Sequence
  Description of Artificial Sequence: Synthetic oligonucleotide
  Target: FXN; (+) strand; PAM type: NRG; PAM sequence: TGG
gcaggagcatcacttaagac

SEQ ID NO: 18956 - DNA, 20 bp, Artificial Sequence
  Description of Artificial Sequence: Synthetic oligonucleotide
  Target: FXN; (+) strand; PAM type: NRG; PAM sequence: GGG
caggagcatcacttaagact

SEQ ID NO: 18957 - DNA, 20 bp, Artificial Sequence
  Description of Artificial Sequence: Synthetic oligonucleotide
  Target: FXN; (+) strand; PAM type: NRG; PAM sequence: GAG
ggagcatcacttaagactgg

SEQ ID NO: 18958 - DNA, 20 bp, Artificial Sequence
  Description of Artificial Sequence: Synthetic oligonucleotide
  Target: FXN; (+) strand; PAM type: NRG; PAM sequence: GAG
tcacttaagactgggagttc

SEQ ID NO: 18959 - DNA, 20 bp, Artificial Sequence
  Description of Artificial Sequence: Synthetic oligonucleotide
  Target: FXN; (+) strand; PAM type: NRG; PAM sequence: AGG
cacttaagactgggagttcg

SEQ ID NO: 18960 - DNA, 20 bp, Artificial Sequence
  Description of Artificial Sequence: Synthetic oligonucleotide
  Target: FXN; (+) strand; PAM type: NRG; PAM sequence: CAG
ttaagactgggagttcgagg

SEQ ID NO: 18961 - DNA, 20 bp, Artificial Sequence
  Description of Artificial Sequence: Synthetic oligonucleotide
  Target: FXN; (+) strand; PAM type: NRG; PAM sequence: GAG
tgggagttcgaggcagctgt

SEQ ID NO: 18962 - DNA, 20 bp, Artificial Sequence
  Description of Artificial Sequence: Synthetic oligonucleotide
  Target: FXN; (+) strand; PAM type: NRG; PAM sequence: CAG
atgatcgcaccactgttctc

SEQ ID NO: 18963 - DNA, 20 bp, Artificial Sequence
  Description of Artificial Sequence: Synthetic oligonucleotide
  Target: FXN; (+) strand; PAM type: NRG; PAM sequence: CAG
tcgcaccactgttctccagc

SEQ ID NO: 18964 - DNA, 20 bp, Artificial Sequence
  Description of Artificial Sequence: Synthetic oligonucleotide
  Target: FXN; (+) strand; PAM type: NRG; PAM sequence: AGG
cgcaccactgttctccagcc

SEQ ID NO: 18965 - DNA, 20 bp, Artificial Sequence
  Description of Artificial Sequence: Synthetic oligonucleotide
  Target: FXN; (+) strand; PAM type: NRG; PAM sequence: CAG
ctgttctccagccaggatga

SEQ ID NO: 18966 - DNA, 20 bp, Artificial Sequence
  Description of Artificial Sequence: Synthetic oligonucleotide
  Target: FXN; (+) strand; PAM type: NRG; PAM sequence: AGG
tgttctccagccaggatgac

SEQ ID NO: 18967 - DNA, 20 bp, Artificial Sequence
  Description of Artificial Sequence: Synthetic oligonucleotide
  Target: FXN; (+) strand; PAM type: NRG; PAM sequence: GGG
gttctccagccaggatgaca

SEQ ID NO: 18968 - DNA, 20 bp, Artificial Sequence
  Description of Artificial Sequence: Synthetic oligonucleotide
  Target: FXN; (+) strand; PAM type: NRG; PAM sequence: AAG
tccagccaggatgacagggc

SEQ ID NO: 18969 - DNA, 20 bp, Artificial Sequence
  Description of Artificial Sequence: Synthetic oligonucleotide
  Target: FXN; (+) strand; PAM type: NRG; PAM sequence: TAG
gacagggcaagaccctgtct

SEQ ID NO: 18970 - DNA, 20 bp, Artificial Sequence
  Description of Artificial Sequence: Synthetic oligonucleotide
  Target: FXN; (+) strand; PAM type: NRG; PAM sequence: TGG
ccctgtcttagaccactctg

SEQ ID NO: 18971 - DNA, 20 bp, Artificial Sequence
  Description of Artificial Sequence: Synthetic oligonucleotide
  Target: FXN; (+) strand; PAM type: NRG; PAM sequence: CAG
gtcttagaccactctgtggt

SEQ ID NO: 18972 - DNA, 20 bp, Artificial Sequence
  Description of Artificial Sequence: Synthetic oligonucleotide
  Target: FXN; (+) strand; PAM type: NRG; PAM sequence: TGG
ttagaccactctgtggtcag

SEQ ID NO: 18973 - DNA, 20 bp, Artificial Sequence
  Description of Artificial Sequence: Synthetic oligonucleotide
  Target: FXN; (+) strand; PAM type: NRG; PAM sequence: CAG
actctgtggtcagtggttat

SEQ ID NO: 18974 - DNA, 20 bp, Artificial Sequence
  Description of Artificial Sequence: Synthetic oligonucleotide
  Target: FXN; (+) strand; PAM type: NRG; PAM sequence: AGG
ctctgtggtcagtggttatc

SEQ ID NO: 18975 - DNA, 20 bp, Artificial Sequence
  Description of Artificial Sequence: Synthetic oligonucleotide
  Target: FXN; (+) strand; PAM type: NRG; PAM sequence: AAG
tgtggtcagtggttatcagg

SEQ ID NO: 18976 - DNA, 20 bp, Artificial Sequence
  Description of Artificial Sequence: Synthetic oligonucleotide
  Target: FXN; (+) strand; PAM type: NRG; PAM sequence: AGG
gtggtcagtggttatcagga

SEQ ID NO: 18977 - DNA, 20 bp, Artificial Sequence
  Description of Artificial Sequence: Synthetic oligonucleotide
  Target: FXN; (+) strand; PAM type: NRG; PAM sequence: TAG
tggttatcaggaaggaatgc

SEQ ID NO: 18978 - DNA, 20 bp, Artificial Sequence
  Description of Artificial Sequence: Synthetic oligonucleotide
  Target: FXN; (+) strand; PAM type: NRG; PAM sequence: CAG
tatcaggaaggaatgctagt

SEQ ID NO: 18979 - DNA, 20 bp, Artificial Sequence
  Description of Artificial Sequence: Synthetic oligonucleotide
  Target: FXN; (+) strand; PAM type: NRG; PAM sequence: AAG
gttgtgctgaaaccactaaa

SEQ ID NO: 18980 - DNA, 20 bp, Artificial Sequence
  Description of Artificial Sequence: Synthetic oligonucleotide
  Target: FXN; (+) strand; PAM type: NRG; PAM sequence: AGG
ttgtgctgaaaccactaaaa

SEQ ID NO: 18981 - DNA, 20 bp, Artificial Sequence
  Description of Artificial Sequence: Synthetic oligonucleotide
  Target: FXN; (+) strand; PAM type: NRG; PAM sequence: AAG
tgctgaaaccactaaaaagg

SEQ ID NO: 18982 - DNA, 20 bp, Artificial Sequence
  Description of Artificial Sequence: Synthetic oligonucleotide
  Target: FXN; (+) strand; PAM type: NRG; PAM sequence: AGG
gctgaaaccactaaaaagga

SEQ ID NO: 18983 - DNA, 20 bp, Artificial Sequence
  Description of Artificial Sequence: Synthetic oligonucleotide
  Target: FXN; (+) strand; PAM type: NRG; PAM sequence: GGG
ctgaaaccactaaaaaggaa

SEQ ID NO: 18984 - DNA, 20 bp, Artificial Sequence
  Description of Artificial Sequence: Synthetic oligonucleotide
  Target: FXN; (+) strand; PAM type: NRG; PAM sequence: CAG
aaaccactaaaaaggaaggg

SEQ ID NO: 18985 - DNA, 20 bp, Artificial Sequence
  Description of Artificial Sequence: Synthetic oligonucleotide
  Target: FXN; (+) strand; PAM type: NRG; PAM sequence: TAG
ctaaaaaggaagggcagaat

SEQ ID NO: 18986 - DNA, 20 bp, Artificial Sequence
  Description of Artificial Sequence: Synthetic oligonucleotide
  Target: FXN; (+) strand; PAM type: NRG; PAM sequence: AGG
taaaaaggaagggcagaatt

SEQ ID NO: 18987 - DNA, 20 bp, Artificial Sequence
  Description of Artificial Sequence: Synthetic oligonucleotide
  Target: FXN; (+) strand; PAM type: NRG; PAM sequence: GAG
gaagggcagaattaggtgat

SEQ ID NO: 18988 - DNA, 20 bp, Artificial Sequence
  Description of Artificial Sequence: Synthetic oligonucleotide
  Target: FXN; (+) strand; PAM type: NRG; PAM sequence: CAG
attaggtgatgagttgatac

SEQ ID NO: 18989 - DNA, 20 bp, Artificial Sequence
  Description of Artificial Sequence: Synthetic oligonucleotide
  Target: FXN; (+) strand; PAM type: NRG; PAM sequence: TGG
aggtgatgagttgataccag

SEQ ID NO: 18990 - DNA, 20 bp, Artificial Sequence
  Description of Artificial Sequence: Synthetic oligonucleotide
  Target: FXN; (+) strand; PAM type: NRG; PAM sequence: AAG
atgagttgataccagtggtg

SEQ ID NO: 18991 - DNA, 20 bp, Artificial Sequence
  Description of Artificial Sequence: Synthetic oligonucleotide
  Target: FXN; (+) strand; PAM type: NRG; PAM sequence: GAG
gttgataccagtggtgaagt

SEQ ID NO: 18992 - DNA, 20 bp, Artificial Sequence
  Description of Artificial Sequence: Synthetic oligonucleotide
  Target: FXN; (+) strand; PAM type: NRG; PAM sequence: GAG
ttttttttttttttcttttt

SEQ ID NO: 18993 - DNA, 20 bp, Artificial Sequence
  Description of Artificial Sequence: Synthetic oligonucleotide
  Target: FXN; (+) strand; PAM type: NRG; PAM sequence: TGG
ttttttttttctttttgaga

SEQ ID NO: 18994 - DNA, 20 bp, Artificial Sequence
  Description of Artificial Sequence: Synthetic oligonucleotide
  Target: FXN; (+) strand; PAM type: NRG; PAM sequence: GAG
ttttttttctttttgagatg

SEQ ID NO: 18995 - DNA, 20 bp, Artificial Sequence
  Description of Artificial Sequence: Synthetic oligonucleotide
  Target: FXN; (+) strand; PAM type: NRG; PAM sequence: CAG
tggagtcttgctctgttgcc

SEQ ID NO: 18996 - DNA, 20 bp, Artificial Sequence
  Description of Artificial Sequence: Synthetic oligonucleotide
  Target: FXN; (+) strand; PAM type: NRG; PAM sequence: AGG
ggagtcttgctctgttgccc

SEQ ID NO: 18997 - DNA, 20 bp, Artificial Sequence
  Description of Artificial Sequence: Synthetic oligonucleotide
  Target: FXN; (+) strand; PAM type: NRG; PAM sequence: TGG
tcttgctctgttgcccaggc

SEQ ID NO: 18998 - DNA, 20 bp, Artificial Sequence
  Description of Artificial Sequence: Synthetic oligonucleotide
  Target: FXN; (+) strand; PAM type: NRG; PAM sequence: GAG
ttgctctgttgcccaggctg

SEQ ID NO: 18999 - DNA, 20 bp, Artificial Sequence
  Description of Artificial Sequence: Synthetic oligonucleotide
  Target: FXN; (+) strand; PAM type: NRG; PAM sequence: TAG
ctgttgcccaggctggagtg

SEQ ID NO: 19000 - DNA, 20 bp, Artificial Sequence
  Description of Artificial Sequence: Synthetic oligonucleotide
  Target: FXN; (+) strand; PAM type: NRG; PAM sequence: TGG
ttgcccaggctggagtgtag

SEQ ID NO: 19001 - DNA, 20 bp, Artificial Sequence
  Description of Artificial Sequence: Synthetic oligonucleotide
  Target: FXN; (+) strand; PAM type: NRG; PAM sequence: CAG
ggagtgtagtggtgtgatct

SEQ ID NO: 19002 - DNA, 20 bp, Artificial Sequence
  Description of Artificial Sequence: Synthetic oligonucleotide
  Target: FXN; (+) strand; PAM type: NRG; PAM sequence: TGG
tcatcgcaacctccacctcc

SEQ ID NO: 19003 - DNA, 20 bp, Artificial Sequence
  Description of Artificial Sequence: Synthetic oligonucleotide
  Target: FXN; (+) strand; PAM type: NRG; PAM sequence: GGG
catcgcaacctccacctcct

SEQ ID NO: 19004 - DNA, 20 bp, Artificial Sequence
  Description of Artificial Sequence: Synthetic oligonucleotide
  Target: FXN; (+) strand; PAM type: NRG; PAM sequence: AAG
aacctccacctcctgggttc

SEQ ID NO: 19005 - DNA, 20 bp, Artificial Sequence
  Description of Artificial Sequence: Synthetic oligonucleotide
  Target: FXN; (+) strand; PAM type: NRG; PAM sequence: CAG
ttcaagtgattctcttgcct

SEQ ID NO: 19006 - DNA, 20 bp, Artificial Sequence
  Description of Artificial Sequence: Synthetic oligonucleotide
  Target: FXN; (+) strand; PAM type: NRG; PAM sequence: GAG
ttctcttgcctcagcctccc

SEQ ID NO: 19007 - DNA, 20 bp, Artificial Sequence
  Description of Artificial Sequence: Synthetic oligonucleotide
  Target: FXN; (+) strand; PAM type: NRG; PAM sequence: TAG
tcttgcctcagcctcccgag

SEQ ID NO: 19008 - DNA, 20 bp, Artificial Sequence
  Description of Artificial Sequence: Synthetic oligonucleotide
  Target: FXN; (+) strand; PAM type: NRG; PAM sequence: TGG
gcctcagcctcccgagtagc

SEQ ID NO: 19009 - DNA, 20 bp, Artificial Sequence
  Description of Artificial Sequence: Synthetic oligonucleotide
  Target: FXN; (+) strand; PAM type: NRG; PAM sequence: GGG
cctcagcctcccgagtagct

SEQ ID NO: 19010 - DNA, 20 bp, Artificial Sequence
  Description of Artificial Sequence: Synthetic oligonucleotide
  Target: FXN; (+) strand; PAM type: NRG; PAM sequence: CAG
ctcccgagtagctgggatta

SEQ ID NO: 19011 - DNA, 20 bp, Artificial Sequence
  Description of Artificial Sequence: Synthetic oligonucleotide
  Target: FXN; (+) strand; PAM type: NRG; PAM sequence: AGG
tcccgagtagctgggattac

SEQ ID NO: 19012 - DNA, 20 bp, Artificial Sequence
  Description of Artificial Sequence: Synthetic oligonucleotide
  Target: FXN; (+) strand; PAM type: NRG; PAM sequence: TGG
caggcgcctgccaccacgcc

SEQ ID NO: 19013 - DNA, 20 bp, Artificial Sequence
  Description of Artificial Sequence: Synthetic oligonucleotide
  Target: FXN; (+) strand; PAM type: NRG; PAM sequence: TAG
ggctaatttttttatatttt

SEQ ID NO: 19014 - DNA, 20 bp, Artificial Sequence
  Description of Artificial Sequence: Synthetic oligonucleotide
  Target: FXN; (+) strand; PAM type: NRG; PAM sequence: TAG
taatttttttatatttttag

SEQ ID NO: 19015 - DNA, 20 bp, Artificial Sequence
  Description of Artificial Sequence: Synthetic oligonucleotide
  Target: FXN; (+) strand; PAM type: NRG; PAM sequence: GAG
atttttttatatttttagta

SEQ ID NO: 19016 - DNA, 20 bp, Artificial Sequence
  Description of Artificial Sequence: Synthetic oligonucleotide
  Target: FXN; (+) strand; PAM type: NRG; PAM sequence: TGG
tttatatttttagtagagac

SEQ ID NO: 19017 - DNA, 20 bp, Artificial Sequence
  Description of Artificial Sequence: Synthetic oligonucleotide
  Target: FXN; (+) strand; PAM type: NRG; PAM sequence: GGG
ttatatttttagtagagact

SEQ ID NO: 19018 - DNA, 20 bp, Artificial Sequence
  Description of Artificial Sequence: Synthetic oligonucleotide
  Target: FXN; (+) strand; PAM type: NRG; PAM sequence: CAG
actgggttttgccatgttgt

SEQ ID NO: 19019 - DNA, 20 bp, Artificial Sequence
  Description of Artificial Sequence: Synthetic oligonucleotide
  Target: FXN; (+) strand; PAM type: NRG; PAM sequence: AGG
ctgggttttgccatgttgtc

SEQ ID NO: 19020 - DNA, 20 bp, Artificial Sequence
  Description of Artificial Sequence: Synthetic oligonucleotide
  Target: FXN; (+) strand; PAM type: NRG; PAM sequence: TAG
gttttgccatgttgtcaggc

SEQ ID NO: 19021 - DNA, 20 bp, Artificial Sequence
  Description of Artificial Sequence: Synthetic oligonucleotide
  Target: FXN; (+) strand; PAM type: NRG; PAM sequence: CAG
tagtcttgaactcctgacct

SEQ ID NO: 19022 - DNA, 20 bp, Artificial Sequence
  Description of Artificial Sequence: Synthetic oligonucleotide
  Target: FXN; (+) strand; PAM type: NRG; PAM sequence: AGG
agtcttgaactcctgacctc

SEQ ID NO: 19023 - DNA, 20 bp, Artificial Sequence
  Description of Artificial Sequence: Synthetic oligonucleotide
  Target: FXN; (+) strand; PAM type: NRG; PAM sequence: TGG
ctcaggtaatccaactgctt

SEQ ID NO: 19024 - DNA, 20 bp, Artificial Sequence
  Description of Artificial Sequence: Synthetic oligonucleotide
  Target: FXN; (+) strand; PAM type: NRG; PAM sequence: AAG
ccaactgctttggcctccca

SEQ ID NO: 19025 - DNA, 20 bp, Artificial Sequence
  Description of Artificial Sequence: Synthetic oligonucleotide
  Target: FXN; (+) strand; PAM type: NRG; PAM sequence: TGG
gctttggcctcccaaagtgc

SEQ ID NO: 19026 - DNA, 20 bp, Artificial Sequence
  Description of Artificial Sequence: Synthetic oligonucleotide
  Target: FXN; (+) strand; PAM type: NRG; PAM sequence: GGG
ctttggcctcccaaagtgct

SEQ ID NO: 19027 - DNA, 20 bp, Artificial Sequence
  Description of Artificial Sequence: Synthetic oligonucleotide
  Target: FXN; (+) strand; PAM type: NRG; PAM sequence: CAG
ctcccaaagtgctgggatta

SEQ ID NO: 19028 - DNA, 20 bp, Artificial Sequence
  Description of Artificial Sequence: Synthetic oligonucleotide
  Target: FXN; (+) strand; PAM type: NRG; PAM sequence: AGG
tcccaaagtgctgggattac

SEQ ID NO: 19029 - DNA, 20 bp, Artificial Sequence
  Description of Artificial Sequence: Synthetic oligonucleotide
  Target: FXN; (+) strand; PAM type: NRG; PAM sequence: CAG
caaagtgctgggattacagg

SEQ ID NO: 19030 - DNA, 20 bp, Artificial Sequence
  Description of Artificial Sequence: Synthetic oligonucleotide
  Target: FXN; (+) strand; PAM type: NRG; PAM sequence: AAG
tgggattacaggcagctcca

SEQ ID NO: 19031 - DNA, 20 bp, Artificial Sequence
  Description of Artificial Sequence: Synthetic oligonucleotide
  Target: FXN; (+) strand; PAM type: NRG; PAM sequence: TGG
tacaggcagctccaaagtgc

SEQ ID NO: 19032 - DNA, 20 bp, Artificial Sequence
  Description of Artificial Sequence: Synthetic oligonucleotide
  Target: FXN; (+) strand; PAM type: NRG; PAM sequence: GGG
acaggcagctccaaagtgct

SEQ ID NO: 19033 - DNA, 20 bp, Artificial Sequence
  Description of Artificial Sequence: Synthetic oligonucleotide
  Target: FXN; (+) strand; PAM type: NRG; PAM sequence: CAG
gctccaaagtgctgggatta

SEQ ID NO: 19034 - DNA, 20 bp, Artificial Sequence
  Description of Artificial Sequence: Synthetic oligonucleotide
  Target: FXN; (+) strand; PAM type: NRG; PAM sequence: AGG
ctccaaagtgctgggattac

SEQ ID NO: 19035 - DNA, 20 bp, Artificial Sequence
  Description of Artificial Sequence: Synthetic oligonucleotide
  Target: FXN; (+) strand; PAM type: NRG; PAM sequence: GAG
agtgctgggattacaggcat

SEQ ID NO: 19036 - DNA, 20 bp, Artificial Sequence
  Description of Artificial Sequence: Synthetic oligonucleotide
  Target: FXN; (+) strand; PAM type: NRG; PAM sequence: TGG
caggcatgagccaccatgca

SEQ ID NO: 19037 - DNA, 20 bp, Artificial Sequence
  Description of Artificial Sequence: Synthetic oligonucleotide
  Target: FXN; (+) strand; PAM type: NRG; PAM sequence: AAG
gcctgaaataatttttttga

SEQ ID NO: 19038 - DNA, 20 bp, Artificial Sequence
  Description of Artificial Sequence: Synthetic oligonucleotide
  Target: FXN; (+) strand; PAM type: NRG; PAM sequence: AGG
cctgaaataatttttttgaa

SEQ ID NO: 19039 - DNA, 20 bp, Artificial Sequence
  Description of Artificial Sequence: Synthetic oligonucleotide
  Target: FXN; (+) strand; PAM type: NRG; PAM sequence: GGG
ctgaaataatttttttgaaa

SEQ ID NO: 19040 - DNA, 20 bp, Artificial Sequence
  Description of Artificial Sequence: Synthetic oligonucleotide
  Target: FXN; (+) strand; PAM type: NRG; PAM sequence: TAG
aataatttttttgaaagggc

SEQ ID NO: 19041 - DNA, 20 bp, Artificial Sequence
  Description of Artificial Sequence: Synthetic oligonucleotide
  Target: FXN; (+) strand; PAM type: NRG; PAM sequence: TAG
tgaaagggctagtttctatt

SEQ ID NO: 19042 - DNA, 20 bp, Artificial Sequence
  Description of Artificial Sequence: Synthetic oligonucleotide
  Target: FXN; (+) strand; PAM type: NRG; PAM sequence: TAG
gctagtttctatttagccct

SEQ ID NO: 19043 - DNA, 20 bp, Artificial Sequence
  Description of Artificial Sequence: Synthetic oligonucleotide
  Target: FXN; (+) strand; PAM type: NRG; PAM sequence: AGG
ctagtttctatttagccctt

SEQ ID NO: 19044 - DNA, 20 bp, Artificial Sequence
  Description of Artificial Sequence: Synthetic oligonucleotide
  Target: FXN; (+) strand; PAM type: NRG; PAM sequence: GGG
tagtttctatttagccctta

SEQ ID NO: 19045 - DNA, 20 bp, Artificial Sequence
  Description of Artificial Sequence: Synthetic oligonucleotide
  Target: FXN; (+) strand; PAM type: NRG; PAM sequence: GGG
agtttctatttagcccttag

SEQ ID NO: 19046 - DNA, 20 bp, Artificial Sequence
  Description of Artificial Sequence: Synthetic oligonucleotide
  Target: FXN; (+) strand; PAM type: NRG; PAM sequence: TGG
cttaggggaaaaaaaactaa

SEQ ID NO: 19047 - DNA, 20 bp, Artificial Sequence
  Description of Artificial Sequence: Synthetic oligonucleotide
  Target: FXN; (+) strand; PAM type: NRG; PAM sequence: CAG
aggggaaaaaaaactaatgg

SEQ ID NO: 19048 - DNA, 20 bp, Artificial Sequence
  Description of Artificial Sequence: Synthetic oligonucleotide
  Target: FXN; (+) strand; PAM type: NRG; PAM sequence: TAG
gaaaaaaaactaatggcagt

SEQ ID NO: 19049 - DNA, 20 bp, Artificial Sequence
  Description of Artificial Sequence: Synthetic oligonucleotide
  Target: FXN; (+) strand; PAM type: NRG; PAM sequence: AGG
aaaaaaaactaatggcagtt

SEQ ID NO: 19050 - DNA, 20 bp, Artificial Sequence
  Description of Artificial Sequence: Synthetic oligonucleotide
  Target: FXN; (+) strand; PAM type: NRG; PAM sequence: GGG
aaaaaaactaatggcagtta

SEQ ID NO: 19051 - DNA, 20 bp, Artificial Sequence
  Description of Artificial Sequence: Synthetic oligonucleotide
  Target: FXN; (+) strand; PAM type: NRG; PAM sequence: GAG
aaaaactaatggcagttagg

SEQ ID NO: 19052 - DNA, 20 bp, Artificial Sequence
  Description of Artificial Sequence: Synthetic oligonucleotide
  Target: FXN; (+) strand; PAM type: NRG; PAM sequence: AGG
aaaactaatggcagttaggg

SEQ ID NO: 19053 - DNA, 20 bp, Artificial Sequence
  Description of Artificial Sequence: Synthetic oligonucleotide
  Target: FXN; (+) strand; PAM type: NRG; PAM sequence: GGG
aaactaatggcagttaggga

SEQ ID NO: 19054 - DNA, 20 bp, Artificial Sequence
  Description of Artificial Sequence: Synthetic oligonucleotide
  Target: FXN; (+) strand; PAM type: NRG; PAM sequence: TAG
aatggcagttagggagggaa

SEQ ID NO: 19055 - DNA, 20 bp, Artificial Sequence
  Description of Artificial Sequence: Synthetic oligonucleotide
  Target: FXN; (+) strand; PAM type: NRG; PAM sequence: GAG
agttagggagggaatagaac

SEQ ID NO: 19056 - DNA, 20 bp, Artificial Sequence
  Description of Artificial Sequence: Synthetic oligonucleotide
  Target: FXN; (+) strand; PAM type: NRG; PAM sequence: TGG
tttgaactcctttcccatca

SEQ ID NO: 19057 - DNA, 20 bp, Artificial Sequence
  Description of Artificial Sequence: Synthetic oligonucleotide
  Target: FXN; (+) strand; PAM type: NRG; PAM sequence: TAG
ccaaaacttaaaattttttt

SEQ ID NO: 19058 - DNA, 20 bp, Artificial Sequence
  Description of Artificial Sequence: Synthetic oligonucleotide
  Target: FXN; (+) strand; PAM type: NRG; PAM sequence: TGG
aaattttttttagatatctc

SEQ ID NO: 19059 - DNA, 20 bp, Artificial Sequence
  Description of Artificial Sequence: Synthetic oligonucleotide
  Target: FXN; (+) strand; PAM type: NRG; PAM sequence: GGG
aattttttttagatatctct

SEQ ID NO: 19060 - DNA, 20 bp, Artificial Sequence
  Description of Artificial Sequence: Synthetic oligonucleotide
  Target: FXN; (+) strand; PAM type: NRG; PAM sequence: TGG
agatatctctgggctcccct

SEQ ID NO: 19061 - DNA, 20 bp, Artificial Sequence
  Description of Artificial Sequence: Synthetic oligonucleotide
  Target: FXN; (+) strand; PAM type: NRG; PAM sequence: AAG
tctgggctccccttggccaa

SEQ ID NO: 19062 - DNA, 20 bp, Artificial Sequence
  Description of Artificial Sequence: Synthetic oligonucleotide
  Target: FXN; (+) strand; PAM type: NRG; PAM sequence: TAG
ggctccccttggccaaaaga

SEQ ID NO: 19063 - DNA, 20 bp, Artificial Sequence
  Description of Artificial Sequence: Synthetic oligonucleotide
  Target: FXN; (+) strand; PAM type: NRG; PAM sequence: GAG
tggccaaaagatagtttgtt

SEQ ID NO: 19064 - DNA, 20 bp, Artificial Sequence
  Description of Artificial Sequence: Synthetic oligonucleotide
  Target: FXN; (+) strand; PAM type: NRG; PAM sequence: CAG
caaaagatagtttgttgagt

SEQ ID NO: 19065 - DNA, 20 bp, Artificial Sequence
  Description of Artificial Sequence: Synthetic oligonucleotide
  Target: FXN; (+) strand; PAM type: NRG; PAM sequence: TGG
agatagtttgttgagtcagt

SEQ ID NO: 19066 - DNA, 20 bp, Artificial Sequence
  Description of Artificial Sequence: Synthetic oligonucleotide
  Target: FXN; (+) strand; PAM type: NRG; PAM sequence: GGG
gatagtttgttgagtcagtt

SEQ ID NO: 19067 - DNA, 20 bp, Artificial Sequence
  Description of Artificial Sequence: Synthetic oligonucleotide
  Target: FXN; (+) strand; PAM type: NRG; PAM sequence: GAG
tagtttgttgagtcagttgg

SEQ ID NO: 19068 - DNA, 20 bp, Artificial Sequence
  Description of Artificial Sequence: Synthetic oligonucleotide
  Target: FXN; (+) strand; PAM type: NRG; PAM sequence: TAG
tgttgagtcagttgggagct

SEQ ID NO: 19069 - DNA, 20 bp, Artificial Sequence
  Description of Artificial Sequence: Synthetic oligonucleotide
  Target: FXN; (+) strand; PAM type: NRG; PAM sequence: CAG
atcattgaatcaatttgaac

SEQ ID NO: 19070 - DNA, 20 bp, Artificial Sequence
  Description of Artificial Sequence: Synthetic oligonucleotide
  Target: FXN; (+) strand; PAM type: NRG; PAM sequence: AGG
tcattgaatcaatttgaacc

SEQ ID NO: 19071 - DNA, 20 bp, Artificial Sequence
  Description of Artificial Sequence: Synthetic oligonucleotide
  Target: FXN; (+) strand; PAM type: NRG; PAM sequence: CAG
gcgacaaaaccttctgctcc

SEQ ID NO: 19072 - DNA, 20 bp, Artificial Sequence
  Description of Artificial Sequence: Synthetic oligonucleotide
  Target: FXN; (+) strand; PAM type: NRG; PAM sequence: TAG
acaaaaccttctgctcccag

SEQ ID NO: 19073 - DNA, 20 bp, Artificial Sequence
  Description of Artificial Sequence: Synthetic oligonucleotide
  Target: FXN; (+) strand; PAM type: NRG; PAM sequence: TGG
aaaccttctgctcccagtag

SEQ ID NO: 19074 - DNA, 20 bp, Artificial Sequence
  Description of Artificial Sequence: Synthetic oligonucleotide
  Target: FXN; (+) strand; PAM type: NRG; PAM sequence: GGG
aaccttctgctcccagtagt

SEQ ID NO: 19075 - DNA, 20 bp, Artificial Sequence
  Description of Artificial Sequence: Synthetic oligonucleotide
  Target: FXN; (+) strand; PAM type: NRG; PAM sequence: CAG
ttctgctcccagtagtgggt

SEQ ID NO: 19076 - DNA, 20 bp, Artificial Sequence
  Description of Artificial Sequence: Synthetic oligonucleotide
  Target: FXN; (+) strand; PAM type: NRG; PAM sequence: GAG
ctgctcccagtagtgggtca

SEQ ID NO: 19077 - DNA, 20 bp, Artificial Sequence
  Description of Artificial Sequence: Synthetic oligonucleotide
  Target: FXN; (+) strand; PAM type: NRG; PAM sequence: GAG
accttcctgattcctgccct

SEQ ID NO: 19078 - DNA, 20 bp, Artificial Sequence
  Description of Artificial Sequence: Synthetic oligonucleotide
  Target: FXN; (+) strand; PAM type: NRG; PAM sequence: AAG
gccctgagattgtctctctg

SEQ ID NO: 19079 - DNA, 20 bp, Artificial Sequence
  Description of Artificial Sequence: Synthetic oligonucleotide
  Target: FXN; (+) strand; PAM type: NRG; PAM sequence: TAG
tgtctctctgaagacaacat

SEQ ID NO: 19080 - DNA, 20 bp, Artificial Sequence
  Description of Artificial Sequence: Synthetic oligonucleotide
  Target: FXN; (+) strand; PAM type: NRG; PAM sequence: AGG
gtctctctgaagacaacatt

SEQ ID NO: 19081 - DNA, 20 bp, Artificial Sequence
  Description of Artificial Sequence: Synthetic oligonucleotide
  Target: FXN; (+) strand; PAM type: NRG; PAM sequence: TAG
ctctgaagacaacattaggc

SEQ ID NO: 19082 - DNA, 20 bp, Artificial Sequence
  Description of Artificial Sequence: Synthetic oligonucleotide
  Target: FXN; (+) strand; PAM type: NRG; PAM sequence: TAG
tgaagacaacattaggctag

SEQ ID NO: 19083 - DNA, 20 bp, Artificial Sequence
  Description of Artificial Sequence: Synthetic oligonucleotide
  Target: FXN; (+) strand; PAM type: NRG; PAM sequence: AGG
gaagacaacattaggctagt

SEQ ID NO: 19084 - DNA, 20 bp, Artificial Sequence
  Description of Artificial Sequence: Synthetic oligonucleotide
  Target: FXN; (+) strand; PAM type: NRG; PAM sequence: CAG
cattaggctagtaggctttc

SEQ ID NO: 19085 - DNA, 20 bp, Artificial Sequence
  Description of Artificial Sequence: Synthetic oligonucleotide
  Target: FXN; (+) strand; PAM type: NRG; PAM sequence: AAG
ttctgtaacccattctttca

SEQ ID NO: 19086 - DNA, 20 bp, Artificial Sequence
  Description of Artificial Sequence: Synthetic oligonucleotide
  Target: FXN; (+) strand; PAM type: NRG; PAM sequence: AGG
tctgtaacccattctttcaa

SEQ ID NO: 19087 - DNA, 20 bp, Artificial Sequence
  Description of Artificial Sequence: Synthetic oligonucleotide
  Target: FXN; (+) strand; PAM type: NRG; PAM sequence: AAG
gtaacccattctttcaaagg

SEQ ID NO: 19088 - DNA, 20 bp, Artificial Sequence
  Description of Artificial Sequence: Synthetic oligonucleotide
  Target: FXN; (+) strand; PAM type: NRG; PAM sequence: GAG
aacccattctttcaaaggaa

SEQ ID NO: 19089 - DNA, 20 bp, Artificial Sequence
  Description of Artificial Sequence: Synthetic oligonucleotide
  Target: FXN; (+) strand; PAM type: NRG; PAM sequence: TAG
aagagatgcctatatttttc

SEQ ID NO: 19090 - DNA, 20 bp, Artificial Sequence
  Description of Artificial Sequence: Synthetic oligonucleotide
  Target: FXN; (+) strand; PAM type: NRG; PAM sequence: GAG
ctagccaattcatatacctt

SEQ ID NO: 19091 - DNA, 20 bp, Artificial Sequence
  Description of Artificial Sequence: Synthetic oligonucleotide
  Target: FXN; (+) strand; PAM type: NRG; PAM sequence: AAG
atataccttgagtatcactc

SEQ ID NO: 19092 - DNA, 20 bp, Artificial Sequence
  Description of Artificial Sequence: Synthetic oligonucleotide
  Target: FXN; (+) strand; PAM type: NRG; PAM sequence: AGG
tataccttgagtatcactca

SEQ ID NO: 19093 - DNA, 20 bp, Artificial Sequence
  Description of Artificial Sequence: Synthetic oligonucleotide
  Target: FXN; (+) strand; PAM type: NRG; PAM sequence: GGG
ataccttgagtatcactcaa

SEQ ID NO: 19094 - DNA, 20 bp, Artificial Sequence
  Description of Artificial Sequence: Synthetic oligonucleotide
  Target: FXN; (+) strand; PAM type: NRG; PAM sequence: TAG
ctaacaaatcatttactaat

SEQ ID NO: 19095 - DNA, 20 bp, Artificial Sequence
  Description of Artificial Sequence: Synthetic oligonucleotide
  Target: FXN; (+) strand; PAM type: NRG; PAM sequence: AAG
ttactaattagcaaatgctt

SEQ ID NO: 19096 - DNA, 20 bp, Artificial Sequence
  Description of Artificial Sequence: Synthetic oligonucleotide
  Target: FXN; (+) strand; PAM type: NRG; PAM sequence: TAG
aattagcaaatgcttaagtg

SEQ ID NO: 19097 - DNA, 20 bp, Artificial Sequence
  Description of Artificial Sequence: Synthetic oligonucleotide
  Target: FXN; (+) strand; PAM type: NRG; PAM sequence: TAG
caaatgcttaagtgtagatt

SEQ ID NO: 19098 - DNA, 20 bp, Artificial Sequence
  Description of Artificial Sequence: Synthetic oligonucleotide
  Target: FXN; (+) strand; PAM type: NRG; PAM sequence: AAG
tgcttaagtgtagatttaga

SEQ ID NO: 19099 - DNA, 20 bp, Artificial Sequence
  Description of Artificial Sequence: Synthetic oligonucleotide
  Target: FXN; (+) strand; PAM type: NRG; PAM sequence: AAG
agtgtagatttagaaagcta

SEQ ID NO: 19100 - DNA, 20 bp, Artificial Sequence
  Description of Artificial Sequence: Synthetic oligonucleotide
  Target: FXN; (+) strand; PAM type: NRG; PAM sequence: CAG
tttagaaagctaaagctata

SEQ ID NO: 19101 - DNA, 20 bp, Artificial Sequence
  Description of Artificial Sequence: Synthetic oligonucleotide
  Target: FXN; (+) strand; PAM type: NRG; PAM sequence: TGG
agaaagctaaagctatacag

SEQ ID NO: 19102 - DNA, 20 bp, Artificial Sequence
  Description of Artificial Sequence: Synthetic oligonucleotide
  Target: FXN; (+) strand; PAM type: NRG; PAM sequence: TAG
tatacagtggctgccatcta

SEQ ID NO: 19103 - DNA, 20 bp, Artificial Sequence
  Description of Artificial Sequence: Synthetic oligonucleotide
  Target: FXN; (+) strand; PAM type: NRG; PAM sequence: TGG
agtggctgccatctatagtt

SEQ ID NO: 19104 - DNA, 20 bp, Artificial Sequence
  Description of Artificial Sequence: Synthetic oligonucleotide
  Target: FXN; (+) strand; PAM type: NRG; PAM sequence: TAG
gaaatgctaactctgtaccc

SEQ ID NO: 19105 - DNA, 20 bp, Artificial Sequence
  Description of Artificial Sequence: Synthetic oligonucleotide
  Target: FXN; (+) strand; PAM type: NRG; PAM sequence: GAG
aatgctaactctgtacccta

SEQ ID NO: 19106 - DNA, 20 bp, Artificial Sequence
  Description of Artificial Sequence: Synthetic oligonucleotide
  Target: FXN; (+) strand; PAM type: NRG; PAM sequence: TAG
ctagagtatgaattcctgat

SEQ ID NO: 19107 - DNA, 20 bp, Artificial Sequence
  Description of Artificial Sequence: Synthetic oligonucleotide
  Target: FXN; (+) strand; PAM type: NRG; PAM sequence: GAG
agagtatgaattcctgatta

SEQ ID NO: 19108 - DNA, 20 bp, Artificial Sequence
  Description of Artificial Sequence: Synthetic oligonucleotide
  Target: FXN; (+) strand; PAM type: NRG; PAM sequence: CAG
aattcctgattagagtcctt

SEQ ID NO: 19109 - DNA, 20 bp, Artificial Sequence
  Description of Artificial Sequence: Synthetic oligonucleotide
  Target: FXN; (+) strand; PAM type: NRG; PAM sequence: AGG
attcctgattagagtccttc

SEQ ID NO: 19110 - DNA, 20 bp, Artificial Sequence
  Description of Artificial Sequence: Synthetic oligonucleotide
  Target: FXN; (+) strand; PAM type: NRG; PAM sequence: GAG
gtttgataatattattactt

SEQ ID NO: 19111 - DNA, 20 bp, Artificial Sequence
  Description of Artificial Sequence: Synthetic oligonucleotide
  Target: FXN; (+) strand; PAM type: NRG; PAM sequence: TGG
atattattacttgagctttg

SEQ ID NO: 19112 - DNA, 20 bp, Artificial Sequence
  Description of Artificial Sequence: Synthetic oligonucleotide
  Target: FXN; (+) strand; PAM type: NRG; PAM sequence: GGG
tattattacttgagctttgt

SEQ ID NO: 19113 - DNA, 20 bp, Artificial Sequence
  Description of Artificial Sequence: Synthetic oligonucleotide
  Target: FXN; (+) strand; PAM type: NRG; PAM sequence: GAG
ttattacttgagctttgtgg

SEQ ID NO: 19114 - DNA, 20 bp, Artificial Sequence
  Description of Artificial Sequence: Synthetic oligonucleotide
  Target: FXN; (+) strand; PAM type: NRG; PAM sequence: GAG
attacttgagctttgtggga

SEQ ID NO: 19115 - DNA, 20 bp, Artificial Sequence
  Description of Artificial Sequence: Synthetic oligonucleotide
  Target: FXN; (+) strand; PAM type: NRG; PAM sequence: CAG
acttgagctttgtgggagag

SEQ ID NO: 19116 - DNA, 20 bp, Artificial Sequence
  Description of Artificial Sequence: Synthetic oligonucleotide
  Target: FXN; (+) strand; PAM type: NRG; PAM sequence: GAG
gagcagtcttttcctcccct

SEQ ID NO: 19117 - DNA, 20 bp, Artificial Sequence
  Description of Artificial Sequence: Synthetic oligonucleotide
  Target: FXN; (+) strand; PAM type: NRG; PAM sequence: TAG
tcttttcctcccctgagata

SEQ ID NO: 19118 - DNA, 20 bp, Artificial Sequence
  Description of Artificial Sequence: Synthetic oligonucleotide
  Target: FXN; (+) strand; PAM type: NRG; PAM sequence: TAG
ttcctcccctgagatatagc

SEQ ID NO: 19119 - DNA, 20 bp, Artificial Sequence
  Description of Artificial Sequence: Synthetic oligonucleotide
  Target: FXN; (+) strand; PAM type: NRG; PAM sequence: AAG
ctcccctgagatatagctag

SEQ ID NO: 19120 - DNA, 20 bp, Artificial Sequence
  Description of Artificial Sequence: Synthetic oligonucleotide
  Target: FXN; (+) strand; PAM type: NRG; PAM sequence: AAG
tagaagttacctcctttgtg

SEQ ID NO: 19121 - DNA, 20 bp, Artificial Sequence
  Description of Artificial Sequence: Synthetic oligonucleotide
  Target: FXN; (+) strand; PAM type: NRG; PAM sequence: TAG
cctcctttgtgaagccttcc

SEQ ID NO: 19122 - DNA, 20 bp, Artificial Sequence
  Description of Artificial Sequence: Synthetic oligonucleotide
  Target: FXN; (+) strand; PAM type: NRG; PAM sequence: AAG
gaagccttcctagatactcc

SEQ ID NO: 19123 - DNA, 20 bp, Artificial Sequence
  Description of Artificial Sequence: Synthetic oligonucleotide
  Target: FXN; (+) strand; PAM type: NRG; PAM sequence: CAG
gccttcctagatactccaag

SEQ ID NO: 19124 - DNA, 20 bp, Artificial Sequence
  Description of Artificial Sequence: Synthetic oligonucleotide
  Target: FXN; (+) strand; PAM type: NRG; PAM sequence: CGG
ctagatactccaagcagaca

SEQ ID NO: 19125 - DNA, 20 bp, Artificial Sequence
  Description of Artificial Sequence: Synthetic oligonucleotide
  Target: FXN; (+) strand; PAM type: NRG; PAM sequence: CAG
tccttcctttctcccttgcc

SEQ ID NO: 19126 - DNA, 20 bp, Artificial Sequence
  Description of Artificial Sequence: Synthetic oligonucleotide
  Target: FXN; (+) strand; PAM type: NRG; PAM sequence: GAG
tctcccttgcccagcactct

SEQ ID NO: 19127 - DNA, 20 bp, Artificial Sequence
  Description of Artificial Sequence: Synthetic oligonucleotide
  Target: FXN; (+) strand; PAM type: NRG; PAM sequence: AGG
ctcccttgcccagcactctg

SEQ ID NO: 19128 - DNA, 20 bp, Artificial Sequence
  Description of Artificial Sequence: Synthetic oligonucleotide
  Target: FXN; (+) strand; PAM type: NRG; PAM sequence: TGG
gcactctgaggttgactctg

SEQ ID NO: 19129 - DNA, 20 bp, Artificial Sequence
  Description of Artificial Sequence: Synthetic oligonucleotide
  Target: FXN; (+) strand; PAM type: NRG; PAM sequence: GAG
actctgaggttgactctgtg

SEQ ID NO: 19130 - DNA, 20 bp, Artificial Sequence
  Description of Artificial Sequence: Synthetic oligonucleotide
  Target: FXN; (+) strand; PAM type: NRG; PAM sequence: CAG
ataattgtctatttacacgt

SEQ ID NO: 19131 - DNA, 20 bp, Artificial Sequence
  Description of Artificial Sequence: Synthetic oligonucleotide
  Target: FXN; (+) strand; PAM type: NRG; PAM sequence: GAG
gctaccacctataacacact

SEQ ID NO: 19132 - DNA, 20 bp, Artificial Sequence
  Description of Artificial Sequence: Synthetic oligonucleotide
  Target: FXN; (+) strand; PAM type: NRG; PAM sequence: CAG
taacacactgagttcctcaa

SEQ ID NO: 19133 - DNA, 20 bp, Artificial Sequence
  Description of Artificial Sequence: Synthetic oligonucleotide
  Target: FXN; (+) strand; PAM type: NRG; PAM sequence: CAG
cacactgagttcctcaacag

SEQ ID NO: 19134 - DNA, 20 bp, Artificial Sequence
  Description of Artificial Sequence: Synthetic oligonucleotide
  Target: FXN; (+) strand; PAM type: NRG; PAM sequence: AGG
acactgagttcctcaacagc

SEQ ID NO: 19135 - DNA, 20 bp, Artificial Sequence
  Description of Artificial Sequence: Synthetic oligonucleotide
  Target: FXN; (+) strand; PAM type: NRG; PAM sequence: GGG
cactgagttcctcaacagca

SEQ ID NO: 19136 - DNA, 20 bp, Artificial Sequence
  Description of Artificial Sequence: Synthetic oligonucleotide
  Target: FXN; (+) strand; PAM type: NRG; PAM sequence: CAG
cactgtccattctttgatcc

SEQ ID NO: 19137 - DNA, 20 bp, Artificial Sequence
  Description of Artificial Sequence: Synthetic oligonucleotide
  Target: FXN; (+) strand; PAM type: NRG; PAM sequence: TGG
cattctttgatcccagtgtc

SEQ ID NO: 19138 - DNA, 20 bp, Artificial Sequence
  Description of Artificial Sequence: Synthetic oligonucleotide
  Target: FXN; (+) strand; PAM type: NRG; PAM sequence: CAG
tttgatcccagtgtctggaa

SEQ ID NO: 19139 - DNA, 20 bp, Artificial Sequence
  Description of Artificial Sequence: Synthetic oligonucleotide
  Target: FXN; (+) strand; PAM type: NRG; PAM sequence: AAG
ccagtgtctggaacagtgcc

SEQ ID NO: 19140 - DNA, 20 bp, Artificial Sequence
  Description of Artificial Sequence: Synthetic oligonucleotide
  Target: FXN; (+) strand; PAM type: NRG; PAM sequence: TAG
ctggaacagtgccaagtaca

SEQ ID NO: 19141 - DNA, 20 bp, Artificial Sequence
  Description of Artificial Sequence: Synthetic oligonucleotide
  Target: FXN; (+) strand; PAM type: NRG; PAM sequence: TAG
gaacagtgccaagtacatag

SEQ ID NO: 19142 - DNA, 20 bp, Artificial Sequence
  Description of Artificial Sequence: Synthetic oligonucleotide
  Target: FXN; (+) strand; PAM type: NRG; PAM sequence: AGG
aacagtgccaagtacatagt

SEQ ID NO: 19143 - DNA, 20 bp, Artificial Sequence
  Description of Artificial Sequence: Synthetic oligonucleotide
  Target: FXN; (+) strand; PAM type: NRG; PAM sequence: GGG
acagtgccaagtacatagta

SEQ ID NO: 19144 - DNA, 20 bp, Artificial Sequence
  Description of Artificial Sequence: Synthetic oligonucleotide
  Target: FXN; (+) strand; PAM type: NRG; PAM sequence: GAG
atattgattcatatgtaaat

SEQ ID NO: 19145 - DNA, 20 bp, Artificial Sequence
  Description of Artificial Sequence: Synthetic oligonucleotide
  Target: FXN; (+) strand; PAM type: NRG; PAM sequence: CAG
atgctttcgttgatgcctct

SEQ ID NO: 19146 - DNA, 20 bp, Artificial Sequence
  Description of Artificial Sequence: Synthetic oligonucleotide
  Target: FXN; (+) strand; PAM type: NRG; PAM sequence: TGG
accttttaccaactcgctac

SEQ ID NO: 19147 - DNA, 20 bp, Artificial Sequence
  Description of Artificial Sequence: Synthetic oligonucleotide
  Target: FXN; (+) strand; PAM type: NRG; PAM sequence: TAG
ccaactcgctactggccaca

SEQ ID NO: 19148 - DNA, 20 bp, Artificial Sequence
  Description of Artificial Sequence: Synthetic oligonucleotide
  Target: FXN; (+) strand; PAM type: NRG; PAM sequence: AAG
ctggccacatagacaaatga

SEQ ID NO: 19149 - DNA, 20 bp, Artificial Sequence
  Description of Artificial Sequence: Synthetic oligonucleotide
  Target: FXN; (+) strand; PAM type: NRG; PAM sequence: CAG
gccacatagacaaatgaaag

SEQ ID NO: 19150 - DNA, 20 bp, Artificial Sequence
  Description of Artificial Sequence: Synthetic oligonucleotide
  Target: FXN; (+) strand; PAM type: NRG; PAM sequence: CAG
gacaaatgaaagcagtaatc

SEQ ID NO: 19151 - DNA, 20 bp, Artificial Sequence
  Description of Artificial Sequence: Synthetic oligonucleotide
  Target: FXN; (+) strand; PAM type: NRG; PAM sequence: AAG
gcagtaatccagatacaccc

SEQ ID NO: 19152 - DNA, 20 bp, Artificial Sequence
  Description of Artificial Sequence: Synthetic oligonucleotide
  Target: FXN; (+) strand; PAM type: NRG; PAM sequence: GAG
agtaatccagatacacccaa

SEQ ID NO: 19153 - DNA, 20 bp, Artificial Sequence
  Description of Artificial Sequence: Synthetic oligonucleotide
  Target: FXN; (+) strand; PAM type: NRG; PAM sequence: AGG
gtaatccagatacacccaag

SEQ ID NO: 19154 - DNA, 20 bp, Artificial Sequence
  Description of Artificial Sequence: Synthetic oligonucleotide
  Target: FXN; (+) strand; PAM type: NRG; PAM sequence: TGG
tctgttcttttttctctctg

SEQ ID NO: 19155 - DNA, 20 bp, Artificial Sequence
  Description of Artificial Sequence: Synthetic oligonucleotide
  Target: FXN; (+) strand; PAM type: NRG; PAM sequence: GAG
tgttcttttttctctctgtg

SEQ ID NO: 19156 - DNA, 20 bp, Artificial Sequence
  Description of Artificial Sequence: Synthetic oligonucleotide
  Target: FXN; (+) strand; PAM type: NRG; PAM sequence: TGG
tcttttttctctctgtggag

SEQ ID NO: 19157 - DNA, 20 bp, Artificial Sequence
  Description of Artificial Sequence: Synthetic oligonucleotide
  Target: FXN; (+) strand; PAM type: NRG; PAM sequence: GGG
cttttttctctctgtggagt

SEQ ID NO: 19158 - DNA, 20 bp, Artificial Sequence
  Description of Artificial Sequence: Synthetic oligonucleotide
  Target: FXN; (+) strand; PAM type: NRG; PAM sequence: GAG
tttttctctctgtggagtgg

SEQ ID NO: 19159 - DNA, 20 bp, Artificial Sequence
  Description of Artificial Sequence: Synthetic oligonucleotide
  Target: FXN; (+) strand; PAM type: NRG; PAM sequence: AAG
ctctgtggagtgggagactt

SEQ ID NO: 19160 - DNA, 20 bp, Artificial Sequence
  Description of Artificial Sequence: Synthetic oligonucleotide
  Target: FXN; (+) strand; PAM type: NRG; PAM sequence: TGG
tgtggagtgggagacttaag

SEQ ID NO: 19161 - DNA, 20 bp, Artificial Sequence
  Description of Artificial Sequence: Synthetic oligonucleotide
  Target: FXN; (+) strand; PAM type: NRG; PAM sequence: TGG
gacttaagtggcttcttaac

SEQ ID NO: 19162 - DNA, 20 bp, Artificial Sequence
  Description of Artificial Sequence: Synthetic oligonucleotide
  Target: FXN; (+) strand; PAM type: NRG; PAM sequence: AAG
aactggtgtgtcgtctgatc

SEQ ID NO: 19163 - DNA, 20 bp, Artificial Sequence
  Description of Artificial Sequence: Synthetic oligonucleotide
  Target: FXN; (+) strand; PAM type: NRG; PAM sequence: TGG
tggtgtgtcgtctgatcaag

SEQ ID NO: 19164 - DNA, 20 bp, Artificial Sequence
  Description of Artificial Sequence: Synthetic oligonucleotide
  Target: FXN; (+) strand; PAM type: NRG; PAM sequence: CAG
tgtcgtctgatcaagtggtc

SEQ ID NO: 19165 - DNA, 20 bp, Artificial Sequence
  Description of Artificial Sequence: Synthetic oligonucleotide
  Target: FXN; (+) strand; PAM type: NRG; PAM sequence: AGG
gtcgtctgatcaagtggtcc

SEQ ID NO: 19166 - DNA, 20 bp, Artificial Sequence
  Description of Artificial Sequence: Synthetic oligonucleotide
  Target: FXN; (+) strand; PAM type: NRG; PAM sequence: CAG
tgatcaagtggtccaggtaa

SEQ ID NO: 19167 - DNA, 20 bp, Artificial Sequence
  Description of Artificial Sequence: Synthetic oligonucleotide
  Target: FXN; (+) strand; PAM type: NRG; PAM sequence: AGG
gatcaagtggtccaggtaac

SEQ ID NO: 19168 - DNA, 20 bp, Artificial Sequence
  Description of Artificial Sequence: Synthetic oligonucleotide
  Target: FXN; (+) strand; PAM type: NRG; PAM sequence: TGG
caagtggtccaggtaacagg

SEQ ID NO: 19169 - DNA, 20 bp, Artificial Sequence
  Description of Artificial Sequence: Synthetic oligonucleotide
  Target: FXN; (+) strand; PAM type: NRG; PAM sequence: TGG
aacaggtggatgccaatgtc

SEQ ID NO: 19170 - DNA, 20 bp, Artificial Sequence
  Description of Artificial Sequence: Synthetic oligonucleotide
  Target: FXN; (+) strand; PAM type: NRG; PAM sequence: CAG
gtggatgccaatgtctggcc

SEQ ID NO: 19171 - DNA, 20 bp, Artificial Sequence
  Description of Artificial Sequence: Synthetic oligonucleotide
  Target: FXN; (+) strand; PAM type: NRG; PAM sequence: AGG
tggatgccaatgtctggccc

SEQ ID NO: 19172 - DNA, 20 bp, Artificial Sequence
  Description of Artificial Sequence: Synthetic oligonucleotide
  Target: FXN; (+) strand; PAM type: NRG; PAM sequence: TGG
gcccaggcatcaccccttac

SEQ ID NO: 19173 - DNA, 20 bp, Artificial Sequence
  Description of Artificial Sequence: Synthetic oligonucleotide
  Target: FXN; (+) strand; PAM type: NRG; PAM sequence: TGG
gcatcaccccttactggcac

SEQ ID NO: 19174 - DNA, 20 bp, Artificial Sequence
  Description of Artificial Sequence: Synthetic oligonucleotide
  Target: FXN; (+) strand; PAM type: NRG; PAM sequence: CAG
cttactggcactggtcatta

SEQ ID NO: 19175 - DNA, 20 bp, Artificial Sequence
  Description of Artificial Sequence: Synthetic oligonucleotide
  Target: FXN; (+) strand; PAM type: NRG; PAM sequence: AAG
actggcactggtcattacag

SEQ ID NO: 19176 - DNA, 20 bp, Artificial Sequence
  Description of Artificial Sequence: Synthetic oligonucleotide
  Target: FXN; (+) strand; PAM type: NRG; PAM sequence: CAG
cattacagaagacactctac

SEQ ID NO: 19177 - DNA, 20 bp, Artificial Sequence
  Description of Artificial Sequence: Synthetic oligonucleotide
  Target: FXN; (+) strand; PAM type: NRG; PAM sequence: GAG
ttacagaagacactctacca

SEQ ID NO: 19178 - DNA, 20 bp, Artificial Sequence
  Description of Artificial Sequence: Synthetic oligonucleotide
  Target: FXN; (+) strand; PAM type: NRG; PAM sequence: AAG
agacactctaccagagctga

SEQ ID NO: 19179 - DNA, 20 bp, Artificial Sequence
  Description of Artificial Sequence: Synthetic oligonucleotide
  Target: FXN; (+) strand; PAM type: NRG; PAM sequence: AGG
gacactctaccagagctgaa

SEQ ID NO: 19180 - DNA, 20 bp, Artificial Sequence
  Description of Artificial Sequence: Synthetic oligonucleotide
  Target: FXN; (+) strand; PAM type: NRG; PAM sequence: TAG
ctgaaaggacctcttgtcac

SEQ ID NO: 19181 - DNA, 20 bp, Artificial Sequence
  Description of Artificial Sequence: Synthetic oligonucleotide
  Target: FXN; (+) strand; PAM type: NRG; PAM sequence: AGG
tgaaaggacctcttgtcact

SEQ ID NO: 19182 - DNA, 20 bp, Artificial Sequence
  Description of Artificial Sequence: Synthetic oligonucleotide
  Target: FXN; (+) strand; PAM type: NRG; PAM sequence: CAG
aaggacctcttgtcactagg

SEQ ID NO: 19183 - DNA, 20 bp, Artificial Sequence
  Description of Artificial Sequence: Synthetic oligonucleotide
  Target: FXN; (+) strand; PAM type: NRG; PAM sequence: TGG
ctcttgtcactaggcagctg

SEQ ID NO: 19184 - DNA, 20 bp, Artificial Sequence
  Description of Artificial Sequence: Synthetic oligonucleotide
  Target: FXN; (+) strand; PAM type: NRG; PAM sequence: GAG
cttgtcactaggcagctgtg

SEQ ID NO: 19185 - DNA, 20 bp, Artificial Sequence
  Description of Artificial Sequence: Synthetic oligonucleotide
  Target: FXN; (+) strand; PAM type: NRG; PAM sequence: TAG
ggagtccgctctacttgacc

SEQ ID NO: 19186 - DNA, 20 bp, Artificial Sequence
  Description of Artificial Sequence: Synthetic oligonucleotide
  Target: FXN; (+) strand; PAM type: NRG; PAM sequence: TGG
ttgacctagtaaaatctgcc

SEQ ID NO: 19187 - DNA, 20 bp, Artificial Sequence
  Description of Artificial Sequence: Synthetic oligonucleotide
  Target: FXN; (+) strand; PAM type: NRG; PAM sequence: GAG
gacctagtaaaatctgcctg

SEQ ID NO: 19188 - DNA, 20 bp, Artificial Sequence
  Description of Artificial Sequence: Synthetic oligonucleotide
  Target: FXN; (+) strand; PAM type: NRG; PAM sequence: TAG
aaaatctgcctggagactgt

SEQ ID NO: 19189 - DNA, 20 bp, Artificial Sequence
  Description of Artificial Sequence: Synthetic oligonucleotide
  Target: FXN; (+) strand; PAM type: NRG; PAM sequence: GAG
aatctgcctggagactgtta

SEQ ID NO: 19190 - DNA, 20 bp, Artificial Sequence
  Description of Artificial Sequence: Synthetic oligonucleotide
  Target: FXN; (+) strand; PAM type: NRG; PAM sequence: AAG
tagagtcaccccactacctg

SEQ ID NO: 19191 - DNA, 20 bp, Artificial Sequence
  Description of Artificial Sequence: Synthetic oligonucleotide
  Target: FXN; (+) strand; PAM type: NRG; PAM sequence: CAG
ccactacctgaagttacctc

SEQ ID NO: 19192 - DNA, 20 bp, Artificial Sequence
  Description of Artificial Sequence: Synthetic oligonucleotide
  Target: FXN; (+) strand; PAM type: NRG; PAM sequence: AGG
cactacctgaagttacctcc

SEQ ID NO: 19193 - DNA, 20 bp, Artificial Sequence
  Description of Artificial Sequence: Synthetic oligonucleotide
  Target: FXN; (+) strand; PAM type: NRG; PAM sequence: CAG
ggctgacctcttttttttcc

SEQ ID NO: 19194 - DNA, 20 bp, Artificial Sequence
  Description of Artificial Sequence: Synthetic oligonucleotide
  Target: FXN; (+) strand; PAM type: NRG; PAM sequence: AGG
gctgacctcttttttttccc

SEQ ID NO: 19195 - DNA, 20 bp, Artificial Sequence
  Description of Artificial Sequence: Synthetic oligonucleotide
  Target: FXN; (+) strand; PAM type: NRG; PAM sequence: TGG
gacctcttttttttcccagg

SEQ ID NO: 19196 - DNA, 20 bp, Artificial Sequence
  Description of Artificial Sequence: Synthetic oligonucleotide
  Target: FXN; (+) strand; PAM type: NRG; PAM sequence: GAG
cctcttttttttcccaggtg

SEQ ID NO: 19197 - DNA, 20 bp, Artificial Sequence
  Description of Artificial Sequence: Synthetic oligonucleotide
  Target: FXN; (+) strand; PAM type: NRG; PAM sequence: TGG
ttttttcccaggtggagtcc

SEQ ID NO: 19198 - DNA, 20 bp, Artificial Sequence
  Description of Artificial Sequence: Synthetic oligonucleotide
  Target: FXN; (+) strand; PAM type: NRG; PAM sequence: TAG
caggtggagtcctggcatct

SEQ ID NO: 19199 - DNA, 20 bp, Artificial Sequence
  Description of Artificial Sequence: Synthetic oligonucleotide
  Target: FXN; (+) strand; PAM type: NRG; PAM sequence: AAG
ggcatcttagatattttaat

SEQ ID NO: 19200 - DNA, 20 bp, Artificial Sequence
  Description of Artificial Sequence: Synthetic oligonucleotide
  Target: FXN; (+) strand; PAM type: NRG; PAM sequence: AGG
gcatcttagatattttaata

SEQ ID NO: 19201 - DNA, 20 bp, Artificial Sequence
  Description of Artificial Sequence: Synthetic oligonucleotide
  Target: FXN; (+) strand; PAM type: NRG; PAM sequence: AAG
tgacatgttctttattcact

SEQ ID NO: 19202 - DNA, 20 bp, Artificial Sequence
  Description of Artificial Sequence: Synthetic oligonucleotide
  Target: FXN; (+) strand; PAM type: NRG; PAM sequence: AGG
gacatgttctttattcacta

SEQ ID NO: 19203 - DNA, 20 bp, Artificial Sequence
  Description of Artificial Sequence: Synthetic oligonucleotide
  Target: FXN; (+) strand; PAM type: NRG; PAM sequence: CAG
ttctttattcactaaggtgt

SEQ ID NO: 19204 - DNA, 20 bp, Artificial Sequence
  Description of Artificial Sequence: Synthetic oligonucleotide
  Target: FXN; (+) strand; PAM type: NRG; PAM sequence: TAG
gtgtcagcatattactgtct

SEQ ID NO: 19205 - DNA, 20 bp, Artificial Sequence
  Description of Artificial Sequence: Synthetic oligonucleotide
  Target: FXN; (+) strand; PAM type: NRG; PAM sequence: GAG
catattactgtcttagaact

SEQ ID NO: 19206 - DNA, 20 bp, Artificial Sequence
  Description of Artificial Sequence: Synthetic oligonucleotide
  Target: FXN; (+) strand; PAM type: NRG; PAM sequence: AGG
atattactgtcttagaactg

SEQ ID NO: 19207 - DNA, 20 bp, Artificial Sequence
  Description of Artificial Sequence: Synthetic oligonucleotide
  Target: FXN; (+) strand; PAM type: NRG; PAM sequence: GGG
tattactgtcttagaactga

SEQ ID NO: 19208 - DNA, 20 bp, Artificial Sequence
  Description of Artificial Sequence: Synthetic oligonucleotide
  Target: FXN; (+) strand; PAM type: NRG; PAM sequence: TGG
tgagggttcttcatcttttt

SEQ ID NO: 19209 - DNA, 20 bp, Artificial Sequence
  Description of Artificial Sequence: Synthetic oligonucleotide
  Target: FXN; (+) strand; PAM type: NRG; PAM sequence: CAG
gttcttcatcttttttggat

SEQ ID NO: 19210 - DNA, 20 bp, Artificial Sequence
  Description of Artificial Sequence: Synthetic oligonucleotide
  Target: FXN; (+) strand; PAM type: NRG; PAM sequence: AGG
ttcttcatcttttttggatc

SEQ ID NO: 19211 - DNA, 20 bp, Artificial Sequence
  Description of Artificial Sequence: Synthetic oligonucleotide
  Target: FXN; (+) strand; PAM type: NRG; PAM sequence: AAG
ttggatcaggacctccctct

SEQ ID NO: 19212 - DNA, 20 bp, Artificial Sequence
  Description of Artificial Sequence: Synthetic oligonucleotide
  Target: FXN; (+) strand; PAM type: NRG; PAM sequence: TGG
taagaatctgatgactgctc

SEQ ID NO: 19213 - DNA, 20 bp, Artificial Sequence
  Description of Artificial Sequence: Synthetic oligonucleotide
  Target: FXN; (+) strand; PAM type: NRG; PAM sequence: CAG
aaaaactttaaacaaattaa

SEQ ID NO: 19214 - DNA, 20 bp, Artificial Sequence
  Description of Artificial Sequence: Synthetic oligonucleotide
  Target: FXN; (+) strand; PAM type: NRG; PAM sequence: GAG
aaactttaaacaaattaaca

SEQ ID NO: 19215 - DNA, 20 bp, Artificial Sequence
  Description of Artificial Sequence: Synthetic oligonucleotide
  Target: FXN; (+) strand; PAM type: NRG; PAM sequence: CAG
caaattaacagagttttatt

SEQ ID NO: 19216 - DNA, 20 bp, Artificial Sequence
  Description of Artificial Sequence: Synthetic oligonucleotide
  Target: FXN; (+) strand; PAM type: NRG; PAM sequence: AAG
taacagagttttattcagca

SEQ ID NO: 19217 - DNA, 20 bp, Artificial Sequence
  Description of Artificial Sequence: Synthetic oligonucleotide
  Target: FXN; (+) strand; PAM type: NRG; PAM sequence: CGG
gcaaagaatgattcataaat

SEQ ID NO: 19218 - DNA, 20 bp, Artificial Sequence
  Description of Artificial Sequence: Synthetic oligonucleotide
  Target: FXN; (+) strand; PAM type: NRG; PAM sequence: GGG
caaagaatgattcataaatc

SEQ ID NO: 19219 - DNA, 20 bp, Artificial Sequence
  Description of Artificial Sequence: Synthetic oligonucleotide
  Target: FXN; (+) strand; PAM type: NRG; PAM sequence: AAG
agaatgattcataaatcggg

SEQ ID NO: 19220 - DNA, 20 bp, Artificial Sequence
  Description of Artificial Sequence: Synthetic oligonucleotide
  Target: FXN; (+) strand; PAM type: NRG; PAM sequence: AGG
gaatgattcataaatcggga

SEQ ID NO: 19221 - DNA, 20 bp, Artificial Sequence
  Description of Artificial Sequence: Synthetic oligonucleotide
  Target: FXN; (+) strand; PAM type: NRG; PAM sequence: CAG
taaatcgggaaggctgcaac

SEQ ID NO: 19222 - DNA, 20 bp, Artificial Sequence
  Description of Artificial Sequence: Synthetic oligonucleotide
  Target: FXN; (+) strand; PAM type: NRG; PAM sequence: TAG
cgggaaggctgcaaccagaa

SEQ ID NO: 19223 - DNA, 20 bp, Artificial Sequence
  Description of Artificial Sequence: Synthetic oligonucleotide
  Target: FXN; (+) strand; PAM type: NRG; PAM sequence: AGG
gggaaggctgcaaccagaat

SEQ ID NO: 19224 - DNA, 20 bp, Artificial Sequence
  Description of Artificial Sequence: Synthetic oligonucleotide
  Target: FXN; (+) strand; PAM type: NRG; PAM sequence: CAG
ggctgcaaccagaataggtt

SEQ ID NO: 19225 - DNA, 20 bp, Artificial Sequence
  Description of Artificial Sequence: Synthetic oligonucleotide
  Target: FXN; (+) strand; PAM type: NRG; PAM sequence: GAG
ctgcaaccagaataggttca

SEQ ID NO: 19226 - DNA, 20 bp, Artificial Sequence
  Description of Artificial Sequence: Synthetic oligonucleotide
  Target: FXN; (+) strand; PAM type: NRG; PAM sequence: GAG
gcaaccagaataggttcaga

SEQ ID NO: 19227 - DNA, 20 bp, Artificial Sequence
  Description of Artificial Sequence: Synthetic oligonucleotide
  Target: FXN; (+) strand; PAM type: NRG; PAM sequence: CGG
ataggttcagagagactcca

SEQ ID NO: 19228 - DNA, 20 bp, Artificial Sequence
  Description of Artificial Sequence: Synthetic oligonucleotide
  Target: FXN; (+) strand; PAM type: NRG; PAM sequence: TGG
agactccacggtgtgccacg

SEQ ID NO: 19229 - DNA, 20 bp, Artificial Sequence
  Description of Artificial Sequence: Synthetic oligonucleotide
  Target: FXN; (+) strand; PAM type: NRG; PAM sequence: TGG
tccacggtgtgccacgtggt

SEQ ID NO: 19230 - DNA, 20 bp, Artificial Sequence
  Description of Artificial Sequence: Synthetic oligonucleotide
  Target: FXN; (+) strand; PAM type: NRG; PAM sequence: GAG
cacggtgtgccacgtggttg

SEQ ID NO: 19231 - DNA, 20 bp, Artificial Sequence
  Description of Artificial Sequence: Synthetic oligonucleotide
  Target: FXN; (+) strand; PAM type: NRG; PAM sequence: GAG
cggtgtgccacgtggttgga

SEQ ID NO: 19232 - DNA, 20 bp, Artificial Sequence
  Description of Artificial Sequence: Synthetic oligonucleotide
  Target: FXN; (+) strand; PAM type: NRG; PAM sequence: AGG
ggtgtgccacgtggttggag

SEQ ID NO: 19233 - DNA, 20 bp, Artificial Sequence
  Description of Artificial Sequence: Synthetic oligonucleotide
  Target: FXN; (+) strand; PAM type: NRG; PAM sequence: TAG
ccacgtggttggagaggatt

SEQ ID NO: 19234 - DNA, 20 bp, Artificial Sequence
  Description of Artificial Sequence: Synthetic oligonucleotide
  Target: FXN; (+) strand; PAM type: NRG; PAM sequence: AGG
cacgtggttggagaggattt

SEQ ID NO: 19235 - DNA, 20 bp, Artificial Sequence
  Description of Artificial Sequence: Synthetic oligonucleotide
  Target: FXN; (+) strand; PAM type: NRG; PAM sequence: CAG
gaggatttaggatttatgca

SEQ ID NO: 19236 - DNA, 20 bp, Artificial Sequence
  Description of Artificial Sequence: Synthetic oligonucleotide
  Target: FXN; (+) strand; PAM type: NRG; PAM sequence: AAG
ttaggatttatgcacagaaa

SEQ ID NO: 19237 - DNA, 20 bp, Artificial Sequence
  Description of Artificial Sequence: Synthetic oligonucleotide
  Target: FXN; (+) strand; PAM type: NRG; PAM sequence: AGG
taggatttatgcacagaaaa

SEQ ID NO: 19238 - DNA, 20 bp, Artificial Sequence
  Description of Artificial Sequence: Synthetic oligonucleotide
  Target: FXN; (+) strand; PAM type: NRG; PAM sequence: AAG
atttatgcacagaaaaagga

SEQ ID NO: 19239 - DNA, 20 bp, Artificial Sequence
  Description of Artificial Sequence: Synthetic oligonucleotide
  Target: FXN; (+) strand; PAM type: NRG; PAM sequence: CAG
agaaaaaggaaagtgacatg

SEQ ID NO: 19240 - DNA, 20 bp, Artificial Sequence
  Description of Artificial Sequence: Synthetic oligonucleotide
  Target: FXN; (+) strand; PAM type: NRG; PAM sequence: AAG
aagtgacatgcagaaaatga

SEQ ID NO: 19241 - DNA, 20 bp, Artificial Sequence
  Description of Artificial Sequence: Synthetic oligonucleotide
  Target: FXN; (+) strand; PAM type: NRG; PAM sequence: GAG
gacatgcagaaaatgaaagt

SEQ ID NO: 19242 - DNA, 20 bp, Artificial Sequence
  Description of Artificial Sequence: Synthetic oligonucleotide
  Target: FXN; (+) strand; PAM type: NRG; PAM sequence: AGG
acatgcagaaaatgaaagtg

SEQ ID NO: 19243 - DNA, 20 bp, Artificial Sequence
  Description of Artificial Sequence: Synthetic oligonucleotide
  Target: FXN; (+) strand; PAM type: NRG; PAM sequence: GGG
catgcagaaaatgaaagtga

SEQ ID NO: 19244 - DNA, 20 bp, Artificial Sequence
  Description of Artificial Sequence: Synthetic oligonucleotide
  Target: FXN; (+) strand; PAM type: NRG; PAM sequence: TGG
agaaaatgaaagtgagggcc

SEQ ID NO: 19245 - DNA, 20 bp, Artificial Sequence
  Description of Artificial Sequence: Synthetic oligonucleotide
  Target: FXN; (+) strand; PAM type: NRG; PAM sequence: TGG
tgaaagtgagggcctggtgc

SEQ ID NO: 19246 - DNA, 20 bp, Artificial Sequence
  Description of Artificial Sequence: Synthetic oligonucleotide
  Target: FXN; (+) strand; PAM type: NRG; PAM sequence: CGG
gtgagggcctggtgctggtg

SEQ ID NO: 19247 - DNA, 20 bp, Artificial Sequence
  Description of Artificial Sequence: Synthetic oligonucleotide
  Target: FXN; (+) strand; PAM type: NRG; PAM sequence: CAG
gtgcctcacgcctgtaatcc

SEQ ID NO: 19248 - DNA, 20 bp, Artificial Sequence
  Description of Artificial Sequence: Synthetic oligonucleotide
  Target: FXN; (+) strand; PAM type: NRG; PAM sequence: TGG
cgcctgtaatcccagcactt

SEQ ID NO: 19249 - DNA, 20 bp, Artificial Sequence
  Description of Artificial Sequence: Synthetic oligonucleotide
  Target: FXN; (+) strand; PAM type: NRG; PAM sequence: GGG
gcctgtaatcccagcacttt

SEQ ID NO: 19250 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttgg

SEQ ID NO: 19251 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttggg

SEQ ID NO: 19252 - DNA, 20 bp, Artificial Sequence
  Description of Artificial Sequence: Synthetic oligonucleotide
  Target: FXN; (+) strand; PAM type: NRG; PAM sequence: GAG
tcccagcactttgggaggcc

SEQ ID NO: 19253 - DNA, 20 bp, Artificial Sequence
  Description of Artificial Sequence: Synthetic oligonucleotide
  Target: FXN; (+) strand; PAM type: NRG; PAM sequence: AGG
cccagcactttgggaggccg

SEQ ID NO: 19254 - DNA, 20 bp, Artificial Sequence
  Description of Artificial Sequence: Synthetic oligonucleotide
  Target: FXN; (+) strand; PAM type: NRG; PAM sequence: CGG
agcactttgggaggccgagg

SEQ ID NO: 19255 - DNA, 20 bp, Artificial Sequence
  Description of Artificial Sequence: Synthetic oligonucleotide
  Target: FXN; (+) strand; PAM type: NRG; PAM sequence: GGG
gcactttgggaggccgaggc

SEQ ID NO: 19256 - DNA, 20 bp, Artificial Sequence
  Description of Artificial Sequence: Synthetic oligonucleotide
  Target: FXN; (+) strand; PAM type: NRG; PAM sequence: CAG
ctttgggaggccgaggcggg

SEQ ID NO: 19257 - DNA, 20 bp, Artificial Sequence
  Description of Artificial Sequence: Synthetic oligonucleotide
  Target: FXN; (+) strand; PAM type: NRG; PAM sequence: GAG
ggccgaggcgggcagatcat

SEQ ID NO: 19258 - DNA, 20 bp, Artificial Sequence
  Description of Artificial Sequence: Synthetic oligonucleotide
  Target: FXN; (+) strand; PAM type: NRG; PAM sequence: AGG
gccgaggcgggcagatcatg

SEQ ID NO: 19259 - DNA, 20 bp, Artificial Sequence
  Description of Artificial Sequence: Synthetic oligonucleotide
  Target: FXN; (+) strand; PAM type: NRG; PAM sequence: CAG
aggcgggcagatcatgaggt

SEQ ID NO: 19260 - DNA, 20 bp, Artificial Sequence
  Description of Artificial Sequence: Synthetic oligonucleotide
  Target: FXN; (+) strand; PAM type: NRG; PAM sequence: AGG
ggcgggcagatcatgaggtc

SEQ ID NO: 19261 - DNA, 20 bp, Artificial Sequence
  Description of Artificial Sequence: Synthetic oligonucleotide
  Target: FXN; (+) strand; PAM type: NRG; PAM sequence: GAG
cgggcagatcatgaggtcag

SEQ ID NO: 19262 - DNA, 20 bp, Artificial Sequence
  Description of Artificial Sequence: Synthetic oligonucleotide
  Target: FXN; (+) strand; PAM type: NRG; PAM sequence: GAG
gatcatgaggtcaggagatc

SEQ ID NO: 19263 - DNA, 20 bp, Artificial Sequence
  Description of Artificial Sequence: Synthetic oligonucleotide
  Target: FXN; (+) strand; PAM type: NRG; PAM sequence: TGG
tcaggagatcgagaccatcc

SEQ ID NO: 19264 - DNA, 20 bp, Artificial Sequence
  Description of Artificial Sequence: Synthetic oligonucleotide
  Target: FXN; (+) strand; PAM type: NRG; PAM sequence: CGG
cgagaccatcctggctaaca

SEQ ID NO: 19265 - DNA, 20 bp, Artificial Sequence
  Description of Artificial Sequence: Synthetic oligonucleotide
  Target: FXN; (+) strand; PAM type: NRG; PAM sequence: TAG
ctactaaaaatgcaaaaact

SEQ ID NO: 19266 - DNA, 20 bp, Artificial Sequence
  Description of Artificial Sequence: Synthetic oligonucleotide
  Target: FXN; (+) strand; PAM type: NRG; PAM sequence: CGG
taaaaatgcaaaaacttagc

SEQ ID NO: 19267 - DNA, 20 bp, Artificial Sequence
  Description of Artificial Sequence: Synthetic oligonucleotide
  Target: FXN; (+) strand; PAM type: NRG; PAM sequence: GGG
aaaaatgcaaaaacttagcc

SEQ ID NO: 19268 - DNA, 20 bp, Artificial Sequence
  Description of Artificial Sequence: Synthetic oligonucleotide
  Target: FXN; (+) strand; PAM type: NRG; PAM sequence: TGG
tgcaaaaacttagccgggcg

SEQ ID NO: 19269 - DNA, 20 bp, Artificial Sequence
  Description of Artificial Sequence: Synthetic oligonucleotide
  Target: FXN; (+) strand; PAM type: NRG; PAM sequence: TGG
aaaaacttagccgggcgtgg

SEQ ID NO: 19270 - DNA, 20 bp, Artificial Sequence
  Description of Artificial Sequence: Synthetic oligonucleotide
  Target: FXN; (+) strand; PAM type: NRG; PAM sequence: CAG
aacttagccgggcgtggtgg

SEQ ID NO: 19271 - DNA, 20 bp, Artificial Sequence
  Description of Artificial Sequence: Synthetic oligonucleotide
  Target: FXN; (+) strand; PAM type: NRG; PAM sequence: AGG
acttagccgggcgtggtggc

SEQ ID NO: 19272 - DNA, 20 bp, Artificial Sequence
  Description of Artificial Sequence: Synthetic oligonucleotide
  Target: FXN; (+) strand; PAM type: NRG; PAM sequence: TAG
ggcgtggtggcaggcacctg

SEQ ID NO: 19273 - DNA, 20 bp, Artificial Sequence
  Description of Artificial Sequence: Synthetic oligonucleotide
  Target: FXN; (+) strand; PAM type: NRG; PAM sequence: CAG
gtggcaggcacctgtagtcc

SEQ ID NO: 19274 - DNA, 20 bp, Artificial Sequence
  Description of Artificial Sequence: Synthetic oligonucleotide
  Target: FXN; (+) strand; PAM type: NRG; PAM sequence: TGG
cacctgtagtcccagctact

SEQ ID NO: 19275 - DNA, 20 bp, Artificial Sequence
  Description of Artificial Sequence: Synthetic oligonucleotide
  Target: FXN; (+) strand; PAM type: NRG; PAM sequence: GGG
acctgtagtcccagctactt

SEQ ID NO: 19276 - DNA, 20 bp, Artificial Sequence
  Description of Artificial Sequence: Synthetic oligonucleotide
  Target: FXN; (+) strand; PAM type: NRG; PAM sequence: GAG
ctgtagtcccagctacttgg

SEQ ID NO: 19277 - DNA, 20 bp, Artificial Sequence
  Description of Artificial Sequence: Synthetic oligonucleotide
  Target: FXN; (+) strand; PAM type: NRG; PAM sequence: AGG
tgtagtcccagctacttggg

SEQ ID NO: 19278 - DNA, 20 bp, Artificial Sequence
  Description of Artificial Sequence: Synthetic oligonucleotide
  Target: FXN; (+) strand; PAM type: NRG; PAM sequence: GAG
tcccagctacttgggaggct

SEQ ID NO: 19279 - DNA, 20 bp, Artificial Sequence
  Description of Artificial Sequence: Synthetic oligonucleotide
  Target: FXN; (+) strand; PAM type: NRG; PAM sequence: AGG
cccagctacttgggaggctg

SEQ ID NO: 19280 - DNA, 20 bp, Artificial Sequence
  Description of Artificial Sequence: Synthetic oligonucleotide
  Target: FXN; (+) strand; PAM type: NRG; PAM sequence: CAG
agctacttgggaggctgagg

SEQ ID NO: 19281 - DNA, 20 bp, Artificial Sequence
  Description of Artificial Sequence: Synthetic oligonucleotide
  Target: FXN; (+) strand; PAM type: NRG; PAM sequence: AGG
gctacttgggaggctgaggc

SEQ ID NO: 19282 - DNA, 20 bp, Artificial Sequence
  Description of Artificial Sequence: Synthetic oligonucleotide
  Target: FXN; (+) strand; PAM type: NRG; PAM sequence: GAG
tacttgggaggctgaggcag

SEQ ID NO: 19283 - DNA, 20 bp, Artificial Sequence
  Description of Artificial Sequence: Synthetic oligonucleotide
  Target: FXN; (+) strand; PAM type: NRG; PAM sequence: TGG
gggaggctgaggcaggagaa

SEQ ID NO: 19284 - DNA, 20 bp, Artificial Sequence
  Description of Artificial Sequence: Synthetic oligonucleotide
  Target: FXN; (+) strand; PAM type: NRG; PAM sequence: TGG
gcaggagaatggtgtgaacc

SEQ ID NO: 19285 - DNA, 20 bp, Artificial Sequence
  Description of Artificial Sequence: Synthetic oligonucleotide
  Target: FXN; (+) strand; PAM type: NRG; PAM sequence: GGG
caggagaatggtgtgaacct

SEQ ID NO: 19286 - DNA, 20 bp, Artificial Sequence
  Description of Artificial Sequence: Synthetic oligonucleotide
  Target: FXN; (+) strand; PAM type: NRG; PAM sequence: GAG
ggagaatggtgtgaacctgg

SEQ ID NO: 19287 - DNA, 20 bp, Artificial Sequence
  Description of Artificial Sequence: Synthetic oligonucleotide
  Target: FXN; (+) strand; PAM type: NRG; PAM sequence: AGG
gagaatggtgtgaacctggg

SEQ ID NO: 19288 - DNA, 20 bp, Artificial Sequence
  Description of Artificial Sequence: Synthetic oligonucleotide
  Target: FXN; (+) strand; PAM type: NRG; PAM sequence: CGG
aatggtgtgaacctgggagg

SEQ ID NO: 19289 - DNA, 20 bp, Artificial Sequence
  Description of Artificial Sequence: Synthetic oligonucleotide
  Target: FXN; (+) strand; PAM type: NRG; PAM sequence: GAG
tggtgtgaacctgggaggcg

SEQ ID NO: 19290 - DNA, 20 bp, Artificial Sequence
  Description of Artificial Sequence: Synthetic oligonucleotide
  Target: FXN; (+) strand; PAM type: NRG; PAM sequence: CAG
aacctgggaggcggagcttg

SEQ ID NO: 19291 - DNA, 20 bp, Artificial Sequence
  Description of Artificial Sequence: Synthetic oligonucleotide
  Target: FXN; (+) strand; PAM type: NRG; PAM sequence: GAG
tgggaggcggagcttgcagt

SEQ ID NO: 19292 - DNA, 20 bp, Artificial Sequence
  Description of Artificial Sequence: Synthetic oligonucleotide
  Target: FXN; (+) strand; PAM type: NRG; PAM sequence: CAG
aggcggagcttgcagtgagc

SEQ ID NO: 19293 - DNA, 20 bp, Artificial Sequence
  Description of Artificial Sequence: Synthetic oligonucleotide
  Target: FXN; (+) strand; PAM type: NRG; PAM sequence: AGG
ggcggagcttgcagtgagcc

SEQ ID NO: 19294 - DNA, 20 bp, Artificial Sequence
  Description of Artificial Sequence: Synthetic oligonucleotide
  Target: FXN; (+) strand; PAM type: NRG; PAM sequence: CAG
aggatcccgccactgcactc

SEQ ID NO: 19295 - DNA, 20 bp, Artificial Sequence
  Description of Artificial Sequence: Synthetic oligonucleotide
  Target: FXN; (+) strand; PAM type: NRG; PAM sequence: TGG
cccgccactgcactccagcc

SEQ ID NO: 19296 - DNA, 20 bp, Artificial Sequence
  Description of Artificial Sequence: Synthetic oligonucleotide
  Target: FXN; (+) strand; PAM type: NRG; PAM sequence: GGG
ccgccactgcactccagcct

SEQ ID NO: 19297 - DNA, 20 bp, Artificial Sequence
  Description of Artificial Sequence: Synthetic oligonucleotide
  Target: FXN; (+) strand; PAM type: NRG; PAM sequence: CAG
ctgcactccagcctgggcga

SEQ ID NO: 19298 - DNA, 20 bp, Artificial Sequence
  Description of Artificial Sequence: Synthetic oligonucleotide
  Target: FXN; (+) strand; PAM type: NRG; PAM sequence: GAG
gcactccagcctgggcgaca

SEQ ID NO: 19299 - DNA, 20 bp, Artificial Sequence
  Description of Artificial Sequence: Synthetic oligonucleotide
  Target: FXN; (+) strand; PAM type: NRG; PAM sequence: GAG
tccagcctgggcgacagagc

SEQ ID NO: 19300 - DNA, 20 bp, Artificial Sequence
  Description of Artificial Sequence: Synthetic oligonucleotide
  Target: FXN; (+) strand; PAM type: NRG; PAM sequence: AAG
gagacttcatcttaaaaaaa

SEQ ID NO: 19301 - DNA, 20 bp, Artificial Sequence
  Description of Artificial Sequence: Synthetic oligonucleotide
  Target: FXN; (+) strand; PAM type: NRG; PAM sequence: AAG
ttcatcttaaaaaaaaagaa

SEQ ID NO: 19302 - DNA, 20 bp, Artificial Sequence
  Description of Artificial Sequence: Synthetic oligonucleotide
  Target: FXN; (+) strand; PAM type: NRG; PAM sequence: AAG
ttaaaaaaaaagaaaagaaa

SEQ ID NO: 19303 - DNA, 20 bp, Artificial Sequence
  Description of Artificial Sequence: Synthetic oligonucleotide
  Target: FXN; (+) strand; PAM type: NRG; PAM sequence: AGG
taaaaaaaaagaaaagaaaa

SEQ ID NO: 19304 - DNA, 20 bp, Artificial Sequence
  Description of Artificial Sequence: Synthetic oligonucleotide
  Target: FXN; (+) strand; PAM type: NRG; PAM sequence: AAG
gaaaagaaaaaggaaaatga

SEQ ID NO: 19305 - DNA, 20 bp, Artificial Sequence
  Description of Artificial Sequence: Synthetic oligonucleotide
  Target: FXN; (+) strand; PAM type: NRG; PAM sequence: GAG
agaaaaaggaaaatgaaagt

SEQ ID NO: 19306 - DNA, 20 bp, Artificial Sequence
  Description of Artificial Sequence: Synthetic oligonucleotide
  Target: FXN; (+) strand; PAM type: NRG; PAM sequence: AGG
gaaaaaggaaaatgaaagtg

SEQ ID NO: 19307 - DNA, 20 bp, Artificial Sequence
  Description of Artificial Sequence: Synthetic oligonucleotide
  Target: FXN; (+) strand; PAM type: NRG; PAM sequence: CAG
aggaaaatgaaagtgaggta

SEQ ID NO: 19308 - DNA, 20 bp, Artificial Sequence
  Description of Artificial Sequence: Synthetic oligonucleotide
  Target: FXN; (+) strand; PAM type: NRG; PAM sequence: CAG
atgaaagtgaggtacagaaa

SEQ ID NO: 19309 - DNA, 20 bp, Artificial Sequence
  Description of Artificial Sequence: Synthetic oligonucleotide
  Target: FXN; (+) strand; PAM type: NRG; PAM sequence: CAG
aagtgaggtacagaaacagc

SEQ ID NO: 19310 - DNA, 20 bp, Artificial Sequence
  Description of Artificial Sequence: Synthetic oligonucleotide
  Target: FXN; (+) strand; PAM type: NRG; PAM sequence: AGG
agtgaggtacagaaacagcc

SEQ ID NO: 19311 - DNA, 20 bp, Artificial Sequence
  Description of Artificial Sequence: Synthetic oligonucleotide
  Target: FXN; (+) strand; PAM type: NRG; PAM sequence: TGG
aggtacagaaacagccaggt

SEQ ID NO: 19312 - DNA, 20 bp, Artificial Sequence
  Description of Artificial Sequence: Synthetic oligonucleotide
  Target: FXN; (+) strand; PAM type: NRG; PAM sequence: CAG
agaaacagccaggttggtta

SEQ ID NO: 19313 - DNA, 20 bp, Artificial Sequence
  Description of Artificial Sequence: Synthetic oligonucleotide
  Target: FXN; (+) strand; PAM type: NRG; PAM sequence: TGG
cagccaggttggttacagct

SEQ ID NO: 19314 - DNA, 20 bp, Artificial Sequence
  Description of Artificial Sequence: Synthetic oligonucleotide
  Target: FXN; (+) strand; PAM type: NRG; PAM sequence: TGG
cttggtgtttgccttaaact

SEQ ID NO: 19315 - DNA, 20 bp, Artificial Sequence
  Description of Artificial Sequence: Synthetic oligonucleotide
  Target: FXN; (+) strand; PAM type: NRG; PAM sequence: CAG
tgccttaaacttggtttgaa

SEQ ID NO: 19316 - DNA, 20 bp, Artificial Sequence
  Description of Artificial Sequence: Synthetic oligonucleotide
  Target: FXN; (+) strand; PAM type: NRG; PAM sequence: TGG
ttaaacttggtttgaacagt

SEQ ID NO: 19317 - DNA, 20 bp, Artificial Sequence
  Description of Artificial Sequence: Synthetic oligonucleotide
  Target: FXN; (+) strand; PAM type: NRG; PAM sequence: TAG
aacagttggccgcctttgat

SEQ ID NO: 19318 - DNA, 20 bp, Artificial Sequence
  Description of Artificial Sequence: Synthetic oligonucleotide
  Target: FXN; (+) strand; PAM type: NRG; PAM sequence: CGG
gcctttgattagccaaaact

SEQ ID NO: 19319 - DNA, 20 bp, Artificial Sequence
  Description of Artificial Sequence: Synthetic oligonucleotide
  Target: FXN; (+) strand; PAM type: NRG; PAM sequence: TGG
attagccaaaactcggtgat

SEQ ID NO: 19320 - DNA, 20 bp, Artificial Sequence
  Description of Artificial Sequence: Synthetic oligonucleotide
  Target: FXN; (+) strand; PAM type: NRG; PAM sequence: AAG
caaaactcggtgattggtac

SEQ ID NO: 19321 - DNA, 20 bp, Artificial Sequence
  Description of Artificial Sequence: Synthetic oligonucleotide
  Target: FXN; (+) strand; PAM type: NRG; PAM sequence: GAG
aaactcggtgattggtacaa

SEQ ID NO: 19322 - DNA, 20 bp, Artificial Sequence
  Description of Artificial Sequence: Synthetic oligonucleotide
  Target: FXN; (+) strand; PAM type: NRG; PAM sequence: TAG
ctcggtgattggtacaagag

SEQ ID NO: 19323 - DNA, 20 bp, Artificial Sequence
  Description of Artificial Sequence: Synthetic oligonucleotide
  Target: FXN; (+) strand; PAM type: NRG; PAM sequence: CAG
attggtacaagagtagattg

SEQ ID NO: 19324 - DNA, 20 bp, Artificial Sequence
  Description of Artificial Sequence: Synthetic oligonucleotide
  Target: FXN; (+) strand; PAM type: NRG; PAM sequence: CAG
agattgcagttcactatgta

SEQ ID NO: 19325 - DNA, 20 bp, Artificial Sequence
  Description of Artificial Sequence: Synthetic oligonucleotide
  Target: FXN; (+) strand; PAM type: NRG; PAM sequence: GAG
attgcagttcactatgtaca

SEQ ID NO: 19326 - DNA, 20 bp, Artificial Sequence
  Description of Artificial Sequence: Synthetic oligonucleotide
  Target: FXN; (+) strand; PAM type: NRG; PAM sequence: AAG
gcagttcactatgtacagag

SEQ ID NO: 19327 - DNA, 20 bp, Artificial Sequence
  Description of Artificial Sequence: Synthetic oligonucleotide
  Target: FXN; (+) strand; PAM type: NRG; PAM sequence: TAG
actatgtacagagaagccct

SEQ ID NO: 19328 - DNA, 20 bp, Artificial Sequence
  Description of Artificial Sequence: Synthetic oligonucleotide
  Target: FXN; (+) strand; PAM type: NRG; PAM sequence: TAG
ccttagatccgaactcaaaa

SEQ ID NO: 19329 - DNA, 20 bp, Artificial Sequence
  Description of Artificial Sequence: Synthetic oligonucleotide
  Target: FXN; (+) strand; PAM type: NRG; PAM sequence: AGG
cttagatccgaactcaaaat

SEQ ID NO: 19330 - DNA, 20 bp, Artificial Sequence
  Description of Artificial Sequence: Synthetic oligonucleotide
  Target: FXN; (+) strand; PAM type: NRG; PAM sequence: AAG
gatccgaactcaaaataggt

SEQ ID NO: 19331 - DNA, 20 bp, Artificial Sequence
  Description of Artificial Sequence: Synthetic oligonucleotide
  Target: FXN; (+) strand; PAM type: NRG; PAM sequence: AGG
atccgaactcaaaataggta

SEQ ID NO: 19332 - DNA, 20 bp, Artificial Sequence
  Description of Artificial Sequence: Synthetic oligonucleotide
  Target: FXN; (+) strand; PAM type: NRG; PAM sequence: GAG
ccgaactcaaaataggtaag

SEQ ID NO: 19333 - DNA, 20 bp, Artificial Sequence
  Description of Artificial Sequence: Synthetic oligonucleotide
  Target: FXN; (+) strand; PAM type: NRG; PAM sequence: AGG
cgaactcaaaataggtaagg

SEQ ID NO: 19334 - DNA, 20 bp, Artificial Sequence
  Description of Artificial Sequence: Synthetic oligonucleotide
  Target: FXN; (+) strand; PAM type: NRG; PAM sequence: CAG
actcaaaataggtaaggagg

SEQ ID NO: 19335 - DNA, 20 bp, Artificial Sequence
  Description of Artificial Sequence: Synthetic oligonucleotide
  Target: FXN; (+) strand; PAM type: NRG; PAM sequence: TAG
aataggtaaggaggcagttt

SEQ ID NO: 19336 - DNA, 20 bp, Artificial Sequence
  Description of Artificial Sequence: Synthetic oligonucleotide
  Target: FXN; (+) strand; PAM type: NRG; PAM sequence: AAG
aggcagttttagctacactt

SEQ ID NO: 19337 - DNA, 20 bp, Artificial Sequence
  Description of Artificial Sequence: Synthetic oligonucleotide
  Target: FXN; (+) strand; PAM type: NRG; PAM sequence: CAG
tacacttaagttaacatact

SEQ ID NO: 19338 - DNA, 20 bp, Artificial Sequence
  Description of Artificial Sequence: Synthetic oligonucleotide
  Target: FXN; (+) strand; PAM type: NRG; PAM sequence: AGG
acacttaagttaacatactc

SEQ ID NO: 19339 - DNA, 20 bp, Artificial Sequence
  Description of Artificial Sequence: Synthetic oligonucleotide
  Target: FXN; (+) strand; PAM type: NRG; PAM sequence: GAG
acttaagttaacatactcag

SEQ ID NO: 19340 - DNA, 20 bp, Artificial Sequence
  Description of Artificial Sequence: Synthetic oligonucleotide
  Target: FXN; (+) strand; PAM type: NRG; PAM sequence: CAG
catactcaggagtaccattc

SEQ ID NO: 19341 - DNA, 20 bp, Artificial Sequence
  Description of Artificial Sequence: Synthetic oligonucleotide
  Target: FXN; (+) strand; PAM type: NRG; PAM sequence: AAG
aggagtaccattccagcttc

SEQ ID NO: 19342 - DNA, 20 bp, Artificial Sequence
  Description of Artificial Sequence: Synthetic oligonucleotide
  Target: FXN; (+) strand; PAM type: NRG; PAM sequence: TGG
gtaccattccagcttcaagc

SEQ ID NO: 19343 - DNA, 20 bp, Artificial Sequence
  Description of Artificial Sequence: Synthetic oligonucleotide
  Target: FXN; (+) strand; PAM type: NRG; PAM sequence: AAG
ccattccagcttcaagctgg

SEQ ID NO: 19344 - DNA, 20 bp, Artificial Sequence
  Description of Artificial Sequence: Synthetic oligonucleotide
  Target: FXN; (+) strand; PAM type: NRG; PAM sequence: CAG
cttcaagctggaagtgtctg

SEQ ID NO: 19345 - DNA, 20 bp, Artificial Sequence
  Description of Artificial Sequence: Synthetic oligonucleotide
  Target: FXN; (+) strand; PAM type: NRG; PAM sequence: GAG
ggaagtgtctgcagccccct

SEQ ID NO: 19346 - DNA, 20 bp, Artificial Sequence
  Description of Artificial Sequence: Synthetic oligonucleotide
  Target: FXN; (+) strand; PAM type: NRG; PAM sequence: AAG
ccctgagaccacttaatccc

SEQ ID NO: 19347 - DNA, 20 bp, Artificial Sequence
  Description of Artificial Sequence: Synthetic oligonucleotide
  Target: FXN; (+) strand; PAM type: NRG; PAM sequence: CAG
ccaagttaaaaacccctgct

SEQ ID NO: 19348 - DNA, 20 bp, Artificial Sequence
  Description of Artificial Sequence: Synthetic oligonucleotide
  Target: FXN; (+) strand; PAM type: NRG; PAM sequence: GAG
aagttaaaaacccctgctca

SEQ ID NO: 19349 - DNA, 20 bp, Artificial Sequence
  Description of Artificial Sequence: Synthetic oligonucleotide
  Target: FXN; (+) strand; PAM type: NRG; PAM sequence: AGG
agttaaaaacccctgctcag

SEQ ID NO: 19350 - DNA, 20 bp, Artificial Sequence
  Description of Artificial Sequence: Synthetic oligonucleotide
  Target: FXN; (+) strand; PAM type: NRG; PAM sequence: CAG
taaaaacccctgctcagagg

SEQ ID NO: 19351 - DNA, 20 bp, Artificial Sequence
  Description of Artificial Sequence: Synthetic oligonucleotide
  Target: FXN; (+) strand; PAM type: NRG; PAM sequence: GAG
tttttttttttttttttttt

SEQ ID NO: 19352 - DNA, 20 bp, Artificial Sequence
  Description of Artificial Sequence: Synthetic oligonucleotide
  Target: FXN; (+) strand; PAM type: NRG; PAM sequence: GAG
ttttttttttttttttttga

SEQ ID NO: 19353 - DNA, 20 bp, Artificial Sequence
  Description of Artificial Sequence: Synthetic oligonucleotide
  Target: FXN; (+) strand; PAM type: NRG; PAM sequence: GAG
ttttttttttttttttgaga

SEQ ID NO: 19354 - DNA, 20 bp, Artificial Sequence
  Description of Artificial Sequence: Synthetic oligonucleotide
  Target: FXN; (+) strand; PAM type: NRG; PAM sequence: CAG
agagatctcactctgtcacc

SEQ ID NO: 19355 - DNA, 20 bp, Artificial Sequence
  Description of Artificial Sequence: Synthetic oligonucleotide
  Target: FXN; (+) strand; PAM type: NRG; PAM sequence: AGG
gagatctcactctgtcaccc

SEQ ID NO: 19356 - DNA, 20 bp, Artificial Sequence
  Description of Artificial Sequence: Synthetic oligonucleotide
  Target: FXN; (+) strand; PAM type: NRG; PAM sequence: TGG
tctcactctgtcacccaggc

SEQ ID NO: 19357 - DNA, 20 bp, Artificial Sequence
  Description of Artificial Sequence: Synthetic oligonucleotide
  Target: FXN; (+) strand; PAM type: NRG; PAM sequence: GAG
tcactctgtcacccaggctg

SEQ ID NO: 19358 - DNA, 20 bp, Artificial Sequence
  Description of Artificial Sequence: Synthetic oligonucleotide
  Target: FXN; (+) strand; PAM type: NRG; PAM sequence: CAG
ctgtcacccaggctggagtg

SEQ ID NO: 19359 - DNA, 20 bp, Artificial Sequence
  Description of Artificial Sequence: Synthetic oligonucleotide
  Target: FXN; (+) strand; PAM type: NRG; PAM sequence: TGG
tcacccaggctggagtgcag

SEQ ID NO: 19360 - DNA, 20 bp, Artificial Sequence
  Description of Artificial Sequence: Synthetic oligonucleotide
  Target: FXN; (+) strand; PAM type: NRG; PAM sequence: CAG
ggagtgcagtggcacgatct

SEQ ID NO: 19361 - DNA, 20 bp, Artificial Sequence
  Description of Artificial Sequence: Synthetic oligonucleotide
  Target: FXN; (+) strand; PAM type: NRG; PAM sequence: TGG
tcactgcaaccaccacctcc

SEQ ID NO: 19362 - DNA, 20 bp, Artificial Sequence
  Description of Artificial Sequence: Synthetic oligonucleotide
  Target: FXN; (+) strand; PAM type: NRG; PAM sequence: GGG
cactgcaaccaccacctcct

SEQ ID NO: 19363 - DNA, 20 bp, Artificial Sequence
  Description of Artificial Sequence: Synthetic oligonucleotide
  Target: FXN; (+) strand; PAM type: NRG; PAM sequence: AAG
aaccaccacctcctgggctc

SEQ ID NO: 19364 - DNA, 20 bp, Artificial Sequence
  Description of Artificial Sequence: Synthetic oligonucleotide
  Target: FXN; (+) strand; PAM type: NRG; PAM sequence: AGG
accaccacctcctgggctca

SEQ ID NO: 19365 - DNA, 20 bp, Artificial Sequence
  Description of Artificial Sequence: Synthetic oligonucleotide
  Target: FXN; (+) strand; PAM type: NRG; PAM sequence: GGG
ccaccacctcctgggctcaa

SEQ ID NO: 19366 - DNA, 20 bp, Artificial Sequence
  Description of Artificial Sequence: Synthetic oligonucleotide
  Target: FXN; (+) strand; PAM type: NRG; PAM sequence: CAG
ctcaagggattctcttgcct

SEQ ID NO: 19367 - DNA, 20 bp, Artificial Sequence
  Description of Artificial Sequence: Synthetic oligonucleotide
  Target: FXN; (+) strand; PAM type: NRG; PAM sequence: GAG
ttctcttgcctcagtctccc

SEQ ID NO: 19368 - DNA, 20 bp, Artificial Sequence
  Description of Artificial Sequence: Synthetic oligonucleotide
  Target: FXN; (+) strand; PAM type: NRG; PAM sequence: TGG
gcctcagtctcccgagtaac

SEQ ID NO: 19369 - DNA, 20 bp, Artificial Sequence
  Description of Artificial Sequence: Synthetic oligonucleotide
  Target: FXN; (+) strand; PAM type: NRG; PAM sequence: GGG
cctcagtctcccgagtaact

SEQ ID NO: 19370 - DNA, 20 bp, Artificial Sequence
  Description of Artificial Sequence: Synthetic oligonucleotide
  Target: FXN; (+) strand; PAM type: NRG; PAM sequence: CAG
ctcccgagtaactgggatta

SEQ ID NO: 19371 - DNA, 20 bp, Artificial Sequence
  Description of Artificial Sequence: Synthetic oligonucleotide
  Target: FXN; (+) strand; PAM type: NRG; PAM sequence: AGG
tcccgagtaactgggattac

SEQ ID NO: 19372 - DNA, 20 bp, Artificial Sequence
  Description of Artificial Sequence: Synthetic oligonucleotide
  Target: FXN; (+) strand; PAM type: NRG; PAM sequence: CAG
caggcgcgtgccactatgtc

SEQ ID NO: 19373 - DNA, 20 bp, Artificial Sequence
  Description of Artificial Sequence: Synthetic oligonucleotide
  Target: FXN; (+) strand; PAM type: NRG; PAM sequence: TAG
aatttttttttttgtatttt

SEQ ID NO: 19374 - DNA, 20 bp, Artificial Sequence
  Description of Artificial Sequence: Synthetic oligonucleotide
  Target: FXN; (+) strand; PAM type: NRG; PAM sequence: TAG
ttttttttttgtatttttag

SEQ ID NO: 19375 - DNA, 20 bp, Artificial Sequence
  Description of Artificial Sequence: Synthetic oligonucleotide
  Target: FXN; (+) strand; PAM type: NRG; PAM sequence: GAG
ttttttttgtatttttagta

SEQ ID NO: 19376 - DNA, 20 bp, Artificial Sequence
  Description of Artificial Sequence: Synthetic oligonucleotide
  Target: FXN; (+) strand; PAM type: NRG; PAM sequence: TGG
ttttgtatttttagtagaga

SEQ ID NO: 19377 - DNA, 20 bp, Artificial Sequence
  Description of Artificial Sequence: Synthetic oligonucleotide
  Target: FXN; (+) strand; PAM type: NRG; PAM sequence: GGG
tttgtatttttagtagagat

SEQ ID NO: 19378 - DNA, 20 bp, Artificial Sequence
  Description of Artificial Sequence: Synthetic oligonucleotide
  Target: FXN; (+) strand; PAM type: NRG; PAM sequence: GGG
ttgtatttttagtagagatg

SEQ ID NO: 19379 - DNA, 20 bp, Artificial Sequence
  Description of Artificial Sequence: Synthetic oligonucleotide
  Target: FXN; (+) strand; PAM type: NRG; PAM sequence: TGG
gagatggggtttcaccatgt

SEQ ID NO: 19380 - DNA, 20 bp, Artificial Sequence
  Description of Artificial Sequence: Synthetic oligonucleotide
  Target: FXN; (+) strand; PAM type: NRG; PAM sequence: TGG
ggggtttcaccatgttggcc

SEQ ID NO: 19381 - DNA, 20 bp, Artificial Sequence
  Description of Artificial Sequence: Synthetic oligonucleotide
  Target: FXN; (+) strand; PAM type: NRG; PAM sequence: TGG
tttcaccatgttggcctggc

SEQ ID NO: 19382 - DNA, 20 bp, Artificial Sequence
  Description of Artificial Sequence: Synthetic oligonucleotide
  Target: FXN; (+) strand; PAM type: NRG; PAM sequence: AAG
ggtcttgaactcttgacctc

SEQ ID NO: 19383 - DNA, 20 bp, Artificial Sequence
  Description of Artificial Sequence: Synthetic oligonucleotide
  Target: FXN; (+) strand; PAM type: NRG; PAM sequence: TGG
cttgacctcaagtgatccac

SEQ ID NO: 19384 - DNA, 20 bp, Artificial Sequence
  Description of Artificial Sequence: Synthetic oligonucleotide
  Target: FXN; (+) strand; PAM type: NRG; PAM sequence: CAG
ctcaagtgatccactggcct

SEQ ID NO: 19385 - DNA, 20 bp, Artificial Sequence
  Description of Artificial Sequence: Synthetic oligonucleotide
  Target: FXN; (+) strand; PAM type: NRG; PAM sequence: AAG
ccactggcctcagcctccca

SEQ ID NO: 19386 - DNA, 20 bp, Artificial Sequence
  Description of Artificial Sequence: Synthetic oligonucleotide
  Target: FXN; (+) strand; PAM type: NRG; PAM sequence: TGG
gcctcagcctcccaaagtgc

SEQ ID NO: 19387 - DNA, 20 bp, Artificial Sequence
  Description of Artificial Sequence: Synthetic oligonucleotide
  Target: FXN; (+) strand; PAM type: NRG; PAM sequence: TAG
gcctcccaaagtgctggcat

SEQ ID NO: 19388 - DNA, 20 bp, Artificial Sequence
  Description of Artificial Sequence: Synthetic oligonucleotide
  Target: FXN; (+) strand; PAM type: NRG; PAM sequence: GAG
ctcccaaagtgctggcatta

SEQ ID NO: 19389 - DNA, 20 bp, Artificial Sequence
  Description of Artificial Sequence: Synthetic oligonucleotide
  Target: FXN; (+) strand; PAM type: NRG; PAM sequence: AGG
tcccaaagtgctggcattag

SEQ ID NO: 19390 - DNA, 20 bp, Artificial Sequence
  Description of Artificial Sequence: Synthetic oligonucleotide
  Target: FXN; (+) strand; PAM type: NRG; PAM sequence: GAG
agtgctggcattagaggtgt

SEQ ID NO: 19391 - DNA, 20 bp, Artificial Sequence
  Description of Artificial Sequence: Synthetic oligonucleotide
  Target: FXN; (+) strand; PAM type: NRG; PAM sequence: TGG
gaggtgtgagtcactgttcc

SEQ ID NO: 19392 - DNA, 20 bp, Artificial Sequence
  Description of Artificial Sequence: Synthetic oligonucleotide
  Target: FXN; (+) strand; PAM type: NRG; PAM sequence: CAG
gtgagtcactgttcctggcc

SEQ ID NO: 19393 - DNA, 20 bp, Artificial Sequence
  Description of Artificial Sequence: Synthetic oligonucleotide
  Target: FXN; (+) strand; PAM type: NRG; PAM sequence: GAG
gtcactgttcctggcccagt

SEQ ID NO: 19394 - DNA, 20 bp, Artificial Sequence
  Description of Artificial Sequence: Synthetic oligonucleotide
  Target: FXN; (+) strand; PAM type: NRG; PAM sequence: AGG
tcactgttcctggcccagtg

SEQ ID NO: 19395 - DNA, 20 bp, Artificial Sequence
  Description of Artificial Sequence: Synthetic oligonucleotide
  Target: FXN; (+) strand; PAM type: NRG; PAM sequence: TGG
ccagtgaggcaccatctcat

SEQ ID NO: 19396 - DNA, 20 bp, Artificial Sequence
  Description of Artificial Sequence: Synthetic oligonucleotide
  Target: FXN; (+) strand; PAM type: NRG; PAM sequence: TGG
aggcaccatctcattggata

SEQ ID NO: 19397 - DNA, 20 bp, Artificial Sequence
  Description of Artificial Sequence: Synthetic oligonucleotide
  Target: FXN; (+) strand; PAM type: NRG; PAM sequence: GAG
gcaccatctcattggatatg

SEQ ID NO: 19398 - DNA, 20 bp, Artificial Sequence
  Description of Artificial Sequence: Synthetic oligonucleotide
  Target: FXN; (+) strand; PAM type: NRG; PAM sequence: AAG
tctcattggatatggagaca

SEQ ID NO: 19399 - DNA, 20 bp, Artificial Sequence
  Description of Artificial Sequence: Synthetic oligonucleotide
  Target: FXN; (+) strand; PAM type: NRG; PAM sequence: AGG
ctcattggatatggagacaa

SEQ ID NO: 19400 - DNA, 20 bp, Artificial Sequence
  Description of Artificial Sequence: Synthetic oligonucleotide
  Target: FXN; (+) strand; PAM type: NRG; PAM sequence: TGG
ggatatggagacaaaggatc

SEQ ID NO: 19401 - DNA, 20 bp, Artificial Sequence
  Description of Artificial Sequence: Synthetic oligonucleotide
  Target: FXN; (+) strand; PAM type: NRG; PAM sequence: TAG
tggagacaaaggatctggct

SEQ ID NO: 19402 - DNA, 20 bp, Artificial Sequence
  Description of Artificial Sequence: Synthetic oligonucleotide
  Target: FXN; (+) strand; PAM type: NRG; PAM sequence: TGG
aaggatctggcttagcatcc

SEQ ID NO: 19403 - DNA, 20 bp, Artificial Sequence
  Description of Artificial Sequence: Synthetic oligonucleotide
  Target: FXN; (+) strand; PAM type: NRG; PAM sequence: AAG
tggatttgtattttctttcc

SEQ ID NO: 19404 - DNA, 20 bp, Artificial Sequence
  Description of Artificial Sequence: Synthetic oligonucleotide
  Target: FXN; (+) strand; PAM type: NRG; PAM sequence: GAG
gatttgtattttctttccaa

SEQ ID NO: 19405 - DNA, 20 bp, Artificial Sequence
  Description of Artificial Sequence: Synthetic oligonucleotide
  Target: FXN; (+) strand; PAM type: NRG; PAM sequence: AAG
ttttctttccaagagtcctt

SEQ ID NO: 19406 - DNA, 20 bp, Artificial Sequence
  Description of Artificial Sequence: Synthetic oligonucleotide
  Target: FXN; (+) strand; PAM type: NRG; PAM sequence: GAG
aagtgatatctaacttttgc

SEQ ID NO: 19407 - DNA, 20 bp, Artificial Sequence
  Description of Artificial Sequence: Synthetic oligonucleotide
  Target: FXN; (+) strand; PAM type: NRG; PAM sequence: CAG
tatctaacttttgcgagctg

SEQ ID NO: 19408 - DNA, 20 bp, Artificial Sequence
  Description of Artificial Sequence: Synthetic oligonucleotide
  Target: FXN; (+) strand; PAM type: NRG; PAM sequence: CAG
tttgcgagctgcagtttcct

SEQ ID NO: 19409 - DNA, 20 bp, Artificial Sequence
  Description of Artificial Sequence: Synthetic oligonucleotide
  Target: FXN; (+) strand; PAM type: NRG; PAM sequence: GAG
gctgcagtttcctcagctat

SEQ ID NO: 19410 - DNA, 20 bp, Artificial Sequence
  Description of Artificial Sequence: Synthetic oligonucleotide
  Target: FXN; (+) strand; PAM type: NRG; PAM sequence: GAG
agtttcctcagctatgagat

SEQ ID NO: 19411 - DNA, 20 bp, Artificial Sequence
  Description of Artificial Sequence: Synthetic oligonucleotide
  Target: FXN; (+) strand; PAM type: NRG; PAM sequence: CAG
tgacattaacctcctctctt

SEQ ID NO: 19412 - DNA, 20 bp, Artificial Sequence
  Description of Artificial Sequence: Synthetic oligonucleotide
  Target: FXN; (+) strand; PAM type: NRG; PAM sequence: AAG
cctcctctcttcagatttat

SEQ ID NO: 19413 - DNA, 20 bp, Artificial Sequence
  Description of Artificial Sequence: Synthetic oligonucleotide
  Target: FXN; (+) strand; PAM type: NRG; PAM sequence: GAG
tcctctcttcagatttataa

SEQ ID NO: 19414 - DNA, 20 bp, Artificial Sequence
  Description of Artificial Sequence: Synthetic oligonucleotide
  Target: FXN; (+) strand; PAM type: NRG; PAM sequence: AGG
cctctcttcagatttataag

SEQ ID NO: 19415 - DNA, 20 bp, Artificial Sequence
  Description of Artificial Sequence: Synthetic oligonucleotide
  Target: FXN; (+) strand; PAM type: NRG; PAM sequence: TGG
tataagaggatcaattaaaa

SEQ ID NO: 19416 - DNA, 20 bp, Artificial Sequence
  Description of Artificial Sequence: Synthetic oligonucleotide
  Target: FXN; (+) strand; PAM type: NRG; PAM sequence: TAG
gaggatcaattaaaatggca

SEQ ID NO: 19417 - DNA, 20 bp, Artificial Sequence
  Description of Artificial Sequence: Synthetic oligonucleotide
  Target: FXN; (+) strand; PAM type: NRG; PAM sequence: AGG
aggatcaattaaaatggcat

SEQ ID NO: 19418 - DNA, 20 bp, Artificial Sequence
  Description of Artificial Sequence: Synthetic oligonucleotide
  Target: FXN; (+) strand; PAM type: NRG; PAM sequence: AAG
aattaaaatggcataggtaa

SEQ ID NO: 19419 - DNA, 20 bp, Artificial Sequence
  Description of Artificial Sequence: Synthetic oligonucleotide
  Target: FXN; (+) strand; PAM type: NRG; PAM sequence: TAG
gcataggtaaaagtgcatcc

SEQ ID NO: 19420 - DNA, 20 bp, Artificial Sequence
  Description of Artificial Sequence: Synthetic oligonucleotide
  Target: FXN; (+) strand; PAM type: NRG; PAM sequence: AAG
aggtaaaagtgcatcctagc

SEQ ID NO: 19421 - DNA, 20 bp, Artificial Sequence
  Description of Artificial Sequence: Synthetic oligonucleotide
  Target: FXN; (+) strand; PAM type: NRG; PAM sequence: TGG
aaaagtgcatcctagcaagt

SEQ ID NO: 19422 - DNA, 20 bp, Artificial Sequence
  Description of Artificial Sequence: Synthetic oligonucleotide
  Target: FXN; (+) strand; PAM type: NRG; PAM sequence: TAG
tagcaagttggtatctactt

SEQ ID NO: 19423 - DNA, 20 bp, Artificial Sequence
  Description of Artificial Sequence: Synthetic oligonucleotide
  Target: FXN; (+) strand; PAM type: NRG; PAM sequence: AAG
tggtatctactttagaaatg

SEQ ID NO: 19424 - DNA, 20 bp, Artificial Sequence
  Description of Artificial Sequence: Synthetic oligonucleotide
  Target: FXN; (+) strand; PAM type: NRG; PAM sequence: AGG
ggtatctactttagaaatga

SEQ ID NO: 19425 - DNA, 20 bp, Artificial Sequence
  Description of Artificial Sequence: Synthetic oligonucleotide
  Target: FXN; (+) strand; PAM type: NRG; PAM sequence: GAG
tatctactttagaaatgaag

SEQ ID NO: 19426 - DNA, 20 bp, Artificial Sequence
  Description of Artificial Sequence: Synthetic oligonucleotide
  Target: FXN; (+) strand; PAM type: NRG; PAM sequence: AGG
atctactttagaaatgaagg

SEQ ID NO: 19427 - DNA, 20 bp, Artificial Sequence
  Description of Artificial Sequence: Synthetic oligonucleotide
  Target: FXN; (+) strand; PAM type: NRG; PAM sequence: AAG
aaggaggtcatatgtatgtg

SEQ ID NO: 19428 - DNA, 20 bp, Artificial Sequence
  Description of Artificial Sequence: Synthetic oligonucleotide
  Target: FXN; (+) strand; PAM type: NRG; PAM sequence: CAG
tcatatgtatgtgaagtctc

SEQ ID NO: 19429 - DNA, 20 bp, Artificial Sequence
  Description of Artificial Sequence: Synthetic oligonucleotide
  Target: FXN; (+) strand; PAM type: NRG; PAM sequence: AAG
ttatatgtgtctatttctac

SEQ ID NO: 19430 - DNA, 20 bp, Artificial Sequence
  Description of Artificial Sequence: Synthetic oligonucleotide
  Target: FXN; (+) strand; PAM type: NRG; PAM sequence: GAG
atgtgtctatttctacaagt

SEQ ID NO: 19431 - DNA, 20 bp, Artificial Sequence
  Description of Artificial Sequence: Synthetic oligonucleotide
  Target: FXN; (+) strand; PAM type: NRG; PAM sequence: TAG
gtctatttctacaagtgagc

SEQ ID NO: 19432 - DNA, 20 bp, Artificial Sequence
  Description of Artificial Sequence: Synthetic oligonucleotide
  Target: FXN; (+) strand; PAM type: NRG; PAM sequence: CAG
tacaagtgagctagtgacaa

SEQ ID NO: 19433 - DNA, 20 bp, Artificial Sequence
  Description of Artificial Sequence: Synthetic oligonucleotide
  Target: FXN; (+) strand; PAM type: NRG; PAM sequence: TGG
ttgctatttttgctcctaca

SEQ ID NO: 19434 - DNA, 20 bp, Artificial Sequence
  Description of Artificial Sequence: Synthetic oligonucleotide
  Target: FXN; (+) strand; PAM type: NRG; PAM sequence: GGG
tgctatttttgctcctacat

SEQ ID NO: 19435 - DNA, 20 bp, Artificial Sequence
  Description of Artificial Sequence: Synthetic oligonucleotide
  Target: FXN; (+) strand; PAM type: NRG; PAM sequence: TAG
tatttttgctcctacatggg

SEQ ID NO: 19436 - DNA, 20 bp, Artificial Sequence
  Description of Artificial Sequence: Synthetic oligonucleotide
  Target: FXN; (+) strand; PAM type: NRG; PAM sequence: AGG
atttttgctcctacatgggt

SEQ ID NO: 19437 - DNA, 20 bp, Artificial Sequence
  Description of Artificial Sequence: Synthetic oligonucleotide
  Target: FXN; (+) strand; PAM type: NRG; PAM sequence: GGG
tttttgctcctacatgggta

SEQ ID NO: 19438 - DNA, 20 bp, Artificial Sequence
  Description of Artificial Sequence: Synthetic oligonucleotide
  Target: FXN; (+) strand; PAM type: NRG; PAM sequence: TAG
tgggtagggctgatcttgac

SEQ ID NO: 19439 - DNA, 20 bp, Artificial Sequence
  Description of Artificial Sequence: Synthetic oligonucleotide
  Target: FXN; (+) strand; PAM type: NRG; PAM sequence: AGG
gggtagggctgatcttgact

SEQ ID NO: 19440 - DNA, 20 bp, Artificial Sequence
  Description of Artificial Sequence: Synthetic oligonucleotide
  Target: FXN; (+) strand; PAM type: NRG; PAM sequence: GAG
gtagggctgatcttgactag

SEQ ID NO: 19441 - DNA, 20 bp, Artificial Sequence
  Description of Artificial Sequence: Synthetic oligonucleotide
  Target: FXN; (+) strand; PAM type: NRG; PAM sequence: AGG
tagggctgatcttgactagg

SEQ ID NO: 19442 - DNA, 20 bp, Artificial Sequence
  Description of Artificial Sequence: Synthetic oligonucleotide
  Target: FXN; (+) strand; PAM type: NRG; PAM sequence: GAG
gggctgatcttgactaggag

SEQ ID NO: 19443 - DNA, 20 bp, Artificial Sequence
  Description of Artificial Sequence: Synthetic oligonucleotide
  Target: FXN; (+) strand; PAM type: NRG; PAM sequence: AAG
cttgactaggaggagtcaat

SEQ ID NO: 19444 - DNA, 20 bp, Artificial Sequence
  Description of Artificial Sequence: Synthetic oligonucleotide
  Target: FXN; (+) strand; PAM type: NRG; PAM sequence: CAG
gaggagtcaataagactcac

SEQ ID NO: 19445 - DNA, 20 bp, Artificial Sequence
  Description of Artificial Sequence: Synthetic oligonucleotide
  Target: FXN; (+) strand; PAM type: NRG; PAM sequence: CGG
agtcaataagactcaccagc

SEQ ID NO: 19446 - DNA, 20 bp, Artificial Sequence
  Description of Artificial Sequence: Synthetic oligonucleotide
  Target: FXN; (+) strand; PAM type: NRG; PAM sequence: GGG
gtcaataagactcaccagcc

SEQ ID NO: 19447 - DNA, 20 bp, Artificial Sequence
  Description of Artificial Sequence: Synthetic oligonucleotide
  Target: FXN; (+) strand; PAM type: NRG; PAM sequence: TGG
taagactcaccagccgggcg

SEQ ID NO: 19448 - DNA, 20 bp, Artificial Sequence
  Description of Artificial Sequence: Synthetic oligonucleotide
  Target: FXN; (+) strand; PAM type: NRG; PAM sequence: TGG
gactcaccagccgggcgtgg

SEQ ID NO: 19449 - DNA, 20 bp, Artificial Sequence
  Description of Artificial Sequence: Synthetic oligonucleotide
  Target: FXN; (+) strand; PAM type: NRG; PAM sequence: CAG
gtggctcacgcctgtaatcc

SEQ ID NO: 19450 - DNA, 20 bp, Artificial Sequence
  Description of Artificial Sequence: Synthetic oligonucleotide
  Target: FXN; (+) strand; PAM type: NRG; PAM sequence: TGG
cgcctgtaatcccagcactt

SEQ ID NO: 19451 - DNA, 20 bp, Artificial Sequence
  Description of Artificial Sequence: Synthetic oligonucleotide
  Target: FXN; (+) strand; PAM type: NRG; PAM sequence: GGG
gcctgtaatcccagcacttt

SEQ ID NO: 19452 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttgg

SEQ ID NO: 19453 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttggg

SEQ ID NO: 19454 - DNA, 20 bp, Artificial Sequence
  Description of Artificial Sequence: Synthetic oligonucleotide
  Target: FXN; (+) strand; PAM type: NRG; PAM sequence: AAG
tcccagcactttgggaggcc

SEQ ID NO: 19455 - DNA, 20 bp, Artificial Sequence
  Description of Artificial Sequence: Synthetic oligonucleotide
  Target: FXN; (+) strand; PAM type: NRG; PAM sequence: AGG
cccagcactttgggaggcca

SEQ ID NO: 19456 - DNA, 20 bp, Artificial Sequence
  Description of Artificial Sequence: Synthetic oligonucleotide
  Target: FXN; (+) strand; PAM type: NRG; PAM sequence: CGG
agcactttgggaggccaagg

SEQ ID NO: 19457 - DNA, 20 bp, Artificial Sequence
  Description of Artificial Sequence: Synthetic oligonucleotide
  Target: FXN; (+) strand; PAM type: NRG; PAM sequence: GGG
gcactttgggaggccaaggc

SEQ ID NO: 19458 - DNA, 20 bp, Artificial Sequence
  Description of Artificial Sequence: Synthetic oligonucleotide
  Target: FXN; (+) strand; PAM type: NRG; PAM sequence: CGG
ctttgggaggccaaggcggg

SEQ ID NO: 19459 - DNA, 20 bp, Artificial Sequence
  Description of Artificial Sequence: Synthetic oligonucleotide
  Target: FXN; (+) strand; PAM type: NRG; PAM sequence: GAG
ggccaaggcgggcggatcac

SEQ ID NO: 19460 - DNA, 20 bp, Artificial Sequence
  Description of Artificial Sequence: Synthetic oligonucleotide
  Target: FXN; (+) strand; PAM type: NRG; PAM sequence: AGG
gccaaggcgggcggatcacg

SEQ ID NO: 19461 - DNA, 20 bp, Artificial Sequence
  Description of Artificial Sequence: Synthetic oligonucleotide
  Target: FXN; (+) strand; PAM type: NRG; PAM sequence: CAG
aggcgggcggatcacgaggt

SEQ ID NO: 19462 - DNA, 20 bp, Artificial Sequence
  Description of Artificial Sequence: Synthetic oligonucleotide
  Target: FXN; (+) strand; PAM type: NRG; PAM sequence: AGG
ggcgggcggatcacgaggtc

SEQ ID NO: 19463 - DNA, 20 bp, Artificial Sequence
  Description of Artificial Sequence: Synthetic oligonucleotide
  Target: FXN; (+) strand; PAM type: NRG; PAM sequence: GAG
cgggcggatcacgaggtcag

SEQ ID NO: 19464 - DNA, 20 bp, Artificial Sequence
  Description of Artificial Sequence: Synthetic oligonucleotide
  Target: FXN; (+) strand; PAM type: NRG; PAM sequence: GAG
gatcacgaggtcaggagatc

SEQ ID NO: 19465 - DNA, 20 bp, Artificial Sequence
  Description of Artificial Sequence: Synthetic oligonucleotide
  Target: FXN; (+) strand; PAM type: NRG; PAM sequence: TGG
tcaggagatcgagaccattc

SEQ ID NO: 19466 - DNA, 20 bp, Artificial Sequence
  Description of Artificial Sequence: Synthetic oligonucleotide
  Target: FXN; (+) strand; PAM type: NRG; PAM sequence: CGG
cgagaccattctggctaaca

SEQ ID NO: 19467 - DNA, 20 bp, Artificial Sequence
  Description of Artificial Sequence: Synthetic oligonucleotide
  Target: FXN; (+) strand; PAM type: NRG; PAM sequence: TAG
ctaaaaaaatacaaaaaaat

SEQ ID NO: 19468 - DNA, 20 bp, Artificial Sequence
  Description of Artificial Sequence: Synthetic oligonucleotide
  Target: FXN; (+) strand; PAM type: NRG; PAM sequence: TGG
aaaaatacaaaaaaattagc

SEQ ID NO: 19469 - DNA, 20 bp, Artificial Sequence
  Description of Artificial Sequence: Synthetic oligonucleotide
  Target: FXN; (+) strand; PAM type: NRG; PAM sequence: GGG
aaaatacaaaaaaattagct

SEQ ID NO: 19470 - DNA, 20 bp, Artificial Sequence
  Description of Artificial Sequence: Synthetic oligonucleotide
  Target: FXN; (+) strand; PAM type: NRG; PAM sequence: TGG
acaaaaaaattagctgggcg

SEQ ID NO: 19471 - DNA, 20 bp, Artificial Sequence
  Description of Artificial Sequence: Synthetic oligonucleotide
  Target: FXN; (+) strand; PAM type: NRG; PAM sequence: TGG
aaaaaattagctgggcgtgg

SEQ ID NO: 19472 - DNA, 20 bp, Artificial Sequence
  Description of Artificial Sequence: Synthetic oligonucleotide
  Target: FXN; (+) strand; PAM type: NRG; PAM sequence: TGG
aaattagctgggcgtggtgg

SEQ ID NO: 19473 - DNA, 20 bp, Artificial Sequence
  Description of Artificial Sequence: Synthetic oligonucleotide
  Target: FXN; (+) strand; PAM type: NRG; PAM sequence: GGG
aattagctgggcgtggtggt

SEQ ID NO: 19474 - DNA, 20 bp, Artificial Sequence
  Description of Artificial Sequence: Synthetic oligonucleotide
  Target: FXN; (+) strand; PAM type: NRG; PAM sequence: TAG
ggcgtggtggtgggcgcctg

SEQ ID NO: 19475 - DNA, 20 bp, Artificial Sequence
  Description of Artificial Sequence: Synthetic oligonucleotide
  Target: FXN; (+) strand; PAM type: NRG; PAM sequence: CAG
gtggtgggcgcctgtagtcc

SEQ ID NO: 19476 - DNA, 20 bp, Artificial Sequence
  Description of Artificial Sequence: Synthetic oligonucleotide
  Target: FXN; (+) strand; PAM type: NRG; PAM sequence: CGG
cgcctgtagtcccagctact

SEQ ID NO: 19477 - DNA, 20 bp, Artificial Sequence
  Description of Artificial Sequence: Synthetic oligonucleotide
  Target: FXN; (+) strand; PAM type: NRG; PAM sequence: GGG
gcctgtagtcccagctactc

SEQ ID NO: 19478 - DNA, 20 bp, Artificial Sequence
  Description of Artificial Sequence: Synthetic oligonucleotide
  Target: FXN; (+) strand; PAM type: NRG; PAM sequence: AAG
tgtagtcccagctactcggg

SEQ ID NO: 19479 - DNA, 20 bp, Artificial Sequence
  Description of Artificial Sequence: Synthetic oligonucleotide
  Target: FXN; (+) strand; PAM type: NRG; PAM sequence: GAG
tcccagctactcgggaagct

SEQ ID NO: 19480 - DNA, 20 bp, Artificial Sequence
  Description of Artificial Sequence: Synthetic oligonucleotide
  Target: FXN; (+) strand; PAM type: NRG; PAM sequence: AGG
cccagctactcgggaagctg

SEQ ID NO: 19481 - DNA, 20 bp, Artificial Sequence
  Description of Artificial Sequence: Synthetic oligonucleotide
  Target: FXN; (+) strand; PAM type: NRG; PAM sequence: CAG
agctactcgggaagctgagg

SEQ ID NO: 19482 - DNA, 20 bp, Artificial Sequence
  Description of Artificial Sequence: Synthetic oligonucleotide
  Target: FXN; (+) strand; PAM type: NRG; PAM sequence: AGG
gctactcgggaagctgaggc

SEQ ID NO: 19483 - DNA, 20 bp, Artificial Sequence
  Description of Artificial Sequence: Synthetic oligonucleotide
  Target: FXN; (+) strand; PAM type: NRG; PAM sequence: GAG
tactcgggaagctgaggcag

SEQ ID NO: 19484 - DNA, 20 bp, Artificial Sequence
  Description of Artificial Sequence: Synthetic oligonucleotide
  Target: FXN; (+) strand; PAM type: NRG; PAM sequence: TGG
gggaagctgaggcaggagaa

SEQ ID NO: 19485 - DNA, 20 bp, Artificial Sequence
  Description of Artificial Sequence: Synthetic oligonucleotide
  Target: FXN; (+) strand; PAM type: NRG; PAM sequence: CGG
gcaggagaatggcgtgaacc

SEQ ID NO: 19486 - DNA, 20 bp, Artificial Sequence
  Description of Artificial Sequence: Synthetic oligonucleotide
  Target: FXN; (+) strand; PAM type: NRG; PAM sequence: GGG
caggagaatggcgtgaaccc

SEQ ID NO: 19487 - DNA, 20 bp, Artificial Sequence
  Description of Artificial Sequence: Synthetic oligonucleotide
  Target: FXN; (+) strand; PAM type: NRG; PAM sequence: GAG
ggagaatggcgtgaacccgg

SEQ ID NO: 19488 - DNA, 20 bp, Artificial Sequence
  Description of Artificial Sequence: Synthetic oligonucleotide
  Target: FXN; (+) strand; PAM type: NRG; PAM sequence: AGG
gagaatggcgtgaacccggg

SEQ ID NO: 19489 - DNA, 20 bp, Artificial Sequence
  Description of Artificial Sequence: Synthetic oligonucleotide
  Target: FXN; (+) strand; PAM type: NRG; PAM sequence: CAG
aatggcgtgaacccgggagg

SEQ ID NO: 19490 - DNA, 20 bp, Artificial Sequence
  Description of Artificial Sequence: Synthetic oligonucleotide
  Target: FXN; (+) strand; PAM type: NRG; PAM sequence: GAG
tggcgtgaacccgggaggca

SEQ ID NO: 19491 - DNA, 20 bp, Artificial Sequence
  Description of Artificial Sequence: Synthetic oligonucleotide
  Target: FXN; (+) strand; PAM type: NRG; PAM sequence: CAG
aacccgggaggcagagcttg

SEQ ID NO: 19492 - DNA, 20 bp, Artificial Sequence
  Description of Artificial Sequence: Synthetic oligonucleotide
  Target: FXN; (+) strand; PAM type: NRG; PAM sequence: AAG
ggcagagcttgcagtgaacc

SEQ ID NO: 19493 - DNA, 20 bp, Artificial Sequence
  Description of Artificial Sequence: Synthetic oligonucleotide
  Target: FXN; (+) strand; PAM type: NRG; PAM sequence: GAG
gcttgcagtgaaccaagatc

SEQ ID NO: 19494 - DNA, 20 bp, Artificial Sequence
  Description of Artificial Sequence: Synthetic oligonucleotide
  Target: FXN; (+) strand; PAM type: NRG; PAM sequence: TAG
aagatcgagccactgcactc

SEQ ID NO: 19495 - DNA, 20 bp, Artificial Sequence
  Description of Artificial Sequence: Synthetic oligonucleotide
  Target: FXN; (+) strand; PAM type: NRG; PAM sequence: TGG
cgagccactgcactctagcc

SEQ ID NO: 19496 - DNA, 20 bp, Artificial Sequence
  Description of Artificial Sequence: Synthetic oligonucleotide
  Target: FXN; (+) strand; PAM type: NRG; PAM sequence: GGG
gagccactgcactctagcct

SEQ ID NO: 19497 - DNA, 20 bp, Artificial Sequence
  Description of Artificial Sequence: Synthetic oligonucleotide
  Target: FXN; (+) strand; PAM type: NRG; PAM sequence: CAG
ctgcactctagcctgggtga

SEQ ID NO: 19498 - DNA, 20 bp, Artificial Sequence
  Description of Artificial Sequence: Synthetic oligonucleotide
  Target: FXN; (+) strand; PAM type: NRG; PAM sequence: GAG
gcactctagcctgggtgaca

SEQ ID NO: 19499 - DNA, 20 bp, Artificial Sequence
  Description of Artificial Sequence: Synthetic oligonucleotide
  Target: FXN; (+) strand; PAM type: NRG; PAM sequence: GAG
tctagcctgggtgacagagc

SEQ ID NO: 19500 - DNA, 20 bp, Artificial Sequence
  Description of Artificial Sequence: Synthetic oligonucleotide
  Target: FXN; (+) strand; PAM type: NRG; PAM sequence: AAG
tccatctcaaaaaaaaaaaa

SEQ ID NO: 19501 - DNA, 20 bp, Artificial Sequence
  Description of Artificial Sequence: Synthetic oligonucleotide
  Target: FXN; (+) strand; PAM type: NRG; PAM sequence: CAG
aaaaaaaaaaaaagactcac

SEQ ID NO: 19502 - DNA, 20 bp, Artificial Sequence
  Description of Artificial Sequence: Synthetic oligonucleotide
  Target: FXN; (+) strand; PAM type: NRG; PAM sequence: TGG
aaaaaaagactcaccagctg

SEQ ID NO: 19503 - DNA, 20 bp, Artificial Sequence
  Description of Artificial Sequence: Synthetic oligonucleotide
  Target: FXN; (+) strand; PAM type: NRG; PAM sequence: TGG
tggccactgtctgtgctaat

SEQ ID NO: 19504 - DNA, 20 bp, Artificial Sequence
  Description of Artificial Sequence: Synthetic oligonucleotide
  Target: FXN; (+) strand; PAM type: NRG; PAM sequence: TAG
cactgtctgtgctaattggc

SEQ ID NO: 19505 - DNA, 20 bp, Artificial Sequence
  Description of Artificial Sequence: Synthetic oligonucleotide
  Target: FXN; (+) strand; PAM type: NRG; PAM sequence: CAG
attggctagtgcctgcatct

SEQ ID NO: 19506 - DNA, 20 bp, Artificial Sequence
  Description of Artificial Sequence: Synthetic oligonucleotide
  Target: FXN; (+) strand; PAM type: NRG; PAM sequence: AAG
tgactattccccctgcactt

SEQ ID NO: 19507 - DNA, 20 bp, Artificial Sequence
  Description of Artificial Sequence: Synthetic oligonucleotide
  Target: FXN; (+) strand; PAM type: NRG; PAM sequence: AGG
gactattccccctgcactta

SEQ ID NO: 19508 - DNA, 20 bp, Artificial Sequence
  Description of Artificial Sequence: Synthetic oligonucleotide
  Target: FXN; (+) strand; PAM type: NRG; PAM sequence: GGG
actattccccctgcacttaa

SEQ ID NO: 19509 - DNA, 20 bp, Artificial Sequence
  Description of Artificial Sequence: Synthetic oligonucleotide
  Target: FXN; (+) strand; PAM type: NRG; PAM sequence: TAG
gggcatgcacactcccaaaa

SEQ ID NO: 19510 - DNA, 20 bp, Artificial Sequence
  Description of Artificial Sequence: Synthetic oligonucleotide
  Target: FXN; (+) strand; PAM type: NRG; PAM sequence: CAG
gcacactcccaaaatagact

SEQ ID NO: 19511 - DNA, 20 bp, Artificial Sequence
  Description of Artificial Sequence: Synthetic oligonucleotide
  Target: FXN; (+) strand; PAM type: NRG; PAM sequence: AAG
aaaatagactcagattgtct

SEQ ID NO: 19512 - DNA, 20 bp, Artificial Sequence
  Description of Artificial Sequence: Synthetic oligonucleotide
  Target: FXN; (+) strand; PAM type: NRG; PAM sequence: AGG
aaatagactcagattgtcta

SEQ ID NO: 19513 - DNA, 20 bp, Artificial Sequence
  Description of Artificial Sequence: Synthetic oligonucleotide
  Target: FXN; (+) strand; PAM type: NRG; PAM sequence: AAG
aaggaataatgatgatgatg

SEQ ID NO: 19514 - DNA, 20 bp, Artificial Sequence
  Description of Artificial Sequence: Synthetic oligonucleotide
  Target: FXN; (+) strand; PAM type: NRG; PAM sequence: GAG
ggaataatgatgatgatgaa

SEQ ID NO: 19515 - DNA, 20 bp, Artificial Sequence
  Description of Artificial Sequence: Synthetic oligonucleotide
  Target: FXN; (+) strand; PAM type: NRG; PAM sequence: AAG
taatgatgatgatgaagaga

SEQ ID NO: 19516 - DNA, 20 bp, Artificial Sequence
  Description of Artificial Sequence: Synthetic oligonucleotide
  Target: FXN; (+) strand; PAM type: NRG; PAM sequence: TGG
aagagaaagccctctttatc

SEQ ID NO: 19517 - DNA, 20 bp, Artificial Sequence
  Description of Artificial Sequence: Synthetic oligonucleotide
  Target: FXN; (+) strand; PAM type: NRG; PAM sequence: TAG
ctctttatctggtctatttg

SEQ ID NO: 19518 - DNA, 20 bp, Artificial Sequence
  Description of Artificial Sequence: Synthetic oligonucleotide
  Target: FXN; (+) strand; PAM type: NRG; PAM sequence: CAG
ttatctggtctatttgtagt

SEQ ID NO: 19519 - DNA, 20 bp, Artificial Sequence
  Description of Artificial Sequence: Synthetic oligonucleotide
  Target: FXN; (+) strand; PAM type: NRG; PAM sequence: AAG
ctatttgtagtcagttccaa

SEQ ID NO: 19520 - DNA, 20 bp, Artificial Sequence
  Description of Artificial Sequence: Synthetic oligonucleotide
  Target: FXN; (+) strand; PAM type: NRG; PAM sequence: AAG
tagtcagttccaaaagcatt

SEQ ID NO: 19521 - DNA, 20 bp, Artificial Sequence
  Description of Artificial Sequence: Synthetic oligonucleotide
  Target: FXN; (+) strand; PAM type: NRG; PAM sequence: CAG
gaatttctgctgaactaatg

SEQ ID NO: 19522 - DNA, 20 bp, Artificial Sequence
  Description of Artificial Sequence: Synthetic oligonucleotide
  Target: FXN; (+) strand; PAM type: NRG; PAM sequence: TAG
ttctgctgaactaatgcagc

SEQ ID NO: 19523 - DNA, 20 bp, Artificial Sequence
  Description of Artificial Sequence: Synthetic oligonucleotide
  Target: FXN; (+) strand; PAM type: NRG; PAM sequence: TAG
tcaccactttccttccaaaa

SEQ ID NO: 19524 - DNA, 20 bp, Artificial Sequence
  Description of Artificial Sequence: Synthetic oligonucleotide
  Target: FXN; (+) strand; PAM type: NRG; PAM sequence: AAG
tttccttccaaaatagtttc

SEQ ID NO: 19525 - DNA, 20 bp, Artificial Sequence
  Description of Artificial Sequence: Synthetic oligonucleotide
  Target: FXN; (+) strand; PAM type: NRG; PAM sequence: TGG
caaaatagtttcaagatctg

SEQ ID NO: 19526 - DNA, 20 bp, Artificial Sequence
  Description of Artificial Sequence: Synthetic oligonucleotide
  Target: FXN; (+) strand; PAM type: NRG; PAM sequence: GGG
aaaatagtttcaagatctgt

SEQ ID NO: 19527 - DNA, 20 bp, Artificial Sequence
  Description of Artificial Sequence: Synthetic oligonucleotide
  Target: FXN; (+) strand; PAM type: NRG; PAM sequence: GGG
aaatagtttcaagatctgtg

SEQ ID NO: 19528 - DNA, 20 bp, Artificial Sequence
  Description of Artificial Sequence: Synthetic oligonucleotide
  Target: FXN; (+) strand; PAM type: NRG; PAM sequence: GGG
aatagtttcaagatctgtgg

SEQ ID NO: 19529 - DNA, 20 bp, Artificial Sequence
  Description of Artificial Sequence: Synthetic oligonucleotide
  Target: FXN; (+) strand; PAM type: NRG; PAM sequence: CAG
tgggggaaaaaatctattta

SEQ ID NO: 19530 - DNA, 20 bp, Artificial Sequence
  Description of Artificial Sequence: Synthetic oligonucleotide
  Target: FXN; (+) strand; PAM type: NRG; PAM sequence: CAG
aaaaatctatttacagtgaa

SEQ ID NO: 19531 - DNA, 20 bp, Artificial Sequence
  Description of Artificial Sequence: Synthetic oligonucleotide
  Target: FXN; (+) strand; PAM type: NRG; PAM sequence: TGG
tctatttacagtgaacagac

SEQ ID NO: 19532 - DNA, 20 bp, Artificial Sequence
  Description of Artificial Sequence: Synthetic oligonucleotide
  Target: FXN; (+) strand; PAM type: NRG; PAM sequence: TGG
atttacagtgaacagactgg

SEQ ID NO: 19533 - DNA, 20 bp, Artificial Sequence
  Description of Artificial Sequence: Synthetic oligonucleotide
  Target: FXN; (+) strand; PAM type: NRG; PAM sequence: GGG
tttacagtgaacagactggt

SEQ ID NO: 19534 - DNA, 20 bp, Artificial Sequence
  Description of Artificial Sequence: Synthetic oligonucleotide
  Target: FXN; (+) strand; PAM type: NRG; PAM sequence: GAG
tacagtgaacagactggtgg

SEQ ID NO: 19535 - DNA, 20 bp, Artificial Sequence
  Description of Artificial Sequence: Synthetic oligonucleotide
  Target: FXN; (+) strand; PAM type: NRG; PAM sequence: AGG
acagtgaacagactggtggg

SEQ ID NO: 19536 - DNA, 20 bp, Artificial Sequence
  Description of Artificial Sequence: Synthetic oligonucleotide
  Target: FXN; (+) strand; PAM type: NRG; PAM sequence: AAG
gtgaacagactggtgggagg

SEQ ID NO: 19537 - DNA, 20 bp, Artificial Sequence
  Description of Artificial Sequence: Synthetic oligonucleotide
  Target: FXN; (+) strand; PAM type: NRG; PAM sequence: GAG
cagactggtgggaggaagtt

SEQ ID NO: 19538 - DNA, 20 bp, Artificial Sequence
  Description of Artificial Sequence: Synthetic oligonucleotide
  Target: FXN; (+) strand; PAM type: NRG; PAM sequence: TGG
ggtgggaggaagttgagcat

SEQ ID NO: 19539 - DNA, 20 bp, Artificial Sequence
  Description of Artificial Sequence: Synthetic oligonucleotide
  Target: FXN; (+) strand; PAM type: NRG; PAM sequence: GGG
gtgggaggaagttgagcatt

SEQ ID NO: 19540 - DNA, 20 bp, Artificial Sequence
  Description of Artificial Sequence: Synthetic oligonucleotide
  Target: FXN; (+) strand; PAM type: NRG; PAM sequence: GGG
tgggaggaagttgagcattg

SEQ ID NO: 19541 - DNA, 20 bp, Artificial Sequence
  Description of Artificial Sequence: Synthetic oligonucleotide
  Target: FXN; (+) strand; PAM type: NRG; PAM sequence: AAG
gccctgtgtaaccttgccct

SEQ ID NO: 19542 - DNA, 20 bp, Artificial Sequence
  Description of Artificial Sequence: Synthetic oligonucleotide
  Target: FXN; (+) strand; PAM type: NRG; PAM sequence: TGG
tgtgtaaccttgccctaagt

SEQ ID NO: 19543 - DNA, 20 bp, Artificial Sequence
  Description of Artificial Sequence: Synthetic oligonucleotide
  Target: FXN; (+) strand; PAM type: NRG; PAM sequence: GGG
gtgtaaccttgccctaagtt

SEQ ID NO: 19544 - DNA, 20 bp, Artificial Sequence
  Description of Artificial Sequence: Synthetic oligonucleotide
  Target: FXN; (+) strand; PAM type: NRG; PAM sequence: CAG
taaccttgccctaagttggg

SEQ ID NO: 19545 - DNA, 20 bp, Artificial Sequence
  Description of Artificial Sequence: Synthetic oligonucleotide
  Target: FXN; (+) strand; PAM type: NRG; PAM sequence: TGG
cttgccctaagttgggcaga

SEQ ID NO: 19546 - DNA, 20 bp, Artificial Sequence
  Description of Artificial Sequence: Synthetic oligonucleotide
  Target: FXN; (+) strand; PAM type: NRG; PAM sequence: TGG
gcagatggtatcacactacc

SEQ ID NO: 19547 - DNA, 20 bp, Artificial Sequence
  Description of Artificial Sequence: Synthetic oligonucleotide
  Target: FXN; (+) strand; PAM type: NRG; PAM sequence: CAG
ctgctcattcactatttgac

SEQ ID NO: 19548 - DNA, 20 bp, Artificial Sequence
  Description of Artificial Sequence: Synthetic oligonucleotide
  Target: FXN; (+) strand; PAM type: NRG; PAM sequence: TGG
tcattcactatttgaccagt

SEQ ID NO: 19549 - DNA, 20 bp, Artificial Sequence
  Description of Artificial Sequence: Synthetic oligonucleotide
  Target: FXN; (+) strand; PAM type: NRG; PAM sequence: CAG
attcacaaatgtcctttttg

SEQ ID NO: 19550 - DNA, 20 bp, Artificial Sequence
  Description of Artificial Sequence: Synthetic oligonucleotide
  Target: FXN; (+) strand; PAM type: NRG; PAM sequence: AGG
ttcacaaatgtcctttttgc

SEQ ID NO: 19551 - DNA, 20 bp, Artificial Sequence
  Description of Artificial Sequence: Synthetic oligonucleotide
  Target: FXN; (+) strand; PAM type: NRG; PAM sequence: GAG
cacaaatgtcctttttgcag

SEQ ID NO: 19552 - DNA, 20 bp, Artificial Sequence
  Description of Artificial Sequence: Synthetic oligonucleotide
  Target: FXN; (+) strand; PAM type: NRG; PAM sequence: AGG
acaaatgtcctttttgcagg

SEQ ID NO: 19553 - DNA, 20 bp, Artificial Sequence
  Description of Artificial Sequence: Synthetic oligonucleotide
  Target: FXN; (+) strand; PAM type: NRG; PAM sequence: GGG
caaatgtcctttttgcagga

SEQ ID NO: 19554 - DNA, 20 bp, Artificial Sequence
  Description of Artificial Sequence: Synthetic oligonucleotide
  Target: FXN; (+) strand; PAM type: NRG; PAM sequence: TGG
tgtcctttttgcaggaggga

SEQ ID NO: 19555 - DNA, 20 bp, Artificial Sequence
  Description of Artificial Sequence: Synthetic oligonucleotide
  Target: FXN; (+) strand; PAM type: NRG; PAM sequence: GAG
tcctttttgcaggagggatg

SEQ ID NO: 19556 - DNA, 20 bp, Artificial Sequence
  Description of Artificial Sequence: Synthetic oligonucleotide
  Target: FXN; (+) strand; PAM type: NRG; PAM sequence: AGG
cctttttgcaggagggatgg

SEQ ID NO: 19557 - DNA, 20 bp, Artificial Sequence
  Description of Artificial Sequence: Synthetic oligonucleotide
  Target: FXN; (+) strand; PAM type: NRG; PAM sequence: TAG
tgcaggagggatggaggtgc

SEQ ID NO: 19558 - DNA, 20 bp, Artificial Sequence
  Description of Artificial Sequence: Synthetic oligonucleotide
  Target: FXN; (+) strand; PAM type: NRG; PAM sequence: CAG
ggatggaggtgctagacctg

SEQ ID NO: 19559 - DNA, 20 bp, Artificial Sequence
  Description of Artificial Sequence: Synthetic oligonucleotide
  Target: FXN; (+) strand; PAM type: NRG; PAM sequence: TAG
ggtgctagacctgcagatgc

SEQ ID NO: 19560 - DNA, 20 bp, Artificial Sequence
  Description of Artificial Sequence: Synthetic oligonucleotide
  Target: FXN; (+) strand; PAM type: NRG; PAM sequence: AAG
cctgcagatgctagcatgaa

SEQ ID NO: 19561 - DNA, 20 bp, Artificial Sequence
  Description of Artificial Sequence: Synthetic oligonucleotide
  Target: FXN; (+) strand; PAM type: NRG; PAM sequence: CAG
cagatgctagcatgaaaaga

SEQ ID NO: 19562 - DNA, 20 bp, Artificial Sequence
  Description of Artificial Sequence: Synthetic oligonucleotide
  Target: FXN; (+) strand; PAM type: NRG; PAM sequence: AAG
aagacagatctcctgctgct

SEQ ID NO: 19563 - DNA, 20 bp, Artificial Sequence
  Description of Artificial Sequence: Synthetic oligonucleotide
  Target: FXN; (+) strand; PAM type: NRG; PAM sequence: AGG
agacagatctcctgctgcta

SEQ ID NO: 19564 - DNA, 20 bp, Artificial Sequence
  Description of Artificial Sequence: Synthetic oligonucleotide
  Target: FXN; (+) strand; PAM type: NRG; PAM sequence: AAG
tcctgctgctaaggtgctta

SEQ ID NO: 19565 - DNA, 20 bp, Artificial Sequence
  Description of Artificial Sequence: Synthetic oligonucleotide
  Target: FXN; (+) strand; PAM type: NRG; PAM sequence: TAG
tgctgctaaggtgcttaaag

SEQ ID NO: 19566 - DNA, 20 bp, Artificial Sequence
  Description of Artificial Sequence: Synthetic oligonucleotide
  Target: FXN; (+) strand; PAM type: NRG; PAM sequence: TGG
tgctaaggtgcttaaagtag

SEQ ID NO: 19567 - DNA, 20 bp, Artificial Sequence
  Description of Artificial Sequence: Synthetic oligonucleotide
  Target: FXN; (+) strand; PAM type: NRG; PAM sequence: GAG
ctaaggtgcttaaagtagtg

SEQ ID NO: 19568 - DNA, 20 bp, Artificial Sequence
  Description of Artificial Sequence: Synthetic oligonucleotide
  Target: FXN; (+) strand; PAM type: NRG; PAM sequence: AGG
taaggtgcttaaagtagtgg

SEQ ID NO: 19569 - DNA, 20 bp, Artificial Sequence
  Description of Artificial Sequence: Synthetic oligonucleotide
  Target: FXN; (+) strand; PAM type: NRG; PAM sequence: CAG
gtgcttaaagtagtggaggt

SEQ ID NO: 19570 - DNA, 20 bp, Artificial Sequence
  Description of Artificial Sequence: Synthetic oligonucleotide
  Target: FXN; (+) strand; PAM type: NRG; PAM sequence: AGG
tgcttaaagtagtggaggtc

SEQ ID NO: 19571 - DNA, 20 bp, Artificial Sequence
  Description of Artificial Sequence: Synthetic oligonucleotide
  Target: FXN; (+) strand; PAM type: NRG; PAM sequence: GGG
gcttaaagtagtggaggtca

SEQ ID NO: 19572 - DNA, 20 bp, Artificial Sequence
  Description of Artificial Sequence: Synthetic oligonucleotide
  Target: FXN; (+) strand; PAM type: NRG; PAM sequence: GGG
cttaaagtagtggaggtcag

SEQ ID NO: 19573 - DNA, 20 bp, Artificial Sequence
  Description of Artificial Sequence: Synthetic oligonucleotide
  Target: FXN; (+) strand; PAM type: NRG; PAM sequence: AAG
agtagtggaggtcaggggac

SEQ ID NO: 19574 - DNA, 20 bp, Artificial Sequence
  Description of Artificial Sequence: Synthetic oligonucleotide
  Target: FXN; (+) strand; PAM type: NRG; PAM sequence: AAG
gtggaggtcaggggacaagc

SEQ ID NO: 19575 - DNA, 20 bp, Artificial Sequence
  Description of Artificial Sequence: Synthetic oligonucleotide
  Target: FXN; (+) strand; PAM type: NRG; PAM sequence: CAG
gaggtcaggggacaagcaag

SEQ ID NO: 19576 - DNA, 20 bp, Artificial Sequence
  Description of Artificial Sequence: Synthetic oligonucleotide
  Target: FXN; (+) strand; PAM type: NRG; PAM sequence: CAG
tcaggggacaagcaagcagt

SEQ ID NO: 19577 - DNA, 20 bp, Artificial Sequence
  Description of Artificial Sequence: Synthetic oligonucleotide
  Target: FXN; (+) strand; PAM type: NRG; PAM sequence: AGG
caggggacaagcaagcagtc

SEQ ID NO: 19578 - DNA, 20 bp, Artificial Sequence
  Description of Artificial Sequence: Synthetic oligonucleotide
  Target: FXN; (+) strand; PAM type: NRG; PAM sequence: CAG
gggacaagcaagcagtcagg

SEQ ID NO: 19579 - DNA, 20 bp, Artificial Sequence
  Description of Artificial Sequence: Synthetic oligonucleotide
  Target: FXN; (+) strand; PAM type: NRG; PAM sequence: CAG
cagtcaggcagctctgaatg

SEQ ID NO: 19580 - DNA, 20 bp, Artificial Sequence
  Description of Artificial Sequence: Synthetic oligonucleotide
  Target: FXN; (+) strand; PAM type: NRG; PAM sequence: GAG
gtcaggcagctctgaatgca

SEQ ID NO: 19581 - DNA, 20 bp, Artificial Sequence
  Description of Artificial Sequence: Synthetic oligonucleotide
  Target: FXN; (+) strand; PAM type: NRG; PAM sequence: AGG
tcaggcagctctgaatgcag

SEQ ID NO: 19582 - DNA, 20 bp, Artificial Sequence
  Description of Artificial Sequence: Synthetic oligonucleotide
  Target: FXN; (+) strand; PAM type: NRG; PAM sequence: CAG
ggcagctctgaatgcagagg

SEQ ID NO: 19583 - DNA, 20 bp, Artificial Sequence
  Description of Artificial Sequence: Synthetic oligonucleotide
  Target: FXN; (+) strand; PAM type: NRG; PAM sequence: AGG
gcagctctgaatgcagaggc

SEQ ID NO: 19584 - DNA, 20 bp, Artificial Sequence
  Description of Artificial Sequence: Synthetic oligonucleotide
  Target: FXN; (+) strand; PAM type: NRG; PAM sequence: AAG
gctctgaatgcagaggcagg

SEQ ID NO: 19585 - DNA, 20 bp, Artificial Sequence
  Description of Artificial Sequence: Synthetic oligonucleotide
  Target: FXN; (+) strand; PAM type: NRG; PAM sequence: GAG
gcagaggcaggaagcaccac

SEQ ID NO: 19586 - DNA, 20 bp, Artificial Sequence
  Description of Artificial Sequence: Synthetic oligonucleotide
  Target: FXN; (+) strand; PAM type: NRG; PAM sequence: AGG
cagaggcaggaagcaccacg

SEQ ID NO: 19587 - DNA, 20 bp, Artificial Sequence
  Description of Artificial Sequence: Synthetic oligonucleotide
  Target: FXN; (+) strand; PAM type: NRG; PAM sequence: TGG
caggaagcaccacgaggcaa

SEQ ID NO: 19588 - DNA, 20 bp, Artificial Sequence
  Description of Artificial Sequence: Synthetic oligonucleotide
  Target: FXN; (+) strand; PAM type: NRG; PAM sequence: GGG
aggaagcaccacgaggcaat

SEQ ID NO: 19589 - DNA, 20 bp, Artificial Sequence
  Description of Artificial Sequence: Synthetic oligonucleotide
  Target: FXN; (+) strand; PAM type: NRG; PAM sequence: CAG
ccacgaggcaatgggaccca

SEQ ID NO: 19590 - DNA, 20 bp, Artificial Sequence
  Description of Artificial Sequence: Synthetic oligonucleotide
  Target: FXN; (+) strand; PAM type: NRG; PAM sequence: GAG
acgaggcaatgggacccaca

SEQ ID NO: 19591 - DNA, 20 bp, Artificial Sequence
  Description of Artificial Sequence: Synthetic oligonucleotide
  Target: FXN; (+) strand; PAM type: NRG; PAM sequence: AGG
cgaggcaatgggacccacag

SEQ ID NO: 19592 - DNA, 20 bp, Artificial Sequence
  Description of Artificial Sequence: Synthetic oligonucleotide
  Target: FXN; (+) strand; PAM type: NRG; PAM sequence: GGG
gaggcaatgggacccacaga

SEQ ID NO: 19593 - DNA, 20 bp, Artificial Sequence
  Description of Artificial Sequence: Synthetic oligonucleotide
  Target: FXN; (+) strand; PAM type: NRG; PAM sequence: GGG
aggcaatgggacccacagag

SEQ ID NO: 19594 - DNA, 20 bp, Artificial Sequence
  Description of Artificial Sequence: Synthetic oligonucleotide
  Target: FXN; (+) strand; PAM type: NRG; PAM sequence: TAG
caatgggacccacagagggg

SEQ ID NO: 19595 - DNA, 20 bp, Artificial Sequence
  Description of Artificial Sequence: Synthetic oligonucleotide
  Target: FXN; (+) strand; PAM type: NRG; PAM sequence: CAG
tgggacccacagaggggtag

SEQ ID NO: 19596 - DNA, 20 bp, Artificial Sequence
  Description of Artificial Sequence: Synthetic oligonucleotide
  Target: FXN; (+) strand; PAM type: NRG; PAM sequence: AGG
gggacccacagaggggtagc

SEQ ID NO: 19597 - DNA, 20 bp, Artificial Sequence
  Description of Artificial Sequence: Synthetic oligonucleotide
  Target: FXN; (+) strand; PAM type: NRG; PAM sequence: GGG
ggacccacagaggggtagca

SEQ ID NO: 19598 - DNA, 20 bp, Artificial Sequence
  Description of Artificial Sequence: Synthetic oligonucleotide
  Target: FXN; (+) strand; PAM type: NRG; PAM sequence: TAG
cccacagaggggtagcaggg

SEQ ID NO: 19599 - DNA, 20 bp, Artificial Sequence
  Description of Artificial Sequence: Synthetic oligonucleotide
  Target: FXN; (+) strand; PAM type: NRG; PAM sequence: GAG
cacagaggggtagcagggta

SEQ ID NO: 19600 - DNA, 20 bp, Artificial Sequence
  Description of Artificial Sequence: Synthetic oligonucleotide
  Target: FXN; (+) strand; PAM type: NRG; PAM sequence: AGG
acagaggggtagcagggtag

SEQ ID NO: 19601 - DNA, 20 bp, Artificial Sequence
  Description of Artificial Sequence: Synthetic oligonucleotide
  Target: FXN; (+) strand; PAM type: NRG; PAM sequence: GAG
aggggtagcagggtagaggt

SEQ ID NO: 19602 - DNA, 20 bp, Artificial Sequence
  Description of Artificial Sequence: Synthetic oligonucleotide
  Target: FXN; (+) strand; PAM type: NRG; PAM sequence: TGG
ggtagcagggtagaggtgag

SEQ ID NO: 19603 - DNA, 20 bp, Artificial Sequence
  Description of Artificial Sequence: Synthetic oligonucleotide
  Target: FXN; (+) strand; PAM type: NRG; PAM sequence: GGG
gtagcagggtagaggtgagt

SEQ ID NO: 19604 - DNA, 20 bp, Artificial Sequence
  Description of Artificial Sequence: Synthetic oligonucleotide
  Target: FXN; (+) strand; PAM type: NRG; PAM sequence: TGG
agaggtgagtgggtctcatg

SEQ ID NO: 19605 - DNA, 20 bp, Artificial Sequence
  Description of Artificial Sequence: Synthetic oligonucleotide
  Target: FXN; (+) strand; PAM type: NRG; PAM sequence: GGG
gaggtgagtgggtctcatgt

SEQ ID NO: 19606 - DNA, 20 bp, Artificial Sequence
  Description of Artificial Sequence: Synthetic oligonucleotide
  Target: FXN; (+) strand; PAM type: NRG; PAM sequence: GGG
aggtgagtgggtctcatgtg

SEQ ID NO: 19607 - DNA, 20 bp, Artificial Sequence
  Description of Artificial Sequence: Synthetic oligonucleotide
  Target: FXN; (+) strand; PAM type: NRG; PAM sequence: GAG
gtgagtgggtctcatgtggg

SEQ ID NO: 19608 - DNA, 20 bp, Artificial Sequence
  Description of Artificial Sequence: Synthetic oligonucleotide
  Target: FXN; (+) strand; PAM type: NRG; PAM sequence: AGG
tgagtgggtctcatgtgggg

SEQ ID NO: 19609 - DNA, 20 bp, Artificial Sequence
  Description of Artificial Sequence: Synthetic oligonucleotide
  Target: FXN; (+) strand; PAM type: NRG; PAM sequence: GGG
gagtgggtctcatgtgggga

SEQ ID NO: 19610 - DNA, 20 bp, Artificial Sequence
  Description of Artificial Sequence: Synthetic oligonucleotide
  Target: FXN; (+) strand; PAM type: NRG; PAM sequence: GAG
gtgggtctcatgtggggagg

SEQ ID NO: 19611 - DNA, 20 bp, Artificial Sequence
  Description of Artificial Sequence: Synthetic oligonucleotide
  Target: FXN; (+) strand; PAM type: NRG; PAM sequence: AGG
tgggtctcatgtggggaggg

SEQ ID NO: 19612 - DNA, 20 bp, Artificial Sequence
  Description of Artificial Sequence: Synthetic oligonucleotide
  Target: FXN; (+) strand; PAM type: NRG; PAM sequence: AAG
gtctcatgtggggagggagg

SEQ ID NO: 19613 - DNA, 20 bp, Artificial Sequence
  Description of Artificial Sequence: Synthetic oligonucleotide
  Target: FXN; (+) strand; PAM type: NRG; PAM sequence: CAG
gggagggaggaagttgactg

SEQ ID NO: 19614 - DNA, 20 bp, Artificial Sequence
  Description of Artificial Sequence: Synthetic oligonucleotide
  Target: FXN; (+) strand; PAM type: NRG; PAM sequence: GAG
gagggaggaagttgactgca

SEQ ID NO: 19615 - DNA, 20 bp, Artificial Sequence
  Description of Artificial Sequence: Synthetic oligonucleotide
  Target: FXN; (+) strand; PAM type: NRG; PAM sequence: AAG
ggaggaagttgactgcagag

SEQ ID NO: 19616 - DNA, 20 bp, Artificial Sequence
  Description of Artificial Sequence: Synthetic oligonucleotide
  Target: FXN; (+) strand; PAM type: NRG; PAM sequence: AGG
gaggaagttgactgcagaga

SEQ ID NO: 19617 - DNA, 20 bp, Artificial Sequence
  Description of Artificial Sequence: Synthetic oligonucleotide
  Target: FXN; (+) strand; PAM type: NRG; PAM sequence: CAG
gttgactgcagagaaggtgc

SEQ ID NO: 19618 - DNA, 20 bp, Artificial Sequence
  Description of Artificial Sequence: Synthetic oligonucleotide
  Target: FXN; (+) strand; PAM type: NRG; PAM sequence: AGG
ttgactgcagagaaggtgcc

SEQ ID NO: 19619 - DNA, 20 bp, Artificial Sequence
  Description of Artificial Sequence: Synthetic oligonucleotide
  Target: FXN; (+) strand; PAM type: NRG; PAM sequence: GGG
tgactgcagagaaggtgcca

SEQ ID NO: 19620 - DNA, 20 bp, Artificial Sequence
  Description of Artificial Sequence: Synthetic oligonucleotide
  Target: FXN; (+) strand; PAM type: NRG; PAM sequence: GGG
gactgcagagaaggtgccag

SEQ ID NO: 19621 - DNA, 20 bp, Artificial Sequence
  Description of Artificial Sequence: Synthetic oligonucleotide
  Target: FXN; (+) strand; PAM type: NRG; PAM sequence: GGG
actgcagagaaggtgccagg

SEQ ID NO: 19622 - DNA, 20 bp, Artificial Sequence
  Description of Artificial Sequence: Synthetic oligonucleotide
  Target: FXN; (+) strand; PAM type: NRG; PAM sequence: TAG
aaggtgccagggggtgaaaa

SEQ ID NO: 19623 - DNA, 20 bp, Artificial Sequence
  Description of Artificial Sequence: Synthetic oligonucleotide
  Target: FXN; (+) strand; PAM type: NRG; PAM sequence: GAG
ccagggggtgaaaatagctt

SEQ ID NO: 19624 - DNA, 20 bp, Artificial Sequence
  Description of Artificial Sequence: Synthetic oligonucleotide
  Target: FXN; (+) strand; PAM type: NRG; PAM sequence: GAG
agggggtgaaaatagcttga

SEQ ID NO: 19625 - DNA, 20 bp, Artificial Sequence
  Description of Artificial Sequence: Synthetic oligonucleotide
  Target: FXN; (+) strand; PAM type: NRG; PAM sequence: TGG
tgaaaatagcttgagagctg

SEQ ID NO: 19626 - DNA, 20 bp, Artificial Sequence
  Description of Artificial Sequence: Synthetic oligonucleotide
  Target: FXN; (+) strand; PAM type: NRG; PAM sequence: GAG
aaaatagcttgagagctgtg

SEQ ID NO: 19627 - DNA, 20 bp, Artificial Sequence
  Description of Artificial Sequence: Synthetic oligonucleotide
  Target: FXN; (+) strand; PAM type: NRG; PAM sequence: TAG
tagcttgagagctgtggagc

SEQ ID NO: 19628 - DNA, 20 bp, Artificial Sequence
  Description of Artificial Sequence: Synthetic oligonucleotide
  Target: FXN; (+) strand; PAM type: NRG; PAM sequence: AAG
cttgagagctgtggagctag

SEQ ID NO: 19629 - DNA, 20 bp, Artificial Sequence
  Description of Artificial Sequence: Synthetic oligonucleotide
  Target: FXN; (+) strand; PAM type: NRG; PAM sequence: AGG
ttgagagctgtggagctaga

SEQ ID NO: 19630 - DNA, 20 bp, Artificial Sequence
  Description of Artificial Sequence: Synthetic oligonucleotide
  Target: FXN; (+) strand; PAM type: NRG; PAM sequence: GGG
tgagagctgtggagctagaa

SEQ ID NO: 19631 - DNA, 20 bp, Artificial Sequence
  Description of Artificial Sequence: Synthetic oligonucleotide
  Target: FXN; (+) strand; PAM type: NRG; PAM sequence: AAG
tattaatatgccctttgaaa

SEQ ID NO: 19632 - DNA, 20 bp, Artificial Sequence
  Description of Artificial Sequence: Synthetic oligonucleotide
  Target: FXN; (+) strand; PAM type: NRG; PAM sequence: GAG
ttaatatgccctttgaaaaa

SEQ ID NO: 19633 - DNA, 20 bp, Artificial Sequence
  Description of Artificial Sequence: Synthetic oligonucleotide
  Target: FXN; (+) strand; PAM type: NRG; PAM sequence: TGG
atatgccctttgaaaaagag

SEQ ID NO: 19634 - DNA, 20 bp, Artificial Sequence
  Description of Artificial Sequence: Synthetic oligonucleotide
  Target: FXN; (+) strand; PAM type: NRG; PAM sequence: TGG
aaaaagagtggcctgatacc

SEQ ID NO: 19635 - DNA, 20 bp, Artificial Sequence
  Description of Artificial Sequence: Synthetic oligonucleotide
  Target: FXN; (+) strand; PAM type: NRG; PAM sequence: GAG
aaagagtggcctgatacctg

SEQ ID NO: 19636 - DNA, 20 bp, Artificial Sequence
  Description of Artificial Sequence: Synthetic oligonucleotide
  Target: FXN; (+) strand; PAM type: NRG; PAM sequence: AAG
tgatacctggagtcactcaa

SEQ ID NO: 19637 - DNA, 20 bp, Artificial Sequence
  Description of Artificial Sequence: Synthetic oligonucleotide
  Target: FXN; (+) strand; PAM type: NRG; PAM sequence: TAG
caaaagatttccaattccga

SEQ ID NO: 19638 - DNA, 20 bp, Artificial Sequence
  Description of Artificial Sequence: Synthetic oligonucleotide
  Target: FXN; (+) strand; PAM type: NRG; PAM sequence: AGG
aaaagatttccaattccgat

SEQ ID NO: 19639 - DNA, 20 bp, Artificial Sequence
  Description of Artificial Sequence: Synthetic oligonucleotide
  Target: FXN; (+) strand; PAM type: NRG; PAM sequence: AAG
tttccaattccgataggaaa

SEQ ID NO: 19640 - DNA, 20 bp, Artificial Sequence
  Description of Artificial Sequence: Synthetic oligonucleotide
  Target: FXN; (+) strand; PAM type: NRG; PAM sequence: TGG
cgataggaaaaagtcaattt

SEQ ID NO: 19641 - DNA, 20 bp, Artificial Sequence
  Description of Artificial Sequence: Synthetic oligonucleotide
  Target: FXN; (+) strand; PAM type: NRG; PAM sequence: CAG
gaaaaagtcaattttggctt

SEQ ID NO: 19642 - DNA, 20 bp, Artificial Sequence
  Description of Artificial Sequence: Synthetic oligonucleotide
  Target: FXN; (+) strand; PAM type: NRG; PAM sequence: TGG
aaagtcaattttggcttcag

SEQ ID NO: 19643 - DNA, 20 bp, Artificial Sequence
  Description of Artificial Sequence: Synthetic oligonucleotide
  Target: FXN; (+) strand; PAM type: NRG; PAM sequence: GAG
cccctgatttgctgtatgct

SEQ ID NO: 19644 - DNA, 20 bp, Artificial Sequence
  Description of Artificial Sequence: Synthetic oligonucleotide
  Target: FXN; (+) strand; PAM type: NRG; PAM sequence: AGG
ccctgatttgctgtatgctg

SEQ ID NO: 19645 - DNA, 20 bp, Artificial Sequence
  Description of Artificial Sequence: Synthetic oligonucleotide
  Target: FXN; (+) strand; PAM type: NRG; PAM sequence: TGG
tgctgtatgctgaggcattg

SEQ ID NO: 19646 - DNA, 20 bp, Artificial Sequence
  Description of Artificial Sequence: Synthetic oligonucleotide
  Target: FXN; (+) strand; PAM type: NRG; PAM sequence: TGG
atgctgaggcattgtggtga

SEQ ID NO: 19647 - DNA, 20 bp, Artificial Sequence
  Description of Artificial Sequence: Synthetic oligonucleotide
  Target: FXN; (+) strand; PAM type: NRG; PAM sequence: AAG
ggcattgtggtgatggacgc

SEQ ID NO: 19648 - DNA, 20 bp, Artificial Sequence
  Description of Artificial Sequence: Synthetic oligonucleotide
  Target: FXN; (+) strand; PAM type: NRG; PAM sequence: CGG
tgtggtgatggacgcaagtg

SEQ ID NO: 19649 - DNA, 20 bp, Artificial Sequence
  Description of Artificial Sequence: Synthetic oligonucleotide
  Target: FXN; (+) strand; PAM type: NRG; PAM sequence: GAG
tggtgatggacgcaagtgcg

SEQ ID NO: 19650 - DNA, 20 bp, Artificial Sequence
  Description of Artificial Sequence: Synthetic oligonucleotide
  Target: FXN; (+) strand; PAM type: NRG; PAM sequence: GAG
gacgcaagtgcggagacctt

SEQ ID NO: 19651 - DNA, 20 bp, Artificial Sequence
  Description of Artificial Sequence: Synthetic oligonucleotide
  Target: FXN; (+) strand; PAM type: NRG; PAM sequence: TAG
cttgagcacgcatctgcccc

SEQ ID NO: 19652 - DNA, 20 bp, Artificial Sequence
  Description of Artificial Sequence: Synthetic oligonucleotide
  Target: FXN; (+) strand; PAM type: NRG; PAM sequence: GAG
ctgcccctagttcttgccct

SEQ ID NO: 19653 - DNA, 20 bp, Artificial Sequence
  Description of Artificial Sequence: Synthetic oligonucleotide
  Target: FXN; (+) strand; PAM type: NRG; PAM sequence: AAG
gttcttgccctgagtcctcg

SEQ ID NO: 19654 - DNA, 20 bp, Artificial Sequence
  Description of Artificial Sequence: Synthetic oligonucleotide
  Target: FXN; (+) strand; PAM type: NRG; PAM sequence: AGG
ttcttgccctgagtcctcga

SEQ ID NO: 19655 - DNA, 20 bp, Artificial Sequence
  Description of Artificial Sequence: Synthetic oligonucleotide
  Target: FXN; (+) strand; PAM type: NRG; PAM sequence: GAG
cttgccctgagtcctcgaag

SEQ ID NO: 19656 - DNA, 20 bp, Artificial Sequence
  Description of Artificial Sequence: Synthetic oligonucleotide
  Target: FXN; (+) strand; PAM type: NRG; PAM sequence: AGG
ttgccctgagtcctcgaagg

SEQ ID NO: 19657 - DNA, 20 bp, Artificial Sequence
  Description of Artificial Sequence: Synthetic oligonucleotide
  Target: FXN; (+) strand; PAM type: NRG; PAM sequence: CAG
ccctgagtcctcgaaggagg

SEQ ID NO: 19658 - DNA, 20 bp, Artificial Sequence
  Description of Artificial Sequence: Synthetic oligonucleotide
  Target: FXN; (+) strand; PAM type: NRG; PAM sequence: AGG
cctgagtcctcgaaggaggc

SEQ ID NO: 19659 - DNA, 20 bp, Artificial Sequence
  Description of Artificial Sequence: Synthetic oligonucleotide
  Target: FXN; (+) strand; PAM type: NRG; PAM sequence: GAG
tgagtcctcgaaggaggcag

SEQ ID NO: 19660 - DNA, 20 bp, Artificial Sequence
  Description of Artificial Sequence: Synthetic oligonucleotide
  Target: FXN; (+) strand; PAM type: NRG; PAM sequence: GAG
agtcctcgaaggaggcagga

SEQ ID NO: 19661 - DNA, 20 bp, Artificial Sequence
  Description of Artificial Sequence: Synthetic oligonucleotide
  Target: FXN; (+) strand; PAM type: NRG; PAM sequence: AAG
aaggaggcaggagagacatc

SEQ ID NO: 19662 - DNA, 20 bp, Artificial Sequence
  Description of Artificial Sequence: Synthetic oligonucleotide
  Target: FXN; (+) strand; PAM type: NRG; PAM sequence: AGG
aggaggcaggagagacatca

SEQ ID NO: 19663 - DNA, 20 bp, Artificial Sequence
  Description of Artificial Sequence: Synthetic oligonucleotide
  Target: FXN; (+) strand; PAM type: NRG; PAM sequence: CAG
aggcaggagagacatcaagg

SEQ ID NO: 19664 - DNA, 20 bp, Artificial Sequence
  Description of Artificial Sequence: Synthetic oligonucleotide
  Target: FXN; (+) strand; PAM type: NRG; PAM sequence: CAG
aggagagacatcaaggcaga

SEQ ID NO: 19665 - DNA, 20 bp, Artificial Sequence
  Description of Artificial Sequence: Synthetic oligonucleotide
  Target: FXN; (+) strand; PAM type: NRG; PAM sequence: AGG
ggagagacatcaaggcagac

SEQ ID NO: 19666 - DNA, 20 bp, Artificial Sequence
  Description of Artificial Sequence: Synthetic oligonucleotide
  Target: FXN; (+) strand; PAM type: NRG; PAM sequence: CAG
ggcagacaggcgccgctcat

SEQ ID NO: 19667 - DNA, 20 bp, Artificial Sequence
  Description of Artificial Sequence: Synthetic oligonucleotide
  Target: FXN; (+) strand; PAM type: NRG; PAM sequence: GAG
aggcgccgctcatcagtgat

SEQ ID NO: 19668 - DNA, 20 bp, Artificial Sequence
  Description of Artificial Sequence: Synthetic oligonucleotide
  Target: FXN; (+) strand; PAM type: NRG; PAM sequence: CAG
ccgctcatcagtgatgagac

SEQ ID NO: 19669 - DNA, 20 bp, Artificial Sequence
  Description of Artificial Sequence: Synthetic oligonucleotide
  Target: FXN; (+) strand; PAM type: NRG; PAM sequence: TGG
atcagtgatgagaccagacc

SEQ ID NO: 19670 - DNA, 20 bp, Artificial Sequence
  Description of Artificial Sequence: Synthetic oligonucleotide
  Target: FXN; (+) strand; PAM type: NRG; PAM sequence: CAG
tggaactcgcgtcttatact

SEQ ID NO: 19671 - DNA, 20 bp, Artificial Sequence
  Description of Artificial Sequence: Synthetic oligonucleotide
  Target: FXN; (+) strand; PAM type: NRG; PAM sequence: TGG
cagtcctctgccctttctgc

SEQ ID NO: 19672 - DNA, 20 bp, Artificial Sequence
  Description of Artificial Sequence: Synthetic oligonucleotide
  Target: FXN; (+) strand; PAM type: NRG; PAM sequence: TGG
ctgccctttctgctggattg

SEQ ID NO: 19673 - DNA, 20 bp, Artificial Sequence
  Description of Artificial Sequence: Synthetic oligonucleotide
  Target: FXN; (+) strand; PAM type: NRG; PAM sequence: CAG
tctgctggattgtggccccc

SEQ ID NO: 19674 - DNA, 20 bp, Artificial Sequence
  Description of Artificial Sequence: Synthetic oligonucleotide
  Target: FXN; (+) strand; PAM type: NRG; PAM sequence: TAG
tggattgtggccccccagta

SEQ ID NO: 19675 - DNA, 20 bp, Artificial Sequence
  Description of Artificial Sequence: Synthetic oligonucleotide
  Target: FXN; (+) strand; PAM type: NRG; PAM sequence: AGG
ggattgtggccccccagtat

SEQ ID NO: 19676 - DNA, 20 bp, Artificial Sequence
  Description of Artificial Sequence: Synthetic oligonucleotide
  Target: FXN; (+) strand; PAM type: NRG; PAM sequence: GGG
gattgtggccccccagtata

SEQ ID NO: 19677 - DNA, 20 bp, Artificial Sequence
  Description of Artificial Sequence: Synthetic oligonucleotide
  Target: FXN; (+) strand; PAM type: NRG; PAM sequence: TGG
tatagggtgcaacacacaac

SEQ ID NO: 19678 - DNA, 20 bp, Artificial Sequence
  Description of Artificial Sequence: Synthetic oligonucleotide
  Target: FXN; (+) strand; PAM type: NRG; PAM sequence: GAG
tagggtgcaacacacaactg

SEQ ID NO: 19679 - DNA, 20 bp, Artificial Sequence
  Description of Artificial Sequence: Synthetic oligonucleotide
  Target: FXN; (+) strand; PAM type: NRG; PAM sequence: AAG
aacacacaactggagcattt

SEQ ID NO: 19680 - DNA, 20 bp, Artificial Sequence
  Description of Artificial Sequence: Synthetic oligonucleotide
  Target: FXN; (+) strand; PAM type: NRG; PAM sequence: AGG
acacacaactggagcattta

SEQ ID NO: 19681 - DNA, 20 bp, Artificial Sequence
  Description of Artificial Sequence: Synthetic oligonucleotide
  Target: FXN; (+) strand; PAM type: NRG; PAM sequence: GGG
cacacaactggagcatttaa

SEQ ID NO: 19682 - DNA, 20 bp, Artificial Sequence
  Description of Artificial Sequence: Synthetic oligonucleotide
  Target: FXN; (+) strand; PAM type: NRG; PAM sequence: AAG
tggagcatttaagggccaca

SEQ ID NO: 19683 - DNA, 20 bp, Artificial Sequence
  Description of Artificial Sequence: Synthetic oligonucleotide
  Target: FXN; (+) strand; PAM type: NRG; PAM sequence: GAG
gagcatttaagggccacaaa

SEQ ID NO: 19684 - DNA, 20 bp, Artificial Sequence
  Description of Artificial Sequence: Synthetic oligonucleotide
  Target: FXN; (+) strand; PAM type: NRG; PAM sequence: GAG
tgattgtgtgttgattcttt

SEQ ID NO: 19685 - DNA, 20 bp, Artificial Sequence
  Description of Artificial Sequence: Synthetic oligonucleotide
  Target: FXN; (+) strand; PAM type: NRG; PAM sequence: AAG
tttttttattattatacttt

SEQ ID NO: 19686 - DNA, 20 bp, Artificial Sequence
  Description of Artificial Sequence: Synthetic oligonucleotide
  Target: FXN; (+) strand; PAM type: NRG; PAM sequence: TAG
tattattatactttaagtgt

SEQ ID NO: 19687 - DNA, 20 bp, Artificial Sequence
  Description of Artificial Sequence: Synthetic oligonucleotide
  Target: FXN; (+) strand; PAM type: NRG; PAM sequence: AGG
attattatactttaagtgtt

SEQ ID NO: 19688 - DNA, 20 bp, Artificial Sequence
  Description of Artificial Sequence: Synthetic oligonucleotide
  Target: FXN; (+) strand; PAM type: NRG; PAM sequence: GGG
ttattatactttaagtgtta

SEQ ID NO: 19689 - DNA, 20 bp, Artificial Sequence
  Description of Artificial Sequence: Synthetic oligonucleotide
  Target: FXN; (+) strand; PAM type: NRG; PAM sequence: CAG
gggtacatgtgcacaatgtg

SEQ ID NO: 19690 - DNA, 20 bp, Artificial Sequence
  Description of Artificial Sequence: Synthetic oligonucleotide
  Target: FXN; (+) strand; PAM type: NRG; PAM sequence: AGG
ggtacatgtgcacaatgtgc

SEQ ID NO: 19691 - DNA, 20 bp, Artificial Sequence
  Description of Artificial Sequence: Synthetic oligonucleotide
  Target: FXN; (+) strand; PAM type: NRG; PAM sequence: TAG
catgtgcacaatgtgcaggt

SEQ ID NO: 19692 - DNA, 20 bp, Artificial Sequence
  Description of Artificial Sequence: Synthetic oligonucleotide
  Target: FXN; (+) strand; PAM type: NRG; PAM sequence: TGG
tatgtatacatgtgccatgc

SEQ ID NO: 19693 - DNA, 20 bp, Artificial Sequence
  Description of Artificial Sequence: Synthetic oligonucleotide
  Target: FXN; (+) strand; PAM type: NRG; PAM sequence: TAG
gcacccattaactcgtcatt

SEQ ID NO: 19694 - DNA, 20 bp, Artificial Sequence
  Description of Artificial Sequence: Synthetic oligonucleotide
  Target: FXN; (+) strand; PAM type: NRG; PAM sequence: TAG
attaactcgtcatttagcat

SEQ ID NO: 19695 - DNA, 20 bp, Artificial Sequence
  Description of Artificial Sequence: Synthetic oligonucleotide
  Target: FXN; (+) strand; PAM type: NRG; PAM sequence: AGG
ttaactcgtcatttagcatt

SEQ ID NO: 19696 - DNA, 20 bp, Artificial Sequence
  Description of Artificial Sequence: Synthetic oligonucleotide
  Target: FXN; (+) strand; PAM type: NRG; PAM sequence: TAG
tcgtcatttagcattaggta

SEQ ID NO: 19697 - DNA, 20 bp, Artificial Sequence
  Description of Artificial Sequence: Synthetic oligonucleotide
  Target: FXN; (+) strand; PAM type: NRG; PAM sequence: AAG
agcattaggtatagctccta

SEQ ID NO: 19698 - DNA, 20 bp, Artificial Sequence
  Description of Artificial Sequence: Synthetic oligonucleotide
  Target: FXN; (+) strand; PAM type: NRG; PAM sequence: CAG
cccctccctccaccccacaa

SEQ ID NO: 19699 - DNA, 20 bp, Artificial Sequence
  Description of Artificial Sequence: Synthetic oligonucleotide
  Target: FXN; (+) strand; PAM type: NRG; PAM sequence: CAG
ctccaccccacaacagtccc

SEQ ID NO: 19700 - DNA, 20 bp, Artificial Sequence
  Description of Artificial Sequence: Synthetic oligonucleotide
  Target: FXN; (+) strand; PAM type: NRG; PAM sequence: GAG
ccaccccacaacagtcccca

SEQ ID NO: 19701 - DNA, 20 bp, Artificial Sequence
  Description of Artificial Sequence: Synthetic oligonucleotide
  Target: FXN; (+) strand; PAM type: NRG; PAM sequence: CAG
gaccatgtgttctcattgtt

SEQ ID NO: 19702 - DNA, 20 bp, Artificial Sequence
  Description of Artificial Sequence: Synthetic oligonucleotide
  Target: FXN; (+) strand; PAM type: NRG; PAM sequence: GAG
attgttcagttcccacctat

SEQ ID NO: 19703 - DNA, 20 bp, Artificial Sequence
  Description of Artificial Sequence: Synthetic oligonucleotide
  Target: FXN; (+) strand; PAM type: NRG; PAM sequence: GAG
ttcagttcccacctatgagt

SEQ ID NO: 19704 - DNA, 20 bp, Artificial Sequence
  Description of Artificial Sequence: Synthetic oligonucleotide
  Target: FXN; (+) strand; PAM type: NRG; PAM sequence: CAG
cacctatgagtgagaatatg

SEQ ID NO: 19705 - DNA, 20 bp, Artificial Sequence
  Description of Artificial Sequence: Synthetic oligonucleotide
  Target: FXN; (+) strand; PAM type: NRG; PAM sequence: TAG
ttgattttttgttcttgcga

SEQ ID NO: 19706 - DNA, 20 bp, Artificial Sequence
  Description of Artificial Sequence: Synthetic oligonucleotide
  Target: FXN; (+) strand; PAM type: NRG; PAM sequence: GAG
tgttcttgcgatagtttact

SEQ ID NO: 19707 - DNA, 20 bp, Artificial Sequence
  Description of Artificial Sequence: Synthetic oligonucleotide
  Target: FXN; (+) strand; PAM type: NRG; PAM sequence: CAG
ttactgagaatgatgatttc

SEQ ID NO: 19708 - DNA, 20 bp, Artificial Sequence
  Description of Artificial Sequence: Synthetic oligonucleotide
  Target: FXN; (+) strand; PAM type: NRG; PAM sequence: AAG
gtttcatccatgtccctaca

SEQ ID NO: 19709 - DNA, 20 bp, Artificial Sequence
  Description of Artificial Sequence: Synthetic oligonucleotide
  Target: FXN; (+) strand; PAM type: NRG; PAM sequence: AGG
tttcatccatgtccctacaa

SEQ ID NO: 19710 - DNA, 20 bp, Artificial Sequence
  Description of Artificial Sequence: Synthetic oligonucleotide
  Target: FXN; (+) strand; PAM type: NRG; PAM sequence: TAG
catcattttttattgctgca

SEQ ID NO: 19711 - DNA, 20 bp, Artificial Sequence
  Description of Artificial Sequence: Synthetic oligonucleotide
  Target: FXN; (+) strand; PAM type: NRG; PAM sequence: TGG
tattgctgcatagtattcca

SEQ ID NO: 19712 - DNA, 20 bp, Artificial Sequence
  Description of Artificial Sequence: Synthetic oligonucleotide
  Target: FXN; (+) strand; PAM type: NRG; PAM sequence: CAG
tgtgccacattttcttaatc

SEQ ID NO: 19713 - DNA, 20 bp, Artificial Sequence
  Description of Artificial Sequence: Synthetic oligonucleotide
  Target: FXN; (+) strand; PAM type: NRG; PAM sequence: TGG
ttaatccagtctatcattgt

SEQ ID NO: 19714 - DNA, 20 bp, Artificial Sequence
  Description of Artificial Sequence: Synthetic oligonucleotide
  Target: FXN; (+) strand; PAM type: NRG; PAM sequence: GAG
ccagtctatcattgttggat

SEQ ID NO: 19715 - DNA, 20 bp, Artificial Sequence
  Description of Artificial Sequence: Synthetic oligonucleotide
  Target: FXN; (+) strand; PAM type: NRG; PAM sequence: TGG
tggatgagctctttatctca

SEQ ID NO: 19716 - DNA, 20 bp, Artificial Sequence
  Description of Artificial Sequence: Synthetic oligonucleotide
  Target: FXN; (+) strand; PAM type: NRG; PAM sequence: GAG
taatttataaaactctgtat

SEQ ID NO: 19717 - DNA, 20 bp, Artificial Sequence
  Description of Artificial Sequence: Synthetic oligonucleotide
  Target: FXN; (+) strand; PAM type: NRG; PAM sequence: GAG
atttataaaactctgtatga

SEQ ID NO: 19718 - DNA, 20 bp, Artificial Sequence
  Description of Artificial Sequence: Synthetic oligonucleotide
  Target: FXN; (+) strand; PAM type: NRG; PAM sequence: AGG
tttataaaactctgtatgag

SEQ ID NO: 19719 - DNA, 20 bp, Artificial Sequence
  Description of Artificial Sequence: Synthetic oligonucleotide
  Target: FXN; (+) strand; PAM type: NRG; PAM sequence: GAG
tataaaactctgtatgagag

SEQ ID NO: 19720 - DNA, 20 bp, Artificial Sequence
  Description of Artificial Sequence: Synthetic oligonucleotide
  Target: FXN; (+) strand; PAM type: NRG; PAM sequence: TGG
aaaactctgtatgagaggag

SEQ ID NO: 19721 - DNA, 20 bp, Artificial Sequence
  Description of Artificial Sequence: Synthetic oligonucleotide
  Target: FXN; (+) strand; PAM type: NRG; PAM sequence: GGG
aaactctgtatgagaggagt

SEQ ID NO: 19722 - DNA, 20 bp, Artificial Sequence
  Description of Artificial Sequence: Synthetic oligonucleotide
  Target: FXN; (+) strand; PAM type: NRG; PAM sequence: TAG
tgtatgagaggagtgggaaa

SEQ ID NO: 19723 - DNA, 20 bp, Artificial Sequence
  Description of Artificial Sequence: Synthetic oligonucleotide
  Target: FXN; (+) strand; PAM type: NRG; PAM sequence: CGG
ggagtgggaaatagtattaa

SEQ ID NO: 19724 - DNA, 20 bp, Artificial Sequence
  Description of Artificial Sequence: Synthetic oligonucleotide
  Target: FXN; (+) strand; PAM type: NRG; PAM sequence: GGG
gagtgggaaatagtattaac

SEQ ID NO: 19725 - DNA, 20 bp, Artificial Sequence
  Description of Artificial Sequence: Synthetic oligonucleotide
  Target: FXN; (+) strand; PAM type: NRG; PAM sequence: CGG
ggaaatagtattaacgggtg

SEQ ID NO: 19726 - DNA, 20 bp, Artificial Sequence
  Description of Artificial Sequence: Synthetic oligonucleotide
  Target: FXN; (+) strand; PAM type: NRG; PAM sequence: GGG
gaaatagtattaacgggtgc

SEQ ID NO: 19727 - DNA, 20 bp, Artificial Sequence
  Description of Artificial Sequence: Synthetic oligonucleotide
  Target: FXN; (+) strand; PAM type: NRG; PAM sequence: GGG
aaatagtattaacgggtgcg

SEQ ID NO: 19728 - DNA, 20 bp, Artificial Sequence
  Description of Artificial Sequence: Synthetic oligonucleotide
  Target: FXN; (+) strand; PAM type: NRG; PAM sequence: TGG
acgggtgcggggtttctttt

SEQ ID NO: 19729 - DNA, 20 bp, Artificial Sequence
  Description of Artificial Sequence: Synthetic oligonucleotide
  Target: FXN; (+) strand; PAM type: NRG; PAM sequence: GGG
cgggtgcggggtttcttttt

SEQ ID NO: 19730 - DNA, 20 bp, Artificial Sequence
  Description of Artificial Sequence: Synthetic oligonucleotide
  Target: FXN; (+) strand; PAM type: NRG; PAM sequence: TGG
ggggtttctttttgggacaa

SEQ ID NO: 19731 - DNA, 20 bp, Artificial Sequence
  Description of Artificial Sequence: Synthetic oligonucleotide
  Target: FXN; (+) strand; PAM type: NRG; PAM sequence: TAG
tctttttgggacaatggaaa

SEQ ID NO: 19732 - DNA, 20 bp, Artificial Sequence
  Description of Artificial Sequence: Synthetic oligonucleotide
  Target: FXN; (+) strand; PAM type: NRG; PAM sequence: TGG
tttgggacaatggaaatagc

SEQ ID NO: 19733 - DNA, 20 bp, Artificial Sequence
  Description of Artificial Sequence: Synthetic oligonucleotide
  Target: FXN; (+) strand; PAM type: NRG; PAM sequence: TAG
acaatggaaatagctggaat

SEQ ID NO: 19734 - DNA, 20 bp, Artificial Sequence
  Description of Artificial Sequence: Synthetic oligonucleotide
  Target: FXN; (+) strand; PAM type: NRG; PAM sequence: TAG
tggaaatagctggaattaga

SEQ ID NO: 19735 - DNA, 20 bp, Artificial Sequence
  Description of Artificial Sequence: Synthetic oligonucleotide
  Target: FXN; (+) strand; PAM type: NRG; PAM sequence: TGG
aaatagctggaattagatag

SEQ ID NO: 19736 - DNA, 20 bp, Artificial Sequence
  Description of Artificial Sequence: Synthetic oligonucleotide
  Target: FXN; (+) strand; PAM type: NRG; PAM sequence: CAG
ctaaaaactcctgaattata

SEQ ID NO: 19737 - DNA, 20 bp, Artificial Sequence
  Description of Artificial Sequence: Synthetic oligonucleotide
  Target: FXN; (+) strand; PAM type: NRG; PAM sequence: AAG
ctcctgaattatacagtttt

SEQ ID NO: 19738 - DNA, 20 bp, Artificial Sequence
  Description of Artificial Sequence: Synthetic oligonucleotide
  Target: FXN; (+) strand; PAM type: NRG; PAM sequence: GAG
acttttatttatttgttttt

SEQ ID NO: 19739 - DNA, 20 bp, Artificial Sequence
  Description of Artificial Sequence: Synthetic oligonucleotide
  Target: FXN; (+) strand; PAM type: NRG; PAM sequence: GAG
ttttatttatttgtttttga

SEQ ID NO: 19740 - DNA, 20 bp, Artificial Sequence
  Description of Artificial Sequence: Synthetic oligonucleotide
  Target: FXN; (+) strand; PAM type: NRG; PAM sequence: AAG
tatttatttgtttttgagag

SEQ ID NO: 19741 - DNA, 20 bp, Artificial Sequence
  Description of Artificial Sequence: Synthetic oligonucleotide
  Target: FXN; (+) strand; PAM type: NRG; PAM sequence: CAG
gagaagttctctgtgtcacc

SEQ ID NO: 19742 - DNA, 20 bp, Artificial Sequence
  Description of Artificial Sequence: Synthetic oligonucleotide
  Target: FXN; (+) strand; PAM type: NRG; PAM sequence: AGG
agaagttctctgtgtcaccc

SEQ ID NO: 19743 - DNA, 20 bp, Artificial Sequence
  Description of Artificial Sequence: Synthetic oligonucleotide
  Target: FXN; (+) strand; PAM type: NRG; PAM sequence: AAG
tctctgtgtcacccaggctg

SEQ ID NO: 19744 - DNA, 20 bp, Artificial Sequence
  Description of Artificial Sequence: Synthetic oligonucleotide
  Target: FXN; (+) strand; PAM type: NRG; PAM sequence: TGG
gtgtcacccaggctgaagtg

SEQ ID NO: 19745 - DNA, 20 bp, Artificial Sequence
  Description of Artificial Sequence: Synthetic oligonucleotide
  Target: FXN; (+) strand; PAM type: NRG; PAM sequence: TGG
tcacccaggctgaagtgtgg

SEQ ID NO: 19746 - DNA, 20 bp, Artificial Sequence
  Description of Artificial Sequence: Synthetic oligonucleotide
  Target: FXN; (+) strand; PAM type: NRG; PAM sequence: CGG
aagtgtggtggcgtgatcac

SEQ ID NO: 19747 - DNA, 20 bp, Artificial Sequence
  Description of Artificial Sequence: Synthetic oligonucleotide
  Target: FXN; (+) strand; PAM type: NRG; PAM sequence: CAG
ggcgtgatcaccggttattg

SEQ ID NO: 19748 - DNA, 20 bp, Artificial Sequence
  Description of Artificial Sequence: Synthetic oligonucleotide
  Target: FXN; (+) strand; PAM type: NRG; PAM sequence: GAG
ttattgcagcctcaatctct

SEQ ID NO: 19749 - DNA, 20 bp, Artificial Sequence
  Description of Artificial Sequence: Synthetic oligonucleotide
  Target: FXN; (+) strand; PAM type: NRG; PAM sequence: AGG
tattgcagcctcaatctctg

SEQ ID NO: 19750 - DNA, 20 bp, Artificial Sequence
  Description of Artificial Sequence: Synthetic oligonucleotide
  Target: FXN; (+) strand; PAM type: NRG; PAM sequence: AAG
agcctcaatctctgaggctc

SEQ ID NO: 19751 - DNA, 20 bp, Artificial Sequence
  Description of Artificial Sequence: Synthetic oligonucleotide
  Target: FXN; (+) strand; PAM type: NRG; PAM sequence: CAG
ctcaagcgattctcccacct

SEQ ID NO: 19752 - DNA, 20 bp, Artificial Sequence
  Description of Artificial Sequence: Synthetic oligonucleotide
  Target: FXN; (+) strand; PAM type: NRG; PAM sequence: AAG
ttctcccacctcagcctacc

SEQ ID NO: 19753 - DNA, 20 bp, Artificial Sequence
  Description of Artificial Sequence: Synthetic oligonucleotide
  Target: FXN; (+) strand; PAM type: NRG; PAM sequence: TAG
tcccacctcagcctaccaag

SEQ ID NO: 19754 - DNA, 20 bp, Artificial Sequence
  Description of Artificial Sequence: Synthetic oligonucleotide
  Target: FXN; (+) strand; PAM type: NRG; PAM sequence: TAG
ctaccaagtagatgtgacta

SEQ ID NO: 19755 - DNA, 20 bp, Artificial Sequence
  Description of Artificial Sequence: Synthetic oligonucleotide
  Target: FXN; (+) strand; PAM type: NRG; PAM sequence: AGG
taccaagtagatgtgactat

SEQ ID NO: 19756 - DNA, 20 bp, Artificial Sequence
  Description of Artificial Sequence: Synthetic oligonucleotide
  Target: FXN; (+) strand; PAM type: NRG; PAM sequence: CAG
taggtgcgcaccaccacacc

SEQ ID NO: 19757 - DNA, 20 bp, Artificial Sequence
  Description of Artificial Sequence: Synthetic oligonucleotide
  Target: FXN; (+) strand; PAM type: NRG; PAM sequence: AAG
ttgtaattttttgtaaaaac

SEQ ID NO: 19758 - DNA, 20 bp, Artificial Sequence
  Description of Artificial Sequence: Synthetic oligonucleotide
  Target: FXN; (+) strand; PAM type: NRG; PAM sequence: AGG
tgtaattttttgtaaaaaca

SEQ ID NO: 19759 - DNA, 20 bp, Artificial Sequence
  Description of Artificial Sequence: Synthetic oligonucleotide
  Target: FXN; (+) strand; PAM type: NRG; PAM sequence: CAG
caaggttttaccatgttgcc

SEQ ID NO: 19760 - DNA, 20 bp, Artificial Sequence
  Description of Artificial Sequence: Synthetic oligonucleotide
  Target: FXN; (+) strand; PAM type: NRG; PAM sequence: TGG
ttttaccatgttgcccagtc

SEQ ID NO: 19761 - DNA, 20 bp, Artificial Sequence
  Description of Artificial Sequence: Synthetic oligonucleotide
  Target: FXN; (+) strand; PAM type: NRG; PAM sequence: TGG
ccagtctggtcttgaactcc

SEQ ID NO: 19762 - DNA, 20 bp, Artificial Sequence
  Description of Artificial Sequence: Synthetic oligonucleotide
  Target: FXN; (+) strand; PAM type: NRG; PAM sequence: GGG
cagtctggtcttgaactcct

SEQ ID NO: 19763 - DNA, 20 bp, Artificial Sequence
  Description of Artificial Sequence: Synthetic oligonucleotide
  Target: FXN; (+) strand; PAM type: NRG; PAM sequence: AAG
ggtcttgaactcctgggccc

SEQ ID NO: 19764 - DNA, 20 bp, Artificial Sequence
  Description of Artificial Sequence: Synthetic oligonucleotide
  Target: FXN; (+) strand; PAM type: NRG; PAM sequence: TGG
cccaagcgatcctccctcct

SEQ ID NO: 19765 - DNA, 20 bp, Artificial Sequence
  Description of Artificial Sequence: Synthetic oligonucleotide
  Target: FXN; (+) strand; PAM type: NRG; PAM sequence: GGG
ccaagcgatcctccctcctt

SEQ ID NO: 19766 - DNA, 20 bp, Artificial Sequence
  Description of Artificial Sequence: Synthetic oligonucleotide
  Target: FXN; (+) strand; PAM type: NRG; PAM sequence: AAG
cctccctccttgggctcccg

SEQ ID NO: 19767 - DNA, 20 bp, Artificial Sequence
  Description of Artificial Sequence: Synthetic oligonucleotide
  Target: FXN; (+) strand; PAM type: NRG; PAM sequence: CAG
tccttgggctcccgaagtgc

SEQ ID NO: 19768 - DNA, 20 bp, Artificial Sequence
  Description of Artificial Sequence: Synthetic oligonucleotide
  Target: FXN; (+) strand; PAM type: NRG; PAM sequence: AGG
ccttgggctcccgaagtgcc

SEQ ID NO: 19769 - DNA, 20 bp, Artificial Sequence
  Description of Artificial Sequence: Synthetic oligonucleotide
  Target: FXN; (+) strand; PAM type: NRG; PAM sequence: AAG
ctcccgaagtgccaggatac

SEQ ID NO: 19770 - DNA, 20 bp, Artificial Sequence
  Description of Artificial Sequence: Synthetic oligonucleotide
  Target: FXN; (+) strand; PAM type: NRG; PAM sequence: GAG
aagtgccaggatacaagcat

SEQ ID NO: 19771 - DNA, 20 bp, Artificial Sequence
  Description of Artificial Sequence: Synthetic oligonucleotide
  Target: FXN; (+) strand; PAM type: NRG; PAM sequence: CAG
caagcatgagtcaccacatg

SEQ ID NO: 19772 - DNA, 20 bp, Artificial Sequence
  Description of Artificial Sequence: Synthetic oligonucleotide
  Target: FXN; (+) strand; PAM type: NRG; PAM sequence: CAG
tgagtcaccacatgcagcct

SEQ ID NO: 19773 - DNA, 20 bp, Artificial Sequence
  Description of Artificial Sequence: Synthetic oligonucleotide
  Target: FXN; (+) strand; PAM type: NRG; PAM sequence: AAG
ccacatgcagcctcagtttt

SEQ ID NO: 19774 - DNA, 20 bp, Artificial Sequence
  Description of Artificial Sequence: Synthetic oligonucleotide
  Target: FXN; (+) strand; PAM type: NRG; PAM sequence: TAG
acttttaaataaatgaaata

SEQ ID NO: 19775 - DNA, 20 bp, Artificial Sequence
  Description of Artificial Sequence: Synthetic oligonucleotide
  Target: FXN; (+) strand; PAM type: NRG; PAM sequence: CAG
gaaatatagtcataccaaaa

SEQ ID NO: 19776 - DNA, 20 bp, Artificial Sequence
  Description of Artificial Sequence: Synthetic oligonucleotide
  Target: FXN; (+) strand; PAM type: NRG; PAM sequence: TGG
tcataccaaaacagtaaaaa

SEQ ID NO: 19777 - DNA, 20 bp, Artificial Sequence
  Description of Artificial Sequence: Synthetic oligonucleotide
  Target: FXN; (+) strand; PAM type: NRG; PAM sequence: GGG
cataccaaaacagtaaaaat

SEQ ID NO: 19778 - DNA, 20 bp, Artificial Sequence
  Description of Artificial Sequence: Synthetic oligonucleotide
  Target: FXN; (+) strand; PAM type: NRG; PAM sequence: CAG
aaaacagtaaaaatgggttt

SEQ ID NO: 19779 - DNA, 20 bp, Artificial Sequence
  Description of Artificial Sequence: Synthetic oligonucleotide
  Target: FXN; (+) strand; PAM type: NRG; PAM sequence: AGG
aaacagtaaaaatgggtttc

SEQ ID NO: 19780 - DNA, 20 bp, Artificial Sequence
  Description of Artificial Sequence: Synthetic oligonucleotide
  Target: FXN; (+) strand; PAM type: NRG; PAM sequence: CAG
acttacgtattgtataatcc

SEQ ID NO: 19781 - DNA, 20 bp, Artificial Sequence
  Description of Artificial Sequence: Synthetic oligonucleotide
  Target: FXN; (+) strand; PAM type: NRG; PAM sequence: TGG
taaaaaatgctttcaaaaac

SEQ ID NO: 19782 - DNA, 20 bp, Artificial Sequence
  Description of Artificial Sequence: Synthetic oligonucleotide
  Target: FXN; (+) strand; PAM type: NRG; PAM sequence: CAG
aaaatgctttcaaaaactgg

SEQ ID NO: 19783 - DNA, 20 bp, Artificial Sequence
  Description of Artificial Sequence: Synthetic oligonucleotide
  Target: FXN; (+) strand; PAM type: NRG; PAM sequence: AAG
aactggcagtcaactcataa

SEQ ID NO: 19784 - DNA, 20 bp, Artificial Sequence
  Description of Artificial Sequence: Synthetic oligonucleotide
  Target: FXN; (+) strand; PAM type: NRG; PAM sequence: AGG
actggcagtcaactcataaa

SEQ ID NO: 19785 - DNA, 20 bp, Artificial Sequence
  Description of Artificial Sequence: Synthetic oligonucleotide
  Target: FXN; (+) strand; PAM type: NRG; PAM sequence: AAG
tacttatgattccactgatg

SEQ ID NO: 19786 - DNA, 20 bp, Artificial Sequence
  Description of Artificial Sequence: Synthetic oligonucleotide
  Target: FXN; (+) strand; PAM type: NRG; PAM sequence: TAG
ttatgattccactgatgaag

SEQ ID NO: 19787 - DNA, 20 bp, Artificial Sequence
  Description of Artificial Sequence: Synthetic oligonucleotide
  Target: FXN; (+) strand; PAM type: NRG; PAM sequence: AAG
tccactgatgaagtagtcaa

SEQ ID NO: 19788 - DNA, 20 bp, Artificial Sequence
  Description of Artificial Sequence: Synthetic oligonucleotide
  Target: FXN; (+) strand; PAM type: NRG; PAM sequence: TAG
actgatgaagtagtcaaaag

SEQ ID NO: 19789 - DNA, 20 bp, Artificial Sequence
  Description of Artificial Sequence: Synthetic oligonucleotide
  Target: FXN; (+) strand; PAM type: NRG; PAM sequence: CAG
tcaaaagtagtcaaaaatca

SEQ ID NO: 19790 - DNA, 20 bp, Artificial Sequence
  Description of Artificial Sequence: Synthetic oligonucleotide
  Target: FXN; (+) strand; PAM type: NRG; PAM sequence: TAG
ttaaaaaaacatcttttttt

SEQ ID NO: 19791 - DNA, 20 bp, Artificial Sequence
  Description of Artificial Sequence: Synthetic oligonucleotide
  Target: FXN; (+) strand; PAM type: NRG; PAM sequence: TAG
cttttttttagtcaaaatca

SEQ ID NO: 19792 - DNA, 20 bp, Artificial Sequence
  Description of Artificial Sequence: Synthetic oligonucleotide
  Target: FXN; (+) strand; PAM type: NRG; PAM sequence: TAG
tttagtcaaaatcatagaaa

SEQ ID NO: 19793 - DNA, 20 bp, Artificial Sequence
  Description of Artificial Sequence: Synthetic oligonucleotide
  Target: FXN; (+) strand; PAM type: NRG; PAM sequence: AAG
gtcaaaatcatagaaataga

SEQ ID NO: 19794 - DNA, 20 bp, Artificial Sequence
  Description of Artificial Sequence: Synthetic oligonucleotide
  Target: FXN; (+) strand; PAM type: NRG; PAM sequence: TAG
aaaatcatagaaatagaaag

SEQ ID NO: 19795 - DNA, 20 bp, Artificial Sequence
  Description of Artificial Sequence: Synthetic oligonucleotide
  Target: FXN; (+) strand; PAM type: NRG; PAM sequence: CAG
tcatagaaatagaaagtaga

SEQ ID NO: 19796 - DNA, 20 bp, Artificial Sequence
  Description of Artificial Sequence: Synthetic oligonucleotide
  Target: FXN; (+) strand; PAM type: NRG; PAM sequence: AGG
catagaaatagaaagtagac

SEQ ID NO: 19797 - DNA, 20 bp, Artificial Sequence
  Description of Artificial Sequence: Synthetic oligonucleotide
  Target: FXN; (+) strand; PAM type: NRG; PAM sequence: TGG
agaaatagaaagtagacagg

SEQ ID NO: 19798 - DNA, 20 bp, Artificial Sequence
  Description of Artificial Sequence: Synthetic oligonucleotide
  Target: FXN; (+) strand; PAM type: NRG; PAM sequence: AAG
aaagtagacaggtggttact

SEQ ID NO: 19799 - DNA, 20 bp, Artificial Sequence
  Description of Artificial Sequence: Synthetic oligonucleotide
  Target: FXN; (+) strand; PAM type: NRG; PAM sequence: AGG
aagtagacaggtggttacta

SEQ ID NO: 19800 - DNA, 20 bp, Artificial Sequence
  Description of Artificial Sequence: Synthetic oligonucleotide
  Target: FXN; (+) strand; PAM type: NRG; PAM sequence: GGG
agtagacaggtggttactaa

SEQ ID NO: 19801 - DNA, 20 bp, Artificial Sequence
  Description of Artificial Sequence: Synthetic oligonucleotide
  Target: FXN; (+) strand; PAM type: NRG; PAM sequence: TGG
caggtggttactaagggcta

SEQ ID NO: 19802 - DNA, 20 bp, Artificial Sequence
  Description of Artificial Sequence: Synthetic oligonucleotide
  Target: FXN; (+) strand; PAM type: NRG; PAM sequence: GGG
aggtggttactaagggctat

SEQ ID NO: 19803 - DNA, 20 bp, Artificial Sequence
  Description of Artificial Sequence: Synthetic oligonucleotide
  Target: FXN; (+) strand; PAM type: NRG; PAM sequence: TGG
ggttactaagggctatggga

SEQ ID NO: 19804 - DNA, 20 bp, Artificial Sequence
  Description of Artificial Sequence: Synthetic oligonucleotide
  Target: FXN; (+) strand; PAM type: NRG; PAM sequence: GGG
gttactaagggctatgggat

SEQ ID NO: 19805 - DNA, 20 bp, Artificial Sequence
  Description of Artificial Sequence: Synthetic oligonucleotide
  Target: FXN; (+) strand; PAM type: NRG; PAM sequence: GGG
ttactaagggctatgggatg

SEQ ID NO: 19806 - DNA, 20 bp, Artificial Sequence
  Description of Artificial Sequence: Synthetic oligonucleotide
  Target: FXN; (+) strand; PAM type: NRG; PAM sequence: TAG
gggctatgggatggggaaat

SEQ ID NO: 19807 - DNA, 20 bp, Artificial Sequence
  Description of Artificial Sequence: Synthetic oligonucleotide
  Target: FXN; (+) strand; PAM type: NRG; PAM sequence: TGG
atggggaaattagtgtctaa

SEQ ID NO: 19808 - DNA, 20 bp, Artificial Sequence
  Description of Artificial Sequence: Synthetic oligonucleotide
  Target: FXN; (+) strand; PAM type: NRG; PAM sequence: GGG
tggggaaattagtgtctaat

SEQ ID NO: 19809 - DNA, 20 bp, Artificial Sequence
  Description of Artificial Sequence: Synthetic oligonucleotide
  Target: FXN; (+) strand; PAM type: NRG; PAM sequence: TAG
aaattagtgtctaatgggca

SEQ ID NO: 19810 - DNA, 20 bp, Artificial Sequence
  Description of Artificial Sequence: Synthetic oligonucleotide
  Target: FXN; (+) strand; PAM type: NRG; PAM sequence: GAG
attagtgtctaatgggcata

SEQ ID NO: 19811 - DNA, 20 bp, Artificial Sequence
  Description of Artificial Sequence: Synthetic oligonucleotide
  Target: FXN; (+) strand; PAM type: NRG; PAM sequence: CAG
gtctaatgggcatagagttt

SEQ ID NO: 19812 - DNA, 20 bp, Artificial Sequence
  Description of Artificial Sequence: Synthetic oligonucleotide
  Target: FXN; (+) strand; PAM type: NRG; PAM sequence: AAG
gcatagagtttcagtgttac

SEQ ID NO: 19813 - DNA, 20 bp, Artificial Sequence
  Description of Artificial Sequence: Synthetic oligonucleotide
  Target: FXN; (+) strand; PAM type: NRG; PAM sequence: AGG
catagagtttcagtgttaca

SEQ ID NO: 19814 - DNA, 20 bp, Artificial Sequence
  Description of Artificial Sequence: Synthetic oligonucleotide
  Target: FXN; (+) strand; PAM type: NRG; PAM sequence: AAG
tttcagtgttacaaggtgaa

SEQ ID NO: 19815 - DNA, 20 bp, Artificial Sequence
  Description of Artificial Sequence: Synthetic oligonucleotide
  Target: FXN; (+) strand; PAM type: NRG; PAM sequence: TAG
tgttacaaggtgaaaagttc

SEQ ID NO: 19816 - DNA, 20 bp, Artificial Sequence
  Description of Artificial Sequence: Synthetic oligonucleotide
  Target: FXN; (+) strand; PAM type: NRG; PAM sequence: GAG
ttacaaggtgaaaagttcta

SEQ ID NO: 19817 - DNA, 20 bp, Artificial Sequence
  Description of Artificial Sequence: Synthetic oligonucleotide
  Target: FXN; (+) strand; PAM type: NRG; PAM sequence: CAG
agttctagagttatgctgcc

SEQ ID NO: 19818 - DNA, 20 bp, Artificial Sequence
  Description of Artificial Sequence: Synthetic oligonucleotide
  Target: FXN; (+) strand; PAM type: NRG; PAM sequence: CAG
tctagagttatgctgcccag

SEQ ID NO: 19819 - DNA, 20 bp, Artificial Sequence
  Description of Artificial Sequence: Synthetic oligonucleotide
  Target: FXN; (+) strand; PAM type: NRG; PAM sequence: TGG
attgttctgtacacttaaca

SEQ ID NO: 19820 - DNA, 20 bp, Artificial Sequence
  Description of Artificial Sequence: Synthetic oligonucleotide
  Target: FXN; (+) strand; PAM type: NRG; PAM sequence: TGG
tacacttaacatggttaata

SEQ ID NO: 19821 - DNA, 20 bp, Artificial Sequence
  Description of Artificial Sequence: Synthetic oligonucleotide
  Target: FXN; (+) strand; PAM type: NRG; PAM sequence: TAG
catggttaatatggtaaatt

SEQ ID NO: 19822 - DNA, 20 bp, Artificial Sequence
  Description of Artificial Sequence: Synthetic oligonucleotide
  Target: FXN; (+) strand; PAM type: NRG; PAM sequence: TAG
gcgttatgtgctttttacta

SEQ ID NO: 19823 - DNA, 20 bp, Artificial Sequence
  Description of Artificial Sequence: Synthetic oligonucleotide
  Target: FXN; (+) strand; PAM type: NRG; PAM sequence: TGG
aaaattaaaaaaaaaaaaaa

SEQ ID NO: 19824 - DNA, 20 bp, Artificial Sequence
  Description of Artificial Sequence: Synthetic oligonucleotide
  Target: FXN; (+) strand; PAM type: NRG; PAM sequence: GGG
aaattaaaaaaaaaaaaaat

SEQ ID NO: 19825 - DNA, 20 bp, Artificial Sequence
  Description of Artificial Sequence: Synthetic oligonucleotide
  Target: FXN; (+) strand; PAM type: NRG; PAM sequence: GGG
aattaaaaaaaaaaaaaatg

SEQ ID NO: 19826 - DNA, 20 bp, Artificial Sequence
  Description of Artificial Sequence: Synthetic oligonucleotide
  Target: FXN; (+) strand; PAM type: NRG; PAM sequence: GAG
aaaaaaaaaaaaatggggcc

SEQ ID NO: 19827 - DNA, 20 bp, Artificial Sequence
  Description of Artificial Sequence: Synthetic oligonucleotide
  Target: FXN; (+) strand; PAM type: NRG; PAM sequence: CAG
aaaaaaaatggggccgagtg

SEQ ID NO: 19828 - DNA, 20 bp, Artificial Sequence
  Description of Artificial Sequence: Synthetic oligonucleotide
  Target: FXN; (+) strand; PAM type: NRG; PAM sequence: TAG
aaaaatggggccgagtgcag

SEQ ID NO: 19829 - DNA, 20 bp, Artificial Sequence
  Description of Artificial Sequence: Synthetic oligonucleotide
  Target: FXN; (+) strand; PAM type: NRG; PAM sequence: CAG
tcacacctgtaacataatcc

SEQ ID NO: 19830 - DNA, 20 bp, Artificial Sequence
  Description of Artificial Sequence: Synthetic oligonucleotide
  Target: FXN; (+) strand; PAM type: NRG; PAM sequence: TGG
gtaacataatcccagcactt

SEQ ID NO: 19831 - DNA, 20 bp, Artificial Sequence
  Description of Artificial Sequence: Synthetic oligonucleotide
  Target: FXN; (+) strand; PAM type: NRG; PAM sequence: GGG
taacataatcccagcacttt

SEQ ID NO: 19832 - DNA, 20 bp, Artificial Sequence
  Description of Artificial Sequence: Synthetic oligonucleotide
  Target: FXN; (+) strand; PAM type: NRG; PAM sequence: GAG
acataatcccagcactttgg

SEQ ID NO: 19833 - DNA, 20 bp, Artificial Sequence
  Description of Artificial Sequence: Synthetic oligonucleotide
  Target: FXN; (+) strand; PAM type: NRG; PAM sequence: AGG
cataatcccagcactttggg

SEQ ID NO: 19834 - DNA, 20 bp, Artificial Sequence
  Description of Artificial Sequence: Synthetic oligonucleotide
  Target: FXN; (+) strand; PAM type: NRG; PAM sequence: GAG
tcccagcactttgggaggcc

SEQ ID NO: 19835 - DNA, 20 bp, Artificial Sequence
  Description of Artificial Sequence: Synthetic oligonucleotide
  Target: FXN; (+) strand; PAM type: NRG; PAM sequence: AGG
cccagcactttgggaggccg

SEQ ID NO: 19836 - DNA, 20 bp, Artificial Sequence
  Description of Artificial Sequence: Synthetic oligonucleotide
  Target: FXN; (+) strand; PAM type: NRG; PAM sequence: TAG
agcactttgggaggccgagg

SEQ ID NO: 19837 - DNA, 20 bp, Artificial Sequence
  Description of Artificial Sequence: Synthetic oligonucleotide
  Target: FXN; (+) strand; PAM type: NRG; PAM sequence: AGG
gcactttgggaggccgaggt

SEQ ID NO: 19838 - DNA, 20 bp, Artificial Sequence
  Description of Artificial Sequence: Synthetic oligonucleotide
  Target: FXN; (+) strand; PAM type: NRG; PAM sequence: GAG
actttgggaggccgaggtag

SEQ ID NO: 19839 - DNA, 20 bp, Artificial Sequence
  Description of Artificial Sequence: Synthetic oligonucleotide
  Target: FXN; (+) strand; PAM type: NRG; PAM sequence: AGG
ctttgggaggccgaggtagg

SEQ ID NO: 19840 - DNA, 20 bp, Artificial Sequence
  Description of Artificial Sequence: Synthetic oligonucleotide
  Target: FXN; (+) strand; PAM type: NRG; PAM sequence: GAG
ccgaggtaggaggatcactt

SEQ ID NO: 19841 - DNA, 20 bp, Artificial Sequence
  Description of Artificial Sequence: Synthetic oligonucleotide
  Target: FXN; (+) strand; PAM type: NRG; PAM sequence: AGG
cgaggtaggaggatcacttg

SEQ ID NO: 19842 - DNA, 20 bp, Artificial Sequence
  Description of Artificial Sequence: Synthetic oligonucleotide
  Target: FXN; (+) strand; PAM type: NRG; PAM sequence: CAG
gtaggaggatcacttgaggc

SEQ ID NO: 19843 - DNA, 20 bp, Artificial Sequence
  Description of Artificial Sequence: Synthetic oligonucleotide
  Target: FXN; (+) strand; PAM type: NRG; PAM sequence: AAG
ggaggatcacttgaggccag

SEQ ID NO: 19844 - DNA, 20 bp, Artificial Sequence
  Description of Artificial Sequence: Synthetic oligonucleotide
  Target: FXN; (+) strand; PAM type: NRG; PAM sequence: CAG
tgaggccagaagtttgaaac

SEQ ID NO: 19845 - DNA, 20 bp, Artificial Sequence
  Description of Artificial Sequence: Synthetic oligonucleotide
  Target: FXN; (+) strand; PAM type: NRG; PAM sequence: TGG
ccagaagtttgaaaccagcc

SEQ ID NO: 19846 - DNA, 20 bp, Artificial Sequence
  Description of Artificial Sequence: Synthetic oligonucleotide
  Target: FXN; (+) strand; PAM type: NRG; PAM sequence: TAG
tgaaaccagcctggtcaata

SEQ ID NO: 19847 - DNA, 20 bp, Artificial Sequence
  Description of Artificial Sequence: Synthetic oligonucleotide
  Target: FXN; (+) strand; PAM type: NRG; PAM sequence: GAG
accagcctggtcaatatagc

SEQ ID NO: 19848 - DNA, 20 bp, Artificial Sequence
  Description of Artificial Sequence: Synthetic oligonucleotide
  Target: FXN; (+) strand; PAM type: NRG; PAM sequence: AAG
gcgagacctcatctctacaa

SEQ ID NO: 19849 - DNA, 20 bp, Artificial Sequence
  Description of Artificial Sequence: Synthetic oligonucleotide
  Target: FXN; (+) strand; PAM type: NRG; PAM sequence: TAG
caaaagaaaaatgttaaaat

SEQ ID NO: 19850 - DNA, 20 bp, Artificial Sequence
  Description of Artificial Sequence: Synthetic oligonucleotide
  Target: FXN; (+) strand; PAM type: NRG; PAM sequence: CAG
agaaaaatgttaaaattaga

SEQ ID NO: 19851 - DNA, 20 bp, Artificial Sequence
  Description of Artificial Sequence: Synthetic oligonucleotide
  Target: FXN; (+) strand; PAM type: NRG; PAM sequence: AGG
gaaaaatgttaaaattagac

SEQ ID NO: 19852 - DNA, 20 bp, Artificial Sequence
  Description of Artificial Sequence: Synthetic oligonucleotide
  Target: FXN; (+) strand; PAM type: NRG; PAM sequence: TGG
atgttaaaattagacaggtg

SEQ ID NO: 19853 - DNA, 20 bp, Artificial Sequence
  Description of Artificial Sequence: Synthetic oligonucleotide
  Target: FXN; (+) strand; PAM type: NRG; PAM sequence: TAG
ttagacaggtgtggtgtctg

SEQ ID NO: 19854 - DNA, 20 bp, Artificial Sequence
  Description of Artificial Sequence: Synthetic oligonucleotide
  Target: FXN; (+) strand; PAM type: NRG; PAM sequence: CAG
aggtgtggtgtctgtagtcc

SEQ ID NO: 19855 - DNA, 20 bp, Artificial Sequence
  Description of Artificial Sequence: Synthetic oligonucleotide
  Target: FXN; (+) strand; PAM type: NRG; PAM sequence: TGG
tgtctgtagtcccagctctc

SEQ ID NO: 19856 - DNA, 20 bp, Artificial Sequence
  Description of Artificial Sequence: Synthetic oligonucleotide
  Target: FXN; (+) strand; PAM type: NRG; PAM sequence: GAG
tctgtagtcccagctctctg

SEQ ID NO: 19857 - DNA, 20 bp, Artificial Sequence
  Description of Artificial Sequence: Synthetic oligonucleotide
  Target: FXN; (+) strand; PAM type: NRG; PAM sequence: AGG
ctgtagtcccagctctctgg

SEQ ID NO: 19858 - DNA, 20 bp, Artificial Sequence
  Description of Artificial Sequence: Synthetic oligonucleotide
  Target: FXN; (+) strand; PAM type: NRG; PAM sequence: CAG
tagtcccagctctctggagg

SEQ ID NO: 19859 - DNA, 20 bp, Artificial Sequence
  Description of Artificial Sequence: Synthetic oligonucleotide
  Target: FXN; (+) strand; PAM type: NRG; PAM sequence: AGG
agtcccagctctctggaggc

SEQ ID NO: 19860 - DNA, 20 bp, Artificial Sequence
  Description of Artificial Sequence: Synthetic oligonucleotide
  Target: FXN; (+) strand; PAM type: NRG; PAM sequence: GGG
gtcccagctctctggaggca

SEQ ID NO: 19861 - DNA, 20 bp, Artificial Sequence
  Description of Artificial Sequence: Synthetic oligonucleotide
  Target: FXN; (+) strand; PAM type: NRG; PAM sequence: GAG
gctctctggaggcagggact

SEQ ID NO: 19862 - DNA, 20 bp, Artificial Sequence
  Description of Artificial Sequence: Synthetic oligonucleotide
  Target: FXN; (+) strand; PAM type: NRG; PAM sequence: CAG
tctggaggcagggactgagt

SEQ ID NO: 19863 - DNA, 20 bp, Artificial Sequence
  Description of Artificial Sequence: Synthetic oligonucleotide
  Target: FXN; (+) strand; PAM type: NRG; PAM sequence: GAG
tggaggcagggactgagtca

SEQ ID NO: 19864 - DNA, 20 bp, Artificial Sequence
  Description of Artificial Sequence: Synthetic oligonucleotide
  Target: FXN; (+) strand; PAM type: NRG; PAM sequence: AGG
ggaggcagggactgagtcag

SEQ ID NO: 19865 - DNA, 20 bp, Artificial Sequence
  Description of Artificial Sequence: Synthetic oligonucleotide
  Target: FXN; (+) strand; PAM type: NRG; PAM sequence: GAG
actgagtcagaggatcactt

SEQ ID NO: 19866 - DNA, 20 bp, Artificial Sequence
  Description of Artificial Sequence: Synthetic oligonucleotide
  Target: FXN; (+) strand; PAM type: NRG; PAM sequence: TAG
gtcagaggatcacttgagca

SEQ ID NO: 19867 - DNA, 20 bp, Artificial Sequence
  Description of Artificial Sequence: Synthetic oligonucleotide
  Target: FXN; (+) strand; PAM type: NRG; PAM sequence: AGG
tcagaggatcacttgagcat

SEQ ID NO: 19868 - DNA, 20 bp, Artificial Sequence
  Description of Artificial Sequence: Synthetic oligonucleotide
  Target: FXN; (+) strand; PAM type: NRG; PAM sequence: GGG
cagaggatcacttgagcata

SEQ ID NO: 19869 - DNA, 20 bp, Artificial Sequence
  Description of Artificial Sequence: Synthetic oligonucleotide
  Target: FXN; (+) strand; PAM type: NRG; PAM sequence: GGG
agaggatcacttgagcatag

SEQ ID NO: 19870 - DNA, 20 bp, Artificial Sequence
  Description of Artificial Sequence: Synthetic oligonucleotide
  Target: FXN; (+) strand; PAM type: NRG; PAM sequence: GAG
tcacttgagcataggggttt

SEQ ID NO: 19871 - DNA, 20 bp, Artificial Sequence
  Description of Artificial Sequence: Synthetic oligonucleotide
  Target: FXN; (+) strand; PAM type: NRG; PAM sequence: AGG
cacttgagcataggggtttg

SEQ ID NO: 19872 - DNA, 20 bp, Artificial Sequence
  Description of Artificial Sequence: Synthetic oligonucleotide
  Target: FXN; (+) strand; PAM type: NRG; PAM sequence: CAG
agcataggggtttgaggctg

SEQ ID NO: 19873 - DNA, 20 bp, Artificial Sequence
  Description of Artificial Sequence: Synthetic oligonucleotide
  Target: FXN; (+) strand; PAM type: NRG; PAM sequence: GAG
taggggtttgaggctgcagt

SEQ ID NO: 19874 - DNA, 20 bp, Artificial Sequence
  Description of Artificial Sequence: Synthetic oligonucleotide
  Target: FXN; (+) strand; PAM type: NRG; PAM sequence: CAG
ccatgatcctgccactgctg

SEQ ID NO: 19875 - DNA, 20 bp, Artificial Sequence
  Description of Artificial Sequence: Synthetic oligonucleotide
  Target: FXN; (+) strand; PAM type: NRG; PAM sequence: GAG
tcctgccactgctgcagcct

SEQ ID NO: 19876 - DNA, 20 bp, Artificial Sequence
  Description of Artificial Sequence: Synthetic oligonucleotide
  Target: FXN; (+) strand; PAM type: NRG; PAM sequence: CAG
cactgctgcagcctgagcaa

SEQ ID NO: 19877 - DNA, 20 bp, Artificial Sequence
  Description of Artificial Sequence: Synthetic oligonucleotide
  Target: FXN; (+) strand; PAM type: NRG; PAM sequence: GAG
ctgctgcagcctgagcaaca

SEQ ID NO: 19878 - DNA, 20 bp, Artificial Sequence
  Description of Artificial Sequence: Synthetic oligonucleotide
  Target: FXN; (+) strand; PAM type: NRG; PAM sequence: AAG
tgcagcctgagcaacagagc

SEQ ID NO: 19879 - DNA, 20 bp, Artificial Sequence
  Description of Artificial Sequence: Synthetic oligonucleotide
  Target: FXN; (+) strand; PAM type: NRG; PAM sequence: TGG
aaaaacaaacaaacaaaaac

SEQ ID NO: 19880 - DNA, 20 bp, Artificial Sequence
  Description of Artificial Sequence: Synthetic oligonucleotide
  Target: FXN; (+) strand; PAM type: NRG; PAM sequence: CAG
aacaaacaaacaaaaactgg

SEQ ID NO: 19881 - DNA, 20 bp, Artificial Sequence
  Description of Artificial Sequence: Synthetic oligonucleotide
  Target: FXN; (+) strand; PAM type: NRG; PAM sequence: GAG
aaaactggcagctgatacct

SEQ ID NO: 19882 - DNA, 20 bp, Artificial Sequence
  Description of Artificial Sequence: Synthetic oligonucleotide
  Target: FXN; (+) strand; PAM type: NRG; PAM sequence: GAG
aactggcagctgatacctga

SEQ ID NO: 19883 - DNA, 20 bp, Artificial Sequence
  Description of Artificial Sequence: Synthetic oligonucleotide
  Target: FXN; (+) strand; PAM type: NRG; PAM sequence: TGG
gagtgaatatcttttatcgc

SEQ ID NO: 19884 - DNA, 20 bp, Artificial Sequence
  Description of Artificial Sequence: Synthetic oligonucleotide
  Target: FXN; (+) strand; PAM type: NRG; PAM sequence: TGG
tatcttttatcgctggttaa

SEQ ID NO: 19885 - DNA, 20 bp, Artificial Sequence
  Description of Artificial Sequence: Synthetic oligonucleotide
  Target: FXN; (+) strand; PAM type: NRG; PAM sequence: GGG
atcttttatcgctggttaat

SEQ ID NO: 19886 - DNA, 20 bp, Artificial Sequence
  Description of Artificial Sequence: Synthetic oligonucleotide
  Target: FXN; (+) strand; PAM type: NRG; PAM sequence: GAG
tatcgctggttaatgggatt

SEQ ID NO: 19887 - DNA, 20 bp, Artificial Sequence
  Description of Artificial Sequence: Synthetic oligonucleotide
  Target: FXN; (+) strand; PAM type: NRG; PAM sequence: GAG
tcgctggttaatgggattga

SEQ ID NO: 19888 - DNA, 20 bp, Artificial Sequence
  Description of Artificial Sequence: Synthetic oligonucleotide
  Target: FXN; (+) strand; PAM type: NRG; PAM sequence: TAG
tgagagaatgcttcatctta

SEQ ID NO: 19889 - DNA, 20 bp, Artificial Sequence
  Description of Artificial Sequence: Synthetic oligonucleotide
  Target: FXN; (+) strand; PAM type: NRG; PAM sequence: AAG
agaatgcttcatcttataga

SEQ ID NO: 19890 - DNA, 20 bp, Artificial Sequence
  Description of Artificial Sequence: Synthetic oligonucleotide
  Target: FXN; (+) strand; PAM type: NRG; PAM sequence: CAG
gcttcatcttatagaaagaa

SEQ ID NO: 19891 - DNA, 20 bp, Artificial Sequence
  Description of Artificial Sequence: Synthetic oligonucleotide
  Target: FXN; (+) strand; PAM type: NRG; PAM sequence: TGG
tatagaaagaacagtgtctt

SEQ ID NO: 19892 - DNA, 20 bp, Artificial Sequence
  Description of Artificial Sequence: Synthetic oligonucleotide
  Target: FXN; (+) strand; PAM type: NRG; PAM sequence: CAG
gaacagtgtctttggaccca

SEQ ID NO: 19893 - DNA, 20 bp, Artificial Sequence
  Description of Artificial Sequence: Synthetic oligonucleotide
  Target: FXN; (+) strand; PAM type: NRG; PAM sequence: GAG
acagtgtctttggacccaca

SEQ ID NO: 19894 - DNA, 20 bp, Artificial Sequence
  Description of Artificial Sequence: Synthetic oligonucleotide
  Target: FXN; (+) strand; PAM type: NRG; PAM sequence: TGG
tctttggacccacagagacc

SEQ ID NO: 19895 - DNA, 20 bp, Artificial Sequence
  Description of Artificial Sequence: Synthetic oligonucleotide
  Target: FXN; (+) strand; PAM type: NRG; PAM sequence: AAG
acccacagagacctggattt

SEQ ID NO: 19896 - DNA, 20 bp, Artificial Sequence
  Description of Artificial Sequence: Synthetic oligonucleotide
  Target: FXN; (+) strand; PAM type: NRG; PAM sequence: TAG
cagagacctggatttaagat

SEQ ID NO: 19897 - DNA, 20 bp, Artificial Sequence
  Description of Artificial Sequence: Synthetic oligonucleotide
  Target: FXN; (+) strand; PAM type: NRG; PAM sequence: GAG
gattagctctgccaattact

SEQ ID NO: 19898 - DNA, 20 bp, Artificial Sequence
  Description of Artificial Sequence: Synthetic oligonucleotide
  Target: FXN; (+) strand; PAM type: NRG; PAM sequence: TGG
gttttcctcatctgtgaaac

SEQ ID NO: 19899 - DNA, 20 bp, Artificial Sequence
  Description of Artificial Sequence: Synthetic oligonucleotide
  Target: FXN; (+) strand; PAM type: NRG; PAM sequence: TAG
aatcctaccgccaacaattg

SEQ ID NO: 19900 - DNA, 20 bp, Artificial Sequence
  Description of Artificial Sequence: Synthetic oligonucleotide
  Target: FXN; (+) strand; PAM type: NRG; PAM sequence: AAG
taccgccaacaattgtagtc

SEQ ID NO: 19901 - DNA, 20 bp, Artificial Sequence
  Description of Artificial Sequence: Synthetic oligonucleotide
  Target: FXN; (+) strand; PAM type: NRG; PAM sequence: TGG
gccaacaattgtagtcaagt

SEQ ID NO: 19902 - DNA, 20 bp, Artificial Sequence
  Description of Artificial Sequence: Synthetic oligonucleotide
  Target: FXN; (+) strand; PAM type: NRG; PAM sequence: AAG
agttggaaacaatttacaca

SEQ ID NO: 19903 - DNA, 20 bp, Artificial Sequence
  Description of Artificial Sequence: Synthetic oligonucleotide
  Target: FXN; (+) strand; PAM type: NRG; PAM sequence: AAG
tacacaaagtgccaaacacc

SEQ ID NO: 19904 - DNA, 20 bp, Artificial Sequence
  Description of Artificial Sequence: Synthetic oligonucleotide
  Target: FXN; (+) strand; PAM type: NRG; PAM sequence: TGG
aaagtgccaaacaccaagcc

SEQ ID NO: 19905 - DNA, 20 bp, Artificial Sequence
  Description of Artificial Sequence: Synthetic oligonucleotide
  Target: FXN; (+) strand; PAM type: NRG; PAM sequence: CAG
gccaaacaccaagcctggca

SEQ ID NO: 19906 - DNA, 20 bp, Artificial Sequence
  Description of Artificial Sequence: Synthetic oligonucleotide
  Target: FXN; (+) strand; PAM type: NRG; PAM sequence: TAG
aaacaccaagcctggcacag

SEQ ID NO: 19907 - DNA, 20 bp, Artificial Sequence
  Description of Artificial Sequence: Synthetic oligonucleotide
  Target: FXN; (+) strand; PAM type: NRG; PAM sequence: AGG
aacaccaagcctggcacagt

SEQ ID NO: 19908 - DNA, 20 bp, Artificial Sequence
  Description of Artificial Sequence: Synthetic oligonucleotide
  Target: FXN; (+) strand; PAM type: NRG; PAM sequence: GAG
agcctggcacagtaggaacc

SEQ ID NO: 19909 - DNA, 20 bp, Artificial Sequence
  Description of Artificial Sequence: Synthetic oligonucleotide
  Target: FXN; (+) strand; PAM type: NRG; PAM sequence: TAG
cacagtaggaaccgagtaaa

SEQ ID NO: 19910 - DNA, 20 bp, Artificial Sequence
  Description of Artificial Sequence: Synthetic oligonucleotide
  Target: FXN; (+) strand; PAM type: NRG; PAM sequence: TGG
agtaggaaccgagtaaatag

SEQ ID NO: 19911 - DNA, 20 bp, Artificial Sequence
  Description of Artificial Sequence: Synthetic oligonucleotide
  Target: FXN; (+) strand; PAM type: NRG; PAM sequence: CAG
atagtggttaatatttttat

SEQ ID NO: 19912 - DNA, 20 bp, Artificial Sequence
  Description of Artificial Sequence: Synthetic oligonucleotide
  Target: FXN; (+) strand; PAM type: NRG; PAM sequence: CAG
ctatacatttgtttttgaat

SEQ ID NO: 19913 - DNA, 20 bp, Artificial Sequence
  Description of Artificial Sequence: Synthetic oligonucleotide
  Target: FXN; (+) strand; PAM type: NRG; PAM sequence: AAG
atttgtttttgaatcagaaa

SEQ ID NO: 19914 - DNA, 20 bp, Artificial Sequence
  Description of Artificial Sequence: Synthetic oligonucleotide
  Target: FXN; (+) strand; PAM type: NRG; PAM sequence: CAG
gttattttaaaaaaataacc

SEQ ID NO: 19915 - DNA, 20 bp, Artificial Sequence
  Description of Artificial Sequence: Synthetic oligonucleotide
  Target: FXN; (+) strand; PAM type: NRG; PAM sequence: TAG
attttaaaaaaataacccag

SEQ ID NO: 19916 - DNA, 20 bp, Artificial Sequence
  Description of Artificial Sequence: Synthetic oligonucleotide
  Target: FXN; (+) strand; PAM type: NRG; PAM sequence: CAG
gccccttgtcccattcctat

SEQ ID NO: 19917 - DNA, 20 bp, Artificial Sequence
  Description of Artificial Sequence: Synthetic oligonucleotide
  Target: FXN; (+) strand; PAM type: NRG; PAM sequence: TGG
ttattattgttactaccctc

SEQ ID NO: 19918 - DNA, 20 bp, Artificial Sequence
  Description of Artificial Sequence: Synthetic oligonucleotide
  Target: FXN; (+) strand; PAM type: NRG; PAM sequence: TGG
ttcaataactctttgttttt

SEQ ID NO: 19919 - DNA, 20 bp, Artificial Sequence
  Description of Artificial Sequence: Synthetic oligonucleotide
  Target: FXN; (+) strand; PAM type: NRG; PAM sequence: GGG
tcaataactctttgtttttt

SEQ ID NO: 19920 - DNA, 20 bp, Artificial Sequence
  Description of Artificial Sequence: Synthetic oligonucleotide
  Target: FXN; (+) strand; PAM type: NRG; PAM sequence: GAG
ttttgttttgctttgctttt

SEQ ID NO: 19921 - DNA, 20 bp, Artificial Sequence
  Description of Artificial Sequence: Synthetic oligonucleotide
  Target: FXN; (+) strand; PAM type: NRG; PAM sequence: CAG
gttttgctttgcttttgaga

SEQ ID NO: 19922 - DNA, 20 bp, Artificial Sequence
  Description of Artificial Sequence: Synthetic oligonucleotide
  Target: FXN; (+) strand; PAM type: NRG; PAM sequence: AGG
ttttgctttgcttttgagac

SEQ ID NO: 19923 - DNA, 20 bp, Artificial Sequence
  Description of Artificial Sequence: Synthetic oligonucleotide
  Target: FXN; (+) strand; PAM type: NRG; PAM sequence: CAG
gagacaggatctctgtcgcc

SEQ ID NO: 19924 - DNA, 20 bp, Artificial Sequence
  Description of Artificial Sequence: Synthetic oligonucleotide
  Target: FXN; (+) strand; PAM type: NRG; PAM sequence: TGG
aggatctctgtcgcccagtc

SEQ ID NO: 19925 - DNA, 20 bp, Artificial Sequence
  Description of Artificial Sequence: Synthetic oligonucleotide
  Target: FXN; (+) strand; PAM type: NRG; PAM sequence: TAG
ctgtcgcccagtctggtgtg

SEQ ID NO: 19926 - DNA, 20 bp, Artificial Sequence
  Description of Artificial Sequence: Synthetic oligonucleotide
  Target: FXN; (+) strand; PAM type: NRG; PAM sequence: TGG
tcgcccagtctggtgtgtag

SEQ ID NO: 19927 - DNA, 20 bp, Artificial Sequence
  Description of Artificial Sequence: Synthetic oligonucleotide
  Target: FXN; (+) strand; PAM type: NRG; PAM sequence: CAG
ggtgtgtagtggtgtgatct

SEQ ID NO: 19928 - DNA, 20 bp, Artificial Sequence
  Description of Artificial Sequence: Synthetic oligonucleotide
  Target: FXN; (+) strand; PAM type: NRG; PAM sequence: CAG
ggtgtgatctcagctcactg

SEQ ID NO: 19929 - DNA, 20 bp, Artificial Sequence
  Description of Artificial Sequence: Synthetic oligonucleotide
  Target: FXN; (+) strand; PAM type: NRG; PAM sequence: TGG
tcactgcagcctcaacctcc

SEQ ID NO: 19930 - DNA, 20 bp, Artificial Sequence
  Description of Artificial Sequence: Synthetic oligonucleotide
  Target: FXN; (+) strand; PAM type: NRG; PAM sequence: GGG
cactgcagcctcaacctcct

SEQ ID NO: 19931 - DNA, 20 bp, Artificial Sequence
  Description of Artificial Sequence: Synthetic oligonucleotide
  Target: FXN; (+) strand; PAM type: NRG; PAM sequence: CAG
cagcctcaacctcctgggct

SEQ ID NO: 19932 - DNA, 20 bp, Artificial Sequence
  Description of Artificial Sequence: Synthetic oligonucleotide
  Target: FXN; (+) strand; PAM type: NRG; PAM sequence: AGG
agcctcaacctcctgggctc

SEQ ID NO: 19933 - DNA, 20 bp, Artificial Sequence
  Description of Artificial Sequence: Synthetic oligonucleotide
  Target: FXN; (+) strand; PAM type: NRG; PAM sequence: CAG
ctcaggtgatcctcccactt

SEQ ID NO: 19934 - DNA, 20 bp, Artificial Sequence
  Description of Artificial Sequence: Synthetic oligonucleotide
  Target: FXN; (+) strand; PAM type: NRG; PAM sequence: AAG
tcctcccacttcagcctccc

SEQ ID NO: 19935 - DNA, 20 bp, Artificial Sequence
  Description of Artificial Sequence: Synthetic oligonucleotide
  Target: FXN; (+) strand; PAM type: NRG; PAM sequence: TAG
tcccacttcagcctcccaag

SEQ ID NO: 19936 - DNA, 20 bp, Artificial Sequence
  Description of Artificial Sequence: Synthetic oligonucleotide
  Target: FXN; (+) strand; PAM type: NRG; PAM sequence: TGG
acttcagcctcccaagtagc

SEQ ID NO: 19937 - DNA, 20 bp, Artificial Sequence
  Description of Artificial Sequence: Synthetic oligonucleotide
  Target: FXN; (+) strand; PAM type: NRG; PAM sequence: GGG
cttcagcctcccaagtagct

SEQ ID NO: 19938 - DNA, 20 bp, Artificial Sequence
  Description of Artificial Sequence: Synthetic oligonucleotide
  Target: FXN; (+) strand; PAM type: NRG; PAM sequence: CAG
ctcccaagtagctgggacca

SEQ ID NO: 19939 - DNA, 20 bp, Artificial Sequence
  Description of Artificial Sequence: Synthetic oligonucleotide
  Target: FXN; (+) strand; PAM type: NRG; PAM sequence: AGG
tcccaagtagctgggaccac

SEQ ID NO: 19940 - DNA, 20 bp, Artificial Sequence
  Description of Artificial Sequence: Synthetic oligonucleotide
  Target: FXN; (+) strand; PAM type: NRG; PAM sequence: TGG
caggcgcatgccaccacact

SEQ ID NO: 19941 - DNA, 20 bp, Artificial Sequence
  Description of Artificial Sequence: Synthetic oligonucleotide
  Target: FXN; (+) strand; PAM type: NRG; PAM sequence: TAG
ttggctaatttttgcatttt

SEQ ID NO: 19942 - DNA, 20 bp, Artificial Sequence
  Description of Artificial Sequence: Synthetic oligonucleotide
  Target: FXN; (+) strand; PAM type: NRG; PAM sequence: TAG
gctaatttttgcatttttag

SEQ ID NO: 19943 - DNA, 20 bp, Artificial Sequence
  Description of Artificial Sequence: Synthetic oligonucleotide
  Target: FXN; (+) strand; PAM type: NRG; PAM sequence: GAG
taatttttgcatttttagta

SEQ ID NO: 19944 - DNA, 20 bp, Artificial Sequence
  Description of Artificial Sequence: Synthetic oligonucleotide
  Target: FXN; (+) strand; PAM type: NRG; PAM sequence: CAG
ttttgcatttttagtagaga

SEQ ID NO: 19945 - DNA, 20 bp, Artificial Sequence
  Description of Artificial Sequence: Synthetic oligonucleotide
  Target: FXN; (+) strand; PAM type: NRG; PAM sequence: AGG
tttgcatttttagtagagac

SEQ ID NO: 19946 - DNA, 20 bp, Artificial Sequence
  Description of Artificial Sequence: Synthetic oligonucleotide
  Target: FXN; (+) strand; PAM type: NRG; PAM sequence: GGG
ttgcatttttagtagagaca

SEQ ID NO: 19947 - DNA, 20 bp, Artificial Sequence
  Description of Artificial Sequence: Synthetic oligonucleotide
  Target: FXN; (+) strand; PAM type: NRG; PAM sequence: TAG
cagggttttgccatattgcc

SEQ ID NO: 19948 - DNA, 20 bp, Artificial Sequence
  Description of Artificial Sequence: Synthetic oligonucleotide
  Target: FXN; (+) strand; PAM type: NRG; PAM sequence: AGG
agggttttgccatattgcct

SEQ ID NO: 19949 - DNA, 20 bp, Artificial Sequence
  Description of Artificial Sequence: Synthetic oligonucleotide
  Target: FXN; (+) strand; PAM type: NRG; PAM sequence: CGG
ttttgccatattgcctaggc

SEQ ID NO: 19950 - DNA, 20 bp, Artificial Sequence
  Description of Artificial Sequence: Synthetic oligonucleotide
  Target: FXN; (+) strand; PAM type: NRG; PAM sequence: TGG
ccatattgcctaggccggtc

SEQ ID NO: 19951 - DNA, 20 bp, Artificial Sequence
  Description of Artificial Sequence: Synthetic oligonucleotide
  Target: FXN; (+) strand; PAM type: NRG; PAM sequence: TGG
ctaggccggtctggaacttc

SEQ ID NO: 19952 - DNA, 20 bp, Artificial Sequence
  Description of Artificial Sequence: Synthetic oligonucleotide
  Target: FXN; (+) strand; PAM type: NRG; PAM sequence: GGG
taggccggtctggaacttct

SEQ ID NO: 19953 - DNA, 20 bp, Artificial Sequence
  Description of Artificial Sequence: Synthetic oligonucleotide
  Target: FXN; (+) strand; PAM type: NRG; PAM sequence: AAG
ggtctggaacttctgggctc

SEQ ID NO: 19954 - DNA, 20 bp, Artificial Sequence
  Description of Artificial Sequence: Synthetic oligonucleotide
  Target: FXN; (+) strand; PAM type: NRG; PAM sequence: CGG
ctcaagccatctgcctgcct

SEQ ID NO: 19955 - DNA, 20 bp, Artificial Sequence
  Description of Artificial Sequence: Synthetic oligonucleotide
  Target: FXN; (+) strand; PAM type: NRG; PAM sequence: AAG
ctgcctgcctcggcctccca

SEQ ID NO: 19956 - DNA, 20 bp, Artificial Sequence
  Description of Artificial Sequence: Synthetic oligonucleotide
  Target: FXN; (+) strand; PAM type: NRG; PAM sequence: TGG
gcctcggcctcccaaagtgc

SEQ ID NO: 19957 - DNA, 20 bp, Artificial Sequence
  Description of Artificial Sequence: Synthetic oligonucleotide
  Target: FXN; (+) strand; PAM type: NRG; PAM sequence: CAG
ctcccaaagtgctggaattt

SEQ ID NO: 19958 - DNA, 20 bp, Artificial Sequence
  Description of Artificial Sequence: Synthetic oligonucleotide
  Target: FXN; (+) strand; PAM type: NRG; PAM sequence: AGG
tcccaaagtgctggaatttc

SEQ ID NO: 19959 - DNA, 20 bp, Artificial Sequence
  Description of Artificial Sequence: Synthetic oligonucleotide
  Target: FXN; (+) strand; PAM type: NRG; PAM sequence: GAG
agtgctggaatttcaggcat

SEQ ID NO: 19960 - DNA, 20 bp, Artificial Sequence
  Description of Artificial Sequence: Synthetic oligonucleotide
  Target: FXN; (+) strand; PAM type: NRG; PAM sequence: TGG
tttcaggcatgagccatgcc

SEQ ID NO: 19961 - DNA, 20 bp, Artificial Sequence
  Description of Artificial Sequence: Synthetic oligonucleotide
  Target: FXN; (+) strand; PAM type: NRG; PAM sequence: TAG
tgagccatgcctggcctaaa

SEQ ID NO: 19962 - DNA, 20 bp, Artificial Sequence
  Description of Artificial Sequence: Synthetic oligonucleotide
  Target: FXN; (+) strand; PAM type: NRG; PAM sequence: AAG
atagctctctgtgtttgcaa

SEQ ID NO: 19963 - DNA, 20 bp, Artificial Sequence
  Description of Artificial Sequence: Synthetic oligonucleotide
  Target: FXN; (+) strand; PAM type: NRG; PAM sequence: AAG
tgtttgcaaaagtgtgttat

SEQ ID NO: 19964 - DNA, 20 bp, Artificial Sequence
  Description of Artificial Sequence: Synthetic oligonucleotide
  Target: FXN; (+) strand; PAM type: NRG; PAM sequence: CAG
agtgtgttataagaatcatt

SEQ ID NO: 19965 - DNA, 20 bp, Artificial Sequence
  Description of Artificial Sequence: Synthetic oligonucleotide
  Target: FXN; (+) strand; PAM type: NRG; PAM sequence: GAG
tgtgttataagaatcattca

SEQ ID NO: 19966 - DNA, 20 bp, Artificial Sequence
  Description of Artificial Sequence: Synthetic oligonucleotide
  Target: FXN; (+) strand; PAM type: NRG; PAM sequence: TGG
atcattcagagcctctcgat

SEQ ID NO: 19967 - DNA, 20 bp, Artificial Sequence
  Description of Artificial Sequence: Synthetic oligonucleotide
  Target: FXN; (+) strand; PAM type: NRG; PAM sequence: TGG
ttcagagcctctcgattgga

SEQ ID NO: 19968 - DNA, 20 bp, Artificial Sequence
  Description of Artificial Sequence: Synthetic oligonucleotide
  Target: FXN; (+) strand; PAM type: NRG; PAM sequence: GAG
cagagcctctcgattggatg

SEQ ID NO: 19969 - DNA, 20 bp, Artificial Sequence
  Description of Artificial Sequence: Synthetic oligonucleotide
  Target: FXN; (+) strand; PAM type: NRG; PAM sequence: AGG
agagcctctcgattggatgg

SEQ ID NO: 19970 - DNA, 20 bp, Artificial Sequence
  Description of Artificial Sequence: Synthetic oligonucleotide
  Target: FXN; (+) strand; PAM type: NRG; PAM sequence: TAG
tctcgattggatggaggctc

SEQ ID NO: 19971 - DNA, 20 bp, Artificial Sequence
  Description of Artificial Sequence: Synthetic oligonucleotide
  Target: FXN; (+) strand; PAM type: NRG; PAM sequence: CAG
gatggaggctctagaatgca

SEQ ID NO: 19972 - DNA, 20 bp, Artificial Sequence
  Description of Artificial Sequence: Synthetic oligonucleotide
  Target: FXN; (+) strand; PAM type: NRG; PAM sequence: AAG
ggctctagaatgcacagaaa

SEQ ID NO: 19973 - DNA, 20 bp, Artificial Sequence
  Description of Artificial Sequence: Synthetic oligonucleotide
  Target: FXN; (+) strand; PAM type: NRG; PAM sequence: AGG
gctctagaatgcacagaaaa

SEQ ID NO: 19974 - DNA, 20 bp, Artificial Sequence
  Description of Artificial Sequence: Synthetic oligonucleotide
  Target: FXN; (+) strand; PAM type: NRG; PAM sequence: AAG
ctgccaccgtgtatctctgc

SEQ ID NO: 19975 - DNA, 20 bp, Artificial Sequence
  Description of Artificial Sequence: Synthetic oligonucleotide
  Target: FXN; (+) strand; PAM type: NRG; PAM sequence: AAG
tatctctgcaagtcatgcac

SEQ ID NO: 19976 - DNA, 20 bp, Artificial Sequence
  Description of Artificial Sequence: Synthetic oligonucleotide
  Target: FXN; (+) strand; PAM type: NRG; PAM sequence: TGG
tctgcaagtcatgcacaaga

SEQ ID NO: 19977 - DNA, 20 bp, Artificial Sequence
  Description of Artificial Sequence: Synthetic oligonucleotide
  Target: FXN; (+) strand; PAM type: NRG; PAM sequence: GGG
ctgcaagtcatgcacaagat

SEQ ID NO: 19978 - DNA, 20 bp, Artificial Sequence
  Description of Artificial Sequence: Synthetic oligonucleotide
  Target: FXN; (+) strand; PAM type: NRG; PAM sequence: GGG
tgcaagtcatgcacaagatg

SEQ ID NO: 19979 - DNA, 20 bp, Artificial Sequence
  Description of Artificial Sequence: Synthetic oligonucleotide
  Target: FXN; (+) strand; PAM type: NRG; PAM sequence: CAG
gtcatgcacaagatggggaa

SEQ ID NO: 19980 - DNA, 20 bp, Artificial Sequence
  Description of Artificial Sequence: Synthetic oligonucleotide
  Target: FXN; (+) strand; PAM type: NRG; PAM sequence: CAG
atgcacaagatggggaacag

SEQ ID NO: 19981 - DNA, 20 bp, Artificial Sequence
  Description of Artificial Sequence: Synthetic oligonucleotide
  Target: FXN; (+) strand; PAM type: NRG; PAM sequence: AGG
tgcacaagatggggaacagc

SEQ ID NO: 19982 - DNA, 20 bp, Artificial Sequence
  Description of Artificial Sequence: Synthetic oligonucleotide
  Target: FXN; (+) strand; PAM type: NRG; PAM sequence: CAG
gcaggcttccccctgcttac

SEQ ID NO: 19983 - DNA, 20 bp, Artificial Sequence
  Description of Artificial Sequence: Synthetic oligonucleotide
  Target: FXN; (+) strand; PAM type: NRG; PAM sequence: CAG
cctgcttaccagttcaaata

SEQ ID NO: 19984 - DNA, 20 bp, Artificial Sequence
  Description of Artificial Sequence: Synthetic oligonucleotide
  Target: FXN; (+) strand; PAM type: NRG; PAM sequence: GAG
tgcttaccagttcaaataca

SEQ ID NO: 19985 - DNA, 20 bp, Artificial Sequence
  Description of Artificial Sequence: Synthetic oligonucleotide
  Target: FXN; (+) strand; PAM type: NRG; PAM sequence: TAG
ccagttcaaatacagagaac

SEQ ID NO: 19986 - DNA, 20 bp, Artificial Sequence
  Description of Artificial Sequence: Synthetic oligonucleotide
  Target: FXN; (+) strand; PAM type: NRG; PAM sequence: TAG
aatacagagaactagccctg

SEQ ID NO: 19987 - DNA, 20 bp, Artificial Sequence
  Description of Artificial Sequence: Synthetic oligonucleotide
  Target: FXN; (+) strand; PAM type: NRG; PAM sequence: AAG
ttcatatctcacccattcta

SEQ ID NO: 19988 - DNA, 20 bp, Artificial Sequence
  Description of Artificial Sequence: Synthetic oligonucleotide
  Target: FXN; (+) strand; PAM type: NRG; PAM sequence: GAG
catatctcacccattctaaa

SEQ ID NO: 19989 - DNA, 20 bp, Artificial Sequence
  Description of Artificial Sequence: Synthetic oligonucleotide
  Target: FXN; (+) strand; PAM type: NRG; PAM sequence: CAG
cacccattctaaagagacca

SEQ ID NO: 19990 - DNA, 20 bp, Artificial Sequence
  Description of Artificial Sequence: Synthetic oligonucleotide
  Target: FXN; (+) strand; PAM type: NRG; PAM sequence: AGG
acccattctaaagagaccac

SEQ ID NO: 19991 - DNA, 20 bp, Artificial Sequence
  Description of Artificial Sequence: Synthetic oligonucleotide
  Target: FXN; (+) strand; PAM type: NRG; PAM sequence: TAG
tctaaagagaccacaggcct

SEQ ID NO: 19992 - DNA, 20 bp, Artificial Sequence
  Description of Artificial Sequence: Synthetic oligonucleotide
  Target: FXN; (+) strand; PAM type: NRG; PAM sequence: AAG
aaagagaccacaggccttag

SEQ ID NO: 19993 - DNA, 20 bp, Artificial Sequence
  Description of Artificial Sequence: Synthetic oligonucleotide
  Target: FXN; (+) strand; PAM type: NRG; PAM sequence: AAG
gaccacaggccttagaagta

SEQ ID NO: 19994 - DNA, 20 bp, Artificial Sequence
  Description of Artificial Sequence: Synthetic oligonucleotide
  Target: FXN; (+) strand; PAM type: NRG; PAM sequence: AGG
accacaggccttagaagtaa

SEQ ID NO: 19995 - DNA, 20 bp, Artificial Sequence
  Description of Artificial Sequence: Synthetic oligonucleotide
  Target: FXN; (+) strand; PAM type: NRG; PAM sequence: AAG
gtaaaggactcttttgttga

SEQ ID NO: 19996 - DNA, 20 bp, Artificial Sequence
  Description of Artificial Sequence: Synthetic oligonucleotide
  Target: FXN; (+) strand; PAM type: NRG; PAM sequence: GAG
aaaggactcttttgttgaaa

SEQ ID NO: 19997 - DNA, 20 bp, Artificial Sequence
  Description of Artificial Sequence: Synthetic oligonucleotide
  Target: FXN; (+) strand; PAM type: NRG; PAM sequence: GAG
gagtgttttcaaatttaaat

SEQ ID NO: 19998 - DNA, 20 bp, Artificial Sequence
  Description of Artificial Sequence: Synthetic oligonucleotide
  Target: FXN; (+) strand; PAM type: NRG; PAM sequence: TGG
aaatttaaatgagcatttat

SEQ ID NO: 19999 - DNA, 20 bp, Artificial Sequence
  Description of Artificial Sequence: Synthetic oligonucleotide
  Target: FXN; (+) strand; PAM type: NRG; PAM sequence: AAG
aaatgagcatttattggtca

SEQ ID NO: 20000 - DNA, 20 bp, Artificial Sequence
  Description of Artificial Sequence: Synthetic oligonucleotide
  Target: FXN; (+) strand; PAM type: NRG; PAM sequence: TAG
ttggtcaaagatgcaccaac

SEQ ID NO: 20001 - DNA, 20 bp, Artificial Sequence
  Description of Artificial Sequence: Synthetic oligonucleotide
  Target: FXN; (+) strand; PAM type: NRG; PAM sequence: AAG
atgcaccaactagtcttttg

SEQ ID NO: 20002 - DNA, 20 bp, Artificial Sequence
  Description of Artificial Sequence: Synthetic oligonucleotide
  Target: FXN; (+) strand; PAM type: NRG; PAM sequence: AAG
actagtcttttgaagaattc

SEQ ID NO: 20003 - DNA, 20 bp, Artificial Sequence
  Description of Artificial Sequence: Synthetic oligonucleotide
  Target: FXN; (+) strand; PAM type: NRG; PAM sequence: AGG
ctagtcttttgaagaattca

SEQ ID NO: 20004 - DNA, 20 bp, Artificial Sequence
  Description of Artificial Sequence: Synthetic oligonucleotide
  Target: FXN; (+) strand; PAM type: NRG; PAM sequence: TAG
ttgaagaattcaaggctctt

SEQ ID NO: 20005 - DNA, 20 bp, Artificial Sequence
  Description of Artificial Sequence: Synthetic oligonucleotide
  Target: FXN; (+) strand; PAM type: NRG; PAM sequence: GAG
gaagaattcaaggctcttta

SEQ ID NO: 20006 - DNA, 20 bp, Artificial Sequence
  Description of Artificial Sequence: Synthetic oligonucleotide
  Target: FXN; (+) strand; PAM type: NRG; PAM sequence: AAG
aggctctttagagaaaaata

SEQ ID NO: 20007 - DNA, 20 bp, Artificial Sequence
  Description of Artificial Sequence: Synthetic oligonucleotide
  Target: FXN; (+) strand; PAM type: NRG; PAM sequence: TGG
tttagagaaaaataaagcct

SEQ ID NO: 20008 - DNA, 20 bp, Artificial Sequence
  Description of Artificial Sequence: Synthetic oligonucleotide
  Target: FXN; (+) strand; PAM type: NRG; PAM sequence: GAG
tagagaaaaataaagccttg

SEQ ID NO: 20009 - DNA, 20 bp, Artificial Sequence
  Description of Artificial Sequence: Synthetic oligonucleotide
  Target: FXN; (+) strand; PAM type: NRG; PAM sequence: AGG
agagaaaaataaagccttgg

SEQ ID NO: 20010 - DNA, 20 bp, Artificial Sequence
  Description of Artificial Sequence: Synthetic oligonucleotide
  Target: FXN; (+) strand; PAM type: NRG; PAM sequence: GAG
agaaaaataaagccttggag

SEQ ID NO: 20011 - DNA, 20 bp, Artificial Sequence
  Description of Artificial Sequence: Synthetic oligonucleotide
  Target: FXN; (+) strand; PAM type: NRG; PAM sequence: GAG
aaagccttggaggagtatct

SEQ ID NO: 20012 - DNA, 20 bp, Artificial Sequence
  Description of Artificial Sequence: Synthetic oligonucleotide
  Target: FXN; (+) strand; PAM type: NRG; PAM sequence: AAG
gccttggaggagtatctgag

SEQ ID NO: 20013 - DNA, 20 bp, Artificial Sequence
  Description of Artificial Sequence: Synthetic oligonucleotide
  Target: FXN; (+) strand; PAM type: NRG; PAM sequence: TAG
ggagtatctgagaagcttgt

SEQ ID NO: 20014 - DNA, 20 bp, Artificial Sequence
  Description of Artificial Sequence: Synthetic oligonucleotide
  Target: FXN; (+) strand; PAM type: NRG; PAM sequence: TGG
tgagaagcttgttagatgcg

SEQ ID NO: 20015 - DNA, 20 bp, Artificial Sequence
  Description of Artificial Sequence: Synthetic oligonucleotide
  Target: FXN; (+) strand; PAM type: NRG; PAM sequence: GGG
gagaagcttgttagatgcgt

SEQ ID NO: 20016 - DNA, 20 bp, Artificial Sequence
  Description of Artificial Sequence: Synthetic oligonucleotide
  Target: FXN; (+) strand; PAM type: NRG; PAM sequence: AAG
aagcttgttagatgcgtggg

SEQ ID NO: 20017 - DNA, 20 bp, Artificial Sequence
  Description of Artificial Sequence: Synthetic oligonucleotide
  Target: FXN; (+) strand; PAM type: NRG; PAM sequence: GAG
gcttgttagatgcgtgggaa

SEQ ID NO: 20018 - DNA, 20 bp, Artificial Sequence
  Description of Artificial Sequence: Synthetic oligonucleotide
  Target: FXN; (+) strand; PAM type: NRG; PAM sequence: TGG
ttagatgcgtgggaagagtc

SEQ ID NO: 20019 - DNA, 20 bp, Artificial Sequence
  Description of Artificial Sequence: Synthetic oligonucleotide
  Target: FXN; (+) strand; PAM type: NRG; PAM sequence: TGG
tggaaataaaaaacttcatc

SEQ ID NO: 20020 - DNA, 20 bp, Artificial Sequence
  Description of Artificial Sequence: Synthetic oligonucleotide
  Target: FXN; (+) strand; PAM type: NRG; PAM sequence: GAG
gaaataaaaaacttcatctg

SEQ ID NO: 20021 - DNA, 20 bp, Artificial Sequence
  Description of Artificial Sequence: Synthetic oligonucleotide
  Target: FXN; (+) strand; PAM type: NRG; PAM sequence: CAG
gagtttctgccttctaccaa

SEQ ID NO: 20022 - DNA, 20 bp, Artificial Sequence
  Description of Artificial Sequence: Synthetic oligonucleotide
  Target: FXN; (+) strand; PAM type: NRG; PAM sequence: GAG
gtttctgccttctaccaaca

SEQ ID NO: 20023 - DNA, 20 bp, Artificial Sequence
  Description of Artificial Sequence: Synthetic oligonucleotide
  Target: FXN; (+) strand; PAM type: NRG; PAM sequence: AAG
gccttctaccaacagagctg

SEQ ID NO: 20024 - DNA, 20 bp, Artificial Sequence
  Description of Artificial Sequence: Synthetic oligonucleotide
  Target: FXN; (+) strand; PAM type: NRG; PAM sequence: AAG
gctgaagctaatgctctcct

SEQ ID NO: 20025 - DNA, 20 bp, Artificial Sequence
  Description of Artificial Sequence: Synthetic oligonucleotide
  Target: FXN; (+) strand; PAM type: NRG; PAM sequence: AAG
agctaatgctctcctaagac

SEQ ID NO: 20026 - DNA, 20 bp, Artificial Sequence
  Description of Artificial Sequence: Synthetic oligonucleotide
  Target: FXN; (+) strand; PAM type: NRG; PAM sequence: AAG
atgctctcctaagacaagca

SEQ ID NO: 20027 - DNA, 20 bp, Artificial Sequence
  Description of Artificial Sequence: Synthetic oligonucleotide
  Target: FXN; (+) strand; PAM type: NRG; PAM sequence: CAG
ctctcctaagacaagcaaag

SEQ ID NO: 20028 - DNA, 20 bp, Artificial Sequence
  Description of Artificial Sequence: Synthetic oligonucleotide
  Target: FXN; (+) strand; PAM type: NRG; PAM sequence: TGG
cctaagacaagcaaagcaga

SEQ ID NO: 20029 - DNA, 20 bp, Artificial Sequence
  Description of Artificial Sequence: Synthetic oligonucleotide
  Target: FXN; (+) strand; PAM type: NRG; PAM sequence: TAG
tccttttacttcctctgtaa

SEQ ID NO: 20030 - DNA, 20 bp, Artificial Sequence
  Description of Artificial Sequence: Synthetic oligonucleotide
  Target: FXN; (+) strand; PAM type: NRG; PAM sequence: GAG
acttgtcatgtctgatgttt

SEQ ID NO: 20031 - DNA, 20 bp, Artificial Sequence
  Description of Artificial Sequence: Synthetic oligonucleotide
  Target: FXN; (+) strand; PAM type: NRG; PAM sequence: TGG
gtctgatgtttgagttgacg

SEQ ID NO: 20032 - DNA, 20 bp, Artificial Sequence
  Description of Artificial Sequence: Synthetic oligonucleotide
  Target: FXN; (+) strand; PAM type: NRG; PAM sequence: TAG
gagttgacgtggtactctaa

SEQ ID NO: 20033 - DNA, 20 bp, Artificial Sequence
  Description of Artificial Sequence: Synthetic oligonucleotide
  Target: FXN; (+) strand; PAM type: NRG; PAM sequence: GAG
gttgacgtggtactctaata

SEQ ID NO: 20034 - DNA, 20 bp, Artificial Sequence
  Description of Artificial Sequence: Synthetic oligonucleotide
  Target: FXN; (+) strand; PAM type: NRG; PAM sequence: TAG
acgtggtactctaatagagt

SEQ ID NO: 20035 - DNA, 20 bp, Artificial Sequence
  Description of Artificial Sequence: Synthetic oligonucleotide
  Target: FXN; (+) strand; PAM type: NRG; PAM sequence: GAG
gtggtactctaatagagtta

SEQ ID NO: 20036 - DNA, 20 bp, Artificial Sequence
  Description of Artificial Sequence: Synthetic oligonucleotide
  Target: FXN; (+) strand; PAM type: NRG; PAM sequence: TAG
tgcattttttttatgtcctc

SEQ ID NO: 20037 - DNA, 20 bp, Artificial Sequence
  Description of Artificial Sequence: Synthetic oligonucleotide
  Target: FXN; (+) strand; PAM type: NRG; PAM sequence: TGG
ttatgtcctctagtatgttc

SEQ ID NO: 20038 - DNA, 20 bp, Artificial Sequence
  Description of Artificial Sequence: Synthetic oligonucleotide
  Target: FXN; (+) strand; PAM type: NRG; PAM sequence: TGG
ctctagtatgttctggttga

SEQ ID NO: 20039 - DNA, 20 bp, Artificial Sequence
  Description of Artificial Sequence: Synthetic oligonucleotide
  Target: FXN; (+) strand; PAM type: NRG; PAM sequence: GAG
gtatgttctggttgatggtt

SEQ ID NO: 20040 - DNA, 20 bp, Artificial Sequence
  Description of Artificial Sequence: Synthetic oligonucleotide
  Target: FXN; (+) strand; PAM type: NRG; PAM sequence: AGG
tatgttctggttgatggttg

SEQ ID NO: 20041 - DNA, 20 bp, Artificial Sequence
  Description of Artificial Sequence: Synthetic oligonucleotide
  Target: FXN; (+) strand; PAM type: NRG; PAM sequence: GGG
atgttctggttgatggttga

SEQ ID NO: 20042 - DNA, 20 bp, Artificial Sequence
  Description of Artificial Sequence: Synthetic oligonucleotide
  Target: FXN; (+) strand; PAM type: NRG; PAM sequence: CAG
gatggttgagggcaacaaac

SEQ ID NO: 20043 - DNA, 20 bp, Artificial Sequence
  Description of Artificial Sequence: Synthetic oligonucleotide
  Target: FXN; (+) strand; PAM type: NRG; PAM sequence: CAG
ggttgagggcaacaaaccag

SEQ ID NO: 20044 - DNA, 20 bp, Artificial Sequence
  Description of Artificial Sequence: Synthetic oligonucleotide
  Target: FXN; (+) strand; PAM type: NRG; PAM sequence: CAG
gggcaacaaaccagcagtcc

SEQ ID NO: 20045 - DNA, 20 bp, Artificial Sequence
  Description of Artificial Sequence: Synthetic oligonucleotide
  Target: FXN; (+) strand; PAM type: NRG; PAM sequence: CAG
aaaccagcagtcccagatgc

SEQ ID NO: 20046 - DNA, 20 bp, Artificial Sequence
  Description of Artificial Sequence: Synthetic oligonucleotide
  Target: FXN; (+) strand; PAM type: NRG; PAM sequence: AAG
cagtcccagatgccagcacc

SEQ ID NO: 20047 - DNA, 20 bp, Artificial Sequence
  Description of Artificial Sequence: Synthetic oligonucleotide
  Target: FXN; (+) strand; PAM type: NRG; PAM sequence: GAG
agatgccagcaccaagacct

SEQ ID NO: 20048 - DNA, 20 bp, Artificial Sequence
  Description of Artificial Sequence: Synthetic oligonucleotide
  Target: FXN; (+) strand; PAM type: NRG; PAM sequence: CAG
gccagcaccaagacctgaga

SEQ ID NO: 20049 - DNA, 20 bp, Artificial Sequence
  Description of Artificial Sequence: Synthetic oligonucleotide
  Target: FXN; (+) strand; PAM type: NRG; PAM sequence: AGG
ccagcaccaagacctgagac

SEQ ID NO: 20050 - DNA, 20 bp, Artificial Sequence
  Description of Artificial Sequence: Synthetic oligonucleotide
  Target: FXN; (+) strand; PAM type: NRG; PAM sequence: GAG
gacaggtcacttaactctcc

SEQ ID NO: 20051 - DNA, 20 bp, Artificial Sequence
  Description of Artificial Sequence: Synthetic oligonucleotide
  Target: FXN; (+) strand; PAM type: NRG; PAM sequence: CAG
tcaccaccattctcaccttg

SEQ ID NO: 20052 - DNA, 20 bp, Artificial Sequence
  Description of Artificial Sequence: Synthetic oligonucleotide
  Target: FXN; (+) strand; PAM type: NRG; PAM sequence: CAG
ttctcaccttgcagacctca

SEQ ID NO: 20053 - DNA, 20 bp, Artificial Sequence
  Description of Artificial Sequence: Synthetic oligonucleotide
  Target: FXN; (+) strand; PAM type: NRG; PAM sequence: AGG
tctcaccttgcagacctcac

SEQ ID NO: 20054 - DNA, 20 bp, Artificial Sequence
  Description of Artificial Sequence: Synthetic oligonucleotide
  Target: FXN; (+) strand; PAM type: NRG; PAM sequence: GGG
ctcaccttgcagacctcaca

SEQ ID NO: 20055 - DNA, 20 bp, Artificial Sequence
  Description of Artificial Sequence: Synthetic oligonucleotide
  Target: FXN; (+) strand; PAM type: NRG; PAM sequence: CAG
cttgcagacctcacagggaa

SEQ ID NO: 20056 - DNA, 20 bp, Artificial Sequence
  Description of Artificial Sequence: Synthetic oligonucleotide
  Target: FXN; (+) strand; PAM type: NRG; PAM sequence: AGG
ttgcagacctcacagggaac

SEQ ID NO: 20057 - DNA, 20 bp, Artificial Sequence
  Description of Artificial Sequence: Synthetic oligonucleotide
  Target: FXN; (+) strand; PAM type: NRG; PAM sequence: GGG
tgcagacctcacagggaaca

SEQ ID NO: 20058 - DNA, 20 bp, Artificial Sequence
  Description of Artificial Sequence: Synthetic oligonucleotide
  Target: FXN; (+) strand; PAM type: NRG; PAM sequence: AAG
gacctcacagggaacaggga

SEQ ID NO: 20059 - DNA, 20 bp, Artificial Sequence
  Description of Artificial Sequence: Synthetic oligonucleotide
  Target: FXN; (+) strand; PAM type: NRG; PAM sequence: GAG
gggaacagggaaagctctat

SEQ ID NO: 20060 - DNA, 20 bp, Artificial Sequence
  Description of Artificial Sequence: Synthetic oligonucleotide
  Target: FXN; (+) strand; PAM type: NRG; PAM sequence: AAG
taatcctattctgattctga

SEQ ID NO: 20061 - DNA, 20 bp, Artificial Sequence
  Description of Artificial Sequence: Synthetic oligonucleotide
  Target: FXN; (+) strand; PAM type: NRG; PAM sequence: AAG
ctattctgattctgaaagca

SEQ ID NO: 20062 - DNA, 20 bp, Artificial Sequence
  Description of Artificial Sequence: Synthetic oligonucleotide
  Target: FXN; (+) strand; PAM type: NRG; PAM sequence: AAG
ctcctatttctaaatactaa

SEQ ID NO: 20063 - DNA, 20 bp, Artificial Sequence
  Description of Artificial Sequence: Synthetic oligonucleotide
  Target: FXN; (+) strand; PAM type: NRG; PAM sequence: TGG
tactaaaagacatttcttta

SEQ ID NO: 20064 - DNA, 20 bp, Artificial Sequence
  Description of Artificial Sequence: Synthetic oligonucleotide
  Target: FXN; (+) strand; PAM type: NRG; PAM sequence: TAG
tggtgtattttgtgtacttg

SEQ ID NO: 20065 - DNA, 20 bp, Artificial Sequence
  Description of Artificial Sequence: Synthetic oligonucleotide
  Target: FXN; (+) strand; PAM type: NRG; PAM sequence: TGG
attttgtgtacttgtagaaa

SEQ ID NO: 20066 - DNA, 20 bp, Artificial Sequence
  Description of Artificial Sequence: Synthetic oligonucleotide
  Target: FXN; (+) strand; PAM type: NRG; PAM sequence: AAG
tgtgtacttgtagaaatgga

SEQ ID NO: 20067 - DNA, 20 bp, Artificial Sequence
  Description of Artificial Sequence: Synthetic oligonucleotide
  Target: FXN; (+) strand; PAM type: NRG; PAM sequence: GAG
ttgtagaaatggaaagtgtt

SEQ ID NO: 20068 - DNA, 20 bp, Artificial Sequence
  Description of Artificial Sequence: Synthetic oligonucleotide
  Target: FXN; (+) strand; PAM type: NRG; PAM sequence: AAG
aagtgttgagataaaacatg

SEQ ID NO: 20069 - DNA, 20 bp, Artificial Sequence
  Description of Artificial Sequence: Synthetic oligonucleotide
  Target: FXN; (+) strand; PAM type: NRG; PAM sequence: AAG
aacatgaagcaatgatgaca

SEQ ID NO: 20070 - DNA, 20 bp, Artificial Sequence
  Description of Artificial Sequence: Synthetic oligonucleotide
  Target: FXN; (+) strand; PAM type: NRG; PAM sequence: TAG
tttttttccacctaatcccc

SEQ ID NO: 20071 - DNA, 20 bp, Artificial Sequence
  Description of Artificial Sequence: Synthetic oligonucleotide
  Target: FXN; (+) strand; PAM type: NRG; PAM sequence: GAG
tttttccacctaatccccta

SEQ ID NO: 20072 - DNA, 20 bp, Artificial Sequence
  Description of Artificial Sequence: Synthetic oligonucleotide
  Target: FXN; (+) strand; PAM type: NRG; PAM sequence: TGG
ttccacctaatcccctagag

SEQ ID NO: 20073 - DNA, 20 bp, Artificial Sequence
  Description of Artificial Sequence: Synthetic oligonucleotide
  Target: FXN; (+) strand; PAM type: NRG; PAM sequence: TGG
tggtgtcttaactgtcaaac

SEQ ID NO: 20074 - DNA, 20 bp, Artificial Sequence
  Description of Artificial Sequence: Synthetic oligonucleotide
  Target: FXN; (+) strand; PAM type: NRG; PAM sequence: GGG
ggtgtcttaactgtcaaact

SEQ ID NO: 20075 - DNA, 20 bp, Artificial Sequence
  Description of Artificial Sequence: Synthetic oligonucleotide
  Target: FXN; (+) strand; PAM type: NRG; PAM sequence: TGG
gtcttaactgtcaaactggg

SEQ ID NO: 20076 - DNA, 20 bp, Artificial Sequence
  Description of Artificial Sequence: Synthetic oligonucleotide
  Target: FXN; (+) strand; PAM type: NRG; PAM sequence: GAG
cttaactgtcaaactgggtg

SEQ ID NO: 20077 - DNA, 20 bp, Artificial Sequence
  Description of Artificial Sequence: Synthetic oligonucleotide
  Target: FXN; (+) strand; PAM type: NRG; PAM sequence: TAG
tgtcaaactgggtggagatc

SEQ ID NO: 20078 - DNA, 20 bp, Artificial Sequence
  Description of Artificial Sequence: Synthetic oligonucleotide
  Target: FXN; (+) strand; PAM type: NRG; PAM sequence: AGG
gtcaaactgggtggagatct

SEQ ID NO: 20079 - DNA, 20 bp, Artificial Sequence
  Description of Artificial Sequence: Synthetic oligonucleotide
  Target: FXN; (+) strand; PAM type: NRG; PAM sequence: AAG
taggaacctatgtgatcaac

SEQ ID NO: 20080 - DNA, 20 bp, Artificial Sequence
  Description of Artificial Sequence: Synthetic oligonucleotide
  Target: FXN; (+) strand; PAM type: NRG; PAM sequence: CAG
gaacctatgtgatcaacaag

SEQ ID NO: 20081 - DNA, 20 bp, Artificial Sequence
  Description of Artificial Sequence: Synthetic oligonucleotide
  Target: FXN; (+) strand; PAM type: NRG; PAM sequence: AAG
tcaacaagcagacgccaaac

SEQ ID NO: 20082 - DNA, 20 bp, Artificial Sequence
  Description of Artificial Sequence: Synthetic oligonucleotide
  Target: FXN; (+) strand; PAM type: NRG; PAM sequence: TGG
agacgccaaacaagcaaatc

SEQ ID NO: 20083 - DNA, 20 bp, Artificial Sequence
  Description of Artificial Sequence: Synthetic oligonucleotide
  Target: FXN; (+) strand; PAM type: NRG; PAM sequence: CAG
atctggctatcttctccatc

SEQ ID NO: 20084 - DNA, 20 bp, Artificial Sequence
  Description of Artificial Sequence: Synthetic oligonucleotide
  Target: FXN; (+) strand; PAM type: NRG; PAM sequence: AGG
tctggctatcttctccatcc

SEQ ID NO: 20085 - DNA, 20 bp, Artificial Sequence
  Description of Artificial Sequence: Synthetic oligonucleotide
  Target: FXN; (+) strand; PAM type: NRG; PAM sequence: TAG
atcttctccatccaggtatg

SEQ ID NO: 20086 - DNA, 20 bp, Artificial Sequence
  Description of Artificial Sequence: Synthetic oligonucleotide
  Target: FXN; (+) strand; PAM type: NRG; PAM sequence: AGG
tcttctccatccaggtatgt

SEQ ID NO: 20087 - DNA, 20 bp, Artificial Sequence
  Description of Artificial Sequence: Synthetic oligonucleotide
  Target: FXN; (+) strand; PAM type: NRG; PAM sequence: CAG
tccaggtatgtaggtatgtt

SEQ ID NO: 20088 - DNA, 20 bp, Artificial Sequence
  Description of Artificial Sequence: Synthetic oligonucleotide
  Target: FXN; (+) strand; PAM type: NRG; PAM sequence: AAG
aggtatgtaggtatgttcag

SEQ ID NO: 20089 - DNA, 20 bp, Artificial Sequence
  Description of Artificial Sequence: Synthetic oligonucleotide
  Target: FXN; (+) strand; PAM type: NRG; PAM sequence: AAG
gtcaacatatgtaattctta

SEQ ID NO: 20090 - DNA, 20 bp, Artificial Sequence
  Description of Artificial Sequence: Synthetic oligonucleotide
  Target: FXN; (+) strand; PAM type: NRG; PAM sequence: TGG
acttccgaaatgtgacattg

SEQ ID NO: 20091 - DNA, 20 bp, Artificial Sequence
  Description of Artificial Sequence: Synthetic oligonucleotide
  Target: FXN; (+) strand; PAM type: NRG; PAM sequence: AAG
tgtgacattgtggaccattt

SEQ ID NO: 20092 - DNA, 20 bp, Artificial Sequence
  Description of Artificial Sequence: Synthetic oligonucleotide
  Target: FXN; (+) strand; PAM type: NRG; PAM sequence: CGG
gtggaccatttaagaaatgt

SEQ ID NO: 20093 - DNA, 20 bp, Artificial Sequence
  Description of Artificial Sequence: Synthetic oligonucleotide
  Target: FXN; (+) strand; PAM type: NRG; PAM sequence: GAG
ccatttaagaaatgtcggct

SEQ ID NO: 20094 - DNA, 20 bp, Artificial Sequence
  Description of Artificial Sequence: Synthetic oligonucleotide
  Target: FXN; (+) strand; PAM type: NRG; PAM sequence: CAG
taagaaatgtcggctgagca

SEQ ID NO: 20095 - DNA, 20 bp, Artificial Sequence
  Description of Artificial Sequence: Synthetic oligonucleotide
  Target: FXN; (+) strand; PAM type: NRG; PAM sequence: TGG
gaaatgtcggctgagcacag

SEQ ID NO: 20096 - DNA, 20 bp, Artificial Sequence
  Description of Artificial Sequence: Synthetic oligonucleotide
  Target: FXN; (+) strand; PAM type: NRG; PAM sequence: GAG
acctgtaatcccaacacttt

SEQ ID NO: 20097 - DNA, 20 bp, Artificial Sequence
  Description of Artificial Sequence: Synthetic oligonucleotide
  Target: FXN; (+) strand; PAM type: NRG; PAM sequence: GAG
ctgtaatcccaacactttga

SEQ ID NO: 20098 - DNA, 20 bp, Artificial Sequence
  Description of Artificial Sequence: Synthetic oligonucleotide
  Target: FXN; (+) strand; PAM type: NRG; PAM sequence: AGG
tgtaatcccaacactttgag

SEQ ID NO: 20099 - DNA, 20 bp, Artificial Sequence
  Description of Artificial Sequence: Synthetic oligonucleotide
  Target: FXN; (+) strand; PAM type: NRG; PAM sequence: GAG
tcccaacactttgagaggct

SEQ ID NO: 20100 - DNA, 20 bp, Artificial Sequence
  Description of Artificial Sequence: Synthetic oligonucleotide
  Target: FXN; (+) strand; PAM type: NRG; PAM sequence: AGG
cccaacactttgagaggctg

SEQ ID NO: 20101 - DNA, 20 bp, Artificial Sequence
  Description of Artificial Sequence: Synthetic oligonucleotide
  Target: FXN; (+) strand; PAM type: NRG; PAM sequence: TAG
aacactttgagaggctgagg

SEQ ID NO: 20102 - DNA, 20 bp, Artificial Sequence
  Description of Artificial Sequence: Synthetic oligonucleotide
  Target: FXN; (+) strand; PAM type: NRG; PAM sequence: AGG
acactttgagaggctgaggt

SEQ ID NO: 20103 - DNA, 20 bp, Artificial Sequence
  Description of Artificial Sequence: Synthetic oligonucleotide
  Target: FXN; (+) strand; PAM type: NRG; PAM sequence: GAG
actttgagaggctgaggtag

SEQ ID NO: 20104 - DNA, 20 bp, Artificial Sequence
  Description of Artificial Sequence: Synthetic oligonucleotide
  Target: FXN; (+) strand; PAM type: NRG; PAM sequence: AGG
ctttgagaggctgaggtagg

SEQ ID NO: 20105 - DNA, 20 bp, Artificial Sequence
  Description of Artificial Sequence: Synthetic oligonucleotide
  Target: FXN; (+) strand; PAM type: NRG; PAM sequence: GAG
ctgaggtaggaggatcactt

SEQ ID NO: 20106 - DNA, 20 bp, Artificial Sequence
  Description of Artificial Sequence: Synthetic oligonucleotide
  Target: FXN; (+) strand; PAM type: NRG; PAM sequence: AGG
tgaggtaggaggatcacttg

SEQ ID NO: 20107 - DNA, 20 bp, Artificial Sequence
  Description of Artificial Sequence: Synthetic oligonucleotide
  Target: FXN; (+) strand; PAM type: NRG; PAM sequence: CAG
gtaggaggatcacttgagga

SEQ ID NO: 20108 - DNA, 20 bp, Artificial Sequence
  Description of Artificial Sequence: Synthetic oligonucleotide
  Target: FXN; (+) strand; PAM type: NRG; PAM sequence: AGG
taggaggatcacttgaggac

SEQ ID NO: 20109 - DNA, 20 bp, Artificial Sequence
  Description of Artificial Sequence: Synthetic oligonucleotide
  Target: FXN; (+) strand; PAM type: NRG; PAM sequence: GAG
ggaggatcacttgaggacag

SEQ ID NO: 20110 - DNA, 20 bp, Artificial Sequence
  Description of Artificial Sequence: Synthetic oligonucleotide
  Target: FXN; (+) strand; PAM type: NRG; PAM sequence: CAG
atcacttgaggacaggagtt

SEQ ID NO: 20111 - DNA, 20 bp, Artificial Sequence
  Description of Artificial Sequence: Synthetic oligonucleotide
  Target: FXN; (+) strand; PAM type: NRG; PAM sequence: TGG
acaggagttcagaaccatcc

SEQ ID NO: 20112 - DNA, 20 bp, Artificial Sequence
  Description of Artificial Sequence: Synthetic oligonucleotide
  Target: FXN; (+) strand; PAM type: NRG; PAM sequence: GGG
caggagttcagaaccatcct

SEQ ID NO: 20113 - DNA, 20 bp, Artificial Sequence
  Description of Artificial Sequence: Synthetic oligonucleotide
  Target: FXN; (+) strand; PAM type: NRG; PAM sequence: TAG
cagaaccatcctgggcaaca

SEQ ID NO: 20114 - DNA, 20 bp, Artificial Sequence
  Description of Artificial Sequence: Synthetic oligonucleotide
  Target: FXN; (+) strand; PAM type: NRG; PAM sequence: GAG
accatcctgggcaacatagt

SEQ ID NO: 20115 - DNA, 20 bp, Artificial Sequence
  Description of Artificial Sequence: Synthetic oligonucleotide
  Target: FXN; (+) strand; PAM type: NRG; PAM sequence: AAG
agtgagtccctgtctctgta

SEQ ID NO: 20116 - DNA, 20 bp, Artificial Sequence
  Description of Artificial Sequence: Synthetic oligonucleotide
  Target: FXN; (+) strand; PAM type: NRG; PAM sequence: AAG
ctgtaaagaaaataaaaata

SEQ ID NO: 20117 - DNA, 20 bp, Artificial Sequence
  Description of Artificial Sequence: Synthetic oligonucleotide
  Target: FXN; (+) strand; PAM type: NRG; PAM sequence: CAG
agaaaataaaaataaagtca

SEQ ID NO: 20118 - DNA, 20 bp, Artificial Sequence
  Description of Artificial Sequence: Synthetic oligonucleotide
  Target: FXN; (+) strand; PAM type: NRG; PAM sequence: TGG
aataaaaataaagtcacagc

SEQ ID NO: 20119 - DNA, 20 bp, Artificial Sequence
  Description of Artificial Sequence: Synthetic oligonucleotide
  Target: FXN; (+) strand; PAM type: NRG; PAM sequence: GGG
ataaaaataaagtcacagct

SEQ ID NO: 20120 - DNA, 20 bp, Artificial Sequence
  Description of Artificial Sequence: Synthetic oligonucleotide
  Target: FXN; (+) strand; PAM type: NRG; PAM sequence: CAG
aataaagtcacagctgggtg

SEQ ID NO: 20121 - DNA, 20 bp, Artificial Sequence
  Description of Artificial Sequence: Synthetic oligonucleotide
  Target: FXN; (+) strand; PAM type: NRG; PAM sequence: AGG
ataaagtcacagctgggtgc

SEQ ID NO: 20122 - DNA, 20 bp, Artificial Sequence
  Description of Artificial Sequence: Synthetic oligonucleotide
  Target: FXN; (+) strand; PAM type: NRG; PAM sequence: CAG
caggcttacacctgtaatcc

SEQ ID NO: 20123 - DNA, 20 bp, Artificial Sequence
  Description of Artificial Sequence: Synthetic oligonucleotide
  Target: FXN; (+) strand; PAM type: NRG; PAM sequence: TGG
cacctgtaatcccagcactt

SEQ ID NO: 20124 - DNA, 20 bp, Artificial Sequence
  Description of Artificial Sequence: Synthetic oligonucleotide
  Target: FXN; (+) strand; PAM type: NRG; PAM sequence: GGG
acctgtaatcccagcacttt

SEQ ID NO: 20125 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttgg

SEQ ID NO: 20126 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttggg

SEQ ID NO: 20127 - DNA, 20 bp, Artificial Sequence
  Description of Artificial Sequence: Synthetic oligonucleotide
  Target: FXN; (+) strand; PAM type: NRG; PAM sequence: AAG
tcccagcactttgggaggcc

SEQ ID NO: 20128 - DNA, 20 bp, Artificial Sequence
  Description of Artificial Sequence: Synthetic oligonucleotide
  Target: FXN; (+) strand; PAM type: NRG; PAM sequence: AGG
cccagcactttgggaggcca

SEQ ID NO: 20129 - DNA, 20 bp, Artificial Sequence
  Description of Artificial Sequence: Synthetic oligonucleotide
  Target: FXN; (+) strand; PAM type: NRG; PAM sequence: TGG
ctttgggaggccaaggcctg

SEQ ID NO: 20130 - DNA, 20 bp, Artificial Sequence
  Description of Artificial Sequence: Synthetic oligonucleotide
  Target: FXN; (+) strand; PAM type: NRG; PAM sequence: GAG
ccaaggcctgtggatcactt

SEQ ID NO: 20131 - DNA, 20 bp, Artificial Sequence
  Description of Artificial Sequence: Synthetic oligonucleotide
  Target: FXN; (+) strand; PAM type: NRG; PAM sequence: CAG
gcctgtggatcacttgagct

SEQ ID NO: 20132 - DNA, 20 bp, Artificial Sequence
  Description of Artificial Sequence: Synthetic oligonucleotide
  Target: FXN; (+) strand; PAM type: NRG; PAM sequence: AGG
cctgtggatcacttgagctc

SEQ ID NO: 20133 - DNA, 20 bp, Artificial Sequence
  Description of Artificial Sequence: Synthetic oligonucleotide
  Target: FXN; (+) strand; PAM type: NRG; PAM sequence: GAG
tgtggatcacttgagctcag

SEQ ID NO: 20134 - DNA, 20 bp, Artificial Sequence
  Description of Artificial Sequence: Synthetic oligonucleotide
  Target: FXN; (+) strand; PAM type: NRG; PAM sequence: GAG
tcacttgagctcaggagttt

SEQ ID NO: 20135 - DNA, 20 bp, Artificial Sequence
  Description of Artificial Sequence: Synthetic oligonucleotide
  Target: FXN; (+) strand; PAM type: NRG; PAM sequence: CAG
tgagctcaggagtttgagac

SEQ ID NO: 20136 - DNA, 20 bp, Artificial Sequence
  Description of Artificial Sequence: Synthetic oligonucleotide
  Target: FXN; (+) strand; PAM type: NRG; PAM sequence: TGG
tcaggagtttgagaccagcc

SEQ ID NO: 20137 - DNA, 20 bp, Artificial Sequence
  Description of Artificial Sequence: Synthetic oligonucleotide
  Target: FXN; (+) strand; PAM type: NRG; PAM sequence: GGG
caggagtttgagaccagcct

SEQ ID NO: 20138 - DNA, 20 bp, Artificial Sequence
  Description of Artificial Sequence: Synthetic oligonucleotide
  Target: FXN; (+) strand; PAM type: NRG; PAM sequence: AAG
ccagcctgggcaatgtcaca

SEQ ID NO: 20139 - DNA, 20 bp, Artificial Sequence
  Description of Artificial Sequence: Synthetic oligonucleotide
  Target: FXN; (+) strand; PAM type: NRG; PAM sequence: TAG
tctactaaaaatataaaaat

SEQ ID NO: 20140 - DNA, 20 bp, Artificial Sequence
  Description of Artificial Sequence: Synthetic oligonucleotide
  Target: FXN; (+) strand; PAM type: NRG; PAM sequence: CAG
ctaaaaatataaaaattagc

SEQ ID NO: 20141 - DNA, 20 bp, Artificial Sequence
  Description of Artificial Sequence: Synthetic oligonucleotide
  Target: FXN; (+) strand; PAM type: NRG; PAM sequence: AGG
taaaaatataaaaattagcc

SEQ ID NO: 20142 - DNA, 20 bp, Artificial Sequence
  Description of Artificial Sequence: Synthetic oligonucleotide
  Target: FXN; (+) strand; PAM type: NRG; PAM sequence: TGG
atataaaaattagccaggtg

SEQ ID NO: 20143 - DNA, 20 bp, Artificial Sequence
  Description of Artificial Sequence: Synthetic oligonucleotide
  Target: FXN; (+) strand; PAM type: NRG; PAM sequence: TGG
taaaaattagccaggtgtgg

SEQ ID NO: 20144 - DNA, 20 bp, Artificial Sequence
  Description of Artificial Sequence: Synthetic oligonucleotide
  Target: FXN; (+) strand; PAM type: NRG; PAM sequence: TAG
ggtgtggtggcacacgccta

SEQ ID NO: 20145 - DNA, 20 bp, Artificial Sequence
  Description of Artificial Sequence: Synthetic oligonucleotide
  Target: FXN; (+) strand; PAM type: NRG; PAM sequence: TGG
cgcctatagtcccaactact

SEQ ID NO: 20146 - DNA, 20 bp, Artificial Sequence
  Description of Artificial Sequence: Synthetic oligonucleotide
  Target: FXN; (+) strand; PAM type: NRG; PAM sequence: AAG
ctatagtcccaactacttgg

SEQ ID NO: 20147 - DNA, 20 bp, Artificial Sequence
  Description of Artificial Sequence: Synthetic oligonucleotide
  Target: FXN; (+) strand; PAM type: NRG; PAM sequence: AGG
tatagtcccaactacttgga

SEQ ID NO: 20148 - DNA, 20 bp, Artificial Sequence
  Description of Artificial Sequence: Synthetic oligonucleotide
  Target: FXN; (+) strand; PAM type: NRG; PAM sequence: GAG
tcccaactacttggaaggct

SEQ ID NO: 20149 - DNA, 20 bp, Artificial Sequence
  Description of Artificial Sequence: Synthetic oligonucleotide
  Target: FXN; (+) strand; PAM type: NRG; PAM sequence: AGG
cccaactacttggaaggctg

SEQ ID NO: 20150 - DNA, 20 bp, Artificial Sequence
  Description of Artificial Sequence: Synthetic oligonucleotide
  Target: FXN; (+) strand; PAM type: NRG; PAM sequence: GAG
ctacttggaaggctgaggtt

SEQ ID NO: 20151 - DNA, 20 bp, Artificial Sequence
  Description of Artificial Sequence: Synthetic oligonucleotide
  Target: FXN; (+) strand; PAM type: NRG; PAM sequence: CAG
ggaaggctgaggttgagcct

SEQ ID NO: 20152 - DNA, 20 bp, Artificial Sequence
  Description of Artificial Sequence: Synthetic oligonucleotide
  Target: FXN; (+) strand; PAM type: NRG; PAM sequence: GAG
ctgaggttgagcctcagcct

SEQ ID NO: 20153 - DNA, 20 bp, Artificial Sequence
  Description of Artificial Sequence: Synthetic oligonucleotide
  Target: FXN; (+) strand; PAM type: NRG; PAM sequence: CAG
gttgagcctcagcctgagcc

SEQ ID NO: 20154 - DNA, 20 bp, Artificial Sequence
  Description of Artificial Sequence: Synthetic oligonucleotide
  Target: FXN; (+) strand; PAM type: NRG; PAM sequence: AGG
ttgagcctcagcctgagccc

SEQ ID NO: 20155 - DNA, 20 bp, Artificial Sequence
  Description of Artificial Sequence: Synthetic oligonucleotide
  Target: FXN; (+) strand; PAM type: NRG; PAM sequence: GAG
gagcctcagcctgagcccag

SEQ ID NO: 20156 - DNA, 20 bp, Artificial Sequence
  Description of Artificial Sequence: Synthetic oligonucleotide
  Target: FXN; (+) strand; PAM type: NRG; PAM sequence: AGG
agcctcagcctgagcccagg

SEQ ID NO: 20157 - DNA, 20 bp, Artificial Sequence
  Description of Artificial Sequence: Synthetic oligonucleotide
  Target: FXN; (+) strand; PAM type: NRG; PAM sequence: TGG
ctcagcctgagcccaggagg

SEQ ID NO: 20158 - DNA, 20 bp, Artificial Sequence
  Description of Artificial Sequence: Synthetic oligonucleotide
  Target: FXN; (+) strand; PAM type: NRG; PAM sequence: GAG
cagcctgagcccaggaggtg

SEQ ID NO: 20159 - DNA, 20 bp, Artificial Sequence
  Description of Artificial Sequence: Synthetic oligonucleotide
  Target: FXN; (+) strand; PAM type: NRG; PAM sequence: AGG
agcctgagcccaggaggtgg

SEQ ID NO: 20160 - DNA, 20 bp, Artificial Sequence
  Description of Artificial Sequence: Synthetic oligonucleotide
  Target: FXN; (+) strand; PAM type: NRG; PAM sequence: CAG
agcccaggaggtggaggttg

SEQ ID NO: 20161 - DNA, 20 bp, Artificial Sequence
  Description of Artificial Sequence: Synthetic oligonucleotide
  Target: FXN; (+) strand; PAM type: NRG; PAM sequence: GAG
caggaggtggaggttgcagt

SEQ ID NO: 20162 - DNA, 20 bp, Artificial Sequence
  Description of Artificial Sequence: Synthetic oligonucleotide
  Target: FXN; (+) strand; PAM type: NRG; PAM sequence: AAG
ggtggaggttgcagtgagcc

SEQ ID NO: 20163 - DNA, 20 bp, Artificial Sequence
  Description of Artificial Sequence: Synthetic oligonucleotide
  Target: FXN; (+) strand; PAM type: NRG; PAM sequence: CAG
aagatcgcgccactgcactc

SEQ ID NO: 20164 - DNA, 20 bp, Artificial Sequence
  Description of Artificial Sequence: Synthetic oligonucleotide
  Target: FXN; (+) strand; PAM type: NRG; PAM sequence: TGG
cgcgccactgcactccagcc

SEQ ID NO: 20165 - DNA, 20 bp, Artificial Sequence
  Description of Artificial Sequence: Synthetic oligonucleotide
  Target: FXN; (+) strand; PAM type: NRG; PAM sequence: GGG
gcgccactgcactccagcct

SEQ ID NO: 20166 - DNA, 20 bp, Artificial Sequence
  Description of Artificial Sequence: Synthetic oligonucleotide
  Target: FXN; (+) strand; PAM type: NRG; PAM sequence: CAG
ctgcactccagcctgggcaa

SEQ ID NO: 20167 - DNA, 20 bp, Artificial Sequence
  Description of Artificial Sequence: Synthetic oligonucleotide
  Target: FXN; (+) strand; PAM type: NRG; PAM sequence: AGG
tgcactccagcctgggcaac

SEQ ID NO: 20168 - DNA, 20 bp, Artificial Sequence
  Description of Artificial Sequence: Synthetic oligonucleotide
  Target: FXN; (+) strand; PAM type: NRG; PAM sequence: GGG
gcactccagcctgggcaaca

SEQ ID NO: 20169 - DNA, 20 bp, Artificial Sequence
  Description of Artificial Sequence: Synthetic oligonucleotide
  Target: FXN; (+) strand; PAM type: NRG; PAM sequence: CAG
tccagcctgggcaacagggc

SEQ ID NO: 20170 - DNA, 20 bp, Artificial Sequence
  Description of Artificial Sequence: Synthetic oligonucleotide
  Target: FXN; (+) strand; PAM type: NRG; PAM sequence: AAG
ctgtcccaaaaaaaaaaaaa

SEQ ID NO: 20171 - DNA, 20 bp, Artificial Sequence
  Description of Artificial Sequence: Synthetic oligonucleotide
  Target: FXN; (+) strand; PAM type: NRG; PAM sequence: TAG
aaaaagtcatcgtcttatgt

SEQ ID NO: 20172 - DNA, 20 bp, Artificial Sequence
  Description of Artificial Sequence: Synthetic oligonucleotide
  Target: FXN; (+) strand; PAM type: NRG; PAM sequence: AAG
tcttatgttagcatccttgt

SEQ ID NO: 20173 - DNA, 20 bp, Artificial Sequence
  Description of Artificial Sequence: Synthetic oligonucleotide
  Target: FXN; (+) strand; PAM type: NRG; PAM sequence: GAG
atgttagcatccttgtaagt

SEQ ID NO: 20174 - DNA, 20 bp, Artificial Sequence
  Description of Artificial Sequence: Synthetic oligonucleotide
  Target: FXN; (+) strand; PAM type: NRG; PAM sequence: CAG
gagcctttcctgatattttg

SEQ ID NO: 20175 - DNA, 20 bp, Artificial Sequence
  Description of Artificial Sequence: Synthetic oligonucleotide
  Target: FXN; (+) strand; PAM type: NRG; PAM sequence: CAG
tttgcagcctgtctcattct

SEQ ID NO: 20176 - DNA, 20 bp, Artificial Sequence
  Description of Artificial Sequence: Synthetic oligonucleotide
  Target: FXN; (+) strand; PAM type: NRG; PAM sequence: TAG
gcagcctgtctcattctcag

SEQ ID NO: 20177 - DNA, 20 bp, Artificial Sequence
  Description of Artificial Sequence: Synthetic oligonucleotide
  Target: FXN; (+) strand; PAM type: NRG; PAM sequence: AAG
ctgtctcattctcagtagaa

SEQ ID NO: 20178 - DNA, 20 bp, Artificial Sequence
  Description of Artificial Sequence: Synthetic oligonucleotide
  Target: FXN; (+) strand; PAM type: NRG; PAM sequence: TAG
ctcagtagaaaagtttactc

SEQ ID NO: 20179 - DNA, 20 bp, Artificial Sequence
  Description of Artificial Sequence: Synthetic oligonucleotide
  Target: FXN; (+) strand; PAM type: NRG; PAM sequence: TGG
acttctccctgctgacaatt

SEQ ID NO: 20180 - DNA, 20 bp, Artificial Sequence
  Description of Artificial Sequence: Synthetic oligonucleotide
  Target: FXN; (+) strand; PAM type: NRG; PAM sequence: AAG
gctgacaatttggatactgt

SEQ ID NO: 20181 - DNA, 20 bp, Artificial Sequence
  Description of Artificial Sequence: Synthetic oligonucleotide
  Target: FXN; (+) strand; PAM type: NRG; PAM sequence: CAG
gacaatttggatactgtaag

SEQ ID NO: 20182 - DNA, 20 bp, Artificial Sequence
  Description of Artificial Sequence: Synthetic oligonucleotide
  Target: FXN; (+) strand; PAM type: NRG; PAM sequence: AGG
acaatttggatactgtaagc

SEQ ID NO: 20183 - DNA, 20 bp, Artificial Sequence
  Description of Artificial Sequence: Synthetic oligonucleotide
  Target: FXN; (+) strand; PAM type: NRG; PAM sequence: CAG
tggatactgtaagcaggcat

SEQ ID NO: 20184 - DNA, 20 bp, Artificial Sequence
  Description of Artificial Sequence: Synthetic oligonucleotide
  Target: FXN; (+) strand; PAM type: NRG; PAM sequence: AGG
ggatactgtaagcaggcatc

SEQ ID NO: 20185 - DNA, 20 bp, Artificial Sequence
  Description of Artificial Sequence: Synthetic oligonucleotide
  Target: FXN; (+) strand; PAM type: NRG; PAM sequence: AAG
taagcaggcatcaggatatt

SEQ ID NO: 20186 - DNA, 20 bp, Artificial Sequence
  Description of Artificial Sequence: Synthetic oligonucleotide
  Target: FXN; (+) strand; PAM type: NRG; PAM sequence: AAG
catcaggatattaagatctg

SEQ ID NO: 20187 - DNA, 20 bp, Artificial Sequence
  Description of Artificial Sequence: Synthetic oligonucleotide
  Target: FXN; (+) strand; PAM type: NRG; PAM sequence: GAG
aggatattaagatctgaagt

SEQ ID NO: 20188 - DNA, 20 bp, Artificial Sequence
  Description of Artificial Sequence: Synthetic oligonucleotide
  Target: FXN; (+) strand; PAM type: NRG; PAM sequence: TAG
atattaagatctgaagtgag

SEQ ID NO: 20189 - DNA, 20 bp, Artificial Sequence
  Description of Artificial Sequence: Synthetic oligonucleotide
  Target: FXN; (+) strand; PAM type: NRG; PAM sequence: CAG
gcttataacttttccaaatc

SEQ ID NO: 20190 - DNA, 20 bp, Artificial Sequence
  Description of Artificial Sequence: Synthetic oligonucleotide
  Target: FXN; (+) strand; PAM type: NRG; PAM sequence: TAG
taacttttccaaatccagcc

SEQ ID NO: 20191 - DNA, 20 bp, Artificial Sequence
  Description of Artificial Sequence: Synthetic oligonucleotide
  Target: FXN; (+) strand; PAM type: NRG; PAM sequence: CAG
ttttccaaatccagcctaga

SEQ ID NO: 20192 - DNA, 20 bp, Artificial Sequence
  Description of Artificial Sequence: Synthetic oligonucleotide
  Target: FXN; (+) strand; PAM type: NRG; PAM sequence: AAG
aattattgccctgactttaa

SEQ ID NO: 20193 - DNA, 20 bp, Artificial Sequence
  Description of Artificial Sequence: Synthetic oligonucleotide
  Target: FXN; (+) strand; PAM type: NRG; PAM sequence: AAG
tattgccctgactttaaaag

SEQ ID NO: 20194 - DNA, 20 bp, Artificial Sequence
  Description of Artificial Sequence: Synthetic oligonucleotide
  Target: FXN; (+) strand; PAM type: NRG; PAM sequence: TAG
agaagctacttttgaccttg

SEQ ID NO: 20195 - DNA, 20 bp, Artificial Sequence
  Description of Artificial Sequence: Synthetic oligonucleotide
  Target: FXN; (+) strand; PAM type: NRG; PAM sequence: AAG
tgaccttgtagcgtttgaac

SEQ ID NO: 20196 - DNA, 20 bp, Artificial Sequence
  Description of Artificial Sequence: Synthetic oligonucleotide
  Target: FXN; (+) strand; PAM type: NRG; PAM sequence: AAG
caagttgcactttgtcttca

SEQ ID NO: 20197 - DNA, 20 bp, Artificial Sequence
  Description of Artificial Sequence: Synthetic oligonucleotide
  Target: FXN; (+) strand; PAM type: NRG; PAM sequence: AAG
ttgcactttgtcttcaaagc

SEQ ID NO: 20198 - DNA, 20 bp, Artificial Sequence
  Description of Artificial Sequence: Synthetic oligonucleotide
  Target: FXN; (+) strand; PAM type: NRG; PAM sequence: AAG
tttgtcttcaaagcaagtta

SEQ ID NO: 20199 - DNA, 20 bp, Artificial Sequence
  Description of Artificial Sequence: Synthetic oligonucleotide
  Target: FXN; (+) strand; PAM type: NRG; PAM sequence: GAG
gtttgacctctacttgtttt

SEQ ID NO: 20200 - DNA, 20 bp, Artificial Sequence
  Description of Artificial Sequence: Synthetic oligonucleotide
  Target: FXN; (+) strand; PAM type: NRG; PAM sequence: CAG
tctacttgttttgagcctct

SEQ ID NO: 20201 - DNA, 20 bp, Artificial Sequence
  Description of Artificial Sequence: Synthetic oligonucleotide
  Target: FXN; (+) strand; PAM type: NRG; PAM sequence: AGG
ctacttgttttgagcctctc

SEQ ID NO: 20202 - DNA, 20 bp, Artificial Sequence
  Description of Artificial Sequence: Synthetic oligonucleotide
  Target: FXN; (+) strand; PAM type: NRG; PAM sequence: AAG
tgttttgagcctctcaggta

SEQ ID NO: 20203 - DNA, 20 bp, Artificial Sequence
  Description of Artificial Sequence: Synthetic oligonucleotide
  Target: FXN; (+) strand; PAM type: NRG; PAM sequence: AGG
gttttgagcctctcaggtaa

SEQ ID NO: 20204 - DNA, 20 bp, Artificial Sequence
  Description of Artificial Sequence: Synthetic oligonucleotide
  Target: FXN; (+) strand; PAM type: NRG; PAM sequence: GGG
ttttgagcctctcaggtaaa

SEQ ID NO: 20205 - DNA, 20 bp, Artificial Sequence
  Description of Artificial Sequence: Synthetic oligonucleotide
  Target: FXN; (+) strand; PAM type: NRG; PAM sequence: CAG
ggttatttgaattccctttg

SEQ ID NO: 20206 - DNA, 20 bp, Artificial Sequence
  Description of Artificial Sequence: Synthetic oligonucleotide
  Target: FXN; (+) strand; PAM type: NRG; PAM sequence: AGG
gttatttgaattccctttgc

SEQ ID NO: 20207 - DNA, 20 bp, Artificial Sequence
  Description of Artificial Sequence: Synthetic oligonucleotide
  Target: FXN; (+) strand; PAM type: NRG; PAM sequence: TGG
tttgaattccctttgcaggt

SEQ ID NO: 20208 - DNA, 20 bp, Artificial Sequence
  Description of Artificial Sequence: Synthetic oligonucleotide
  Target: FXN; (+) strand; PAM type: NRG; PAM sequence: GGG
ttgaattccctttgcaggtt

SEQ ID NO: 20209 - DNA, 20 bp, Artificial Sequence
  Description of Artificial Sequence: Synthetic oligonucleotide
  Target: FXN; (+) strand; PAM type: NRG; PAM sequence: GGG
tgaattccctttgcaggttg

SEQ ID NO: 20210 - DNA, 20 bp, Artificial Sequence
  Description of Artificial Sequence: Synthetic oligonucleotide
  Target: FXN; (+) strand; PAM type: NRG; PAM sequence: TGG
ggttggggttgtgtaccctg

SEQ ID NO: 20211 - DNA, 20 bp, Artificial Sequence
  Description of Artificial Sequence: Synthetic oligonucleotide
  Target: FXN; (+) strand; PAM type: NRG; PAM sequence: GAG
ttggggttgtgtaccctgtg

SEQ ID NO: 20212 - DNA, 20 bp, Artificial Sequence
  Description of Artificial Sequence: Synthetic oligonucleotide
  Target: FXN; (+) strand; PAM type: NRG; PAM sequence: AGG
tggggttgtgtaccctgtgg

SEQ ID NO: 20213 - DNA, 20 bp, Artificial Sequence
  Description of Artificial Sequence: Synthetic oligonucleotide
  Target: FXN; (+) strand; PAM type: NRG; PAM sequence: TGG
ggttgtgtaccctgtggagg

SEQ ID NO: 20214 - DNA, 20 bp, Artificial Sequence
  Description of Artificial Sequence: Synthetic oligonucleotide
  Target: FXN; (+) strand; PAM type: NRG; PAM sequence: TAG
tgtgtaccctgtggaggtgg

SEQ ID NO: 20215 - DNA, 20 bp, Artificial Sequence
  Description of Artificial Sequence: Synthetic oligonucleotide
  Target: FXN; (+) strand; PAM type: NRG; PAM sequence: GAG
tgtaccctgtggaggtggta

SEQ ID NO: 20216 - DNA, 20 bp, Artificial Sequence
  Description of Artificial Sequence: Synthetic oligonucleotide
  Target: FXN; (+) strand; PAM type: NRG; PAM sequence: CAG
agtgttatatattgctgctc

SEQ ID NO: 20217 - DNA, 20 bp, Artificial Sequence
  Description of Artificial Sequence: Synthetic oligonucleotide
  Target: FXN; (+) strand; PAM type: NRG; PAM sequence: AGG
gtgttatatattgctgctcc

SEQ ID NO: 20218 - DNA, 20 bp, Artificial Sequence
  Description of Artificial Sequence: Synthetic oligonucleotide
  Target: FXN; (+) strand; PAM type: NRG; PAM sequence: GGG
tgttatatattgctgctcca

SEQ ID NO: 20219 - DNA, 20 bp, Artificial Sequence
  Description of Artificial Sequence: Synthetic oligonucleotide
  Target: FXN; (+) strand; PAM type: NRG; PAM sequence: TAG
ccattgatgtgctttcaatc

SEQ ID NO: 20220 - DNA, 20 bp, Artificial Sequence
  Description of Artificial Sequence: Synthetic oligonucleotide
  Target: FXN; (+) strand; PAM type: NRG; PAM sequence: GAG
attgatgtgctttcaatcta

SEQ ID NO: 20221 - DNA, 20 bp, Artificial Sequence
  Description of Artificial Sequence: Synthetic oligonucleotide
  Target: FXN; (+) strand; PAM type: NRG; PAM sequence: AGG
ttgatgtgctttcaatctag

SEQ ID NO: 20222 - DNA, 20 bp, Artificial Sequence
  Description of Artificial Sequence: Synthetic oligonucleotide
  Target: FXN; (+) strand; PAM type: NRG; PAM sequence: AAG
ctttcaatctagaggaataa

SEQ ID NO: 20223 - DNA, 20 bp, Artificial Sequence
  Description of Artificial Sequence: Synthetic oligonucleotide
  Target: FXN; (+) strand; PAM type: NRG; PAM sequence: TGG
agaggaataaaagattgtgt

SEQ ID NO: 20224 - DNA, 20 bp, Artificial Sequence
  Description of Artificial Sequence: Synthetic oligonucleotide
  Target: FXN; (+) strand; PAM type: NRG; PAM sequence: GAG
aggaataaaagattgtgttg

SEQ ID NO: 20225 - DNA, 20 bp, Artificial Sequence
  Description of Artificial Sequence: Synthetic oligonucleotide
  Target: FXN; (+) strand; PAM type: NRG; PAM sequence: TGG
attgtgttggagacacaatg

SEQ ID NO: 20226 - DNA, 20 bp, Artificial Sequence
  Description of Artificial Sequence: Synthetic oligonucleotide
  Target: FXN; (+) strand; PAM type: NRG; PAM sequence: TAG
gagacacaatgtggcctgca

SEQ ID NO: 20227 - DNA, 20 bp, Artificial Sequence
  Description of Artificial Sequence: Synthetic oligonucleotide
  Target: FXN; (+) strand; PAM type: NRG; PAM sequence: AAG
gtggcctgcatagcatctga

SEQ ID NO: 20228 - DNA, 20 bp, Artificial Sequence
  Description of Artificial Sequence: Synthetic oligonucleotide
  Target: FXN; (+) strand; PAM type: NRG; PAM sequence: GAG
tgcatagcatctgaaagcct

SEQ ID NO: 20229 - DNA, 20 bp, Artificial Sequence
  Description of Artificial Sequence: Synthetic oligonucleotide
  Target: FXN; (+) strand; PAM type: NRG; PAM sequence: CAG
tctgaaagcctgagaacatg

SEQ ID NO: 20230 - DNA, 20 bp, Artificial Sequence
  Description of Artificial Sequence: Synthetic oligonucleotide
  Target: FXN; (+) strand; PAM type: NRG; PAM sequence: AGG
ctgaaagcctgagaacatgc

SEQ ID NO: 20231 - DNA, 20 bp, Artificial Sequence
  Description of Artificial Sequence: Synthetic oligonucleotide
  Target: FXN; (+) strand; PAM type: NRG; PAM sequence: GGG
tgaaagcctgagaacatgca

SEQ ID NO: 20232 - DNA, 20 bp, Artificial Sequence
  Description of Artificial Sequence: Synthetic oligonucleotide
  Target: FXN; (+) strand; PAM type: NRG; PAM sequence: GAG
aaagcctgagaacatgcagg

SEQ ID NO: 20233 - DNA, 20 bp, Artificial Sequence
  Description of Artificial Sequence: Synthetic oligonucleotide
  Target: FXN; (+) strand; PAM type: NRG; PAM sequence: GAG
agcctgagaacatgcaggga

SEQ ID NO: 20234 - DNA, 20 bp, Artificial Sequence
  Description of Artificial Sequence: Synthetic oligonucleotide
  Target: FXN; (+) strand; PAM type: NRG; PAM sequence: CAG
gagagacatccctcatccct

SEQ ID NO: 20235 - DNA, 20 bp, Artificial Sequence
  Description of Artificial Sequence: Synthetic oligonucleotide
  Target: FXN; (+) strand; PAM type: NRG; PAM sequence: CAG
agacatccctcatccctcag

SEQ ID NO: 20236 - DNA, 20 bp, Artificial Sequence
  Description of Artificial Sequence: Synthetic oligonucleotide
  Target: FXN; (+) strand; PAM type: NRG; PAM sequence: TGG
tccctcatccctcagcagcc

SEQ ID NO: 20237 - DNA, 20 bp, Artificial Sequence
  Description of Artificial Sequence: Synthetic oligonucleotide
  Target: FXN; (+) strand; PAM type: NRG; PAM sequence: AAG
cagcagcctggctgctgttg

SEQ ID NO: 20238 - DNA, 20 bp, Artificial Sequence
  Description of Artificial Sequence: Synthetic oligonucleotide
  Target: FXN; (+) strand; PAM type: NRG; PAM sequence: TGG
cagcctggctgctgttgaag

SEQ ID NO: 20239 - DNA, 20 bp, Artificial Sequence
  Description of Artificial Sequence: Synthetic oligonucleotide
  Target: FXN; (+) strand; PAM type: NRG; PAM sequence: AAG
gctgctgttgaagtggttgt

SEQ ID NO: 20240 - DNA, 20 bp, Artificial Sequence
  Description of Artificial Sequence: Synthetic oligonucleotide
  Target: FXN; (+) strand; PAM type: NRG; PAM sequence: AAG
ctgttgaagtggttgtaaga

SEQ ID NO: 20241 - DNA, 20 bp, Artificial Sequence
  Description of Artificial Sequence: Synthetic oligonucleotide
  Target: FXN; (+) strand; PAM type: NRG; PAM sequence: AAG
aagtggttgtaagaaagtaa

SEQ ID NO: 20242 - DNA, 20 bp, Artificial Sequence
  Description of Artificial Sequence: Synthetic oligonucleotide
  Target: FXN; (+) strand; PAM type: NRG; PAM sequence: GAG
gtggttgtaagaaagtaaaa

SEQ ID NO: 20243 - DNA, 20 bp, Artificial Sequence
  Description of Artificial Sequence: Synthetic oligonucleotide
  Target: FXN; (+) strand; PAM type: NRG; PAM sequence: CAG
aaatgcccacaaaacgttct

SEQ ID NO: 20244 - DNA, 20 bp, Artificial Sequence
  Description of Artificial Sequence: Synthetic oligonucleotide
  Target: FXN; (+) strand; PAM type: NRG; PAM sequence: CAG
ccacaaaacgttctcagatc

SEQ ID NO: 20245 - DNA, 20 bp, Artificial Sequence
  Description of Artificial Sequence: Synthetic oligonucleotide
  Target: FXN; (+) strand; PAM type: NRG; PAM sequence: TAG
tctcagatccagtcattcat

SEQ ID NO: 20246 - DNA, 20 bp, Artificial Sequence
  Description of Artificial Sequence: Synthetic oligonucleotide
  Target: FXN; (+) strand; PAM type: NRG; PAM sequence: AAG
gtcattcattagcacttcca

SEQ ID NO: 20247 - DNA, 20 bp, Artificial Sequence
  Description of Artificial Sequence: Synthetic oligonucleotide
  Target: FXN; (+) strand; PAM type: NRG; PAM sequence: GAG
cattcattagcacttccaaa

SEQ ID NO: 20248 - DNA, 20 bp, Artificial Sequence
  Description of Artificial Sequence: Synthetic oligonucleotide
  Target: FXN; (+) strand; PAM type: NRG; PAM sequence: GAG
ttcattagcacttccaaaga

SEQ ID NO: 20249 - DNA, 20 bp, Artificial Sequence
  Description of Artificial Sequence: Synthetic oligonucleotide
  Target: FXN; (+) strand; PAM type: NRG; PAM sequence: TGG
agagcatgttgactgtgaat

SEQ ID NO: 20250 - DNA, 20 bp, Artificial Sequence
  Description of Artificial Sequence: Synthetic oligonucleotide
  Target: FXN; (+) strand; PAM type: NRG; PAM sequence: GGG
gagcatgttgactgtgaatt

SEQ ID NO: 20251 - DNA, 20 bp, Artificial Sequence
  Description of Artificial Sequence: Synthetic oligonucleotide
  Target: FXN; (+) strand; PAM type: NRG; PAM sequence: AAG
atgttgactgtgaattggga

SEQ ID NO: 20252 - DNA, 20 bp, Artificial Sequence
  Description of Artificial Sequence: Synthetic oligonucleotide
  Target: FXN; (+) strand; PAM type: NRG; PAM sequence: AGG
tgttgactgtgaattgggaa

SEQ ID NO: 20253 - DNA, 20 bp, Artificial Sequence
  Description of Artificial Sequence: Synthetic oligonucleotide
  Target: FXN; (+) strand; PAM type: NRG; PAM sequence: GGG
gttgactgtgaattgggaaa

SEQ ID NO: 20254 - DNA, 20 bp, Artificial Sequence
  Description of Artificial Sequence: Synthetic oligonucleotide
  Target: FXN; (+) strand; PAM type: NRG; PAM sequence: CAG
actgtgaattgggaaagggc

SEQ ID NO: 20255 - DNA, 20 bp, Artificial Sequence
  Description of Artificial Sequence: Synthetic oligonucleotide
  Target: FXN; (+) strand; PAM type: NRG; PAM sequence: TAG
gggaaagggccagataaaac

SEQ ID NO: 20256 - DNA, 20 bp, Artificial Sequence
  Description of Artificial Sequence: Synthetic oligonucleotide
  Target: FXN; (+) strand; PAM type: NRG; PAM sequence: TAG
agggccagataaaactagca

SEQ ID NO: 20257 - DNA, 20 bp, Artificial Sequence
  Description of Artificial Sequence: Synthetic oligonucleotide
  Target: FXN; (+) strand; PAM type: NRG; PAM sequence: AAG
actagcatagaattctttga

SEQ ID NO: 20258 - DNA, 20 bp, Artificial Sequence
  Description of Artificial Sequence: Synthetic oligonucleotide
  Target: FXN; (+) strand; PAM type: NRG; PAM sequence: CGG
agaattctttgaaagactaa

SEQ ID NO: 20259 - DNA, 20 bp, Artificial Sequence
  Description of Artificial Sequence: Synthetic oligonucleotide
  Target: FXN; (+) strand; PAM type: NRG; PAM sequence: TAG
cctaacattgacatcatttt

SEQ ID NO: 20260 - DNA, 20 bp, Artificial Sequence
  Description of Artificial Sequence: Synthetic oligonucleotide
  Target: FXN; (+) strand; PAM type: NRG; PAM sequence: AGG
ctaacattgacatcattttt

SEQ ID NO: 20261 - DNA, 20 bp, Artificial Sequence
  Description of Artificial Sequence: Synthetic oligonucleotide
  Target: FXN; (+) strand; PAM type: NRG; PAM sequence: CAG
gtgatctctaatgctttgtt

SEQ ID NO: 20262 - DNA, 20 bp, Artificial Sequence
  Description of Artificial Sequence: Synthetic oligonucleotide
  Target: FXN; (+) strand; PAM type: NRG; PAM sequence: TAG
aatgctttgttcagaataaa

SEQ ID NO: 20263 - DNA, 20 bp, Artificial Sequence
  Description of Artificial Sequence: Synthetic oligonucleotide
  Target: FXN; (+) strand; PAM type: NRG; PAM sequence: AAG
ctttccccacactttcatcc

SEQ ID NO: 20264 - DNA, 20 bp, Artificial Sequence
  Description of Artificial Sequence: Synthetic oligonucleotide
  Target: FXN; (+) strand; PAM type: NRG; PAM sequence: AAG
tccccacactttcatccaag

SEQ ID NO: 20265 - DNA, 20 bp, Artificial Sequence
  Description of Artificial Sequence: Synthetic oligonucleotide
  Target: FXN; (+) strand; PAM type: NRG; PAM sequence: TAG
ctttcatccaagaagtgtgc

SEQ ID NO: 20266 - DNA, 20 bp, Artificial Sequence
  Description of Artificial Sequence: Synthetic oligonucleotide
  Target: FXN; (+) strand; PAM type: NRG; PAM sequence: GAG
ttcatccaagaagtgtgcta

SEQ ID NO: 20267 - DNA, 20 bp, Artificial Sequence
  Description of Artificial Sequence: Synthetic oligonucleotide
  Target: FXN; (+) strand; PAM type: NRG; PAM sequence: CAG
gtgctagagttcaacaaaaa

SEQ ID NO: 20268 - DNA, 20 bp, Artificial Sequence
  Description of Artificial Sequence: Synthetic oligonucleotide
  Target: FXN; (+) strand; PAM type: NRG; PAM sequence: TAG
gagttcaacaaaaacagcac

SEQ ID NO: 20269 - DNA, 20 bp, Artificial Sequence
  Description of Artificial Sequence: Synthetic oligonucleotide
  Target: FXN; (+) strand; PAM type: NRG; PAM sequence: TAG
actagaaatcactgtcattc

SEQ ID NO: 20270 - DNA, 20 bp, Artificial Sequence
  Description of Artificial Sequence: Synthetic oligonucleotide
  Target: FXN; (+) strand; PAM type: NRG; PAM sequence: AGG
ctagaaatcactgtcattct

SEQ ID NO: 20271 - DNA, 20 bp, Artificial Sequence
  Description of Artificial Sequence: Synthetic oligonucleotide
  Target: FXN; (+) strand; PAM type: NRG; PAM sequence: AAG
gaaatcactgtcattctagg

SEQ ID NO: 20272 - DNA, 20 bp, Artificial Sequence
  Description of Artificial Sequence: Synthetic oligonucleotide
  Target: FXN; (+) strand; PAM type: NRG; PAM sequence: AGG
aaatcactgtcattctagga

SEQ ID NO: 20273 - DNA, 20 bp, Artificial Sequence
  Description of Artificial Sequence: Synthetic oligonucleotide
  Target: FXN; (+) strand; PAM type: NRG; PAM sequence: CAG
tctaggaaggccctaattca

SEQ ID NO: 20274 - DNA, 20 bp, Artificial Sequence
  Description of Artificial Sequence: Synthetic oligonucleotide
  Target: FXN; (+) strand; PAM type: NRG; PAM sequence: TGG
ccctaattcacagattgtat

SEQ ID NO: 20275 - DNA, 20 bp, Artificial Sequence
  Description of Artificial Sequence: Synthetic oligonucleotide
  Target: FXN; (+) strand; PAM type: NRG; PAM sequence: TAG
tcacagattgtattggtttt

SEQ ID NO: 20276 - DNA, 20 bp, Artificial Sequence
  Description of Artificial Sequence: Synthetic oligonucleotide
  Target: FXN; (+) strand; PAM type: NRG; PAM sequence: CAG
attgtattggtttttagacc

SEQ ID NO: 20277 - DNA, 20 bp, Artificial Sequence
  Description of Artificial Sequence: Synthetic oligonucleotide
  Target: FXN; (+) strand; PAM type: NRG; PAM sequence: TAG
tattggtttttagacccagt

SEQ ID NO: 20278 - DNA, 20 bp, Artificial Sequence
  Description of Artificial Sequence: Synthetic oligonucleotide
  Target: FXN; (+) strand; PAM type: NRG; PAM sequence: TGG
tttagacccagttagtgtgc

SEQ ID NO: 20279 - DNA, 20 bp, Artificial Sequence
  Description of Artificial Sequence: Synthetic oligonucleotide
  Target: FXN; (+) strand; PAM type: NRG; PAM sequence: GAG
tagacccagttagtgtgctg

SEQ ID NO: 20280 - DNA, 20 bp, Artificial Sequence
  Description of Artificial Sequence: Synthetic oligonucleotide
  Target: FXN; (+) strand; PAM type: NRG; PAM sequence: AGG
agacccagttagtgtgctgg

SEQ ID NO: 20281 - DNA, 20 bp, Artificial Sequence
  Description of Artificial Sequence: Synthetic oligonucleotide
  Target: FXN; (+) strand; PAM type: NRG; PAM sequence: TGG
ccagttagtgtgctggaggt

SEQ ID NO: 20282 - DNA, 20 bp, Artificial Sequence
  Description of Artificial Sequence: Synthetic oligonucleotide
  Target: FXN; (+) strand; PAM type: NRG; PAM sequence: GAG
agttagtgtgctggaggttg

SEQ ID NO: 20283 - DNA, 20 bp, Artificial Sequence
  Description of Artificial Sequence: Synthetic oligonucleotide
  Target: FXN; (+) strand; PAM type: NRG; PAM sequence: AGG
gttagtgtgctggaggttgg

SEQ ID NO: 20284 - DNA, 20 bp, Artificial Sequence
  Description of Artificial Sequence: Synthetic oligonucleotide
  Target: FXN; (+) strand; PAM type: NRG; PAM sequence: TGG
ttggaggattttaacctctg

SEQ ID NO: 20285 - DNA, 20 bp, Artificial Sequence
  Description of Artificial Sequence: Synthetic oligonucleotide
  Target: FXN; (+) strand; PAM type: NRG; PAM sequence: GGG
tggaggattttaacctctgt

SEQ ID NO: 20286 - DNA, 20 bp, Artificial Sequence
  Description of Artificial Sequence: Synthetic oligonucleotide
  Target: FXN; (+) strand; PAM type: NRG; PAM sequence: TAG
tttaacctctgtgggccaac

SEQ ID NO: 20287 - DNA, 20 bp, Artificial Sequence
  Description of Artificial Sequence: Synthetic oligonucleotide
  Target: FXN; (+) strand; PAM type: NRG; PAM sequence: TGG
tgtgggccaactagcctctg

SEQ ID NO: 20288 - DNA, 20 bp, Artificial Sequence
  Description of Artificial Sequence: Synthetic oligonucleotide
  Target: FXN; (+) strand; PAM type: NRG; PAM sequence: CAG
ccaactagcctctgtggcct

SEQ ID NO: 20289 - DNA, 20 bp, Artificial Sequence
  Description of Artificial Sequence: Synthetic oligonucleotide
  Target: FXN; (+) strand; PAM type: NRG; PAM sequence: TGG
tcagtcattcttcctgaccc

SEQ ID NO: 20290 - DNA, 20 bp, Artificial Sequence
  Description of Artificial Sequence: Synthetic oligonucleotide
  Target: FXN; (+) strand; PAM type: NRG; PAM sequence: GAG
tcctgaccctggctgtgctt

SEQ ID NO: 20291 - DNA, 20 bp, Artificial Sequence
  Description of Artificial Sequence: Synthetic oligonucleotide
  Target: FXN; (+) strand; PAM type: NRG; PAM sequence: CGG
gtgttcttatccttcatctc

SEQ ID NO: 20292 - DNA, 20 bp, Artificial Sequence
  Description of Artificial Sequence: Synthetic oligonucleotide
  Target: FXN; (+) strand; PAM type: NRG; PAM sequence: GGG
tgttcttatccttcatctcc

SEQ ID NO: 20293 - DNA, 20 bp, Artificial Sequence
  Description of Artificial Sequence: Synthetic oligonucleotide
  Target: FXN; (+) strand; PAM type: NRG; PAM sequence: GGG
gttcttatccttcatctccg

SEQ ID NO: 20294 - DNA, 20 bp, Artificial Sequence
  Description of Artificial Sequence: Synthetic oligonucleotide
  Target: FXN; (+) strand; PAM type: NRG; PAM sequence: GGG
ttcttatccttcatctccgg

SEQ ID NO: 20295 - DNA, 20 bp, Artificial Sequence
  Description of Artificial Sequence: Synthetic oligonucleotide
  Target: FXN; (+) strand; PAM type: NRG; PAM sequence: AAG
ccttcatctccgggggaacg

SEQ ID NO: 20296 - DNA, 20 bp, Artificial Sequence
  Description of Artificial Sequence: Synthetic oligonucleotide
  Target: FXN; (+) strand; PAM type: NRG; PAM sequence: TGG
tcatctccgggggaacgaag

SEQ ID NO: 20297 - DNA, 20 bp, Artificial Sequence
  Description of Artificial Sequence: Synthetic oligonucleotide
  Target: FXN; (+) strand; PAM type: NRG; PAM sequence: CAG
tccgggggaacgaagtggat

SEQ ID NO: 20298 - DNA, 20 bp, Artificial Sequence
  Description of Artificial Sequence: Synthetic oligonucleotide
  Target: FXN; (+) strand; PAM type: NRG; PAM sequence: CGG
gggaacgaagtggatcagct

SEQ ID NO: 20299 - DNA, 20 bp, Artificial Sequence
  Description of Artificial Sequence: Synthetic oligonucleotide
  Target: FXN; (+) strand; PAM type: NRG; PAM sequence: CAG
cgaagtggatcagctcggtc

SEQ ID NO: 20300 - DNA, 20 bp, Artificial Sequence
  Description of Artificial Sequence: Synthetic oligonucleotide
  Target: FXN; (+) strand; PAM type: NRG; PAM sequence: TGG
ctcggtccagcgatcacttt

SEQ ID NO: 20301 - DNA, 20 bp, Artificial Sequence
  Description of Artificial Sequence: Synthetic oligonucleotide
  Target: FXN; (+) strand; PAM type: NRG; PAM sequence: GGG
tcggtccagcgatcactttt

SEQ ID NO: 20302 - DNA, 20 bp, Artificial Sequence
  Description of Artificial Sequence: Synthetic oligonucleotide
  Target: FXN; (+) strand; PAM type: NRG; PAM sequence: GGG
cggtccagcgatcacttttg

SEQ ID NO: 20303 - DNA, 20 bp, Artificial Sequence
  Description of Artificial Sequence: Synthetic oligonucleotide
  Target: FXN; (+) strand; PAM type: NRG; PAM sequence: CAG
cagcgatcacttttggggat

SEQ ID NO: 20304 - DNA, 20 bp, Artificial Sequence
  Description of Artificial Sequence: Synthetic oligonucleotide
  Target: FXN; (+) strand; PAM type: NRG; PAM sequence: TGG
cgatcacttttggggatcag

SEQ ID NO: 20305 - DNA, 20 bp, Artificial Sequence
  Description of Artificial Sequence: Synthetic oligonucleotide
  Target: FXN; (+) strand; PAM type: NRG; PAM sequence: TAG
tttggggatcagtggctttg

SEQ ID NO: 20306 - DNA, 20 bp, Artificial Sequence
  Description of Artificial Sequence: Synthetic oligonucleotide
  Target: FXN; (+) strand; PAM type: NRG; PAM sequence: CGG
atcagtggctttgtagatat

SEQ ID NO: 20307 - DNA, 20 bp, Artificial Sequence
  Description of Artificial Sequence: Synthetic oligonucleotide
  Target: FXN; (+) strand; PAM type: NRG; PAM sequence: GGG
tcagtggctttgtagatatc

SEQ ID NO: 20308 - DNA, 20 bp, Artificial Sequence
  Description of Artificial Sequence: Synthetic oligonucleotide
  Target: FXN; (+) strand; PAM type: NRG; PAM sequence: CAG
gtggctttgtagatatcggg

SEQ ID NO: 20309 - DNA, 20 bp, Artificial Sequence
  Description of Artificial Sequence: Synthetic oligonucleotide
  Target: FXN; (+) strand; PAM type: NRG; PAM sequence: AGG
tggctttgtagatatcgggc

SEQ ID NO: 20310 - DNA, 20 bp, Artificial Sequence
  Description of Artificial Sequence: Synthetic oligonucleotide
  Target: FXN; (+) strand; PAM type: NRG; PAM sequence: AAG
cgggcaggcacttaccccaa

SEQ ID NO: 20311 - DNA, 20 bp, Artificial Sequence
  Description of Artificial Sequence: Synthetic oligonucleotide
  Target: FXN; (+) strand; PAM type: NRG; PAM sequence: AAG
aagaactttccccatatctg

SEQ ID NO: 20312 - DNA, 20 bp, Artificial Sequence
  Description of Artificial Sequence: Synthetic oligonucleotide
  Target: FXN; (+) strand; PAM type: NRG; PAM sequence: TGG
gaaaacgtccatatcgtatt

SEQ ID NO: 20313 - DNA, 20 bp, Artificial Sequence
  Description of Artificial Sequence: Synthetic oligonucleotide
  Target: FXN; (+) strand; PAM type: NRG; PAM sequence: CAG
tcgtatttggacacactgcc

SEQ ID NO: 20314 - DNA, 20 bp, Artificial Sequence
  Description of Artificial Sequence: Synthetic oligonucleotide
  Target: FXN; (+) strand; PAM type: NRG; PAM sequence: TAG
cactgcccagcaatacgctc

SEQ ID NO: 20315 - DNA, 20 bp, Artificial Sequence
  Description of Artificial Sequence: Synthetic oligonucleotide
  Target: FXN; (+) strand; PAM type: NRG; PAM sequence: CAG
caatacgctctagctgtgtt

SEQ ID NO: 20316 - DNA, 20 bp, Artificial Sequence
  Description of Artificial Sequence: Synthetic oligonucleotide
  Target: FXN; (+) strand; PAM type: NRG; PAM sequence: AAG
tacgctctagctgtgttcag

SEQ ID NO: 20317 - DNA, 20 bp, Artificial Sequence
  Description of Artificial Sequence: Synthetic oligonucleotide
  Target: FXN; (+) strand; PAM type: NRG; PAM sequence: TGG
tctagctgtgttcagaagca

SEQ ID NO: 20318 - DNA, 20 bp, Artificial Sequence
  Description of Artificial Sequence: Synthetic oligonucleotide
  Target: FXN; (+) strand; PAM type: NRG; PAM sequence: GGG
ctagctgtgttcagaagcat

SEQ ID NO: 20319 - DNA, 20 bp, Artificial Sequence
  Description of Artificial Sequence: Synthetic oligonucleotide
  Target: FXN; (+) strand; PAM type: NRG; PAM sequence: TGG
tgttcagaagcatgggaatt

SEQ ID NO: 20320 - DNA, 20 bp, Artificial Sequence
  Description of Artificial Sequence: Synthetic oligonucleotide
  Target: FXN; (+) strand; PAM type: NRG; PAM sequence: AAG
cagaagcatgggaatttgga

SEQ ID NO: 20321 - DNA, 20 bp, Artificial Sequence
  Description of Artificial Sequence: Synthetic oligonucleotide
  Target: FXN; (+) strand; PAM type: NRG; PAM sequence: GAG
ggaatttggaaagatctgct

SEQ ID NO: 20322 - DNA, 20 bp, Artificial Sequence
  Description of Artificial Sequence: Synthetic oligonucleotide
  Target: FXN; (+) strand; PAM type: NRG; PAM sequence: CAG
gagcatgccgtttactgtca

SEQ ID NO: 20323 - DNA, 20 bp, Artificial Sequence
  Description of Artificial Sequence: Synthetic oligonucleotide
  Target: FXN; (+) strand; PAM type: NRG; PAM sequence: TGG
aaaaaatatatatatatata

SEQ ID NO: 20324 - DNA, 20 bp, Artificial Sequence
  Description of Artificial Sequence: Synthetic oligonucleotide
  Target: FXN; (+) strand; PAM type: NRG; PAM sequence: GGG
aaaaatatatatatatatat

SEQ ID NO: 20325 - DNA, 20 bp, Artificial Sequence
  Description of Artificial Sequence: Synthetic oligonucleotide
  Target: FXN; (+) strand; PAM type: NRG; PAM sequence: GGG
aaaatatatatatatatatg

SEQ ID NO: 20326 - DNA, 20 bp, Artificial Sequence
  Description of Artificial Sequence: Synthetic oligonucleotide
  Target: FXN; (+) strand; PAM type: NRG; PAM sequence: GGG
aaatatatatatatatatgg

SEQ ID NO: 20327 - DNA, 20 bp, Artificial Sequence
  Description of Artificial Sequence: Synthetic oligonucleotide
  Target: FXN; (+) strand; PAM type: NRG; PAM sequence: CGG
atatatatatatatggggga

SEQ ID NO: 20328 - DNA, 20 bp, Artificial Sequence
  Description of Artificial Sequence: Synthetic oligonucleotide
  Target: FXN; (+) strand; PAM type: NRG; PAM sequence: GGG
tatatatatatatgggggac

SEQ ID NO: 20329 - DNA, 20 bp, Artificial Sequence
  Description of Artificial Sequence: Synthetic oligonucleotide
  Target: FXN; (+) strand; PAM type: NRG; PAM sequence: GGG
atatatatatatgggggacg

SEQ ID NO: 20330 - DNA, 20 bp, Artificial Sequence
  Description of Artificial Sequence: Synthetic oligonucleotide
  Target: FXN; (+) strand; PAM type: NRG; PAM sequence: CAG
tatatatatgggggacgggg

SEQ ID NO: 20331 - DNA, 20 bp, Artificial Sequence
  Description of Artificial Sequence: Synthetic oligonucleotide
  Target: FXN; (+) strand; PAM type: NRG; PAM sequence: AGG
atatatatgggggacggggc

SEQ ID NO: 20332 - DNA, 20 bp, Artificial Sequence
  Description of Artificial Sequence: Synthetic oligonucleotide
  Target: FXN; (+) strand; PAM type: NRG; PAM sequence: GAG
tatgggggacggggcaggtt

SEQ ID NO: 20333 - DNA, 20 bp, Artificial Sequence
  Description of Artificial Sequence: Synthetic oligonucleotide
  Target: FXN; (+) strand; PAM type: NRG; PAM sequence: TGG
gggacggggcaggttgagac

SEQ ID NO: 20334 - DNA, 20 bp, Artificial Sequence
  Description of Artificial Sequence: Synthetic oligonucleotide
  Target: FXN; (+) strand; PAM type: NRG; PAM sequence: GGG
ggacggggcaggttgagact

SEQ ID NO: 20335 - DNA, 20 bp, Artificial Sequence
  Description of Artificial Sequence: Synthetic oligonucleotide
  Target: FXN; (+) strand; PAM type: NRG; PAM sequence: GAG
ggggcaggttgagactgggt

SEQ ID NO: 20336 - DNA, 20 bp, Artificial Sequence
  Description of Artificial Sequence: Synthetic oligonucleotide
  Target: FXN; (+) strand; PAM type: NRG; PAM sequence: AAG
gttgagactgggtgagactg

SEQ ID NO: 20337 - DNA, 20 bp, Artificial Sequence
  Description of Artificial Sequence: Synthetic oligonucleotide
  Target: FXN; (+) strand; PAM type: NRG; PAM sequence: GAG
tgagactgggtgagactgaa

SEQ ID NO: 20338 - DNA, 20 bp, Artificial Sequence
  Description of Artificial Sequence: Synthetic oligonucleotide
  Target: FXN; (+) strand; PAM type: NRG; PAM sequence: AGG
gagactgggtgagactgaag

SEQ ID NO: 20339 - DNA, 20 bp, Artificial Sequence
  Description of Artificial Sequence: Synthetic oligonucleotide
  Target: FXN; (+) strand; PAM type: NRG; PAM sequence: TGG
gtgagactgaagaggtgcct

SEQ ID NO: 20340 - DNA, 20 bp, Artificial Sequence
  Description of Artificial Sequence: Synthetic oligonucleotide
  Target: FXN; (+) strand; PAM type: NRG; PAM sequence: CAG
gactgaagaggtgccttggc

SEQ ID NO: 20341 - DNA, 20 bp, Artificial Sequence
  Description of Artificial Sequence: Synthetic oligonucleotide
  Target: FXN; (+) strand; PAM type: NRG; PAM sequence: GAG
ctgaagaggtgccttggcca

SEQ ID NO: 20342 - DNA, 20 bp, Artificial Sequence
  Description of Artificial Sequence: Synthetic oligonucleotide
  Target: FXN; (+) strand; PAM type: NRG; PAM sequence: CAG
aagaggtgccttggccagag

SEQ ID NO: 20343 - DNA, 20 bp, Artificial Sequence
  Description of Artificial Sequence: Synthetic oligonucleotide
  Target: FXN; (+) strand; PAM type: NRG; PAM sequence: AGG
agaggtgccttggccagagc

SEQ ID NO: 20344 - DNA, 20 bp, Artificial Sequence
  Description of Artificial Sequence: Synthetic oligonucleotide
  Target: FXN; (+) strand; PAM type: NRG; PAM sequence: CAG
tggccagagcaggccacacc

SEQ ID NO: 20345 - DNA, 20 bp, Artificial Sequence
  Description of Artificial Sequence: Synthetic oligonucleotide
  Target: FXN; (+) strand; PAM type: NRG; PAM sequence: GAG
gccagagcaggccacaccca

SEQ ID NO: 20346 - DNA, 20 bp, Artificial Sequence
  Description of Artificial Sequence: Synthetic oligonucleotide
  Target: FXN; (+) strand; PAM type: NRG; PAM sequence: CAG
caggccacacccagagacca

SEQ ID NO: 20347 - DNA, 20 bp, Artificial Sequence
  Description of Artificial Sequence: Synthetic oligonucleotide
  Target: FXN; (+) strand; PAM type: NRG; PAM sequence: AGG
aggccacacccagagaccac

SEQ ID NO: 20348 - DNA, 20 bp, Artificial Sequence
  Description of Artificial Sequence: Synthetic oligonucleotide
  Target: FXN; (+) strand; PAM type: NRG; PAM sequence: CGG
cccagagaccacaggctccc

SEQ ID NO: 20349 - DNA, 20 bp, Artificial Sequence
  Description of Artificial Sequence: Synthetic oligonucleotide
  Target: FXN; (+) strand; PAM type: NRG; PAM sequence: CAG
acaggctccccggtccacct

SEQ ID NO: 20350 - DNA, 20 bp, Artificial Sequence
  Description of Artificial Sequence: Synthetic oligonucleotide
  Target: FXN; (+) strand; PAM type: NRG; PAM sequence: AGG
caggctccccggtccacctc

SEQ ID NO: 20351 - DNA, 20 bp, Artificial Sequence
  Description of Artificial Sequence: Synthetic oligonucleotide
  Target: FXN; (+) strand; PAM type: NRG; PAM sequence: CGG
tccccttcctgcgccgtttc

SEQ ID NO: 20352 - DNA, 20 bp, Artificial Sequence
  Description of Artificial Sequence: Synthetic oligonucleotide
  Target: FXN; (+) strand; PAM type: NRG; PAM sequence: CAG
ccttcctgcgccgtttccgg

SEQ ID NO: 20353 - DNA, 20 bp, Artificial Sequence
  Description of Artificial Sequence: Synthetic oligonucleotide
  Target: FXN; (+) strand; PAM type: NRG; PAM sequence: CAG
tgcgccgtttccggcagatc

SEQ ID NO: 20354 - DNA, 20 bp, Artificial Sequence
  Description of Artificial Sequence: Synthetic oligonucleotide
  Target: FXN; (+) strand; PAM type: NRG; PAM sequence: GAG
cgccgtttccggcagatcca

SEQ ID NO: 20355 - DNA, 20 bp, Artificial Sequence
  Description of Artificial Sequence: Synthetic oligonucleotide
  Target: FXN; (+) strand; PAM type: NRG; PAM sequence: TGG
cgtttccggcagatccagag

SEQ ID NO: 20356 - DNA, 20 bp, Artificial Sequence
  Description of Artificial Sequence: Synthetic oligonucleotide
  Target: FXN; (+) strand; PAM type: NRG; PAM sequence: CGG
agatccagagtggccaccgc

SEQ ID NO: 20357 - DNA, 20 bp, Artificial Sequence
  Description of Artificial Sequence: Synthetic oligonucleotide
  Target: FXN; (+) strand; PAM type: NRG; PAM sequence: TGG
ccagagtggccaccgccgga

SEQ ID NO: 20358 - DNA, 20 bp, Artificial Sequence
  Description of Artificial Sequence: Synthetic oligonucleotide
  Target: FXN; (+) strand; PAM type: NRG; PAM sequence: GGG
cagagtggccaccgccggat

SEQ ID NO: 20359 - DNA, 20 bp, Artificial Sequence
  Description of Artificial Sequence: Synthetic oligonucleotide
  Target: FXN; (+) strand; PAM type: NRG; PAM sequence: GAG
gagtggccaccgccggatgg

SEQ ID NO: 20360 - DNA, 20 bp, Artificial Sequence
  Description of Artificial Sequence: Synthetic oligonucleotide
  Target: FXN; (+) strand; PAM type: NRG; PAM sequence: CGG
ggccaccgccggatgggagt

SEQ ID NO: 20361 - DNA, 20 bp, Artificial Sequence
  Description of Artificial Sequence: Synthetic oligonucleotide
  Target: FXN; (+) strand; PAM type: NRG; PAM sequence: GGG
gccaccgccggatgggagtc

SEQ ID NO: 20362 - DNA, 20 bp, Artificial Sequence
  Description of Artificial Sequence: Synthetic oligonucleotide
  Target: FXN; (+) strand; PAM type: NRG; PAM sequence: GGG
ccaccgccggatgggagtcg

SEQ ID NO: 20363 - DNA, 20 bp, Artificial Sequence
  Description of Artificial Sequence: Synthetic oligonucleotide
  Target: FXN; (+) strand; PAM type: NRG; PAM sequence: GGG
caccgccggatgggagtcgg

SEQ ID NO: 20364 - DNA, 20 bp, Artificial Sequence
  Description of Artificial Sequence: Synthetic oligonucleotide
  Target: FXN; (+) strand; PAM type: NRG; PAM sequence: AAG
cgccggatgggagtcggggg

SEQ ID NO: 20365 - DNA, 20 bp, Artificial Sequence
  Description of Artificial Sequence: Synthetic oligonucleotide
  Target: FXN; (+) strand; PAM type: NRG; PAM sequence: AGG
gccggatgggagtcggggga

SEQ ID NO: 20366 - DNA, 20 bp, Artificial Sequence
  Description of Artificial Sequence: Synthetic oligonucleotide
  Target: FXN; (+) strand; PAM type: NRG; PAM sequence: GGG
ccggatgggagtcgggggaa

SEQ ID NO: 20367 - DNA, 20 bp, Artificial Sequence
  Description of Artificial Sequence: Synthetic oligonucleotide
  Target: FXN; (+) strand; PAM type: NRG; PAM sequence: GAG
ggatgggagtcgggggaagg

SEQ ID NO: 20368 - DNA, 20 bp, Artificial Sequence
  Description of Artificial Sequence: Synthetic oligonucleotide
  Target: FXN; (+) strand; PAM type: NRG; PAM sequence: AGG
gatgggagtcgggggaaggg

SEQ ID NO: 20369 - DNA, 20 bp, Artificial Sequence
  Description of Artificial Sequence: Synthetic oligonucleotide
  Target: FXN; (+) strand; PAM type: NRG; PAM sequence: CAG
gggagtcgggggaagggagg

SEQ ID NO: 20370 - DNA, 20 bp, Artificial Sequence
  Description of Artificial Sequence: Synthetic oligonucleotide
  Target: FXN; (+) strand; PAM type: NRG; PAM sequence: GAG
gagtcgggggaagggaggca

SEQ ID NO: 20371 - DNA, 20 bp, Artificial Sequence
  Description of Artificial Sequence: Synthetic oligonucleotide
  Target: FXN; (+) strand; PAM type: NRG; PAM sequence: AAG
tcgggggaagggaggcagag

SEQ ID NO: 20372 - DNA, 20 bp, Artificial Sequence
  Description of Artificial Sequence: Synthetic oligonucleotide
  Target: FXN; (+) strand; PAM type: NRG; PAM sequence: CGG
ggggaagggaggcagagaag

SEQ ID NO: 20373 - DNA, 20 bp, Artificial Sequence
  Description of Artificial Sequence: Synthetic oligonucleotide
  Target: FXN; (+) strand; PAM type: NRG; PAM sequence: GGG
gggaagggaggcagagaagc

SEQ ID NO: 20374 - DNA, 20 bp, Artificial Sequence
  Description of Artificial Sequence: Synthetic oligonucleotide
  Target: FXN; (+) strand; PAM type: NRG; PAM sequence: GAG
gaggcagagaagcgggccct

SEQ ID NO: 20375 - DNA, 20 bp, Artificial Sequence
  Description of Artificial Sequence: Synthetic oligonucleotide
  Target: FXN; (+) strand; PAM type: NRG; PAM sequence: AGG
aggcagagaagcgggccctg

SEQ ID NO: 20376 - DNA, 20 bp, Artificial Sequence
  Description of Artificial Sequence: Synthetic oligonucleotide
  Target: FXN; (+) strand; PAM type: NRG; PAM sequence: AAG
gagaagcgggccctgaggac

SEQ ID NO: 20377 - DNA, 20 bp, Artificial Sequence
  Description of Artificial Sequence: Synthetic oligonucleotide
  Target: FXN; (+) strand; PAM type: NRG; PAM sequence: CAG
gggccctgaggacaagctct

SEQ ID NO: 20378 - DNA, 20 bp, Artificial Sequence
  Description of Artificial Sequence: Synthetic oligonucleotide
  Target: FXN; (+) strand; PAM type: NRG; PAM sequence: TGG
acaagctctcagtgcttctg

SEQ ID NO: 20379 - DNA, 20 bp, Artificial Sequence
  Description of Artificial Sequence: Synthetic oligonucleotide
  Target: FXN; (+) strand; PAM type: NRG; PAM sequence: GGG
caagctctcagtgcttctgt

SEQ ID NO: 20380 - DNA, 20 bp, Artificial Sequence
  Description of Artificial Sequence: Synthetic oligonucleotide
  Target: FXN; (+) strand; PAM type: NRG; PAM sequence: AAG
gctctcagtgcttctgtggg

SEQ ID NO: 20381 - DNA, 20 bp, Artificial Sequence
  Description of Artificial Sequence: Synthetic oligonucleotide
  Target: FXN; (+) strand; PAM type: NRG; PAM sequence: TGG
ctcagtgcttctgtgggaag

SEQ ID NO: 20382 - DNA, 20 bp, Artificial Sequence
  Description of Artificial Sequence: Synthetic oligonucleotide
  Target: FXN; (+) strand; PAM type: NRG; PAM sequence: CGG
agtgcttctgtgggaagtgg

SEQ ID NO: 20383 - DNA, 20 bp, Artificial Sequence
  Description of Artificial Sequence: Synthetic oligonucleotide
  Target: FXN; (+) strand; PAM type: NRG; PAM sequence: AAG
cttctgtgggaagtggcggc

SEQ ID NO: 20384 - DNA, 20 bp, Artificial Sequence
  Description of Artificial Sequence: Synthetic oligonucleotide
  Target: FXN; (+) strand; PAM type: NRG; PAM sequence: CGG
tgtgggaagtggcggcaaga

SEQ ID NO: 20385 - DNA, 20 bp, Artificial Sequence
  Description of Artificial Sequence: Synthetic oligonucleotide
  Target: FXN; (+) strand; PAM type: NRG; PAM sequence: CAG
gggaagtggcggcaagacgg

SEQ ID NO: 20386 - DNA, 20 bp, Artificial Sequence
  Description of Artificial Sequence: Synthetic oligonucleotide
  Target: FXN; (+) strand; PAM type: NRG; PAM sequence: CAG
ggcggcaagacggcagctcc

SEQ ID NO: 20387 - DNA, 20 bp, Artificial Sequence
  Description of Artificial Sequence: Synthetic oligonucleotide
  Target: FXN; (+) strand; PAM type: NRG; PAM sequence: CGG
ggcaagacggcagctcccag

SEQ ID NO: 20388 - DNA, 20 bp, Artificial Sequence
  Description of Artificial Sequence: Synthetic oligonucleotide
  Target: FXN; (+) strand; PAM type: NRG; PAM sequence: GGG
gcaagacggcagctcccagc

SEQ ID NO: 20389 - DNA, 20 bp, Artificial Sequence
  Description of Artificial Sequence: Synthetic oligonucleotide
  Target: FXN; (+) strand; PAM type: NRG; PAM sequence: GGG
caagacggcagctcccagcg

SEQ ID NO: 20390 - DNA, 20 bp, Artificial Sequence
  Description of Artificial Sequence: Synthetic oligonucleotide
  Target: FXN; (+) strand; PAM type: NRG; PAM sequence: GGG
aagacggcagctcccagcgg

SEQ ID NO: 20391 - DNA, 20 bp, Artificial Sequence
  Description of Artificial Sequence: Synthetic oligonucleotide
  Target: FXN; (+) strand; PAM type: NRG; PAM sequence: TGG
cggcagctcccagcggggga

SEQ ID NO: 20392 - DNA, 20 bp, Artificial Sequence
  Description of Artificial Sequence: Synthetic oligonucleotide
  Target: FXN; (+) strand; PAM type: NRG; PAM sequence: GAG
gcagctcccagcgggggatg

SEQ ID NO: 20393 - DNA, 20 bp, Artificial Sequence
  Description of Artificial Sequence: Synthetic oligonucleotide
  Target: FXN; (+) strand; PAM type: NRG; PAM sequence: AGG
cagctcccagcgggggatgg

SEQ ID NO: 20394 - DNA, 20 bp, Artificial Sequence
  Description of Artificial Sequence: Synthetic oligonucleotide
  Target: FXN; (+) strand; PAM type: NRG; PAM sequence: GAG
cccagcgggggatggaggcc

SEQ ID NO: 20395 - DNA, 20 bp, Artificial Sequence
  Description of Artificial Sequence: Synthetic oligonucleotide
  Target: FXN; (+) strand; PAM type: NRG; PAM sequence: CAG
gcgggggatggaggccgagt

SEQ ID NO: 20396 - DNA, 20 bp, Artificial Sequence
  Description of Artificial Sequence: Synthetic oligonucleotide
  Target: FXN; (+) strand; PAM type: NRG; PAM sequence: TGG
tggaggccgagtcagtctgc

SEQ ID NO: 20397 - DNA, 20 bp, Artificial Sequence
  Description of Artificial Sequence: Synthetic oligonucleotide
  Target: FXN; (+) strand; PAM type: NRG; PAM sequence: TGG
cgagtcagtctgctggtcac

SEQ ID NO: 20398 - DNA, 20 bp, Artificial Sequence
  Description of Artificial Sequence: Synthetic oligonucleotide
  Target: FXN; (+) strand; PAM type: NRG; PAM sequence: GAG
agtcagtctgctggtcactg

SEQ ID NO: 20399 - DNA, 20 bp, Artificial Sequence
  Description of Artificial Sequence: Synthetic oligonucleotide
  Target: FXN; (+) strand; PAM type: NRG; PAM sequence: AGG
gtcagtctgctggtcactgg

SEQ ID NO: 20400 - DNA, 20 bp, Artificial Sequence
  Description of Artificial Sequence: Synthetic oligonucleotide
  Target: FXN; (+) strand; PAM type: NRG; PAM sequence: CAG
gtctgctggtcactggaggc

SEQ ID NO: 20401 - DNA, 20 bp, Artificial Sequence
  Description of Artificial Sequence: Synthetic oligonucleotide
  Target: FXN; (+) strand; PAM type: NRG; PAM sequence: AGG
tctgctggtcactggaggcc

SEQ ID NO: 20402 - DNA, 20 bp, Artificial Sequence
  Description of Artificial Sequence: Synthetic oligonucleotide
  Target: FXN; (+) strand; PAM type: NRG; PAM sequence: CAG
ggccaggatgctgcctaaca

SEQ ID NO: 20403 - DNA, 20 bp, Artificial Sequence
  Description of Artificial Sequence: Synthetic oligonucleotide
  Target: FXN; (+) strand; PAM type: NRG; PAM sequence: CGG
ctaacacagccgtcccgctc

SEQ ID NO: 20404 - DNA, 20 bp, Artificial Sequence
  Description of Artificial Sequence: Synthetic oligonucleotide
  Target: FXN; (+) strand; PAM type: NRG; PAM sequence: GGG
taacacagccgtcccgctcc

SEQ ID NO: 20405 - DNA, 20 bp, Artificial Sequence
  Description of Artificial Sequence: Synthetic oligonucleotide
  Target: FXN; (+) strand; PAM type: NRG; PAM sequence: CAG
cccgctccgggcctcaccac

SEQ ID NO: 20406 - DNA, 20 bp, Artificial Sequence
  Description of Artificial Sequence: Synthetic oligonucleotide
  Target: FXN; (+) strand; PAM type: NRG; PAM sequence: AGG
ccgctccgggcctcaccacc

SEQ ID NO: 20407 - DNA, 20 bp, Artificial Sequence
  Description of Artificial Sequence: Synthetic oligonucleotide
  Target: FXN; (+) strand; PAM type: NRG; PAM sequence: GGG
cgctccgggcctcaccacca

SEQ ID NO: 20408 - DNA, 20 bp, Artificial Sequence
  Description of Artificial Sequence: Synthetic oligonucleotide
  Target: FXN; (+) strand; PAM type: NRG; PAM sequence: CGG
tccgggcctcaccaccaggg

SEQ ID NO: 20409 - DNA, 20 bp, Artificial Sequence
  Description of Artificial Sequence: Synthetic oligonucleotide
  Target: FXN; (+) strand; PAM type: NRG; PAM sequence: CGG
agggcggctctccccactcc

SEQ ID NO: 20410 - DNA, 20 bp, Artificial Sequence
  Description of Artificial Sequence: Synthetic oligonucleotide
  Target: FXN; (+) strand; PAM type: NRG; PAM sequence: CAG
ctcccggcctgctgcccaca

SEQ ID NO: 20411 - DNA, 20 bp, Artificial Sequence
  Description of Artificial Sequence: Synthetic oligonucleotide
  Target: FXN; (+) strand; PAM type: NRG; PAM sequence: CGG
cctgctgcccacacagactg

SEQ ID NO: 20412 - DNA, 20 bp, Artificial Sequence
  Description of Artificial Sequence: Synthetic oligonucleotide
  Target: FXN; (+) strand; PAM type: NRG; PAM sequence: GGG
ctgctgcccacacagactgc

SEQ ID NO: 20413 - DNA, 20 bp, Artificial Sequence
  Description of Artificial Sequence: Synthetic oligonucleotide
  Target: FXN; (+) strand; PAM type: NRG; PAM sequence: GGG
tgctgcccacacagactgcg

SEQ ID NO: 20414 - DNA, 20 bp, Artificial Sequence
  Description of Artificial Sequence: Synthetic oligonucleotide
  Target: FXN; (+) strand; PAM type: NRG; PAM sequence: CGG
ccacacagactgcggggttc

SEQ ID NO: 20415 - DNA, 20 bp, Artificial Sequence
  Description of Artificial Sequence: Synthetic oligonucleotide
  Target: FXN; (+) strand; PAM type: NRG; PAM sequence: GGG
cacacagactgcggggttcc

SEQ ID NO: 20416 - DNA, 20 bp, Artificial Sequence
  Description of Artificial Sequence: Synthetic oligonucleotide
  Target: FXN; (+) strand; PAM type: NRG; PAM sequence: GGG
acacagactgcggggttccg

SEQ ID NO: 20417 - DNA, 20 bp, Artificial Sequence
  Description of Artificial Sequence: Synthetic oligonucleotide
  Target: FXN; (+) strand; PAM type: NRG; PAM sequence: GGG
cacagactgcggggttccgg

SEQ ID NO: 20418 - DNA, 20 bp, Artificial Sequence
  Description of Artificial Sequence: Synthetic oligonucleotide
  Target: FXN; (+) strand; PAM type: NRG; PAM sequence: GAG
cagactgcggggttccgggg

SEQ ID NO: 20419 - DNA, 20 bp, Artificial Sequence
  Description of Artificial Sequence: Synthetic oligonucleotide
  Target: FXN; (+) strand; PAM type: NRG; PAM sequence: CAG
actgcggggttccgggggag

SEQ ID NO: 20420 - DNA, 20 bp, Artificial Sequence
  Description of Artificial Sequence: Synthetic oligonucleotide
  Target: FXN; (+) strand; PAM type: NRG; PAM sequence: AGG
ctgcggggttccgggggagc

SEQ ID NO: 20421 - DNA, 20 bp, Artificial Sequence
  Description of Artificial Sequence: Synthetic oligonucleotide
  Target: FXN; (+) strand; PAM type: NRG; PAM sequence: CAG
ggttccgggggagcaggacc

SEQ ID NO: 20422 - DNA, 20 bp, Artificial Sequence
  Description of Artificial Sequence: Synthetic oligonucleotide
  Target: FXN; (+) strand; PAM type: NRG; PAM sequence: AGG
gttccgggggagcaggaccc

SEQ ID NO: 20423 - DNA, 20 bp, Artificial Sequence
  Description of Artificial Sequence: Synthetic oligonucleotide
  Target: FXN; (+) strand; PAM type: NRG; PAM sequence: TGG
ccgttctgcgcctgtcttct

SEQ ID NO: 20424 - DNA, 20 bp, Artificial Sequence
  Description of Artificial Sequence: Synthetic oligonucleotide
  Target: FXN; (+) strand; PAM type: NRG; PAM sequence: AAG
ttctgcgcctgtcttcttgg

SEQ ID NO: 20425 - DNA, 20 bp, Artificial Sequence
  Description of Artificial Sequence: Synthetic oligonucleotide
  Target: FXN; (+) strand; PAM type: NRG; PAM sequence: AGG
tctgcgcctgtcttcttgga

SEQ ID NO: 20426 - DNA, 20 bp, Artificial Sequence
  Description of Artificial Sequence: Synthetic oligonucleotide
  Target: FXN; (+) strand; PAM type: NRG; PAM sequence: GAG
tgcgcctgtcttcttggaag

SEQ ID NO: 20427 - DNA, 20 bp, Artificial Sequence
  Description of Artificial Sequence: Synthetic oligonucleotide
  Target: FXN; (+) strand; PAM type: NRG; PAM sequence: CAG
gcctgtcttcttggaaggag

SEQ ID NO: 20428 - DNA, 20 bp, Artificial Sequence
  Description of Artificial Sequence: Synthetic oligonucleotide
  Target: FXN; (+) strand; PAM type: NRG; PAM sequence: AGG
cctgtcttcttggaaggagc

SEQ ID NO: 20429 - DNA, 20 bp, Artificial Sequence
  Description of Artificial Sequence: Synthetic oligonucleotide
  Target: FXN; (+) strand; PAM type: NRG; PAM sequence: CGG
tcttcttggaaggagcaggc

SEQ ID NO: 20430 - DNA, 20 bp, Artificial Sequence
  Description of Artificial Sequence: Synthetic oligonucleotide
  Target: FXN; (+) strand; PAM type: NRG; PAM sequence: GAG
ttcttggaaggagcaggccg

SEQ ID NO: 20431 - DNA, 20 bp, Artificial Sequence
  Description of Artificial Sequence: Synthetic oligonucleotide
  Target: FXN; (+) strand; PAM type: NRG; PAM sequence: CGG
ggaaggagcaggccggagcg

SEQ ID NO: 20432 - DNA, 20 bp, Artificial Sequence
  Description of Artificial Sequence: Synthetic oligonucleotide
  Target: FXN; (+) strand; PAM type: NRG; PAM sequence: GGG
gaaggagcaggccggagcgc

SEQ ID NO: 20433 - DNA, 20 bp, Artificial Sequence
  Description of Artificial Sequence: Synthetic oligonucleotide
  Target: FXN; (+) strand; PAM type: NRG; PAM sequence: GAG
aggagcaggccggagcgcgg

SEQ ID NO: 20434 - DNA, 20 bp, Artificial Sequence
  Description of Artificial Sequence: Synthetic oligonucleotide
  Target: FXN; (+) strand; PAM type: NRG; PAM sequence: TAG
cggagcgcgggagcgccgtg

SEQ ID NO: 20435 - DNA, 20 bp, Artificial Sequence
  Description of Artificial Sequence: Synthetic oligonucleotide
  Target: FXN; (+) strand; PAM type: NRG; PAM sequence: AAG
gccgtgtagctgtacctgcg

SEQ ID NO: 20436 - DNA, 20 bp, Artificial Sequence
  Description of Artificial Sequence: Synthetic oligonucleotide
  Target: FXN; (+) strand; PAM type: NRG; PAM sequence: AGG
ccgtgtagctgtacctgcga

SEQ ID NO: 20437 - DNA, 20 bp, Artificial Sequence
  Description of Artificial Sequence: Synthetic oligonucleotide
  Target: FXN; (+) strand; PAM type: NRG; PAM sequence: CAG
tagctgtacctgcgaaggca

SEQ ID NO: 20438 - DNA, 20 bp, Artificial Sequence
  Description of Artificial Sequence: Synthetic oligonucleotide
  Target: FXN; (+) strand; PAM type: NRG; PAM sequence: AGG
agctgtacctgcgaaggcac

SEQ ID NO: 20439 - DNA, 20 bp, Artificial Sequence
  Description of Artificial Sequence: Synthetic oligonucleotide
  Target: FXN; (+) strand; PAM type: NRG; PAM sequence: CGG
tgcgaaggcacaggattccg

SEQ ID NO: 20440 - DNA, 20 bp, Artificial Sequence
  Description of Artificial Sequence: Synthetic oligonucleotide
  Target: FXN; (+) strand; PAM type: NRG; PAM sequence: GGG
gcgaaggcacaggattccgc

SEQ ID NO: 20441 - DNA, 20 bp, Artificial Sequence
  Description of Artificial Sequence: Synthetic oligonucleotide
  Target: FXN; (+) strand; PAM type: NRG; PAM sequence: AAG
aaggcacaggattccgcggg

SEQ ID NO: 20442 - DNA, 20 bp, Artificial Sequence
  Description of Artificial Sequence: Synthetic oligonucleotide
  Target: FXN; (+) strand; PAM type: NRG; PAM sequence: CAG
gattccgcgggaagatcccg

SEQ ID NO: 20443 - DNA, 20 bp, Artificial Sequence
  Description of Artificial Sequence: Synthetic oligonucleotide
  Target: FXN; (+) strand; PAM type: NRG; PAM sequence: CGG
gcgggaagatcccgcagttt

SEQ ID NO: 20444 - DNA, 20 bp, Artificial Sequence
  Description of Artificial Sequence: Synthetic oligonucleotide
  Target: FXN; (+) strand; PAM type: NRG; PAM sequence: GGG
cgggaagatcccgcagtttc

SEQ ID NO: 20445 - DNA, 20 bp, Artificial Sequence
  Description of Artificial Sequence: Synthetic oligonucleotide
  Target: FXN; (+) strand; PAM type: NRG; PAM sequence: TGG
cgtcattgtttttatacctg

SEQ ID NO: 20446 - DNA, 20 bp, Artificial Sequence
  Description of Artificial Sequence: Synthetic oligonucleotide
  Target: FXN; (+) strand; PAM type: NRG; PAM sequence: TGG
gtttttatacctgtggcaaa

SEQ ID NO: 20447 - DNA, 20 bp, Artificial Sequence
  Description of Artificial Sequence: Synthetic oligonucleotide
  Target: FXN; (+) strand; PAM type: NRG; PAM sequence: CAG
cctgtggcaaatggcatgac

SEQ ID NO: 20448 - DNA, 20 bp, Artificial Sequence
  Description of Artificial Sequence: Synthetic oligonucleotide
  Target: FXN; (+) strand; PAM type: NRG; PAM sequence: CGG
aaatggcatgaccagacaca

SEQ ID NO: 20449 - DNA, 20 bp, Artificial Sequence
  Description of Artificial Sequence: Synthetic oligonucleotide
  Target: FXN; (+) strand; PAM type: NRG; PAM sequence: TGG
accagacacacggttatgtc

SEQ ID NO: 20450 - DNA, 20 bp, Artificial Sequence
  Description of Artificial Sequence: Synthetic oligonucleotide
  Target: FXN; (+) strand; PAM type: NRG; PAM sequence: GAG
cagacacacggttatgtctg

SEQ ID NO: 20451 - DNA, 20 bp, Artificial Sequence
  Description of Artificial Sequence: Synthetic oligonucleotide
  Target: FXN; (+) strand; PAM type: NRG; PAM sequence: TAG
tatgtctggagaaacccctg

SEQ ID NO: 20452 - DNA, 20 bp, Artificial Sequence
  Description of Artificial Sequence: Synthetic oligonucleotide
  Target: FXN; (+) strand; PAM type: NRG; PAM sequence: GAG
tgtctggagaaacccctgta

SEQ ID NO: 20453 - DNA, 20 bp, Artificial Sequence
  Description of Artificial Sequence: Synthetic oligonucleotide
  Target: FXN; (+) strand; PAM type: NRG; PAM sequence: AGG
gtctggagaaacccctgtag

SEQ ID NO: 20454 - DNA, 20 bp, Artificial Sequence
  Description of Artificial Sequence: Synthetic oligonucleotide
  Target: FXN; (+) strand; PAM type: NRG; PAM sequence: GAG
ctggagaaacccctgtagag

SEQ ID NO: 20455 - DNA, 20 bp, Artificial Sequence
  Description of Artificial Sequence: Synthetic oligonucleotide
  Target: FXN; (+) strand; PAM type: NRG; PAM sequence: CAG
gagaaacccctgtagaggag

SEQ ID NO: 20456 - DNA, 20 bp, Artificial Sequence
  Description of Artificial Sequence: Synthetic oligonucleotide
  Target: FXN; (+) strand; PAM type: NRG; PAM sequence: AGG
agaaacccctgtagaggagc

SEQ ID NO: 20457 - DNA, 20 bp, Artificial Sequence
  Description of Artificial Sequence: Synthetic oligonucleotide
  Target: FXN; (+) strand; PAM type: NRG; PAM sequence: GAG
aaacccctgtagaggagcag

SEQ ID NO: 20458 - DNA, 20 bp, Artificial Sequence
  Description of Artificial Sequence: Synthetic oligonucleotide
  Target: FXN; (+) strand; PAM type: NRG; PAM sequence: AGG
aacccctgtagaggagcagg

SEQ ID NO: 20459 - DNA, 20 bp, Artificial Sequence
  Description of Artificial Sequence: Synthetic oligonucleotide
  Target: FXN; (+) strand; PAM type: NRG; PAM sequence: TGG
tgtagaggagcaggaggttg

SEQ ID NO: 20460 - DNA, 20 bp, Artificial Sequence
  Description of Artificial Sequence: Synthetic oligonucleotide
  Target: FXN; (+) strand; PAM type: NRG; PAM sequence: TGG
aggaggttgtggacatgctg

SEQ ID NO: 20461 - DNA, 20 bp, Artificial Sequence
  Description of Artificial Sequence: Synthetic oligonucleotide
  Target: FXN; (+) strand; PAM type: NRG; PAM sequence: CGG
gttgtggacatgctgtggcc

SEQ ID NO: 20462 - DNA, 20 bp, Artificial Sequence
  Description of Artificial Sequence: Synthetic oligonucleotide
  Target: FXN; (+) strand; PAM type: NRG; PAM sequence: CAG
tggacatgctgtggcccgga

SEQ ID NO: 20463 - DNA, 20 bp, Artificial Sequence
  Description of Artificial Sequence: Synthetic oligonucleotide
  Target: FXN; (+) strand; PAM type: NRG; PAM sequence: TGG
acatgctgtggcccggacag

SEQ ID NO: 20464 - DNA, 20 bp, Artificial Sequence
  Description of Artificial Sequence: Synthetic oligonucleotide
  Target: FXN; (+) strand; PAM type: NRG; PAM sequence: GAG
tggcccggacagtggctgcc

SEQ ID NO: 20465 - DNA, 20 bp, Artificial Sequence
  Description of Artificial Sequence: Synthetic oligonucleotide
  Target: FXN; (+) strand; PAM type: NRG; PAM sequence: CAG
cccggacagtggctgccgag

SEQ ID NO: 20466 - DNA, 20 bp, Artificial Sequence
  Description of Artificial Sequence: Synthetic oligonucleotide
  Target: FXN; (+) strand; PAM type: NRG; PAM sequence: TGG
gacagtggctgccgagcagt

SEQ ID NO: 20467 - DNA, 20 bp, Artificial Sequence
  Description of Artificial Sequence: Synthetic oligonucleotide
  Target: FXN; (+) strand; PAM type: NRG; PAM sequence: GAG
cagtggctgccgagcagttg

SEQ ID NO: 20468 - DNA, 20 bp, Artificial Sequence
  Description of Artificial Sequence: Synthetic oligonucleotide
  Target: FXN; (+) strand; PAM type: NRG; PAM sequence: TGG
gagcctgcacccgcccaact

SEQ ID NO: 20469 - DNA, 20 bp, Artificial Sequence
  Description of Artificial Sequence: Synthetic oligonucleotide
  Target: FXN; (+) strand; PAM type: NRG; PAM sequence: AAG
gcacccgcccaacttggcta

SEQ ID NO: 20470 - DNA, 20 bp, Artificial Sequence
  Description of Artificial Sequence: Synthetic oligonucleotide
  Target: FXN; (+) strand; PAM type: NRG; PAM sequence: AAG
cccgcccaacttggctaaag

SEQ ID NO: 20471 - DNA, 20 bp, Artificial Sequence
  Description of Artificial Sequence: Synthetic oligonucleotide
  Target: FXN; (+) strand; PAM type: NRG; PAM sequence: TGG
agaagtccccatactctctg

SEQ ID NO: 20472 - DNA, 20 bp, Artificial Sequence
  Description of Artificial Sequence: Synthetic oligonucleotide
  Target: FXN; (+) strand; PAM type: NRG; PAM sequence: AAG
tccccatactctctgtggaa

SEQ ID NO: 20473 - DNA, 20 bp, Artificial Sequence
  Description of Artificial Sequence: Synthetic oligonucleotide
  Target: FXN; (+) strand; PAM type: NRG; PAM sequence: CAG
ctctctgtggaaaagatttc

SEQ ID NO: 20474 - DNA, 20 bp, Artificial Sequence
  Description of Artificial Sequence: Synthetic oligonucleotide
  Target: FXN; (+) strand; PAM type: NRG; PAM sequence: AAG
tctgtggaaaagatttccag

SEQ ID NO: 20475 - DNA, 20 bp, Artificial Sequence
  Description of Artificial Sequence: Synthetic oligonucleotide
  Target: FXN; (+) strand; PAM type: NRG; PAM sequence: AAG
aagctgttgtgtcaatatca

SEQ ID NO: 20476 - DNA, 20 bp, Artificial Sequence
  Description of Artificial Sequence: Synthetic oligonucleotide
  Target: FXN; (+) strand; PAM type: NRG; PAM sequence: AAG
acatgaaattatcaacaata

SEQ ID NO: 20477 - DNA, 20 bp, Artificial Sequence
  Description of Artificial Sequence: Synthetic oligonucleotide
  Target: FXN; (+) strand; PAM type: NRG; PAM sequence: GAG
caacaataaagatcatcctt

SEQ ID NO: 20478 - DNA, 20 bp, Artificial Sequence
  Description of Artificial Sequence: Synthetic oligonucleotide
  Target: FXN; (+) strand; PAM type: NRG; PAM sequence: AAG
atccttgagtctgctttgaa

SEQ ID NO: 20479 - DNA, 20 bp, Artificial Sequence
  Description of Artificial Sequence: Synthetic oligonucleotide
  Target: FXN; (+) strand; PAM type: NRG; PAM sequence: TAG
cttgagtctgctttgaaaag

SEQ ID NO: 20480 - DNA, 20 bp, Artificial Sequence
  Description of Artificial Sequence: Synthetic oligonucleotide
  Target: FXN; (+) strand; PAM type: NRG; PAM sequence: AGG
ttgagtctgctttgaaaagt

SEQ ID NO: 20481 - DNA, 20 bp, Artificial Sequence
  Description of Artificial Sequence: Synthetic oligonucleotide
  Target: FXN; (+) strand; PAM type: NRG; PAM sequence: GGG
tgagtctgctttgaaaagta

SEQ ID NO: 20482 - DNA, 20 bp, Artificial Sequence
  Description of Artificial Sequence: Synthetic oligonucleotide
  Target: FXN; (+) strand; PAM type: NRG; PAM sequence: CAG
aaaagtagggtgaaattctg

SEQ ID NO: 20483 - DNA, 20 bp, Artificial Sequence
  Description of Artificial Sequence: Synthetic oligonucleotide
  Target: FXN; (+) strand; PAM type: NRG; PAM sequence: GAG
aagtagggtgaaattctgca

SEQ ID NO: 20484 - DNA, 20 bp, Artificial Sequence
  Description of Artificial Sequence: Synthetic oligonucleotide
  Target: FXN; (+) strand; PAM type: NRG; PAM sequence: AGG
agtagggtgaaattctgcag

SEQ ID NO: 20485 - DNA, 20 bp, Artificial Sequence
  Description of Artificial Sequence: Synthetic oligonucleotide
  Target: FXN; (+) strand; PAM type: NRG; PAM sequence: TGG
attctgcagaggcattcaac

SEQ ID NO: 20486 - DNA, 20 bp, Artificial Sequence
  Description of Artificial Sequence: Synthetic oligonucleotide
  Target: FXN; (+) strand; PAM type: NRG; PAM sequence: AAG
tgcagaggcattcaactggc

SEQ ID NO: 20487 - DNA, 20 bp, Artificial Sequence
  Description of Artificial Sequence: Synthetic oligonucleotide
  Target: FXN; (+) strand; PAM type: NRG; PAM sequence: TAG
ctggcaagataccaccctca

SEQ ID NO: 20488 - DNA, 20 bp, Artificial Sequence
  Description of Artificial Sequence: Synthetic oligonucleotide
  Target: FXN; (+) strand; PAM type: NRG; PAM sequence: CAG
caagataccaccctcatagc

SEQ ID NO: 20489 - DNA, 20 bp, Artificial Sequence
  Description of Artificial Sequence: Synthetic oligonucleotide
  Target: FXN; (+) strand; PAM type: NRG; PAM sequence: CAG
caccctcatagccagatctg

SEQ ID NO: 20490 - DNA, 20 bp, Artificial Sequence
  Description of Artificial Sequence: Synthetic oligonucleotide
  Target: FXN; (+) strand; PAM type: NRG; PAM sequence: AGG
accctcatagccagatctgc

SEQ ID NO: 20491 - DNA, 20 bp, Artificial Sequence
  Description of Artificial Sequence: Synthetic oligonucleotide
  Target: FXN; (+) strand; PAM type: NRG; PAM sequence: CAG
atagccagatctgcaggtct

SEQ ID NO: 20492 - DNA, 20 bp, Artificial Sequence
  Description of Artificial Sequence: Synthetic oligonucleotide
  Target: FXN; (+) strand; PAM type: NRG; PAM sequence: CAG
gcaggtctcagccatcatgc

SEQ ID NO: 20493 - DNA, 20 bp, Artificial Sequence
  Description of Artificial Sequence: Synthetic oligonucleotide
  Target: FXN; (+) strand; PAM type: NRG; PAM sequence: AGG
caggtctcagccatcatgcc

SEQ ID NO: 20494 - DNA, 20 bp, Artificial Sequence
  Description of Artificial Sequence: Synthetic oligonucleotide
  Target: FXN; (+) strand; PAM type: NRG; PAM sequence: GGG
aggtctcagccatcatgcca

SEQ ID NO: 20495 - DNA, 20 bp, Artificial Sequence
  Description of Artificial Sequence: Synthetic oligonucleotide
  Target: FXN; (+) strand; PAM type: NRG; PAM sequence: CAG
atgctccattcaccactcct

SEQ ID NO: 20496 - DNA, 20 bp, Artificial Sequence
  Description of Artificial Sequence: Synthetic oligonucleotide
  Target: FXN; (+) strand; PAM type: NRG; PAM sequence: TGG
cactcctcagcttctgcttc

SEQ ID NO: 20497 - DNA, 20 bp, Artificial Sequence
  Description of Artificial Sequence: Synthetic oligonucleotide
  Target: FXN; (+) strand; PAM type: NRG; PAM sequence: CAG
tcagcttctgcttctggttt

SEQ ID NO: 20498 - DNA, 20 bp, Artificial Sequence
  Description of Artificial Sequence: Synthetic oligonucleotide
  Target: FXN; (+) strand; PAM type: NRG; PAM sequence: GAG
agcttctgcttctggtttca

SEQ ID NO: 20499 - DNA, 20 bp, Artificial Sequence
  Description of Artificial Sequence: Synthetic oligonucleotide
  Target: FXN; (+) strand; PAM type: NRG; PAM sequence: AGG
gcttctgcttctggtttcag

SEQ ID NO: 20500 - DNA, 20 bp, Artificial Sequence
  Description of Artificial Sequence: Synthetic oligonucleotide
  Target: FXN; (+) strand; PAM type: NRG; PAM sequence: TGG
ggtttcagaggtctctgtat

SEQ ID NO: 20501 - DNA, 20 bp, Artificial Sequence
  Description of Artificial Sequence: Synthetic oligonucleotide
  Target: FXN; (+) strand; PAM type: NRG; PAM sequence: GAG
tttcagaggtctctgtattg

SEQ ID NO: 20502 - DNA, 20 bp, Artificial Sequence
  Description of Artificial Sequence: Synthetic oligonucleotide
  Target: FXN; (+) strand; PAM type: NRG; PAM sequence: AGG
ttcagaggtctctgtattgg

SEQ ID NO: 20503 - DNA, 20 bp, Artificial Sequence
  Description of Artificial Sequence: Synthetic oligonucleotide
  Target: FXN; (+) strand; PAM type: NRG; PAM sequence: GGG
tcagaggtctctgtattgga

SEQ ID NO: 20504 - DNA, 20 bp, Artificial Sequence
  Description of Artificial Sequence: Synthetic oligonucleotide
  Target: FXN; (+) strand; PAM type: NRG; PAM sequence: GGG
cagaggtctctgtattggag

SEQ ID NO: 20505 - DNA, 20 bp, Artificial Sequence
  Description of Artificial Sequence: Synthetic oligonucleotide
  Target: FXN; (+) strand; PAM type: NRG; PAM sequence: AAG
tctgtattggaggggcttta

SEQ ID NO: 20506 - DNA, 20 bp, Artificial Sequence
  Description of Artificial Sequence: Synthetic oligonucleotide
  Target: FXN; (+) strand; PAM type: NRG; PAM sequence: AAG
tattggaggggctttaaagc

SEQ ID NO: 20507 - DNA, 20 bp, Artificial Sequence
  Description of Artificial Sequence: Synthetic oligonucleotide
  Target: FXN; (+) strand; PAM type: NRG; PAM sequence: AAG
tggaggggctttaaagcaag

SEQ ID NO: 20508 - DNA, 20 bp, Artificial Sequence
  Description of Artificial Sequence: Synthetic oligonucleotide
  Target: FXN; (+) strand; PAM type: NRG; PAM sequence: AGG
ggaggggctttaaagcaaga

SEQ ID NO: 20509 - DNA, 20 bp, Artificial Sequence
  Description of Artificial Sequence: Synthetic oligonucleotide
  Target: FXN; (+) strand; PAM type: NRG; PAM sequence: GGG
gaggggctttaaagcaagaa

SEQ ID NO: 20510 - DNA, 20 bp, Artificial Sequence
  Description of Artificial Sequence: Synthetic oligonucleotide
  Target: FXN; (+) strand; PAM type: NRG; PAM sequence: CAG
tacccacttactcttattca

SEQ ID NO: 20511 - DNA, 20 bp, Artificial Sequence
  Description of Artificial Sequence: Synthetic oligonucleotide
  Target: FXN; (+) strand; PAM type: NRG; PAM sequence: CAG
tattcacagatgtgaatatg

SEQ ID NO: 20512 - DNA, 20 bp, Artificial Sequence
  Description of Artificial Sequence: Synthetic oligonucleotide
  Target: FXN; (+) strand; PAM type: NRG; PAM sequence: AGG
attcacagatgtgaatatgc

SEQ ID NO: 20513 - DNA, 20 bp, Artificial Sequence
  Description of Artificial Sequence: Synthetic oligonucleotide
  Target: FXN; (+) strand; PAM type: NRG; PAM sequence: CAG
cagatgtgaatatgcaggtc

SEQ ID NO: 20514 - DNA, 20 bp, Artificial Sequence
  Description of Artificial Sequence: Synthetic oligonucleotide
  Target: FXN; (+) strand; PAM type: NRG; PAM sequence: TGG
atgtgaatatgcaggtccag

SEQ ID NO: 20515 - DNA, 20 bp, Artificial Sequence
  Description of Artificial Sequence: Synthetic oligonucleotide
  Target: FXN; (+) strand; PAM type: NRG; PAM sequence: GGG
tgtgaatatgcaggtccagt

SEQ ID NO: 20516 - DNA, 20 bp, Artificial Sequence
  Description of Artificial Sequence: Synthetic oligonucleotide
  Target: FXN; (+) strand; PAM type: NRG; PAM sequence: GGG
gtgaatatgcaggtccagtg

SEQ ID NO: 20517 - DNA, 20 bp, Artificial Sequence
  Description of Artificial Sequence: Synthetic oligonucleotide
  Target: FXN; (+) strand; PAM type: NRG; PAM sequence: AAG
atatgcaggtccagtgggga

SEQ ID NO: 20518 - DNA, 20 bp, Artificial Sequence
  Description of Artificial Sequence: Synthetic oligonucleotide
  Target: FXN; (+) strand; PAM type: NRG; PAM sequence: AAG
tggggaaagtgacatgtcct

SEQ ID NO: 20519 - DNA, 20 bp, Artificial Sequence
  Description of Artificial Sequence: Synthetic oligonucleotide
  Target: FXN; (+) strand; PAM type: NRG; PAM sequence: CAG
gaaagtgacatgtcctaagt

SEQ ID NO: 20520 - DNA, 20 bp, Artificial Sequence
  Description of Artificial Sequence: Synthetic oligonucleotide
  Target: FXN; (+) strand; PAM type: NRG; PAM sequence: TAG
tgacatgtcctaagtcagaa

SEQ ID NO: 20521 - DNA, 20 bp, Artificial Sequence
  Description of Artificial Sequence: Synthetic oligonucleotide
  Target: FXN; (+) strand; PAM type: NRG; PAM sequence: GAG
acatgtcctaagtcagaata

SEQ ID NO: 20522 - DNA, 20 bp, Artificial Sequence
  Description of Artificial Sequence: Synthetic oligonucleotide
  Target: FXN; (+) strand; PAM type: NRG; PAM sequence: AAG
taagtcagaatagagtcaac

SEQ ID NO: 20523 - DNA, 20 bp, Artificial Sequence
  Description of Artificial Sequence: Synthetic oligonucleotide
  Target: FXN; (+) strand; PAM type: NRG; PAM sequence: CAG
gaatagagtcaacaagaaaa

SEQ ID NO: 20524 - DNA, 20 bp, Artificial Sequence
  Description of Artificial Sequence: Synthetic oligonucleotide
  Target: FXN; (+) strand; PAM type: NRG; PAM sequence: AGG
aatagagtcaacaagaaaac

SEQ ID NO: 20525 - DNA, 20 bp, Artificial Sequence
  Description of Artificial Sequence: Synthetic oligonucleotide
  Target: FXN; (+) strand; PAM type: NRG; PAM sequence: GGG
atagagtcaacaagaaaaca

SEQ ID NO: 20526 - DNA, 20 bp, Artificial Sequence
  Description of Artificial Sequence: Synthetic oligonucleotide
  Target: FXN; (+) strand; PAM type: NRG; PAM sequence: TAG
aaacagggcccaaaatgact

SEQ ID NO: 20527 - DNA, 20 bp, Artificial Sequence
  Description of Artificial Sequence: Synthetic oligonucleotide
  Target: FXN; (+) strand; PAM type: NRG; PAM sequence: TAG
gcccaaaatgacttagcctc

SEQ ID NO: 20528 - DNA, 20 bp, Artificial Sequence
  Description of Artificial Sequence: Synthetic oligonucleotide
  Target: FXN; (+) strand; PAM type: NRG; PAM sequence: TGG
acttagcctctagtgtataa

SEQ ID NO: 20529 - DNA, 20 bp, Artificial Sequence
  Description of Artificial Sequence: Synthetic oligonucleotide
  Target: FXN; (+) strand; PAM type: NRG; PAM sequence: GGG
cttagcctctagtgtataat

SEQ ID NO: 20530 - DNA, 20 bp, Artificial Sequence
  Description of Artificial Sequence: Synthetic oligonucleotide
  Target: FXN; (+) strand; PAM type: NRG; PAM sequence: GAG
agtgtataatgggcattgat

SEQ ID NO: 20531 - DNA, 20 bp, Artificial Sequence
  Description of Artificial Sequence: Synthetic oligonucleotide
  Target: FXN; (+) strand; PAM type: NRG; PAM sequence: TGG
aatgggcattgatgagctac

SEQ ID NO: 20532 - DNA, 20 bp, Artificial Sequence
  Description of Artificial Sequence: Synthetic oligonucleotide
  Target: FXN; (+) strand; PAM type: NRG; PAM sequence: CAG
ttgatgagctactggaaata

SEQ ID NO: 20533 - DNA, 20 bp, Artificial Sequence
  Description of Artificial Sequence: Synthetic oligonucleotide
  Target: FXN; (+) strand; PAM type: NRG; PAM sequence: GAG
gatgagctactggaaataca

SEQ ID NO: 20534 - DNA, 20 bp, Artificial Sequence
  Description of Artificial Sequence: Synthetic oligonucleotide
  Target: FXN; (+) strand; PAM type: NRG; PAM sequence: AAG
ctactggaaatacagagatg

SEQ ID NO: 20535 - DNA, 20 bp, Artificial Sequence
  Description of Artificial Sequence: Synthetic oligonucleotide
  Target: FXN; (+) strand; PAM type: NRG; PAM sequence: CAG
atacagagatgaagaaaaca

SEQ ID NO: 20536 - DNA, 20 bp, Artificial Sequence
  Description of Artificial Sequence: Synthetic oligonucleotide
  Target: FXN; (+) strand; PAM type: NRG; PAM sequence: AAG
gaaaacacagtcccatcttc

SEQ ID NO: 20537 - DNA, 20 bp, Artificial Sequence
  Description of Artificial Sequence: Synthetic oligonucleotide
  Target: FXN; (+) strand; PAM type: NRG; PAM sequence: AGG
aaaacacagtcccatcttca

SEQ ID NO: 20538 - DNA, 20 bp, Artificial Sequence
  Description of Artificial Sequence: Synthetic oligonucleotide
  Target: FXN; (+) strand; PAM type: NRG; PAM sequence: GAG
aacacagtcccatcttcaag

SEQ ID NO: 20539 - DNA, 20 bp, Artificial Sequence
  Description of Artificial Sequence: Synthetic oligonucleotide
  Target: FXN; (+) strand; PAM type: NRG; PAM sequence: TAG
catcttcaaggagctcaatc

SEQ ID NO: 20540 - DNA, 20 bp, Artificial Sequence
  Description of Artificial Sequence: Synthetic oligonucleotide
  Target: FXN; (+) strand; PAM type: NRG; PAM sequence: AAG
ttcaaggagctcaatctagc

SEQ ID NO: 20541 - DNA, 20 bp, Artificial Sequence
  Description of Artificial Sequence: Synthetic oligonucleotide
  Target: FXN; (+) strand; PAM type: NRG; PAM sequence: AGG
tcaaggagctcaatctagca

SEQ ID NO: 20542 - DNA, 20 bp, Artificial Sequence
  Description of Artificial Sequence: Synthetic oligonucleotide
  Target: FXN; (+) strand; PAM type: NRG; PAM sequence: GGG
caaggagctcaatctagcaa

SEQ ID NO: 20543 - DNA, 20 bp, Artificial Sequence
  Description of Artificial Sequence: Synthetic oligonucleotide
  Target: FXN; (+) strand; PAM type: NRG; PAM sequence: GAG
aggagctcaatctagcaagg

SEQ ID NO: 20544 - DNA, 20 bp, Artificial Sequence
  Description of Artificial Sequence: Synthetic oligonucleotide
  Target: FXN; (+) strand; PAM type: NRG; PAM sequence: CAG
gctcaatctagcaagggaga

SEQ ID NO: 20545 - DNA, 20 bp, Artificial Sequence
  Description of Artificial Sequence: Synthetic oligonucleotide
  Target: FXN; (+) strand; PAM type: NRG; PAM sequence: TAG
caagggagacagactctttg

SEQ ID NO: 20546 - DNA, 20 bp, Artificial Sequence
  Description of Artificial Sequence: Synthetic oligonucleotide
  Target: FXN; (+) strand; PAM type: NRG; PAM sequence: AGG
aagggagacagactctttgt

SEQ ID NO: 20547 - DNA, 20 bp, Artificial Sequence
  Description of Artificial Sequence: Synthetic oligonucleotide
  Target: FXN; (+) strand; PAM type: NRG; PAM sequence: TGG
ggagacagactctttgtagg

SEQ ID NO: 20548 - DNA, 20 bp, Artificial Sequence
  Description of Artificial Sequence: Synthetic oligonucleotide
  Target: FXN; (+) strand; PAM type: NRG; PAM sequence: GGG
gagacagactctttgtaggt

SEQ ID NO: 20549 - DNA, 20 bp, Artificial Sequence
  Description of Artificial Sequence: Synthetic oligonucleotide
  Target: FXN; (+) strand; PAM type: NRG; PAM sequence: CGG
agactctttgtaggtgggac

SEQ ID NO: 20550 - DNA, 20 bp, Artificial Sequence
  Description of Artificial Sequence: Synthetic oligonucleotide
  Target: FXN; (+) strand; PAM type: NRG; PAM sequence: GGG
gactctttgtaggtgggacc

SEQ ID NO: 20551 - DNA, 20 bp, Artificial Sequence
  Description of Artificial Sequence: Synthetic oligonucleotide
  Target: FXN; (+) strand; PAM type: NRG; PAM sequence: CAG
ggtgggaccgggcttccctg

SEQ ID NO: 20552 - DNA, 20 bp, Artificial Sequence
  Description of Artificial Sequence: Synthetic oligonucleotide
  Target: FXN; (+) strand; PAM type: NRG; PAM sequence: CAG
gggaccgggcttccctgcag

SEQ ID NO: 20553 - DNA, 20 bp, Artificial Sequence
  Description of Artificial Sequence: Synthetic oligonucleotide
  Target: FXN; (+) strand; PAM type: NRG; PAM sequence: AAG
accgggcttccctgcagcag

SEQ ID NO: 20554 - DNA, 20 bp, Artificial Sequence
  Description of Artificial Sequence: Synthetic oligonucleotide
  Target: FXN; (+) strand; PAM type: NRG; PAM sequence: AGG
ccgggcttccctgcagcaga

SEQ ID NO: 20555 - DNA, 20 bp, Artificial Sequence
  Description of Artificial Sequence: Synthetic oligonucleotide
  Target: FXN; (+) strand; PAM type: NRG; PAM sequence: AAG
ggcttccctgcagcagaagg

SEQ ID NO: 20556 - DNA, 20 bp, Artificial Sequence
  Description of Artificial Sequence: Synthetic oligonucleotide
  Target: FXN; (+) strand; PAM type: NRG; PAM sequence: TGG
agcagaaggaagcttgaaat

SEQ ID NO: 20557 - DNA, 20 bp, Artificial Sequence
  Description of Artificial Sequence: Synthetic oligonucleotide
  Target: FXN; (+) strand; PAM type: NRG; PAM sequence: GAG
ggaagcttgaaattggtaac

SEQ ID NO: 20558 - DNA, 20 bp, Artificial Sequence
  Description of Artificial Sequence: Synthetic oligonucleotide
  Target: FXN; (+) strand; PAM type: NRG; PAM sequence: CAG
ttgaaattggtaacgagcct

SEQ ID NO: 20559 - DNA, 20 bp, Artificial Sequence
  Description of Artificial Sequence: Synthetic oligonucleotide
  Target: FXN; (+) strand; PAM type: NRG; PAM sequence: AAG
aaattggtaacgagcctcag

SEQ ID NO: 20560 - DNA, 20 bp, Artificial Sequence
  Description of Artificial Sequence: Synthetic oligonucleotide
  Target: FXN; (+) strand; PAM type: NRG; PAM sequence: AGG
aattggtaacgagcctcaga

SEQ ID NO: 20561 - DNA, 20 bp, Artificial Sequence
  Description of Artificial Sequence: Synthetic oligonucleotide
  Target: FXN; (+) strand; PAM type: NRG; PAM sequence: GGG
attggtaacgagcctcagaa

SEQ ID NO: 20562 - DNA, 20 bp, Artificial Sequence
  Description of Artificial Sequence: Synthetic oligonucleotide
  Target: FXN; (+) strand; PAM type: NRG; PAM sequence: CAG
gtaacgagcctcagaaggga

SEQ ID NO: 20563 - DNA, 20 bp, Artificial Sequence
  Description of Artificial Sequence: Synthetic oligonucleotide
  Target: FXN; (+) strand; PAM type: NRG; PAM sequence: GAG
aacgagcctcagaagggaca

SEQ ID NO: 20564 - DNA, 20 bp, Artificial Sequence
  Description of Artificial Sequence: Synthetic oligonucleotide
  Target: FXN; (+) strand; PAM type: NRG; PAM sequence: AGG
acgagcctcagaagggacag

SEQ ID NO: 20565 - DNA, 20 bp, Artificial Sequence
  Description of Artificial Sequence: Synthetic oligonucleotide
  Target: FXN; (+) strand; PAM type: NRG; PAM sequence: CAG
agcctcagaagggacagagg

SEQ ID NO: 20566 - DNA, 20 bp, Artificial Sequence
  Description of Artificial Sequence: Synthetic oligonucleotide
  Target: FXN; (+) strand; PAM type: NRG; PAM sequence: AGG
gcctcagaagggacagaggc

SEQ ID NO: 20567 - DNA, 20 bp, Artificial Sequence
  Description of Artificial Sequence: Synthetic oligonucleotide
  Target: FXN; (+) strand; PAM type: NRG; PAM sequence: GAG
gcaggccaccatgctaccct

SEQ ID NO: 20568 - DNA, 20 bp, Artificial Sequence
  Description of Artificial Sequence: Synthetic oligonucleotide
  Target: FXN; (+) strand; PAM type: NRG; PAM sequence: GAG
aggccaccatgctaccctga

SEQ ID NO: 20569 - DNA, 20 bp, Artificial Sequence
  Description of Artificial Sequence: Synthetic oligonucleotide
  Target: FXN; (+) strand; PAM type: NRG; PAM sequence: AGG
ggccaccatgctaccctgag

SEQ ID NO: 20570 - DNA, 20 bp, Artificial Sequence
  Description of Artificial Sequence: Synthetic oligonucleotide
  Target: FXN; (+) strand; PAM type: NRG; PAM sequence: TGG
taccctgagaggatcgcatg

SEQ ID NO: 20571 - DNA, 20 bp, Artificial Sequence
  Description of Artificial Sequence: Synthetic oligonucleotide
  Target: FXN; (+) strand; PAM type: NRG; PAM sequence: CGG
gagaggatcgcatgtggaca

SEQ ID NO: 20572 - DNA, 20 bp, Artificial Sequence
  Description of Artificial Sequence: Synthetic oligonucleotide
  Target: FXN; (+) strand; PAM type: NRG; PAM sequence: GGG
agaggatcgcatgtggacac

SEQ ID NO: 20573 - DNA, 20 bp, Artificial Sequence
  Description of Artificial Sequence: Synthetic oligonucleotide
  Target: FXN; (+) strand; PAM type: NRG; PAM sequence: GGG
gaggatcgcatgtggacacg

SEQ ID NO: 20574 - DNA, 20 bp, Artificial Sequence
  Description of Artificial Sequence: Synthetic oligonucleotide
  Target: FXN; (+) strand; PAM type: NRG; PAM sequence: TGG
gtggacacggggctatgacc

SEQ ID NO: 20575 - DNA, 20 bp, Artificial Sequence
  Description of Artificial Sequence: Synthetic oligonucleotide
  Target: FXN; (+) strand; PAM type: NRG; PAM sequence: TAG
ctggccctgctttgacccac

SEQ ID NO: 20576 - DNA, 20 bp, Artificial Sequence
  Description of Artificial Sequence: Synthetic oligonucleotide
  Target: FXN; (+) strand; PAM type: NRG; PAM sequence: TAG
ttgacccactagctgtgctg

SEQ ID NO: 20577 - DNA, 20 bp, Artificial Sequence
  Description of Artificial Sequence: Synthetic oligonucleotide
  Target: FXN; (+) strand; PAM type: NRG; PAM sequence: AGG
tgacccactagctgtgctgt

SEQ ID NO: 20578 - DNA, 20 bp, Artificial Sequence
  Description of Artificial Sequence: Synthetic oligonucleotide
  Target: FXN; (+) strand; PAM type: NRG; PAM sequence: GGG
gacccactagctgtgctgta

SEQ ID NO: 20579 - DNA, 20 bp, Artificial Sequence
  Description of Artificial Sequence: Synthetic oligonucleotide
  Target: FXN; (+) strand; PAM type: NRG; PAM sequence: CAG
cactagctgtgctgtagggc

SEQ ID NO: 20580 - DNA, 20 bp, Artificial Sequence
  Description of Artificial Sequence: Synthetic oligonucleotide
  Target: FXN; (+) strand; PAM type: NRG; PAM sequence: AGG
actagctgtgctgtagggcc

SEQ ID NO: 20581 - DNA, 20 bp, Artificial Sequence
  Description of Artificial Sequence: Synthetic oligonucleotide
  Target: FXN; (+) strand; PAM type: NRG; PAM sequence: TGG
agctgtgctgtagggccagg

SEQ ID NO: 20582 - DNA, 20 bp, Artificial Sequence
  Description of Artificial Sequence: Synthetic oligonucleotide
  Target: FXN; (+) strand; PAM type: NRG; PAM sequence: GAG
ctgtgctgtagggccaggtg

SEQ ID NO: 20583 - DNA, 20 bp, Artificial Sequence
  Description of Artificial Sequence: Synthetic oligonucleotide
  Target: FXN; (+) strand; PAM type: NRG; PAM sequence: TGG
ctgtagggccaggtggagcc

SEQ ID NO: 20584 - DNA, 20 bp, Artificial Sequence
  Description of Artificial Sequence: Synthetic oligonucleotide
  Target: FXN; (+) strand; PAM type: NRG; PAM sequence: GAG
gtagggccaggtggagcctg

SEQ ID NO: 20585 - DNA, 20 bp, Artificial Sequence
  Description of Artificial Sequence: Synthetic oligonucleotide
  Target: FXN; (+) strand; PAM type: NRG; PAM sequence: TGG
gggccaggtggagcctggag

SEQ ID NO: 20586 - DNA, 20 bp, Artificial Sequence
  Description of Artificial Sequence: Synthetic oligonucleotide
  Target: FXN; (+) strand; PAM type: NRG; PAM sequence: AAG
agcctggagtggcctgtgct

SEQ ID NO: 20587 - DNA, 20 bp, Artificial Sequence
  Description of Artificial Sequence: Synthetic oligonucleotide
  Target: FXN; (+) strand; PAM type: NRG; PAM sequence: AGG
gcctggagtggcctgtgcta

SEQ ID NO: 20588 - DNA, 20 bp, Artificial Sequence
  Description of Artificial Sequence: Synthetic oligonucleotide
  Target: FXN; (+) strand; PAM type: NRG; PAM sequence: GGG
cctggagtggcctgtgctaa

SEQ ID NO: 20589 - DNA, 20 bp, Artificial Sequence
  Description of Artificial Sequence: Synthetic oligonucleotide
  Target: FXN; (+) strand; PAM type: NRG; PAM sequence: GGG
ctggagtggcctgtgctaag

SEQ ID NO: 20590 - DNA, 20 bp, Artificial Sequence
  Description of Artificial Sequence: Synthetic oligonucleotide
  Target: FXN; (+) strand; PAM type: NRG; PAM sequence: GAG
ctgtgctaaggggctactat

SEQ ID NO: 20591 - DNA, 20 bp, Artificial Sequence
  Description of Artificial Sequence: Synthetic oligonucleotide
  Target: FXN; (+) strand; PAM type: NRG; PAM sequence: AAG
tgagctctttccactccccc

SEQ ID NO: 20592 - DNA, 20 bp, Artificial Sequence
  Description of Artificial Sequence: Synthetic oligonucleotide
  Target: FXN; (+) strand; PAM type: NRG; PAM sequence: AGG
gagctctttccactccccca

SEQ ID NO: 20593 - DNA, 20 bp, Artificial Sequence
  Description of Artificial Sequence: Synthetic oligonucleotide
  Target: FXN; (+) strand; PAM type: NRG; PAM sequence: CAG
aatgtcactttctgtttgca

SEQ ID NO: 20594 - DNA, 20 bp, Artificial Sequence
  Description of Artificial Sequence: Synthetic oligonucleotide
  Target: FXN; (+) strand; PAM type: NRG; PAM sequence: CAG
ttctgtttgcacagcaaaat

SEQ ID NO: 20595 - DNA, 20 bp, Artificial Sequence
  Description of Artificial Sequence: Synthetic oligonucleotide
  Target: FXN; (+) strand; PAM type: NRG; PAM sequence: AGG
tctgtttgcacagcaaaatc

SEQ ID NO: 20596 - DNA, 20 bp, Artificial Sequence
  Description of Artificial Sequence: Synthetic oligonucleotide
  Target: FXN; (+) strand; PAM type: NRG; PAM sequence: GGG
ctgtttgcacagcaaaatca

SEQ ID NO: 20597 - DNA, 20 bp, Artificial Sequence
  Description of Artificial Sequence: Synthetic oligonucleotide
  Target: FXN; (+) strand; PAM type: NRG; PAM sequence: TAG
aaatcagggacacaattttc

SEQ ID NO: 20598 - DNA, 20 bp, Artificial Sequence
  Description of Artificial Sequence: Synthetic oligonucleotide
  Target: FXN; (+) strand; PAM type: NRG; PAM sequence: TGG
ggacacaattttctagaaca

SEQ ID NO: 20599 - DNA, 20 bp, Artificial Sequence
  Description of Artificial Sequence: Synthetic oligonucleotide
  Target: FXN; (+) strand; PAM type: NRG; PAM sequence: GGG
gacacaattttctagaacat

SEQ ID NO: 20600 - DNA, 20 bp, Artificial Sequence
  Description of Artificial Sequence: Synthetic oligonucleotide
  Target: FXN; (+) strand; PAM type: NRG; PAM sequence: GGG
acacaattttctagaacatg

SEQ ID NO: 20601 - DNA, 20 bp, Artificial Sequence
  Description of Artificial Sequence: Synthetic oligonucleotide
  Target: FXN; (+) strand; PAM type: NRG; PAM sequence: CAG
tggggtgcctcccctccccc

SEQ ID NO: 20602 - DNA, 20 bp, Artificial Sequence
  Description of Artificial Sequence: Synthetic oligonucleotide
  Target: FXN; (+) strand; PAM type: NRG; PAM sequence: CAG
ctcccctccccccagcccaa

SEQ ID NO: 20603 - DNA, 20 bp, Artificial Sequence
  Description of Artificial Sequence: Synthetic oligonucleotide
  Target: FXN; (+) strand; PAM type: NRG; PAM sequence: AAG
ccctccccccagcccaacag

SEQ ID NO: 20604 - DNA, 20 bp, Artificial Sequence
  Description of Artificial Sequence: Synthetic oligonucleotide
  Target: FXN; (+) strand; PAM type: NRG; PAM sequence: TGG
agaagttctacaatgactga

SEQ ID NO: 20605 - DNA, 20 bp, Artificial Sequence
  Description of Artificial Sequence: Synthetic oligonucleotide
  Target: FXN; (+) strand; PAM type: NRG; PAM sequence: GGG
gaagttctacaatgactgat

SEQ ID NO: 20606 - DNA, 20 bp, Artificial Sequence
  Description of Artificial Sequence: Synthetic oligonucleotide
  Target: FXN; (+) strand; PAM type: NRG; PAM sequence: GAG
atgggcccttgtttttgttt

SEQ ID NO: 20607 - DNA, 20 bp, Artificial Sequence
  Description of Artificial Sequence: Synthetic oligonucleotide
  Target: FXN; (+) strand; PAM type: NRG; PAM sequence: CGG
gcccttgtttttgtttgaga

SEQ ID NO: 20608 - DNA, 20 bp, Artificial Sequence
  Description of Artificial Sequence: Synthetic oligonucleotide
  Target: FXN; (+) strand; PAM type: NRG; PAM sequence: CAG
gtttgagacggaacacccca

SEQ ID NO: 20609 - DNA, 20 bp, Artificial Sequence
  Description of Artificial Sequence: Synthetic oligonucleotide
  Target: FXN; (+) strand; PAM type: NRG; PAM sequence: AGG
tttgagacggaacaccccac

SEQ ID NO: 20610 - DNA, 20 bp, Artificial Sequence
  Description of Artificial Sequence: Synthetic oligonucleotide
  Target: FXN; (+) strand; PAM type: NRG; PAM sequence: GGG
ttgagacggaacaccccaca

SEQ ID NO: 20611 - DNA, 20 bp, Artificial Sequence
  Description of Artificial Sequence: Synthetic oligonucleotide
  Target: FXN; (+) strand; PAM type: NRG; PAM sequence: GAG
ggaacaccccacagggttcc

SEQ ID NO: 20612 - DNA, 20 bp, Artificial Sequence
  Description of Artificial Sequence: Synthetic oligonucleotide
  Target: FXN; (+) strand; PAM type: NRG; PAM sequence: TGG
acaccccacagggttccgag

SEQ ID NO: 20613 - DNA, 20 bp, Artificial Sequence
  Description of Artificial Sequence: Synthetic oligonucleotide
  Target: FXN; (+) strand; PAM type: NRG; PAM sequence: TGG
gggttccgagtggtgatttg

SEQ ID NO: 20614 - DNA, 20 bp, Artificial Sequence
  Description of Artificial Sequence: Synthetic oligonucleotide
  Target: FXN; (+) strand; PAM type: NRG; PAM sequence: CAG
gagtggtgatttgtggccca

SEQ ID NO: 20615 - DNA, 20 bp, Artificial Sequence
  Description of Artificial Sequence: Synthetic oligonucleotide
  Target: FXN; (+) strand; PAM type: NRG; PAM sequence: AGG
agtggtgatttgtggcccac

SEQ ID NO: 20616 - DNA, 20 bp, Artificial Sequence
  Description of Artificial Sequence: Synthetic oligonucleotide
  Target: FXN; (+) strand; PAM type: NRG; PAM sequence: TGG
atttgtggcccacaggccac

SEQ ID NO: 20617 - DNA, 20 bp, Artificial Sequence
  Description of Artificial Sequence: Synthetic oligonucleotide
  Target: FXN; (+) strand; PAM type: NRG; PAM sequence: AAG
gtggcccacaggccactggc

SEQ ID NO: 20618 - DNA, 20 bp, Artificial Sequence
  Description of Artificial Sequence: Synthetic oligonucleotide
  Target: FXN; (+) strand; PAM type: NRG; PAM sequence: TGG
gcccacaggccactggcaag

SEQ ID NO: 20619 - DNA, 20 bp, Artificial Sequence
  Description of Artificial Sequence: Synthetic oligonucleotide
  Target: FXN; (+) strand; PAM type: NRG; PAM sequence: GAG
ccacaggccactggcaagtg

SEQ ID NO: 20620 - DNA, 20 bp, Artificial Sequence
  Description of Artificial Sequence: Synthetic oligonucleotide
  Target: FXN; (+) strand; PAM type: NRG; PAM sequence: AGG
cacaggccactggcaagtgg

SEQ ID NO: 20621 - DNA, 20 bp, Artificial Sequence
  Description of Artificial Sequence: Synthetic oligonucleotide
  Target: FXN; (+) strand; PAM type: NRG; PAM sequence: CAG
aggccactggcaagtggagg

SEQ ID NO: 20622 - DNA, 20 bp, Artificial Sequence
  Description of Artificial Sequence: Synthetic oligonucleotide
  Target: FXN; (+) strand; PAM type: NRG; PAM sequence: GAG
gccactggcaagtggaggca

SEQ ID NO: 20623 - DNA, 20 bp, Artificial Sequence
  Description of Artificial Sequence: Synthetic oligonucleotide
  Target: FXN; (+) strand; PAM type: NRG; PAM sequence: CAG
ggcaagtggaggcagagctg

SEQ ID NO: 20624 - DNA, 20 bp, Artificial Sequence
  Description of Artificial Sequence: Synthetic oligonucleotide
  Target: FXN; (+) strand; PAM type: NRG; PAM sequence: GAG
caagtggaggcagagctgca

SEQ ID NO: 20625 - DNA, 20 bp, Artificial Sequence
  Description of Artificial Sequence: Synthetic oligonucleotide
  Target: FXN; (+) strand; PAM type: NRG; PAM sequence: CGG
aggcagagctgcagagccct

SEQ ID NO: 20626 - DNA, 20 bp, Artificial Sequence
  Description of Artificial Sequence: Synthetic oligonucleotide
  Target: FXN; (+) strand; PAM type: NRG; PAM sequence: GGG
ggcagagctgcagagccctc

SEQ ID NO: 20627 - DNA, 20 bp, Artificial Sequence
  Description of Artificial Sequence: Synthetic oligonucleotide
  Target: FXN; (+) strand; PAM type: NRG; PAM sequence: GAG
cagagctgcagagccctcgg

SEQ ID NO: 20628 - DNA, 20 bp, Artificial Sequence
  Description of Artificial Sequence: Synthetic oligonucleotide
  Target: FXN; (+) strand; PAM type: NRG; PAM sequence: CAG
tgcagagccctcgggagcca

SEQ ID NO: 20629 - DNA, 20 bp, Artificial Sequence
  Description of Artificial Sequence: Synthetic oligonucleotide
  Target: FXN; (+) strand; PAM type: NRG; PAM sequence: GAG
cagagccctcgggagccaca

SEQ ID NO: 20630 - DNA, 20 bp, Artificial Sequence
  Description of Artificial Sequence: Synthetic oligonucleotide
  Target: FXN; (+) strand; PAM type: NRG; PAM sequence: AGG
agagccctcgggagccacag

SEQ ID NO: 20631 - DNA, 20 bp, Artificial Sequence
  Description of Artificial Sequence: Synthetic oligonucleotide
  Target: FXN; (+) strand; PAM type: NRG; PAM sequence: GGG
gagccctcgggagccacaga

SEQ ID NO: 20632 - DNA, 20 bp, Artificial Sequence
  Description of Artificial Sequence: Synthetic oligonucleotide
  Target: FXN; (+) strand; PAM type: NRG; PAM sequence: TGG
gggagccacagagggcctgc

SEQ ID NO: 20633 - DNA, 20 bp, Artificial Sequence
  Description of Artificial Sequence: Synthetic oligonucleotide
  Target: FXN; (+) strand; PAM type: NRG; PAM sequence: CAG
gccgccacgacatgccaact

SEQ ID NO: 20634 - DNA, 20 bp, Artificial Sequence
  Description of Artificial Sequence: Synthetic oligonucleotide
  Target: FXN; (+) strand; PAM type: NRG; PAM sequence: TGG
catgccaactcagctgctgc

SEQ ID NO: 20635 - DNA, 20 bp, Artificial Sequence
  Description of Artificial Sequence: Synthetic oligonucleotide
  Target: FXN; (+) strand; PAM type: NRG; PAM sequence: TGG
agctgctgctggccctcctg

SEQ ID NO: 20636 - DNA, 20 bp, Artificial Sequence
  Description of Artificial Sequence: Synthetic oligonucleotide
  Target: FXN; (+) strand; PAM type: NRG; PAM sequence: GGG
gctgctgctggccctcctgt

SEQ ID NO: 20637 - DNA, 20 bp, Artificial Sequence
  Description of Artificial Sequence: Synthetic oligonucleotide
  Target: FXN; (+) strand; PAM type: NRG; PAM sequence: CGG
gctgctggccctcctgtggg

SEQ ID NO: 20638 - DNA, 20 bp, Artificial Sequence
  Description of Artificial Sequence: Synthetic oligonucleotide
  Target: FXN; (+) strand; PAM type: NRG; PAM sequence: CAG
gctggccctcctgtgggcgg

SEQ ID NO: 20639 - DNA, 20 bp, Artificial Sequence
  Description of Artificial Sequence: Synthetic oligonucleotide
  Target: FXN; (+) strand; PAM type: NRG; PAM sequence: TAG
cctcctgtgggcggcagtgc

SEQ ID NO: 20640 - DNA, 20 bp, Artificial Sequence
  Description of Artificial Sequence: Synthetic oligonucleotide
  Target: FXN; (+) strand; PAM type: NRG; PAM sequence: CAG
gcggcagtgctagtgatgtg

SEQ ID NO: 20641 - DNA, 20 bp, Artificial Sequence
  Description of Artificial Sequence: Synthetic oligonucleotide
  Target: FXN; (+) strand; PAM type: NRG; PAM sequence: TAG
gctagtgatgtgcagaatct

SEQ ID NO: 20642 - DNA, 20 bp, Artificial Sequence
  Description of Artificial Sequence: Synthetic oligonucleotide
  Target: FXN; (+) strand; PAM type: NRG; PAM sequence: AGG
ctagtgatgtgcagaatctt

SEQ ID NO: 20643 - DNA, 20 bp, Artificial Sequence
  Description of Artificial Sequence: Synthetic oligonucleotide
  Target: FXN; (+) strand; PAM type: NRG; PAM sequence: TAG
gatgtgcagaatcttaggac

SEQ ID NO: 20644 - DNA, 20 bp, Artificial Sequence
  Description of Artificial Sequence: Synthetic oligonucleotide
  Target: FXN; (+) strand; PAM type: NRG; PAM sequence: AAG
agaatcttaggactagtgcc

SEQ ID NO: 20645 - DNA, 20 bp, Artificial Sequence
  Description of Artificial Sequence: Synthetic oligonucleotide
  Target: FXN; (+) strand; PAM type: NRG; PAM sequence: AGG
gaatcttaggactagtgcca

SEQ ID NO: 20646 - DNA, 20 bp, Artificial Sequence
  Description of Artificial Sequence: Synthetic oligonucleotide
  Target: FXN; (+) strand; PAM type: NRG; PAM sequence: TGG
caaggaacctataaataccc

SEQ ID NO: 20647 - DNA, 20 bp, Artificial Sequence
  Description of Artificial Sequence: Synthetic oligonucleotide
  Target: FXN; (+) strand; PAM type: NRG; PAM sequence: GGG
aaggaacctataaataccct

SEQ ID NO: 20648 - DNA, 20 bp, Artificial Sequence
  Description of Artificial Sequence: Synthetic oligonucleotide
  Target: FXN; (+) strand; PAM type: NRG; PAM sequence: CAG
tataaataccctgggtgacc

SEQ ID NO: 20649 - DNA, 20 bp, Artificial Sequence
  Description of Artificial Sequence: Synthetic oligonucleotide
  Target: FXN; (+) strand; PAM type: NRG; PAM sequence: AGG
ataaataccctgggtgaccc

SEQ ID NO: 20650 - DNA, 20 bp, Artificial Sequence
  Description of Artificial Sequence: Synthetic oligonucleotide
  Target: FXN; (+) strand; PAM type: NRG; PAM sequence: TGG
gacccaggcgtgcactgctg

SEQ ID NO: 20651 - DNA, 20 bp, Artificial Sequence
  Description of Artificial Sequence: Synthetic oligonucleotide
  Target: FXN; (+) strand; PAM type: NRG; PAM sequence: TGG
ccaggcgtgcactgctgtgg

SEQ ID NO: 20652 - DNA, 20 bp, Artificial Sequence
  Description of Artificial Sequence: Synthetic oligonucleotide
  Target: FXN; (+) strand; PAM type: NRG; PAM sequence: CAG
cactgctgtggtggccttca

SEQ ID NO: 20653 - DNA, 20 bp, Artificial Sequence
  Description of Artificial Sequence: Synthetic oligonucleotide
  Target: FXN; (+) strand; PAM type: NRG; PAM sequence: CAG
gctgtggtggccttcacagt

SEQ ID NO: 20654 - DNA, 20 bp, Artificial Sequence
  Description of Artificial Sequence: Synthetic oligonucleotide
  Target: FXN; (+) strand; PAM type: NRG; PAM sequence: AAG
gtggtggccttcacagtcag

SEQ ID NO: 20655 - DNA, 20 bp, Artificial Sequence
  Description of Artificial Sequence: Synthetic oligonucleotide
  Target: FXN; (+) strand; PAM type: NRG; PAM sequence: AAG
cttcacagtcagaagatgac

SEQ ID NO: 20656 - DNA, 20 bp, Artificial Sequence
  Description of Artificial Sequence: Synthetic oligonucleotide
  Target: FXN; (+) strand; PAM type: NRG; PAM sequence: GAG
cagtcagaagatgacaagct

SEQ ID NO: 20657 - DNA, 20 bp, Artificial Sequence
  Description of Artificial Sequence: Synthetic oligonucleotide
  Target: FXN; (+) strand; PAM type: NRG; PAM sequence: AAG
tcagaagatgacaagctgag

SEQ ID NO: 20658 - DNA, 20 bp, Artificial Sequence
  Description of Artificial Sequence: Synthetic oligonucleotide
  Target: FXN; (+) strand; PAM type: NRG; PAM sequence: AGG
cagaagatgacaagctgaga

SEQ ID NO: 20659 - DNA, 20 bp, Artificial Sequence
  Description of Artificial Sequence: Synthetic oligonucleotide
  Target: FXN; (+) strand; PAM type: NRG; PAM sequence: GGG
agaagatgacaagctgagaa

SEQ ID NO: 20660 - DNA, 20 bp, Artificial Sequence
  Description of Artificial Sequence: Synthetic oligonucleotide
  Target: FXN; (+) strand; PAM type: NRG; PAM sequence: GGG
gaagatgacaagctgagaag

SEQ ID NO: 20661 - DNA, 20 bp, Artificial Sequence
  Description of Artificial Sequence: Synthetic oligonucleotide
  Target: FXN; (+) strand; PAM type: NRG; PAM sequence: GAG
agatgacaagctgagaaggg

SEQ ID NO: 20662 - DNA, 20 bp, Artificial Sequence
  Description of Artificial Sequence: Synthetic oligonucleotide
  Target: FXN; (+) strand; PAM type: NRG; PAM sequence: CGG
caagctgagaaggggagaat

SEQ ID NO: 20663 - DNA, 20 bp, Artificial Sequence
  Description of Artificial Sequence: Synthetic oligonucleotide
  Target: FXN; (+) strand; PAM type: NRG; PAM sequence: AAG
gagaaggggagaatcggccc

SEQ ID NO: 20664 - DNA, 20 bp, Artificial Sequence
  Description of Artificial Sequence: Synthetic oligonucleotide
  Target: FXN; (+) strand; PAM type: NRG; PAM sequence: AGG
agaaggggagaatcggccca

SEQ ID NO: 20665 - DNA, 20 bp, Artificial Sequence
  Description of Artificial Sequence: Synthetic oligonucleotide
  Target: FXN; (+) strand; PAM type: NRG; PAM sequence: GAG
ggggagaatcggcccaaggt

SEQ ID NO: 20666 - DNA, 20 bp, Artificial Sequence
  Description of Artificial Sequence: Synthetic oligonucleotide
  Target: FXN; (+) strand; PAM type: NRG; PAM sequence: CAG
tcggcccaaggtgagatcca

SEQ ID NO: 20667 - DNA, 20 bp, Artificial Sequence
  Description of Artificial Sequence: Synthetic oligonucleotide
  Target: FXN; (+) strand; PAM type: NRG; PAM sequence: AAG
cccaaggtgagatccacaga

SEQ ID NO: 20668 - DNA, 20 bp, Artificial Sequence
  Description of Artificial Sequence: Synthetic oligonucleotide
  Target: FXN; (+) strand; PAM type: NRG; PAM sequence: AGG
ccaaggtgagatccacagaa

SEQ ID NO: 20669 - DNA, 20 bp, Artificial Sequence
  Description of Artificial Sequence: Synthetic oligonucleotide
  Target: FXN; (+) strand; PAM type: NRG; PAM sequence: CAG
ggtgagatccacagaaaggc

SEQ ID NO: 20670 - DNA, 20 bp, Artificial Sequence
  Description of Artificial Sequence: Synthetic oligonucleotide
  Target: FXN; (+) strand; PAM type: NRG; PAM sequence: AGG
gtgagatccacagaaaggcc

SEQ ID NO: 20671 - DNA, 20 bp, Artificial Sequence
  Description of Artificial Sequence: Synthetic oligonucleotide
  Target: FXN; (+) strand; PAM type: NRG; PAM sequence: GGG
tgagatccacagaaaggcca

SEQ ID NO: 20672 - DNA, 20 bp, Artificial Sequence
  Description of Artificial Sequence: Synthetic oligonucleotide
  Target: FXN; (+) strand; PAM type: NRG; PAM sequence: AAG
tccacagaaaggccagggcc

SEQ ID NO: 20673 - DNA, 20 bp, Artificial Sequence
  Description of Artificial Sequence: Synthetic oligonucleotide
  Target: FXN; (+) strand; PAM type: NRG; PAM sequence: CGG
gaaaggccagggccaagatg

SEQ ID NO: 20674 - DNA, 20 bp, Artificial Sequence
  Description of Artificial Sequence: Synthetic oligonucleotide
  Target: FXN; (+) strand; PAM type: NRG; PAM sequence: CAG
ggccagggccaagatgcggc

SEQ ID NO: 20675 - DNA, 20 bp, Artificial Sequence
  Description of Artificial Sequence: Synthetic oligonucleotide
  Target: FXN; (+) strand; PAM type: NRG; PAM sequence: CAG
ccaagatgcggccagcacct

SEQ ID NO: 20676 - DNA, 20 bp, Artificial Sequence
  Description of Artificial Sequence: Synthetic oligonucleotide
  Target: FXN; (+) strand; PAM type: NRG; PAM sequence: AGG
caagatgcggccagcacctc

SEQ ID NO: 20677 - DNA, 20 bp, Artificial Sequence
  Description of Artificial Sequence: Synthetic oligonucleotide
  Target: FXN; (+) strand; PAM type: NRG; PAM sequence: TGG
atgcggccagcacctcaggc

SEQ ID NO: 20678 - DNA, 20 bp, Artificial Sequence
  Description of Artificial Sequence: Synthetic oligonucleotide
  Target: FXN; (+) strand; PAM type: NRG; PAM sequence: TGG
cggccagcacctcaggctgg

SEQ ID NO: 20679 - DNA, 20 bp, Artificial Sequence
  Description of Artificial Sequence: Synthetic oligonucleotide
  Target: FXN; (+) strand; PAM type: NRG; PAM sequence: TGG
ccagcacctcaggctggtgg

SEQ ID NO: 20680 - DNA, 20 bp, Artificial Sequence
  Description of Artificial Sequence: Synthetic oligonucleotide
  Target: FXN; (+) strand; PAM type: NRG; PAM sequence: CAG
tggtcttacgttgaccatgc

SEQ ID NO: 20681 - DNA, 20 bp, Artificial Sequence
  Description of Artificial Sequence: Synthetic oligonucleotide
  Target: FXN; (+) strand; PAM type: NRG; PAM sequence: GAG
gtcttacgttgaccatgcca

SEQ ID NO: 20682 - DNA, 20 bp, Artificial Sequence
  Description of Artificial Sequence: Synthetic oligonucleotide
  Target: FXN; (+) strand; PAM type: NRG; PAM sequence: AGG
tcttacgttgaccatgccag

SEQ ID NO: 20683 - DNA, 20 bp, Artificial Sequence
  Description of Artificial Sequence: Synthetic oligonucleotide
  Target: FXN; (+) strand; PAM type: NRG; PAM sequence: CAG
acgttgaccatgccagaggc

SEQ ID NO: 20684 - DNA, 20 bp, Artificial Sequence
  Description of Artificial Sequence: Synthetic oligonucleotide
  Target: FXN; (+) strand; PAM type: NRG; PAM sequence: GAG
ttgctccaaaccctctgttc

SEQ ID NO: 20685 - DNA, 20 bp, Artificial Sequence
  Description of Artificial Sequence: Synthetic oligonucleotide
  Target: FXN; (+) strand; PAM type: NRG; PAM sequence: AGG
tgctccaaaccctctgttcg

SEQ ID NO: 20686 - DNA, 20 bp, Artificial Sequence
  Description of Artificial Sequence: Synthetic oligonucleotide
  Target: FXN; (+) strand; PAM type: NRG; PAM sequence: GGG
gctccaaaccctctgttcga

SEQ ID NO: 20687 - DNA, 20 bp, Artificial Sequence
  Description of Artificial Sequence: Synthetic oligonucleotide
  Target: FXN; (+) strand; PAM type: NRG; PAM sequence: GAG
tcgagggttccaaatgaaat

SEQ ID NO: 20688 - DNA, 20 bp, Artificial Sequence
  Description of Artificial Sequence: Synthetic oligonucleotide
  Target: FXN; (+) strand; PAM type: NRG; PAM sequence: CAG
agggttccaaatgaaatgag

SEQ ID NO: 20689 - DNA, 20 bp, Artificial Sequence
  Description of Artificial Sequence: Synthetic oligonucleotide
  Target: FXN; (+) strand; PAM type: NRG; PAM sequence: AGG
gggttccaaatgaaatgagc

SEQ ID NO: 20690 - DNA, 20 bp, Artificial Sequence
  Description of Artificial Sequence: Synthetic oligonucleotide
  Target: FXN; (+) strand; PAM type: NRG; PAM sequence: CAG
aaatgagcaggtcctcgtgt

SEQ ID NO: 20691 - DNA, 20 bp, Artificial Sequence
  Description of Artificial Sequence: Synthetic oligonucleotide
  Target: FXN; (+) strand; PAM type: NRG; PAM sequence: AGG
aatgagcaggtcctcgtgtc

SEQ ID NO: 20692 - DNA, 20 bp, Artificial Sequence
  Description of Artificial Sequence: Synthetic oligonucleotide
  Target: FXN; (+) strand; PAM type: NRG; PAM sequence: TAG
caggtcctcgtgtcaggacc

SEQ ID NO: 20693 - DNA, 20 bp, Artificial Sequence
  Description of Artificial Sequence: Synthetic oligonucleotide
  Target: FXN; (+) strand; PAM type: NRG; PAM sequence: AGG
aggtcctcgtgtcaggacct

SEQ ID NO: 20694 - DNA, 20 bp, Artificial Sequence
  Description of Artificial Sequence: Synthetic oligonucleotide
  Target: FXN; (+) strand; PAM type: NRG; PAM sequence: TAG
cctcgtgtcaggacctaggt

SEQ ID NO: 20695 - DNA, 20 bp, Artificial Sequence
  Description of Artificial Sequence: Synthetic oligonucleotide
  Target: FXN; (+) strand; PAM type: NRG; PAM sequence: AAG
acctaggttagtttctgaaa

SEQ ID NO: 20696 - DNA, 20 bp, Artificial Sequence
  Description of Artificial Sequence: Synthetic oligonucleotide
  Target: FXN; (+) strand; PAM type: NRG; PAM sequence: AAG
agtttctgaaaaagcatgaa

SEQ ID NO: 20697 - DNA, 20 bp, Artificial Sequence
  Description of Artificial Sequence: Synthetic oligonucleotide
  Target: FXN; (+) strand; PAM type: NRG; PAM sequence: CAG
ttctgaaaaagcatgaaaag

SEQ ID NO: 20698 - DNA, 20 bp, Artificial Sequence
  Description of Artificial Sequence: Synthetic oligonucleotide
  Target: FXN; (+) strand; PAM type: NRG; PAM sequence: AGG
tctgaaaaagcatgaaaagc

SEQ ID NO: 20699 - DNA, 20 bp, Artificial Sequence
  Description of Artificial Sequence: Synthetic oligonucleotide
  Target: FXN; (+) strand; PAM type: NRG; PAM sequence: GAG
caggcctcctgaacttcccc

SEQ ID NO: 20700 - DNA, 20 bp, Artificial Sequence
  Description of Artificial Sequence: Synthetic oligonucleotide
  Target: FXN; (+) strand; PAM type: NRG; PAM sequence: AAG
ttccccgagtgactgatgca

SEQ ID NO: 20701 - DNA, 20 bp, Artificial Sequence
  Description of Artificial Sequence: Synthetic oligonucleotide
  Target: FXN; (+) strand; PAM type: NRG; PAM sequence: CAG
agtgcgtcctgcatgcttca

SEQ ID NO: 20702 - DNA, 20 bp, Artificial Sequence
  Description of Artificial Sequence: Synthetic oligonucleotide
  Target: FXN; (+) strand; PAM type: NRG; PAM sequence: TGG
ctgcatgcttcacagcacca

SEQ ID NO: 20703 - DNA, 20 bp, Artificial Sequence
  Description of Artificial Sequence: Synthetic oligonucleotide
  Target: FXN; (+) strand; PAM type: NRG; PAM sequence: GAG
gcatgcttcacagcaccatg

SEQ ID NO: 20704 - DNA, 20 bp, Artificial Sequence
  Description of Artificial Sequence: Synthetic oligonucleotide
  Target: FXN; (+) strand; PAM type: NRG; PAM sequence: GAG
atgcttcacagcaccatgga

SEQ ID NO: 20705 - DNA, 20 bp, Artificial Sequence
  Description of Artificial Sequence: Synthetic oligonucleotide
  Target: FXN; (+) strand; PAM type: NRG; PAM sequence: AGG
tgcttcacagcaccatggag

SEQ ID NO: 20706 - DNA, 20 bp, Artificial Sequence
  Description of Artificial Sequence: Synthetic oligonucleotide
  Target: FXN; (+) strand; PAM type: NRG; PAM sequence: CAG
agcaccatggagaggatctt

SEQ ID NO: 20707 - DNA, 20 bp, Artificial Sequence
  Description of Artificial Sequence: Synthetic oligonucleotide
  Target: FXN; (+) strand; PAM type: NRG; PAM sequence: AGG
gcaccatggagaggatcttc

SEQ ID NO: 20708 - DNA, 20 bp, Artificial Sequence
  Description of Artificial Sequence: Synthetic oligonucleotide
  Target: FXN; (+) strand; PAM type: NRG; PAM sequence: GGG
caccatggagaggatcttca

SEQ ID NO: 20709 - DNA, 20 bp, Artificial Sequence
  Description of Artificial Sequence: Synthetic oligonucleotide
  Target: FXN; (+) strand; PAM type: NRG; PAM sequence: GGG
accatggagaggatcttcag

SEQ ID NO: 20710 - DNA, 20 bp, Artificial Sequence
  Description of Artificial Sequence: Synthetic oligonucleotide
  Target: FXN; (+) strand; PAM type: NRG; PAM sequence: CAG
ggatcttcaggggcaaactg

SEQ ID NO: 20711 - DNA, 20 bp, Artificial Sequence
  Description of Artificial Sequence: Synthetic oligonucleotide
  Target: FXN; (+) strand; PAM type: NRG; PAM sequence: CGG
actgcagactatctgaatga

SEQ ID NO: 20712 - DNA, 20 bp, Artificial Sequence
  Description of Artificial Sequence: Synthetic oligonucleotide
  Target: FXN; (+) strand; PAM type: NRG; PAM sequence: CAG
tgaatgacggcactgaccat

SEQ ID NO: 20713 - DNA, 20 bp, Artificial Sequence
  Description of Artificial Sequence: Synthetic oligonucleotide
  Target: FXN; (+) strand; PAM type: NRG; PAM sequence: CAG
cactgaccatcagcaaaccg

SEQ ID NO: 20714 - DNA, 20 bp, Artificial Sequence
  Description of Artificial Sequence: Synthetic oligonucleotide
  Target: FXN; (+) strand; PAM type: NRG; PAM sequence: GAG
ctgaccatcagcaaaccgca

SEQ ID NO: 20715 - DNA, 20 bp, Artificial Sequence
  Description of Artificial Sequence: Synthetic oligonucleotide
  Target: FXN; (+) strand; PAM type: NRG; PAM sequence: AAG
aaccgcagagctgcctgacc

SEQ ID NO: 20716 - DNA, 20 bp, Artificial Sequence
  Description of Artificial Sequence: Synthetic oligonucleotide
  Target: FXN; (+) strand; PAM type: NRG; PAM sequence: GAG
ctgcctgaccaagaaattgc

SEQ ID NO: 20717 - DNA, 20 bp, Artificial Sequence
  Description of Artificial Sequence: Synthetic oligonucleotide
  Target: FXN; (+) strand; PAM type: NRG; PAM sequence: CAG
ctgaccaagaaattgcgaga

SEQ ID NO: 20718 - DNA, 20 bp, Artificial Sequence
  Description of Artificial Sequence: Synthetic oligonucleotide
  Target: FXN; (+) strand; PAM type: NRG; PAM sequence: AAG
accaagaaattgcgagacag

SEQ ID NO: 20719 - DNA, 20 bp, Artificial Sequence
  Description of Artificial Sequence: Synthetic oligonucleotide
  Target: FXN; (+) strand; PAM type: NRG; PAM sequence: CAG
cgagacagaagcaatgcttg

SEQ ID NO: 20720 - DNA, 20 bp, Artificial Sequence
  Description of Artificial Sequence: Synthetic oligonucleotide
  Target: FXN; (+) strand; PAM type: NRG; PAM sequence: AGG
gagacagaagcaatgcttgc

SEQ ID NO: 20721 - DNA, 20 bp, Artificial Sequence
  Description of Artificial Sequence: Synthetic oligonucleotide
  Target: FXN; (+) strand; PAM type: NRG; PAM sequence: AAG
agaagcaatgcttgcaggcg

SEQ ID NO: 20722 - DNA, 20 bp, Artificial Sequence
  Description of Artificial Sequence: Synthetic oligonucleotide
  Target: FXN; (+) strand; PAM type: NRG; PAM sequence: AAG
agcaatgcttgcaggcgaag

SEQ ID NO: 20723 - DNA, 20 bp, Artificial Sequence
  Description of Artificial Sequence: Synthetic oligonucleotide
  Target: FXN; (+) strand; PAM type: NRG; PAM sequence: AAG
aatgcttgcaggcgaagaag

SEQ ID NO: 20724 - DNA, 20 bp, Artificial Sequence
  Description of Artificial Sequence: Synthetic oligonucleotide
  Target: FXN; (+) strand; PAM type: NRG; PAM sequence: AGG
atgcttgcaggcgaagaaga

SEQ ID NO: 20725 - DNA, 20 bp, Artificial Sequence
  Description of Artificial Sequence: Synthetic oligonucleotide
  Target: FXN; (+) strand; PAM type: NRG; PAM sequence: GGG
tgcttgcaggcgaagaagaa

SEQ ID NO: 20726 - DNA, 20 bp, Artificial Sequence
  Description of Artificial Sequence: Synthetic oligonucleotide
  Target: FXN; (+) strand; PAM type: NRG; PAM sequence: GGG
gcttgcaggcgaagaagaag

SEQ ID NO: 20727 - DNA, 20 bp, Artificial Sequence
  Description of Artificial Sequence: Synthetic oligonucleotide
  Target: FXN; (+) strand; PAM type: NRG; PAM sequence: CAG
gcaggcgaagaagaaggggc

SEQ ID NO: 20728 - DNA, 20 bp, Artificial Sequence
  Description of Artificial Sequence: Synthetic oligonucleotide
  Target: FXN; (+) strand; PAM type: NRG; PAM sequence: CAG
gaagaagaaggggccagaca

SEQ ID NO: 20729 - DNA, 20 bp, Artificial Sequence
  Description of Artificial Sequence: Synthetic oligonucleotide
  Target: FXN; (+) strand; PAM type: NRG; PAM sequence: TGG
gaagaaggggccagacacag

SEQ ID NO: 20730 - DNA, 20 bp, Artificial Sequence
  Description of Artificial Sequence: Synthetic oligonucleotide
  Target: FXN; (+) strand; PAM type: NRG; PAM sequence: CAG
gtggctcacgcctgtaatcc

SEQ ID NO: 20731 - DNA, 20 bp, Artificial Sequence
  Description of Artificial Sequence: Synthetic oligonucleotide
  Target: FXN; (+) strand; PAM type: NRG; PAM sequence: TGG
cgcctgtaatcccagcactt

SEQ ID NO: 20732 - DNA, 20 bp, Artificial Sequence
  Description of Artificial Sequence: Synthetic oligonucleotide
  Target: FXN; (+) strand; PAM type: NRG; PAM sequence: GGG
gcctgtaatcccagcacttt

SEQ ID NO: 20733 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttgg

SEQ ID NO: 20734 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttggg

SEQ ID NO: 20735 - DNA, 20 bp, Artificial Sequence
  Description of Artificial Sequence: Synthetic oligonucleotide
  Target: FXN; (+) strand; PAM type: NRG; PAM sequence: AAG
tcccagcactttgggaggcc

SEQ ID NO: 20736 - DNA, 20 bp, Artificial Sequence
  Description of Artificial Sequence: Synthetic oligonucleotide
  Target: FXN; (+) strand; PAM type: NRG; PAM sequence: AGG
cccagcactttgggaggcca

SEQ ID NO: 20737 - DNA, 20 bp, Artificial Sequence
  Description of Artificial Sequence: Synthetic oligonucleotide
  Target: FXN; (+) strand; PAM type: NRG; PAM sequence: CAG
agcactttgggaggccaagg

SEQ ID NO: 20738 - DNA, 20 bp, Artificial Sequence
  Description of Artificial Sequence: Synthetic oligonucleotide
  Target: FXN; (+) strand; PAM type: NRG; PAM sequence: AGG
gcactttgggaggccaaggc

SEQ ID NO: 20739 - DNA, 20 bp, Artificial Sequence
  Description of Artificial Sequence: Synthetic oligonucleotide
  Target: FXN; (+) strand; PAM type: NRG; PAM sequence: CGG
ctttgggaggccaaggcagg

SEQ ID NO: 20740 - DNA, 20 bp, Artificial Sequence
  Description of Artificial Sequence: Synthetic oligonucleotide
  Target: FXN; (+) strand; PAM type: NRG; PAM sequence: GAG
ccaaggcaggcggatcactt

SEQ ID NO: 20741 - DNA, 20 bp, Artificial Sequence
  Description of Artificial Sequence: Synthetic oligonucleotide
  Target: FXN; (+) strand; PAM type: NRG; PAM sequence: AGG
caaggcaggcggatcacttg

SEQ ID NO: 20742 - DNA, 20 bp, Artificial Sequence
  Description of Artificial Sequence: Synthetic oligonucleotide
  Target: FXN; (+) strand; PAM type: NRG; PAM sequence: CAG
gcaggcggatcacttgaggt

SEQ ID NO: 20743 - DNA, 20 bp, Artificial Sequence
  Description of Artificial Sequence: Synthetic oligonucleotide
  Target: FXN; (+) strand; PAM type: NRG; PAM sequence: AGG
caggcggatcacttgaggtc

SEQ ID NO: 20744 - DNA, 20 bp, Artificial Sequence
  Description of Artificial Sequence: Synthetic oligonucleotide
  Target: FXN; (+) strand; PAM type: NRG; PAM sequence: GAG
ggcggatcacttgaggtcag

SEQ ID NO: 20745 - DNA, 20 bp, Artificial Sequence
  Description of Artificial Sequence: Synthetic oligonucleotide
  Target: FXN; (+) strand; PAM type: NRG; PAM sequence: GAG
tcacttgaggtcaggagttt

SEQ ID NO: 20746 - DNA, 20 bp, Artificial Sequence
  Description of Artificial Sequence: Synthetic oligonucleotide
  Target: FXN; (+) strand; PAM type: NRG; PAM sequence: CAG
tgaggtcaggagtttgagac

SEQ ID NO: 20747 - DNA, 20 bp, Artificial Sequence
  Description of Artificial Sequence: Synthetic oligonucleotide
  Target: FXN; (+) strand; PAM type: NRG; PAM sequence: TGG
tcaggagtttgagaccagcc

SEQ ID NO: 20748 - DNA, 20 bp, Artificial Sequence
  Description of Artificial Sequence: Synthetic oligonucleotide
  Target: FXN; (+) strand; PAM type: NRG; PAM sequence: GGG
caggagtttgagaccagcct

SEQ ID NO: 20749 - DNA, 20 bp, Artificial Sequence
  Description of Artificial Sequence: Synthetic oligonucleotide
  Target: FXN; (+) strand; PAM type: NRG; PAM sequence: TAG
tgagaccagcctgggcaaca

SEQ ID NO: 20750 - DNA, 20 bp, Artificial Sequence
  Description of Artificial Sequence: Synthetic oligonucleotide
  Target: FXN; (+) strand; PAM type: NRG; PAM sequence: CAG
taaaaatacaaaaaattcgc

SEQ ID NO: 20751 - DNA, 20 bp, Artificial Sequence
  Description of Artificial Sequence: Synthetic oligonucleotide
  Target: FXN; (+) strand; PAM type: NRG; PAM sequence: AGG
aaaaatacaaaaaattcgcc

SEQ ID NO: 20752 - DNA, 20 bp, Artificial Sequence
  Description of Artificial Sequence: Synthetic oligonucleotide
  Target: FXN; (+) strand; PAM type: NRG; PAM sequence: TGG
tacaaaaaattcgccaggca

SEQ ID NO: 20753 - DNA, 20 bp, Artificial Sequence
  Description of Artificial Sequence: Synthetic oligonucleotide
  Target: FXN; (+) strand; PAM type: NRG; PAM sequence: TGG
aaaaaattcgccaggcatgg

SEQ ID NO: 20754 - DNA, 20 bp, Artificial Sequence
  Description of Artificial Sequence: Synthetic oligonucleotide
  Target: FXN; (+) strand; PAM type: NRG; PAM sequence: CAG
aaattcgccaggcatggtgg

SEQ ID NO: 20755 - DNA, 20 bp, Artificial Sequence
  Description of Artificial Sequence: Synthetic oligonucleotide
  Target: FXN; (+) strand; PAM type: NRG; PAM sequence: AGG
aattcgccaggcatggtggc

SEQ ID NO: 20756 - DNA, 20 bp, Artificial Sequence
  Description of Artificial Sequence: Synthetic oligonucleotide
  Target: FXN; (+) strand; PAM type: NRG; PAM sequence: CAG
gtggcaggcacctgtaatcc

SEQ ID NO: 20757 - DNA, 20 bp, Artificial Sequence
  Description of Artificial Sequence: Synthetic oligonucleotide
  Target: FXN; (+) strand; PAM type: NRG; PAM sequence: TGG
cacctgtaatcccagctgct

SEQ ID NO: 20758 - DNA, 20 bp, Artificial Sequence
  Description of Artificial Sequence: Synthetic oligonucleotide
  Target: FXN; (+) strand; PAM type: NRG; PAM sequence: GGG
acctgtaatcccagctgctt

SEQ ID NO: 20759 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagctgcttgg

SEQ ID NO: 20760 - DNA, 20 bp, Artificial Sequence
  Description of Artificial Sequence: Synthetic oligonucleotide
  Target: FXN; (+) strand; PAM type: NRG; PAM sequence: GAG
tcccagctgcttgggagact

SEQ ID NO: 20761 - DNA, 20 bp, Artificial Sequence
  Description of Artificial Sequence: Synthetic oligonucleotide
  Target: FXN; (+) strand; PAM type: NRG; PAM sequence: CAG
agctgcttgggagactgaga

SEQ ID NO: 20762 - DNA, 20 bp, Artificial Sequence
  Description of Artificial Sequence: Synthetic oligonucleotide
  Target: FXN; (+) strand; PAM type: NRG; PAM sequence: AGG
gctgcttgggagactgagac

SEQ ID NO: 20763 - DNA, 20 bp, Artificial Sequence
  Description of Artificial Sequence: Synthetic oligonucleotide
  Target: FXN; (+) strand; PAM type: NRG; PAM sequence: GAG
tgcttgggagactgagacag

SEQ ID NO: 20764 - DNA, 20 bp, Artificial Sequence
  Description of Artificial Sequence: Synthetic oligonucleotide
  Target: FXN; (+) strand; PAM type: NRG; PAM sequence: CAG
acaggagaattgcttgaacc

SEQ ID NO: 20765 - DNA, 20 bp, Artificial Sequence
  Description of Artificial Sequence: Synthetic oligonucleotide
  Target: FXN; (+) strand; PAM type: NRG; PAM sequence: AGG
caggagaattgcttgaaccc

SEQ ID NO: 20766 - DNA, 20 bp, Artificial Sequence
  Description of Artificial Sequence: Synthetic oligonucleotide
  Target: FXN; (+) strand; PAM type: NRG; PAM sequence: GAG
ggagaattgcttgaacccag

SEQ ID NO: 20767 - DNA, 20 bp, Artificial Sequence
  Description of Artificial Sequence: Synthetic oligonucleotide
  Target: FXN; (+) strand; PAM type: NRG; PAM sequence: AGG
gagaattgcttgaacccagg

SEQ ID NO: 20768 - DNA, 20 bp, Artificial Sequence
  Description of Artificial Sequence: Synthetic oligonucleotide
  Target: FXN; (+) strand; PAM type: NRG; PAM sequence: AAG
ttgcttgaacccaggaggcg

SEQ ID NO: 20769 - DNA, 20 bp, Artificial Sequence
  Description of Artificial Sequence: Synthetic oligonucleotide
  Target: FXN; (+) strand; PAM type: NRG; PAM sequence: AGG
tgcttgaacccaggaggcga

SEQ ID NO: 20770 - DNA, 20 bp, Artificial Sequence
  Description of Artificial Sequence: Synthetic oligonucleotide
  Target: FXN; (+) strand; PAM type: NRG; PAM sequence: CAG
aacgaactgaaatcgtgcca

SEQ ID NO: 20771 - DNA, 20 bp, Artificial Sequence
  Description of Artificial Sequence: Synthetic oligonucleotide
  Target: FXN; (+) strand; PAM type: NRG; PAM sequence: TGG
cgtgccacagcactccatcc

SEQ ID NO: 20772 - DNA, 20 bp, Artificial Sequence
  Description of Artificial Sequence: Synthetic oligonucleotide
  Target: FXN; (+) strand; PAM type: NRG; PAM sequence: GGG
gtgccacagcactccatcct

SEQ ID NO: 20773 - DNA, 20 bp, Artificial Sequence
  Description of Artificial Sequence: Synthetic oligonucleotide
  Target: FXN; (+) strand; PAM type: NRG; PAM sequence: CAG
cagcactccatcctgggcga

SEQ ID NO: 20774 - DNA, 20 bp, Artificial Sequence
  Description of Artificial Sequence: Synthetic oligonucleotide
  Target: FXN; (+) strand; PAM type: NRG; PAM sequence: GAG
gcactccatcctgggcgaca

SEQ ID NO: 20775 - DNA, 20 bp, Artificial Sequence
  Description of Artificial Sequence: Synthetic oligonucleotide
  Target: FXN; (+) strand; PAM type: NRG; PAM sequence: GAG
tccatcctgggcgacagagt

SEQ ID NO: 20776 - DNA, 20 bp, Artificial Sequence
  Description of Artificial Sequence: Synthetic oligonucleotide
  Target: FXN; (+) strand; PAM type: NRG; PAM sequence: AAG
gagtgagactgtctcaaaaa

SEQ ID NO: 20777 - DNA, 20 bp, Artificial Sequence
  Description of Artificial Sequence: Synthetic oligonucleotide
  Target: FXN; (+) strand; PAM type: NRG; PAM sequence: AGG
agtgagactgtctcaaaaaa

SEQ ID NO: 20778 - DNA, 20 bp, Artificial Sequence
  Description of Artificial Sequence: Synthetic oligonucleotide
  Target: FXN; (+) strand; PAM type: NRG; PAM sequence: GAG
tgagactgtctcaaaaaaag

SEQ ID NO: 20779 - DNA, 20 bp, Artificial Sequence
  Description of Artificial Sequence: Synthetic oligonucleotide
  Target: FXN; (+) strand; PAM type: NRG; PAM sequence: AGG
gagactgtctcaaaaaaagg

SEQ ID NO: 20780 - DNA, 20 bp, Artificial Sequence
  Description of Artificial Sequence: Synthetic oligonucleotide
  Target: FXN; (+) strand; PAM type: NRG; PAM sequence: GAG
gactgtctcaaaaaaaggag

SEQ ID NO: 20781 - DNA, 20 bp, Artificial Sequence
  Description of Artificial Sequence: Synthetic oligonucleotide
  Target: FXN; (+) strand; PAM type: NRG; PAM sequence: AAG
tgtctcaaaaaaaggaggag

SEQ ID NO: 20782 - DNA, 20 bp, Artificial Sequence
  Description of Artificial Sequence: Synthetic oligonucleotide
  Target: FXN; (+) strand; PAM type: NRG; PAM sequence: AAG
ctcaaaaaaaggaggagaag

SEQ ID NO: 20783 - DNA, 20 bp, Artificial Sequence
  Description of Artificial Sequence: Synthetic oligonucleotide
  Target: FXN; (+) strand; PAM type: NRG; PAM sequence: AGG
tcaaaaaaaggaggagaaga

SEQ ID NO: 20784 - DNA, 20 bp, Artificial Sequence
  Description of Artificial Sequence: Synthetic oligonucleotide
  Target: FXN; (+) strand; PAM type: NRG; PAM sequence: AAG
aaaaaggaggagaagaagga

SEQ ID NO: 20785 - DNA, 20 bp, Artificial Sequence
  Description of Artificial Sequence: Synthetic oligonucleotide
  Target: FXN; (+) strand; PAM type: NRG; PAM sequence: AGG
aaaaggaggagaagaaggaa

SEQ ID NO: 20786 - DNA, 20 bp, Artificial Sequence
  Description of Artificial Sequence: Synthetic oligonucleotide
  Target: FXN; (+) strand; PAM type: NRG; PAM sequence: AAG
gaggagaagaaggaaaggcc

SEQ ID NO: 20787 - DNA, 20 bp, Artificial Sequence
  Description of Artificial Sequence: Synthetic oligonucleotide
  Target: FXN; (+) strand; PAM type: NRG; PAM sequence: AGG
aggagaagaaggaaaggcca

SEQ ID NO: 20788 - DNA, 20 bp, Artificial Sequence
  Description of Artificial Sequence: Synthetic oligonucleotide
  Target: FXN; (+) strand; PAM type: NRG; PAM sequence: CAG
agaagaaggaaaggccaagg

SEQ ID NO: 20789 - DNA, 20 bp, Artificial Sequence
  Description of Artificial Sequence: Synthetic oligonucleotide
  Target: FXN; (+) strand; PAM type: NRG; PAM sequence: AGG
gaagaaggaaaggccaaggc

SEQ ID NO: 20790 - DNA, 20 bp, Artificial Sequence
  Description of Artificial Sequence: Synthetic oligonucleotide
  Target: FXN; (+) strand; PAM type: NRG; PAM sequence: CAG
aggccaaggcaggaatgaaa

SEQ ID NO: 20791 - DNA, 20 bp, Artificial Sequence
  Description of Artificial Sequence: Synthetic oligonucleotide
  Target: FXN; (+) strand; PAM type: NRG; PAM sequence: AGG
ggccaaggcaggaatgaaac

SEQ ID NO: 20792 - DNA, 20 bp, Artificial Sequence
  Description of Artificial Sequence: Synthetic oligonucleotide
  Target: FXN; (+) strand; PAM type: NRG; PAM sequence: TGG
atgaaacaggccatgaatgt

SEQ ID NO: 20793 - DNA, 20 bp, Artificial Sequence
  Description of Artificial Sequence: Synthetic oligonucleotide
  Target: FXN; (+) strand; PAM type: NRG; PAM sequence: GAG
gaaacaggccatgaatgttg

SEQ ID NO: 20794 - DNA, 20 bp, Artificial Sequence
  Description of Artificial Sequence: Synthetic oligonucleotide
  Target: FXN; (+) strand; PAM type: NRG; PAM sequence: AAG
aggccatgaatgttggagtg

SEQ ID NO: 20795 - DNA, 20 bp, Artificial Sequence
  Description of Artificial Sequence: Synthetic oligonucleotide
  Target: FXN; (+) strand; PAM type: NRG; PAM sequence: TGG
gaatgttggagtgaagcaac

SEQ ID NO: 20796 - DNA, 20 bp, Artificial Sequence
  Description of Artificial Sequence: Synthetic oligonucleotide
  Target: FXN; (+) strand; PAM type: NRG; PAM sequence: AAG
gcaactggcctcctcgtgct

SEQ ID NO: 20797 - DNA, 20 bp, Artificial Sequence
  Description of Artificial Sequence: Synthetic oligonucleotide
  Target: FXN; (+) strand; PAM type: NRG; PAM sequence: CGG
actggcctcctcgtgctaag

SEQ ID NO: 20798 - DNA, 20 bp, Artificial Sequence
  Description of Artificial Sequence: Synthetic oligonucleotide
  Target: FXN; (+) strand; PAM type: NRG; PAM sequence: GAG
tcgtgctaagcggctactgt

SEQ ID NO: 20799 - DNA, 20 bp, Artificial Sequence
  Description of Artificial Sequence: Synthetic oligonucleotide
  Target: FXN; (+) strand; PAM type: NRG; PAM sequence: AAG
tgagttctttccactccccc

SEQ ID NO: 20800 - DNA, 20 bp, Artificial Sequence
  Description of Artificial Sequence: Synthetic oligonucleotide
  Target: FXN; (+) strand; PAM type: NRG; PAM sequence: AAG
tgaatgtcctgcctctgctc

SEQ ID NO: 20801 - DNA, 20 bp, Artificial Sequence
  Description of Artificial Sequence: Synthetic oligonucleotide
  Target: FXN; (+) strand; PAM type: NRG; PAM sequence: AGG
gaatgtcctgcctctgctca

SEQ ID NO: 20802 - DNA, 20 bp, Artificial Sequence
  Description of Artificial Sequence: Synthetic oligonucleotide
  Target: FXN; (+) strand; PAM type: NRG; PAM sequence: GGG
aatgtcctgcctctgctcaa

SEQ ID NO: 20803 - DNA, 20 bp, Artificial Sequence
  Description of Artificial Sequence: Synthetic oligonucleotide
  Target: FXN; (+) strand; PAM type: NRG; PAM sequence: TGG
gtcctgcctctgctcaaggg

SEQ ID NO: 20804 - DNA, 20 bp, Artificial Sequence
  Description of Artificial Sequence: Synthetic oligonucleotide
  Target: FXN; (+) strand; PAM type: NRG; PAM sequence: TGG
tctgctcaagggtggtatga

SEQ ID NO: 20805 - DNA, 20 bp, Artificial Sequence
  Description of Artificial Sequence: Synthetic oligonucleotide
  Target: FXN; (+) strand; PAM type: NRG; PAM sequence: GGG
ctgctcaagggtggtatgat

SEQ ID NO: 20806 - DNA, 20 bp, Artificial Sequence
  Description of Artificial Sequence: Synthetic oligonucleotide
  Target: FXN; (+) strand; PAM type: NRG; PAM sequence: GGG
tgctcaagggtggtatgatg

SEQ ID NO: 20807 - DNA, 20 bp, Artificial Sequence
  Description of Artificial Sequence: Synthetic oligonucleotide
  Target: FXN; (+) strand; PAM type: NRG; PAM sequence: TGG
agggtggtatgatggggact

SEQ ID NO: 20808 - DNA, 20 bp, Artificial Sequence
  Description of Artificial Sequence: Synthetic oligonucleotide
  Target: FXN; (+) strand; PAM type: NRG; PAM sequence: CAG
gtggtatgatggggacttgg

SEQ ID NO: 20809 - DNA, 20 bp, Artificial Sequence
  Description of Artificial Sequence: Synthetic oligonucleotide
  Target: FXN; (+) strand; PAM type: NRG; PAM sequence: TGG
gtatgatggggacttggcag

SEQ ID NO: 20810 - DNA, 20 bp, Artificial Sequence
  Description of Artificial Sequence: Synthetic oligonucleotide
  Target: FXN; (+) strand; PAM type: NRG; PAM sequence: GAG
atgatggggacttggcagtg

SEQ ID NO: 20811 - DNA, 20 bp, Artificial Sequence
  Description of Artificial Sequence: Synthetic oligonucleotide
  Target: FXN; (+) strand; PAM type: NRG; PAM sequence: AGG
tgatggggacttggcagtgg

SEQ ID NO: 20812 - DNA, 20 bp, Artificial Sequence
  Description of Artificial Sequence: Synthetic oligonucleotide
  Target: FXN; (+) strand; PAM type: NRG; PAM sequence: GGG
gatggggacttggcagtgga

SEQ ID NO: 20813 - DNA, 20 bp, Artificial Sequence
  Description of Artificial Sequence: Synthetic oligonucleotide
  Target: FXN; (+) strand; PAM type: NRG; PAM sequence: GGG
atggggacttggcagtggag

SEQ ID NO: 20814 - DNA, 20 bp, Artificial Sequence
  Description of Artificial Sequence: Synthetic oligonucleotide
  Target: FXN; (+) strand; PAM type: NRG; PAM sequence: CAG
gacttggcagtggaggggaa

SEQ ID NO: 20815 - DNA, 20 bp, Artificial Sequence
  Description of Artificial Sequence: Synthetic oligonucleotide
  Target: FXN; (+) strand; PAM type: NRG; PAM sequence: AGG
acttggcagtggaggggaac

SEQ ID NO: 20816 - DNA, 20 bp, Artificial Sequence
  Description of Artificial Sequence: Synthetic oligonucleotide
  Target: FXN; (+) strand; PAM type: NRG; PAM sequence: GGG
cttggcagtggaggggaaca

SEQ ID NO: 20817 - DNA, 20 bp, Artificial Sequence
  Description of Artificial Sequence: Synthetic oligonucleotide
  Target: FXN; (+) strand; PAM type: NRG; PAM sequence: CAG
gtggaggggaacagggaaac

SEQ ID NO: 20818 - DNA, 20 bp, Artificial Sequence
  Description of Artificial Sequence: Synthetic oligonucleotide
  Target: FXN; (+) strand; PAM type: NRG; PAM sequence: TGG
gggaacagggaaaccagaca

SEQ ID NO: 20819 - DNA, 20 bp, Artificial Sequence
  Description of Artificial Sequence: Synthetic oligonucleotide
  Target: FXN; (+) strand; PAM type: NRG; PAM sequence: TGG
aacagggaaaccagacatgg

SEQ ID NO: 20820 - DNA, 20 bp, Artificial Sequence
  Description of Artificial Sequence: Synthetic oligonucleotide
  Target: FXN; (+) strand; PAM type: NRG; PAM sequence: TGG
atggtggtctccccgcttcc

SEQ ID NO: 20821 - DNA, 20 bp, Artificial Sequence
  Description of Artificial Sequence: Synthetic oligonucleotide
  Target: FXN; (+) strand; PAM type: NRG; PAM sequence: AAG
tctccccgcttcctggctac

SEQ ID NO: 20822 - DNA, 20 bp, Artificial Sequence
  Description of Artificial Sequence: Synthetic oligonucleotide
  Target: FXN; (+) strand; PAM type: NRG; PAM sequence: AAG
cctggctacaagtccctctg

SEQ ID NO: 20823 - DNA, 20 bp, Artificial Sequence
  Description of Artificial Sequence: Synthetic oligonucleotide
  Target: FXN; (+) strand; PAM type: NRG; PAM sequence: AAG
agtccctctgaagaaatcca

SEQ ID NO: 20824 - DNA, 20 bp, Artificial Sequence
  Description of Artificial Sequence: Synthetic oligonucleotide
  Target: FXN; (+) strand; PAM type: NRG; PAM sequence: AGG
gtccctctgaagaaatccaa

SEQ ID NO: 20825 - DNA, 20 bp, Artificial Sequence
  Description of Artificial Sequence: Synthetic oligonucleotide
  Target: FXN; (+) strand; PAM type: NRG; PAM sequence: GAG
ccctctgaagaaatccaaag

SEQ ID NO: 20826 - DNA, 20 bp, Artificial Sequence
  Description of Artificial Sequence: Synthetic oligonucleotide
  Target: FXN; (+) strand; PAM type: NRG; PAM sequence: AAG
tgaagaaatccaaaggagta

SEQ ID NO: 20827 - DNA, 20 bp, Artificial Sequence
  Description of Artificial Sequence: Synthetic oligonucleotide
  Target: FXN; (+) strand; PAM type: NRG; PAM sequence: GAG
aagaaatccaaaggagtaaa

SEQ ID NO: 20828 - DNA, 20 bp, Artificial Sequence
  Description of Artificial Sequence: Synthetic oligonucleotide
  Target: FXN; (+) strand; PAM type: NRG; PAM sequence: TGG
atccaaaggagtaaagagct

SEQ ID NO: 20829 - DNA, 20 bp, Artificial Sequence
  Description of Artificial Sequence: Synthetic oligonucleotide
  Target: FXN; (+) strand; PAM type: NRG; PAM sequence: GAG
ccaaaggagtaaagagcttg

SEQ ID NO: 20830 - DNA, 20 bp, Artificial Sequence
  Description of Artificial Sequence: Synthetic oligonucleotide
  Target: FXN; (+) strand; PAM type: NRG; PAM sequence: GAG
aaaggagtaaagagcttgga

SEQ ID NO: 20831 - DNA, 20 bp, Artificial Sequence
  Description of Artificial Sequence: Synthetic oligonucleotide
  Target: FXN; (+) strand; PAM type: NRG; PAM sequence: TAG
ggagtaaagagcttggagag

SEQ ID NO: 20832 - DNA, 20 bp, Artificial Sequence
  Description of Artificial Sequence: Synthetic oligonucleotide
  Target: FXN; (+) strand; PAM type: NRG; PAM sequence: AGG
gagtaaagagcttggagagt

SEQ ID NO: 20833 - DNA, 20 bp, Artificial Sequence
  Description of Artificial Sequence: Synthetic oligonucleotide
  Target: FXN; (+) strand; PAM type: NRG; PAM sequence: TAG
gcttggagagtaggcctctg

SEQ ID NO: 20834 - DNA, 20 bp, Artificial Sequence
  Description of Artificial Sequence: Synthetic oligonucleotide
  Target: FXN; (+) strand; PAM type: NRG; PAM sequence: AGG
cttggagagtaggcctctgt

SEQ ID NO: 20835 - DNA, 20 bp, Artificial Sequence
  Description of Artificial Sequence: Synthetic oligonucleotide
  Target: FXN; (+) strand; PAM type: NRG; PAM sequence: GGG
ttggagagtaggcctctgta

SEQ ID NO: 20836 - DNA, 20 bp, Artificial Sequence
  Description of Artificial Sequence: Synthetic oligonucleotide
  Target: FXN; (+) strand; PAM type: NRG; PAM sequence: AAG
agtaggcctctgtagggtgc

SEQ ID NO: 20837 - DNA, 20 bp, Artificial Sequence
  Description of Artificial Sequence: Synthetic oligonucleotide
  Target: FXN; (+) strand; PAM type: NRG; PAM sequence: AGG
gtaggcctctgtagggtgca

SEQ ID NO: 20838 - DNA, 20 bp, Artificial Sequence
  Description of Artificial Sequence: Synthetic oligonucleotide
  Target: FXN; (+) strand; PAM type: NRG; PAM sequence: GGG
taggcctctgtagggtgcaa

SEQ ID NO: 20839 - DNA, 20 bp, Artificial Sequence
  Description of Artificial Sequence: Synthetic oligonucleotide
  Target: FXN; (+) strand; PAM type: NRG; PAM sequence: CAG
ctctgtagggtgcaagggca

SEQ ID NO: 20840 - DNA, 20 bp, Artificial Sequence
  Description of Artificial Sequence: Synthetic oligonucleotide
  Target: FXN; (+) strand; PAM type: NRG; PAM sequence: TGG
gtagggtgcaagggcacagc

SEQ ID NO: 20841 - DNA, 20 bp, Artificial Sequence
  Description of Artificial Sequence: Synthetic oligonucleotide
  Target: FXN; (+) strand; PAM type: NRG; PAM sequence: GAG
agggtgcaagggcacagctg

SEQ ID NO: 20842 - DNA, 20 bp, Artificial Sequence
  Description of Artificial Sequence: Synthetic oligonucleotide
  Target: FXN; (+) strand; PAM type: NRG; PAM sequence: CGG
tgcaagggcacagctggaga

SEQ ID NO: 20843 - DNA, 20 bp, Artificial Sequence
  Description of Artificial Sequence: Synthetic oligonucleotide
  Target: FXN; (+) strand; PAM type: NRG; PAM sequence: GAG
caagggcacagctggagacg

SEQ ID NO: 20844 - DNA, 20 bp, Artificial Sequence
  Description of Artificial Sequence: Synthetic oligonucleotide
  Target: FXN; (+) strand; PAM type: NRG; PAM sequence: GAG
cagctggagacggagctcct

SEQ ID NO: 20845 - DNA, 20 bp, Artificial Sequence
  Description of Artificial Sequence: Synthetic oligonucleotide
  Target: FXN; (+) strand; PAM type: NRG; PAM sequence: AGG
agctggagacggagctcctg

SEQ ID NO: 20846 - DNA, 20 bp, Artificial Sequence
  Description of Artificial Sequence: Synthetic oligonucleotide
  Target: FXN; (+) strand; PAM type: NRG; PAM sequence: CAG
agacggagctcctgaggctg

SEQ ID NO: 20847 - DNA, 20 bp, Artificial Sequence
  Description of Artificial Sequence: Synthetic oligonucleotide
  Target: FXN; (+) strand; PAM type: NRG; PAM sequence: GAG
aactgcaccaaaaacgtgat

SEQ ID NO: 20848 - DNA, 20 bp, Artificial Sequence
  Description of Artificial Sequence: Synthetic oligonucleotide
  Target: FXN; (+) strand; PAM type: NRG; PAM sequence: AGG
actgcaccaaaaacgtgatg

SEQ ID NO: 20849 - DNA, 20 bp, Artificial Sequence
  Description of Artificial Sequence: Synthetic oligonucleotide
  Target: FXN; (+) strand; PAM type: NRG; PAM sequence: TAG
ccaaaaacgtgatgaggcca

SEQ ID NO: 20850 - DNA, 20 bp, Artificial Sequence
  Description of Artificial Sequence: Synthetic oligonucleotide
  Target: FXN; (+) strand; PAM type: NRG; PAM sequence: CGG
aaaacgtgatgaggccatag

SEQ ID NO: 20851 - DNA, 20 bp, Artificial Sequence
  Description of Artificial Sequence: Synthetic oligonucleotide
  Target: FXN; (+) strand; PAM type: NRG; PAM sequence: GGG
aaacgtgatgaggccatagc

SEQ ID NO: 20852 - DNA, 20 bp, Artificial Sequence
  Description of Artificial Sequence: Synthetic oligonucleotide
  Target: FXN; (+) strand; PAM type: NRG; PAM sequence: GAG
acgtgatgaggccatagcgg

SEQ ID NO: 20853 - DNA, 20 bp, Artificial Sequence
  Description of Artificial Sequence: Synthetic oligonucleotide
  Target: FXN; (+) strand; PAM type: NRG; PAM sequence: CGG
gaggccatagcgggagtcca

SEQ ID NO: 20854 - DNA, 20 bp, Artificial Sequence
  Description of Artificial Sequence: Synthetic oligonucleotide
  Target: FXN; (+) strand; PAM type: NRG; PAM sequence: GAG
ggccatagcgggagtccacg

SEQ ID NO: 20855 - DNA, 20 bp, Artificial Sequence
  Description of Artificial Sequence: Synthetic oligonucleotide
  Target: FXN; (+) strand; PAM type: NRG; PAM sequence: AGG
gccatagcgggagtccacgg

SEQ ID NO: 20856 - DNA, 20 bp, Artificial Sequence
  Description of Artificial Sequence: Synthetic oligonucleotide
  Target: FXN; (+) strand; PAM type: NRG; PAM sequence: GAG
catagcgggagtccacggag

SEQ ID NO: 20857 - DNA, 20 bp, Artificial Sequence
  Description of Artificial Sequence: Synthetic oligonucleotide
  Target: FXN; (+) strand; PAM type: NRG; PAM sequence: AGG
atagcgggagtccacggagg

SEQ ID NO: 20858 - DNA, 20 bp, Artificial Sequence
  Description of Artificial Sequence: Synthetic oligonucleotide
  Target: FXN; (+) strand; PAM type: NRG; PAM sequence: TAG
gatgcctactgcccgacctc

SEQ ID NO: 20859 - DNA, 20 bp, Artificial Sequence
  Description of Artificial Sequence: Synthetic oligonucleotide
  Target: FXN; (+) strand; PAM type: NRG; PAM sequence: CAG
gcctactgcccgacctctag

SEQ ID NO: 20860 - DNA, 20 bp, Artificial Sequence
  Description of Artificial Sequence: Synthetic oligonucleotide
  Target: FXN; (+) strand; PAM type: NRG; PAM sequence: GAG
ctactgcccgacctctagca

SEQ ID NO: 20861 - DNA, 20 bp, Artificial Sequence
  Description of Artificial Sequence: Synthetic oligonucleotide
  Target: FXN; (+) strand; PAM type: NRG; PAM sequence: AAG
cccgacctctagcagagact

SEQ ID NO: 20862 - DNA, 20 bp, Artificial Sequence
  Description of Artificial Sequence: Synthetic oligonucleotide
  Target: FXN; (+) strand; PAM type: NRG; PAM sequence: AAG
acctctagcagagactaagc

SEQ ID NO: 20863 - DNA, 20 bp, Artificial Sequence
  Description of Artificial Sequence: Synthetic oligonucleotide
  Target: FXN; (+) strand; PAM type: NRG; PAM sequence: AGG
cctctagcagagactaagca

SEQ ID NO: 20864 - DNA, 20 bp, Artificial Sequence
  Description of Artificial Sequence: Synthetic oligonucleotide
  Target: FXN; (+) strand; PAM type: NRG; PAM sequence: AAG
acacccatgaccactacatg

SEQ ID NO: 20865 - DNA, 20 bp, Artificial Sequence
  Description of Artificial Sequence: Synthetic oligonucleotide
  Target: FXN; (+) strand; PAM type: NRG; PAM sequence: TGG
ccatgaccactacatgaaga

SEQ ID NO: 20866 - DNA, 20 bp, Artificial Sequence
  Description of Artificial Sequence: Synthetic oligonucleotide
  Target: FXN; (+) strand; PAM type: NRG; PAM sequence: TGG
catgaagatggcccaaaacc

SEQ ID NO: 20867 - DNA, 20 bp, Artificial Sequence
  Description of Artificial Sequence: Synthetic oligonucleotide
  Target: FXN; (+) strand; PAM type: NRG; PAM sequence: CAG
agatggcccaaaacctggcc

SEQ ID NO: 20868 - DNA, 20 bp, Artificial Sequence
  Description of Artificial Sequence: Synthetic oligonucleotide
  Target: FXN; (+) strand; PAM type: NRG; PAM sequence: AGG
gatggcccaaaacctggccc

SEQ ID NO: 20869 - DNA, 20 bp, Artificial Sequence
  Description of Artificial Sequence: Synthetic oligonucleotide
  Target: FXN; (+) strand; PAM type: NRG; PAM sequence: AAG
aaaacctggcccaggaattg

SEQ ID NO: 20870 - DNA, 20 bp, Artificial Sequence
  Description of Artificial Sequence: Synthetic oligonucleotide
  Target: FXN; (+) strand; PAM type: NRG; PAM sequence: AAG
cctggcccaggaattgaaga

SEQ ID NO: 20871 - DNA, 20 bp, Artificial Sequence
  Description of Artificial Sequence: Synthetic oligonucleotide
  Target: FXN; (+) strand; PAM type: NRG; PAM sequence: AAG
agactcttccaatttgctgt

SEQ ID NO: 20872 - DNA, 20 bp, Artificial Sequence
  Description of Artificial Sequence: Synthetic oligonucleotide
  Target: FXN; (+) strand; PAM type: NRG; PAM sequence: TGG
tccaatttgctgtaagaaaa

SEQ ID NO: 20873 - DNA, 20 bp, Artificial Sequence
  Description of Artificial Sequence: Synthetic oligonucleotide
  Target: FXN; (+) strand; PAM type: NRG; PAM sequence: CAG
tttgctgtaagaaaatggcc

SEQ ID NO: 20874 - DNA, 20 bp, Artificial Sequence
  Description of Artificial Sequence: Synthetic oligonucleotide
  Target: FXN; (+) strand; PAM type: NRG; PAM sequence: AGG
ttgctgtaagaaaatggccc

SEQ ID NO: 20875 - DNA, 20 bp, Artificial Sequence
  Description of Artificial Sequence: Synthetic oligonucleotide
  Target: FXN; (+) strand; PAM type: NRG; PAM sequence: GGG
tgctgtaagaaaatggccca

SEQ ID NO: 20876 - DNA, 20 bp, Artificial Sequence
  Description of Artificial Sequence: Synthetic oligonucleotide
  Target: FXN; (+) strand; PAM type: NRG; PAM sequence: GGG
gctgtaagaaaatggcccag

SEQ ID NO: 20877 - DNA, 20 bp, Artificial Sequence
  Description of Artificial Sequence: Synthetic oligonucleotide
  Target: FXN; (+) strand; PAM type: NRG; PAM sequence: GGG
ctgtaagaaaatggcccagg

SEQ ID NO: 20878 - DNA, 20 bp, Artificial Sequence
  Description of Artificial Sequence: Synthetic oligonucleotide
  Target: FXN; (+) strand; PAM type: NRG; PAM sequence: AAG
aagaaaatggcccagggggc

SEQ ID NO: 20879 - DNA, 20 bp, Artificial Sequence
  Description of Artificial Sequence: Synthetic oligonucleotide
  Target: FXN; (+) strand; PAM type: NRG; PAM sequence: CGG
aatggcccagggggcaagca

SEQ ID NO: 20880 - DNA, 20 bp, Artificial Sequence
  Description of Artificial Sequence: Synthetic oligonucleotide
  Target: FXN; (+) strand; PAM type: NRG; PAM sequence: TAG
ggcccagggggcaagcacgg

SEQ ID NO: 20881 - DNA, 20 bp, Artificial Sequence
  Description of Artificial Sequence: Synthetic oligonucleotide
  Target: FXN; (+) strand; PAM type: NRG; PAM sequence: TAG
gtagctcacacctgtaatcc

SEQ ID NO: 20882 - DNA, 20 bp, Artificial Sequence
  Description of Artificial Sequence: Synthetic oligonucleotide
  Target: FXN; (+) strand; PAM type: NRG; PAM sequence: TGG
cacctgtaatcctagcactt

SEQ ID NO: 20883 - DNA, 20 bp, Artificial Sequence
  Description of Artificial Sequence: Synthetic oligonucleotide
  Target: FXN; (+) strand; PAM type: NRG; PAM sequence: GGG
acctgtaatcctagcacttt

SEQ ID NO: 20884 - DNA, 20 bp, Artificial Sequence
  Description of Artificial Sequence: Synthetic oligonucleotide
  Target: FXN; (+) strand; PAM type: NRG; PAM sequence: AAG
tgtaatcctagcactttggg

SEQ ID NO: 20885 - DNA, 20 bp, Artificial Sequence
  Description of Artificial Sequence: Synthetic oligonucleotide
  Target: FXN; (+) strand; PAM type: NRG; PAM sequence: CAG
agcactttgggaagctgacg

SEQ ID NO: 20886 - DNA, 20 bp, Artificial Sequence
  Description of Artificial Sequence: Synthetic oligonucleotide
  Target: FXN; (+) strand; PAM type: NRG; PAM sequence: AGG
gcactttgggaagctgacgc

SEQ ID NO: 20887 - DNA, 20 bp, Artificial Sequence
  Description of Artificial Sequence: Synthetic oligonucleotide
  Target: FXN; (+) strand; PAM type: NRG; PAM sequence: CAG
ctttgggaagctgacgcagg

SEQ ID NO: 20888 - DNA, 20 bp, Artificial Sequence
  Description of Artificial Sequence: Synthetic oligonucleotide
  Target: FXN; (+) strand; PAM type: NRG; PAM sequence: TGG
gggaagctgacgcaggcaga

SEQ ID NO: 20889 - DNA, 20 bp, Artificial Sequence
  Description of Artificial Sequence: Synthetic oligonucleotide
  Target: FXN; (+) strand; PAM type: NRG; PAM sequence: GAG
ctgacgcaggcagatggctt

SEQ ID NO: 20890 - DNA, 20 bp, Artificial Sequence
  Description of Artificial Sequence: Synthetic oligonucleotide
  Target: FXN; (+) strand; PAM type: NRG; PAM sequence: CAG
gcaggcagatggcttgagct

SEQ ID NO: 20891 - DNA, 20 bp, Artificial Sequence
  Description of Artificial Sequence: Synthetic oligonucleotide
  Target: FXN; (+) strand; PAM type: NRG; PAM sequence: AGG
caggcagatggcttgagctc

SEQ ID NO: 20892 - DNA, 20 bp, Artificial Sequence
  Description of Artificial Sequence: Synthetic oligonucleotide
  Target: FXN; (+) strand; PAM type: NRG; PAM sequence: GAG
ggcagatggcttgagctcag

SEQ ID NO: 20893 - DNA, 20 bp, Artificial Sequence
  Description of Artificial Sequence: Synthetic oligonucleotide
  Target: FXN; (+) strand; PAM type: NRG; PAM sequence: CAG
tggcttgagctcaggagttc

SEQ ID NO: 20894 - DNA, 20 bp, Artificial Sequence
  Description of Artificial Sequence: Synthetic oligonucleotide
  Target: FXN; (+) strand; PAM type: NRG; PAM sequence: CAG
tgagctcaggagttccagac

SEQ ID NO: 20895 - DNA, 20 bp, Artificial Sequence
  Description of Artificial Sequence: Synthetic oligonucleotide
  Target: FXN; (+) strand; PAM type: NRG; PAM sequence: TGG
tcaggagttccagaccagcc

SEQ ID NO: 20896 - DNA, 20 bp, Artificial Sequence
  Description of Artificial Sequence: Synthetic oligonucleotide
  Target: FXN; (+) strand; PAM type: NRG; PAM sequence: GGG
caggagttccagaccagcct

SEQ ID NO: 20897 - DNA, 20 bp, Artificial Sequence
  Description of Artificial Sequence: Synthetic oligonucleotide
  Target: FXN; (+) strand; PAM type: NRG; PAM sequence: TGG
ccagaccagcctgggcaaca

SEQ ID NO: 20898 - DNA, 20 bp, Artificial Sequence
  Description of Artificial Sequence: Synthetic oligonucleotide
  Target: FXN; (+) strand; PAM type: NRG; PAM sequence: TAG
tctaccaaaaatacaaaaat

SEQ ID NO: 20899 - DNA, 20 bp, Artificial Sequence
  Description of Artificial Sequence: Synthetic oligonucleotide
  Target: FXN; (+) strand; PAM type: NRG; PAM sequence: CGG
ccaaaaatacaaaaattagc

SEQ ID NO: 20900 - DNA, 20 bp, Artificial Sequence
  Description of Artificial Sequence: Synthetic oligonucleotide
  Target: FXN; (+) strand; PAM type: NRG; PAM sequence: GGG
caaaaatacaaaaattagcc

SEQ ID NO: 20901 - DNA, 20 bp, Artificial Sequence
  Description of Artificial Sequence: Synthetic oligonucleotide
  Target: FXN; (+) strand; PAM type: NRG; PAM sequence: TGG
atacaaaaattagccgggtg

SEQ ID NO: 20902 - DNA, 20 bp, Artificial Sequence
  Description of Artificial Sequence: Synthetic oligonucleotide
  Target: FXN; (+) strand; PAM type: NRG; PAM sequence: TGG
ggtgtggtgatgcatgcctg

SEQ ID NO: 20903 - DNA, 20 bp, Artificial Sequence
  Description of Artificial Sequence: Synthetic oligonucleotide
  Target: FXN; (+) strand; PAM type: NRG; PAM sequence: CAG
gtgatgcatgcctgtggtcc

SEQ ID NO: 20904 - DNA, 20 bp, Artificial Sequence
  Description of Artificial Sequence: Synthetic oligonucleotide
  Target: FXN; (+) strand; PAM type: NRG; PAM sequence: CAG
tgcctgtggtcccagctact

SEQ ID NO: 20905 - DNA, 20 bp, Artificial Sequence
  Description of Artificial Sequence: Synthetic oligonucleotide
  Target: FXN; (+) strand; PAM type: NRG; PAM sequence: AGG
gcctgtggtcccagctactc

SEQ ID NO: 20906 - DNA, 20 bp, Artificial Sequence
  Description of Artificial Sequence: Synthetic oligonucleotide
  Target: FXN; (+) strand; PAM type: NRG; PAM sequence: GAG
ctgtggtcccagctactcag

SEQ ID NO: 20907 - DNA, 20 bp, Artificial Sequence
  Description of Artificial Sequence: Synthetic oligonucleotide
  Target: FXN; (+) strand; PAM type: NRG; PAM sequence: AGG
tgtggtcccagctactcagg

SEQ ID NO: 20908 - DNA, 20 bp, Artificial Sequence
  Description of Artificial Sequence: Synthetic oligonucleotide
  Target: FXN; (+) strand; PAM type: NRG; PAM sequence: GAG
tcccagctactcaggaggct

SEQ ID NO: 20909 - DNA, 20 bp, Artificial Sequence
  Description of Artificial Sequence: Synthetic oligonucleotide
  Target: FXN; (+) strand; PAM type: NRG; PAM sequence: AGG
cccagctactcaggaggctg

SEQ ID NO: 20910 - DNA, 20 bp, Artificial Sequence
  Description of Artificial Sequence: Synthetic oligonucleotide
  Target: FXN; (+) strand; PAM type: NRG; PAM sequence: TGG
agctactcaggaggctgagg

SEQ ID NO: 20911 - DNA, 20 bp, Artificial Sequence
  Description of Artificial Sequence: Synthetic oligonucleotide
  Target: FXN; (+) strand; PAM type: NRG; PAM sequence: AAG
tactcaggaggctgaggtgg

SEQ ID NO: 20912 - DNA, 20 bp, Artificial Sequence
  Description of Artificial Sequence: Synthetic oligonucleotide
  Target: FXN; (+) strand; PAM type: NRG; PAM sequence: AGG
actcaggaggctgaggtgga

SEQ ID NO: 20913 - DNA, 20 bp, Artificial Sequence
  Description of Artificial Sequence: Synthetic oligonucleotide
  Target: FXN; (+) strand; PAM type: NRG; PAM sequence: GAG
ctgaggtggaaggattgcct

SEQ ID NO: 20914 - DNA, 20 bp, Artificial Sequence
  Description of Artificial Sequence: Synthetic oligonucleotide
  Target: FXN; (+) strand; PAM type: NRG; PAM sequence: TGG
ggaaggattgcctgagtctg

SEQ ID NO: 20915 - DNA, 20 bp, Artificial Sequence
  Description of Artificial Sequence: Synthetic oligonucleotide
  Target: FXN; (+) strand; PAM type: NRG; PAM sequence: GGG
gaaggattgcctgagtctgt

SEQ ID NO: 20916 - DNA, 20 bp, Artificial Sequence
  Description of Artificial Sequence: Synthetic oligonucleotide
  Target: FXN; (+) strand; PAM type: NRG; PAM sequence: GGG
aaggattgcctgagtctgtg

SEQ ID NO: 20917 - DNA, 20 bp, Artificial Sequence
  Description of Artificial Sequence: Synthetic oligonucleotide
  Target: FXN; (+) strand; PAM type: NRG; PAM sequence: CAG
gattgcctgagtctgtgggg

SEQ ID NO: 20918 - DNA, 20 bp, Artificial Sequence
  Description of Artificial Sequence: Synthetic oligonucleotide
  Target: FXN; (+) strand; PAM type: NRG; PAM sequence: GAG
ttgcctgagtctgtggggca

SEQ ID NO: 20919 - DNA, 20 bp, Artificial Sequence
  Description of Artificial Sequence: Synthetic oligonucleotide
  Target: FXN; (+) strand; PAM type: NRG; PAM sequence: AGG
tgcctgagtctgtggggcag

SEQ ID NO: 20920 - DNA, 20 bp, Artificial Sequence
  Description of Artificial Sequence: Synthetic oligonucleotide
  Target: FXN; (+) strand; PAM type: NRG; PAM sequence: CAG
agtctgtggggcagaggttg

SEQ ID NO: 20921 - DNA, 20 bp, Artificial Sequence
  Description of Artificial Sequence: Synthetic oligonucleotide
  Target: FXN; (+) strand; PAM type: NRG; PAM sequence: GAG
tgtggggcagaggttgcagt

SEQ ID NO: 20922 - DNA, 20 bp, Artificial Sequence
  Description of Artificial Sequence: Synthetic oligonucleotide
  Target: FXN; (+) strand; PAM type: NRG; PAM sequence: GAG
ggcagaggttgcagtgagct

SEQ ID NO: 20923 - DNA, 20 bp, Artificial Sequence
  Description of Artificial Sequence: Synthetic oligonucleotide
  Target: FXN; (+) strand; PAM type: NRG; PAM sequence: CAG
gagatcacaccactgcactc

SEQ ID NO: 20924 - DNA, 20 bp, Artificial Sequence
  Description of Artificial Sequence: Synthetic oligonucleotide
  Target: FXN; (+) strand; PAM type: NRG; PAM sequence: TGG
cacaccactgcactccagcc

SEQ ID NO: 20925 - DNA, 20 bp, Artificial Sequence
  Description of Artificial Sequence: Synthetic oligonucleotide
  Target: FXN; (+) strand; PAM type: NRG; PAM sequence: GGG
acaccactgcactccagcct

SEQ ID NO: 20926 - DNA, 20 bp, Artificial Sequence
  Description of Artificial Sequence: Synthetic oligonucleotide
  Target: FXN; (+) strand; PAM type: NRG; PAM sequence: CAG
gcactccagcctgggtgaca

SEQ ID NO: 20927 - DNA, 20 bp, Artificial Sequence
  Description of Artificial Sequence: Synthetic oligonucleotide
  Target: FXN; (+) strand; PAM type: NRG; PAM sequence: GAG
tccagcctgggtgacacagt

SEQ ID NO: 20928 - DNA, 20 bp, Artificial Sequence
  Description of Artificial Sequence: Synthetic oligonucleotide
  Target: FXN; (+) strand; PAM type: NRG; PAM sequence: AAG
cccatctcaaaaaaaaaaaa

SEQ ID NO: 20929 - DNA, 20 bp, Artificial Sequence
  Description of Artificial Sequence: Synthetic oligonucleotide
  Target: FXN; (+) strand; PAM type: NRG; PAM sequence: AAG
tctcaaaaaaaaaaaaaaga

SEQ ID NO: 20930 - DNA, 20 bp, Artificial Sequence
  Description of Artificial Sequence: Synthetic oligonucleotide
  Target: FXN; (+) strand; PAM type: NRG; PAM sequence: CGG
aaaaaaaaaaagaaagaaaa

SEQ ID NO: 20931 - DNA, 20 bp, Artificial Sequence
  Description of Artificial Sequence: Synthetic oligonucleotide
  Target: FXN; (+) strand; PAM type: NRG; PAM sequence: CAG
aaaaaagaaagaaaacggcc

SEQ ID NO: 20932 - DNA, 20 bp, Artificial Sequence
  Description of Artificial Sequence: Synthetic oligonucleotide
  Target: FXN; (+) strand; PAM type: NRG; PAM sequence: AGG
aaaaagaaagaaaacggccc

SEQ ID NO: 20933 - DNA, 20 bp, Artificial Sequence
  Description of Artificial Sequence: Synthetic oligonucleotide
  Target: FXN; (+) strand; PAM type: NRG; PAM sequence: AAG
aagaaagaaaacggcccagg

SEQ ID NO: 20934 - DNA, 20 bp, Artificial Sequence
  Description of Artificial Sequence: Synthetic oligonucleotide
  Target: FXN; (+) strand; PAM type: NRG; PAM sequence: AGG
agaaagaaaacggcccagga

SEQ ID NO: 20935 - DNA, 20 bp, Artificial Sequence
  Description of Artificial Sequence: Synthetic oligonucleotide
  Target: FXN; (+) strand; PAM type: NRG; PAM sequence: TGG
agaaaacggcccaggaaggc

SEQ ID NO: 20936 - DNA, 20 bp, Artificial Sequence
  Description of Artificial Sequence: Synthetic oligonucleotide
  Target: FXN; (+) strand; PAM type: NRG; PAM sequence: GAG
aaaacggcccaggaaggctg

SEQ ID NO: 20937 - DNA, 20 bp, Artificial Sequence
  Description of Artificial Sequence: Synthetic oligonucleotide
  Target: FXN; (+) strand; PAM type: NRG; PAM sequence: AGG
aaacggcccaggaaggctgg

SEQ ID NO: 20938 - DNA, 20 bp, Artificial Sequence
  Description of Artificial Sequence: Synthetic oligonucleotide
  Target: FXN; (+) strand; PAM type: NRG; PAM sequence: GGG
aacggcccaggaaggctgga

SEQ ID NO: 20939 - DNA, 20 bp, Artificial Sequence
  Description of Artificial Sequence: Synthetic oligonucleotide
  Target: FXN; (+) strand; PAM type: NRG; PAM sequence: GAG
ggagggccgccgtgtccatt

SEQ ID NO: 20940 - DNA, 20 bp, Artificial Sequence
  Description of Artificial Sequence: Synthetic oligonucleotide
  Target: FXN; (+) strand; PAM type: NRG; PAM sequence: GAG
agggccgccgtgtccattga

SEQ ID NO: 20941 - DNA, 20 bp, Artificial Sequence
  Description of Artificial Sequence: Synthetic oligonucleotide
  Target: FXN; (+) strand; PAM type: NRG; PAM sequence: GAG
ggccgccgtgtccattgaga

SEQ ID NO: 20942 - DNA, 20 bp, Artificial Sequence
  Description of Artificial Sequence: Synthetic oligonucleotide
  Target: FXN; (+) strand; PAM type: NRG; PAM sequence: CAG
tgtccattgagagagtgctc

SEQ ID NO: 20943 - DNA, 20 bp, Artificial Sequence
  Description of Artificial Sequence: Synthetic oligonucleotide
  Target: FXN; (+) strand; PAM type: NRG; PAM sequence: AGG
gtccattgagagagtgctcc

SEQ ID NO: 20944 - DNA, 20 bp, Artificial Sequence
  Description of Artificial Sequence: Synthetic oligonucleotide
  Target: FXN; (+) strand; PAM type: NRG; PAM sequence: AAG
agtgctccaggcactccaaa

SEQ ID NO: 20945 - DNA, 20 bp, Artificial Sequence
  Description of Artificial Sequence: Synthetic oligonucleotide
  Target: FXN; (+) strand; PAM type: NRG; PAM sequence: TGG
caaaaagaaaatgaccacaa

SEQ ID NO: 20946 - DNA, 20 bp, Artificial Sequence
  Description of Artificial Sequence: Synthetic oligonucleotide
  Target: FXN; (+) strand; PAM type: NRG; PAM sequence: GGG
aaaaagaaaatgaccacaat

SEQ ID NO: 20947 - DNA, 20 bp, Artificial Sequence
  Description of Artificial Sequence: Synthetic oligonucleotide
  Target: FXN; (+) strand; PAM type: NRG; PAM sequence: AAG
aagaaaatgaccacaatggg

SEQ ID NO: 20948 - DNA, 20 bp, Artificial Sequence
  Description of Artificial Sequence: Synthetic oligonucleotide
  Target: FXN; (+) strand; PAM type: NRG; PAM sequence: CAG
tgaccacaatgggaagaaac

SEQ ID NO: 20949 - DNA, 20 bp, Artificial Sequence
  Description of Artificial Sequence: Synthetic oligonucleotide
  Target: FXN; (+) strand; PAM type: NRG; PAM sequence: GAG
ggaagaaaccagctgaccat

SEQ ID NO: 20950 - DNA, 20 bp, Artificial Sequence
  Description of Artificial Sequence: Synthetic oligonucleotide
  Target: FXN; (+) strand; PAM type: NRG; PAM sequence: AAG
aaccagctgaccatgagacc

SEQ ID NO: 20951 - DNA, 20 bp, Artificial Sequence
  Description of Artificial Sequence: Synthetic oligonucleotide
  Target: FXN; (+) strand; PAM type: NRG; PAM sequence: AAG
accaagttccaaccttttac

SEQ ID NO: 20952 - DNA, 20 bp, Artificial Sequence
  Description of Artificial Sequence: Synthetic oligonucleotide
  Target: FXN; (+) strand; PAM type: NRG; PAM sequence: TGG
aagttccaaccttttacaag

SEQ ID NO: 20953 - DNA, 20 bp, Artificial Sequence
  Description of Artificial Sequence: Synthetic oligonucleotide
  Target: FXN; (+) strand; PAM type: NRG; PAM sequence: TGG
aaccttttacaagtggcctg

SEQ ID NO: 20954 - DNA, 20 bp, Artificial Sequence
  Description of Artificial Sequence: Synthetic oligonucleotide
  Target: FXN; (+) strand; PAM type: NRG; PAM sequence: TGG
tacaagtggcctgtggctcc

SEQ ID NO: 20955 - DNA, 20 bp, Artificial Sequence
  Description of Artificial Sequence: Synthetic oligonucleotide
  Target: FXN; (+) strand; PAM type: NRG; PAM sequence: CAG
ggctcctggcgccccgccca

SEQ ID NO: 20956 - DNA, 20 bp, Artificial Sequence
  Description of Artificial Sequence: Synthetic oligonucleotide
  Target: FXN; (+) strand; PAM type: NRG; PAM sequence: CAG
ggcgccccgcccacagctga

SEQ ID NO: 20957 - DNA, 20 bp, Artificial Sequence
  Description of Artificial Sequence: Synthetic oligonucleotide
  Target: FXN; (+) strand; PAM type: NRG; PAM sequence: AGG
gcgccccgcccacagctgac

SEQ ID NO: 20958 - DNA, 20 bp, Artificial Sequence
  Description of Artificial Sequence: Synthetic oligonucleotide
  Target: FXN; (+) strand; PAM type: NRG; PAM sequence: GGG
cgccccgcccacagctgaca

SEQ ID NO: 20959 - DNA, 20 bp, Artificial Sequence
  Description of Artificial Sequence: Synthetic oligonucleotide
  Target: FXN; (+) strand; PAM type: NRG; PAM sequence: GGG
gccccgcccacagctgacag

SEQ ID NO: 20960 - DNA, 20 bp, Artificial Sequence
  Description of Artificial Sequence: Synthetic oligonucleotide
  Target: FXN; (+) strand; PAM type: NRG; PAM sequence: CAG
gcccacagctgacaggggct

SEQ ID NO: 20961 - DNA, 20 bp, Artificial Sequence
  Description of Artificial Sequence: Synthetic oligonucleotide
  Target: FXN; (+) strand; PAM type: NRG; PAM sequence: AAG
cacagctgacaggggctcag

SEQ ID NO: 20962 - DNA, 20 bp, Artificial Sequence
  Description of Artificial Sequence: Synthetic oligonucleotide
  Target: FXN; (+) strand; PAM type: NRG; PAM sequence: TAG
tgacaggggctcagaagtgc

SEQ ID NO: 20963 - DNA, 20 bp, Artificial Sequence
  Description of Artificial Sequence: Synthetic oligonucleotide
  Target: FXN; (+) strand; PAM type: NRG; PAM sequence: AGG
gacaggggctcagaagtgct

SEQ ID NO: 20964 - DNA, 20 bp, Artificial Sequence
  Description of Artificial Sequence: Synthetic oligonucleotide
  Target: FXN; (+) strand; PAM type: NRG; PAM sequence: GGG
acaggggctcagaagtgcta

SEQ ID NO: 20965 - DNA, 20 bp, Artificial Sequence
  Description of Artificial Sequence: Synthetic oligonucleotide
  Target: FXN; (+) strand; PAM type: NRG; PAM sequence: GGG
caggggctcagaagtgctag

SEQ ID NO: 20966 - DNA, 20 bp, Artificial Sequence
  Description of Artificial Sequence: Synthetic oligonucleotide
  Target: FXN; (+) strand; PAM type: NRG; PAM sequence: GGG
aggggctcagaagtgctagg

SEQ ID NO: 20967 - DNA, 20 bp, Artificial Sequence
  Description of Artificial Sequence: Synthetic oligonucleotide
  Target: FXN; (+) strand; PAM type: NRG; PAM sequence: TGG
cagaagtgctagggggacca

SEQ ID NO: 20968 - DNA, 20 bp, Artificial Sequence
  Description of Artificial Sequence: Synthetic oligonucleotide
  Target: FXN; (+) strand; PAM type: NRG; PAM sequence: GGG
agaagtgctagggggaccat

SEQ ID NO: 20969 - DNA, 20 bp, Artificial Sequence
  Description of Artificial Sequence: Synthetic oligonucleotide
  Target: FXN; (+) strand; PAM type: NRG; PAM sequence: CAG
ctagggggaccatgggccac

SEQ ID NO: 20970 - DNA, 20 bp, Artificial Sequence
  Description of Artificial Sequence: Synthetic oligonucleotide
  Target: FXN; (+) strand; PAM type: NRG; PAM sequence: AGG
tagggggaccatgggccacc

SEQ ID NO: 20971 - DNA, 20 bp, Artificial Sequence
  Description of Artificial Sequence: Synthetic oligonucleotide
  Target: FXN; (+) strand; PAM type: NRG; PAM sequence: GGG
agggggaccatgggccacca

SEQ ID NO: 20972 - DNA, 20 bp, Artificial Sequence
  Description of Artificial Sequence: Synthetic oligonucleotide
  Target: FXN; (+) strand; PAM type: NRG; PAM sequence: CAG
ccatgggccaccagggccac

SEQ ID NO: 20973 - DNA, 20 bp, Artificial Sequence
  Description of Artificial Sequence: Synthetic oligonucleotide
  Target: FXN; (+) strand; PAM type: NRG; PAM sequence: AGG
catgggccaccagggccacc

SEQ ID NO: 20974 - DNA, 20 bp, Artificial Sequence
  Description of Artificial Sequence: Synthetic oligonucleotide
  Target: FXN; (+) strand; PAM type: NRG; PAM sequence: GAG
tgggccaccagggccaccag

SEQ ID NO: 20975 - DNA, 20 bp, Artificial Sequence
  Description of Artificial Sequence: Synthetic oligonucleotide
  Target: FXN; (+) strand; PAM type: NRG; PAM sequence: AGG
gggccaccagggccaccagg

SEQ ID NO: 20976 - DNA, 20 bp, Artificial Sequence
  Description of Artificial Sequence: Synthetic oligonucleotide
  Target: FXN; (+) strand; PAM type: NRG; PAM sequence: GGG
ggccaccagggccaccagga

SEQ ID NO: 20977 - DNA, 20 bp, Artificial Sequence
  Description of Artificial Sequence: Synthetic oligonucleotide
  Target: FXN; (+) strand; PAM type: NRG; PAM sequence: GAG
ccaccagggccaccaggagg

SEQ ID NO: 20978 - DNA, 20 bp, Artificial Sequence
  Description of Artificial Sequence: Synthetic oligonucleotide
  Target: FXN; (+) strand; PAM type: NRG; PAM sequence: AGG
caccagggccaccaggaggg

SEQ ID NO: 20979 - DNA, 20 bp, Artificial Sequence
  Description of Artificial Sequence: Synthetic oligonucleotide
  Target: FXN; (+) strand; PAM type: NRG; PAM sequence: CAG
cagggccaccaggagggagg

SEQ ID NO: 20980 - DNA, 20 bp, Artificial Sequence
  Description of Artificial Sequence: Synthetic oligonucleotide
  Target: FXN; (+) strand; PAM type: NRG; PAM sequence: AGG
agggccaccaggagggaggc

SEQ ID NO: 20981 - DNA, 20 bp, Artificial Sequence
  Description of Artificial Sequence: Synthetic oligonucleotide
  Target: FXN; (+) strand; PAM type: NRG; PAM sequence: GAG
agggaggcaggtaacgatgc

SEQ ID NO: 20982 - DNA, 20 bp, Artificial Sequence
  Description of Artificial Sequence: Synthetic oligonucleotide
  Target: FXN; (+) strand; PAM type: NRG; PAM sequence: AGG
gggaggcaggtaacgatgcg

SEQ ID NO: 20983 - DNA, 20 bp, Artificial Sequence
  Description of Artificial Sequence: Synthetic oligonucleotide
  Target: FXN; (+) strand; PAM type: NRG; PAM sequence: GGG
ggaggcaggtaacgatgcga

SEQ ID NO: 20984 - DNA, 20 bp, Artificial Sequence
  Description of Artificial Sequence: Synthetic oligonucleotide
  Target: FXN; (+) strand; PAM type: NRG; PAM sequence: TGG
caggtaacgatgcgagggct

SEQ ID NO: 20985 - DNA, 20 bp, Artificial Sequence
  Description of Artificial Sequence: Synthetic oligonucleotide
  Target: FXN; (+) strand; PAM type: NRG; PAM sequence: CAG
acgatgcgagggcttggatg

SEQ ID NO: 20986 - DNA, 20 bp, Artificial Sequence
  Description of Artificial Sequence: Synthetic oligonucleotide
  Target: FXN; (+) strand; PAM type: NRG; PAM sequence: CAG
agggcttggatgcagaacac

SEQ ID NO: 20987 - DNA, 20 bp, Artificial Sequence
  Description of Artificial Sequence: Synthetic oligonucleotide
  Target: FXN; (+) strand; PAM type: NRG; PAM sequence: TGG
cttggatgcagaacaccagc

SEQ ID NO: 20988 - DNA, 20 bp, Artificial Sequence
  Description of Artificial Sequence: Synthetic oligonucleotide
  Target: FXN; (+) strand; PAM type: NRG; PAM sequence: TGG
gattctgttttccctgtacc

SEQ ID NO: 20989 - DNA, 20 bp, Artificial Sequence
  Description of Artificial Sequence: Synthetic oligonucleotide
  Target: FXN; (+) strand; PAM type: NRG; PAM sequence: GGG
attctgttttccctgtacct

SEQ ID NO: 20990 - DNA, 20 bp, Artificial Sequence
  Description of Artificial Sequence: Synthetic oligonucleotide
  Target: FXN; (+) strand; PAM type: NRG; PAM sequence: CAG
gtacctgggtcctgaatgcc

SEQ ID NO: 20991 - DNA, 20 bp, Artificial Sequence
  Description of Artificial Sequence: Synthetic oligonucleotide
  Target: FXN; (+) strand; PAM type: NRG; PAM sequence: GAG
acctgggtcctgaatgccca

SEQ ID NO: 20992 - DNA, 20 bp, Artificial Sequence
  Description of Artificial Sequence: Synthetic oligonucleotide
  Target: FXN; (+) strand; PAM type: NRG; PAM sequence: AGG
cctgggtcctgaatgcccag

SEQ ID NO: 20993 - DNA, 20 bp, Artificial Sequence
  Description of Artificial Sequence: Synthetic oligonucleotide
  Target: FXN; (+) strand; PAM type: NRG; PAM sequence: CAG
gtcctgaatgcccagaggct

SEQ ID NO: 20994 - DNA, 20 bp, Artificial Sequence
  Description of Artificial Sequence: Synthetic oligonucleotide
  Target: FXN; (+) strand; PAM type: NRG; PAM sequence: AGG
tcctgaatgcccagaggctc

SEQ ID NO: 20995 - DNA, 20 bp, Artificial Sequence
  Description of Artificial Sequence: Synthetic oligonucleotide
  Target: FXN; (+) strand; PAM type: NRG; PAM sequence: GGG
cctgaatgcccagaggctca

SEQ ID NO: 20996 - DNA, 20 bp, Artificial Sequence
  Description of Artificial Sequence: Synthetic oligonucleotide
  Target: FXN; (+) strand; PAM type: NRG; PAM sequence: CAG
ccagaggctcagggaaacac

SEQ ID NO: 20997 - DNA, 20 bp, Artificial Sequence
  Description of Artificial Sequence: Synthetic oligonucleotide
  Target: FXN; (+) strand; PAM type: NRG; PAM sequence: CAG
aggctcagggaaacaccagc

SEQ ID NO: 20998 - DNA, 20 bp, Artificial Sequence
  Description of Artificial Sequence: Synthetic oligonucleotide
  Target: FXN; (+) strand; PAM type: NRG; PAM sequence: AAG
agccagtgctgctgccttta

SEQ ID NO: 20999 - DNA, 20 bp, Artificial Sequence
  Description of Artificial Sequence: Synthetic oligonucleotide
  Target: FXN; (+) strand; PAM type: NRG; PAM sequence: TAG
tgactgatctcttgttaatt

SEQ ID NO: 21000 - DNA, 20 bp, Artificial Sequence
  Description of Artificial Sequence: Synthetic oligonucleotide
  Target: FXN; (+) strand; PAM type: NRG; PAM sequence: TGG
gttaatttagcaactgttat

SEQ ID NO: 21001 - DNA, 20 bp, Artificial Sequence
  Description of Artificial Sequence: Synthetic oligonucleotide
  Target: FXN; (+) strand; PAM type: NRG; PAM sequence: CAG
actgttattggttgatgctg

SEQ ID NO: 21002 - DNA, 20 bp, Artificial Sequence
  Description of Artificial Sequence: Synthetic oligonucleotide
  Target: FXN; (+) strand; PAM type: NRG; PAM sequence: AAG
tgctgcagttgctcttattg

SEQ ID NO: 21003 - DNA, 20 bp, Artificial Sequence
  Description of Artificial Sequence: Synthetic oligonucleotide
  Target: FXN; (+) strand; PAM type: NRG; PAM sequence: TAG
tcttattgaagtttgattga

SEQ ID NO: 21004 - DNA, 20 bp, Artificial Sequence
  Description of Artificial Sequence: Synthetic oligonucleotide
  Target: FXN; (+) strand; PAM type: NRG; PAM sequence: TAG
tgaagtttgattgatagcat

SEQ ID NO: 21005 - DNA, 20 bp, Artificial Sequence
  Description of Artificial Sequence: Synthetic oligonucleotide
  Target: FXN; (+) strand; PAM type: NRG; PAM sequence: AGG
gaagtttgattgatagcatt

SEQ ID NO: 21006 - DNA, 20 bp, Artificial Sequence
  Description of Artificial Sequence: Synthetic oligonucleotide
  Target: FXN; (+) strand; PAM type: NRG; PAM sequence: TGG
tttgattgatagcattagga

SEQ ID NO: 21007 - DNA, 20 bp, Artificial Sequence
  Description of Artificial Sequence: Synthetic oligonucleotide
  Target: FXN; (+) strand; PAM type: NRG; PAM sequence: AAG
attgatagcattaggatggt

SEQ ID NO: 21008 - DNA, 20 bp, Artificial Sequence
  Description of Artificial Sequence: Synthetic oligonucleotide
  Target: FXN; (+) strand; PAM type: NRG; PAM sequence: AGG
ttgatagcattaggatggta

SEQ ID NO: 21009 - DNA, 20 bp, Artificial Sequence
  Description of Artificial Sequence: Synthetic oligonucleotide
  Target: FXN; (+) strand; PAM type: NRG; PAM sequence: AAG
aaggcactatttttcaaata

SEQ ID NO: 21010 - DNA, 20 bp, Artificial Sequence
  Description of Artificial Sequence: Synthetic oligonucleotide
  Target: FXN; (+) strand; PAM type: NRG; PAM sequence: AGG
aggcactatttttcaaataa

SEQ ID NO: 21011 - DNA, 20 bp, Artificial Sequence
  Description of Artificial Sequence: Synthetic oligonucleotide
  Target: FXN; (+) strand; PAM type: NRG; PAM sequence: CAG
aattttgtttttttttctct

SEQ ID NO: 21012 - DNA, 20 bp, Artificial Sequence
  Description of Artificial Sequence: Synthetic oligonucleotide
  Target: FXN; (+) strand; PAM type: NRG; PAM sequence: TGG
tttctctcagcctttcacat

SEQ ID NO: 21013 - DNA, 20 bp, Artificial Sequence
  Description of Artificial Sequence: Synthetic oligonucleotide
  Target: FXN; (+) strand; PAM type: NRG; PAM sequence: TGG
ggttcaaaatatctttcatc

SEQ ID NO: 21014 - DNA, 20 bp, Artificial Sequence
  Description of Artificial Sequence: Synthetic oligonucleotide
  Target: FXN; (+) strand; PAM type: NRG; PAM sequence: TGG
aataattttttttgtcaaca

SEQ ID NO: 21015 - DNA, 20 bp, Artificial Sequence
  Description of Artificial Sequence: Synthetic oligonucleotide
  Target: FXN; (+) strand; PAM type: NRG; PAM sequence: GGG
ataattttttttgtcaacat

SEQ ID NO: 21016 - DNA, 20 bp, Artificial Sequence
  Description of Artificial Sequence: Synthetic oligonucleotide
  Target: FXN; (+) strand; PAM type: NRG; PAM sequence: GGG
taattttttttgtcaacatg

SEQ ID NO: 21017 - DNA, 20 bp, Artificial Sequence
  Description of Artificial Sequence: Synthetic oligonucleotide
  Target: FXN; (+) strand; PAM type: NRG; PAM sequence: TAG
tggggtctcactttgttgcc

SEQ ID NO: 21018 - DNA, 20 bp, Artificial Sequence
  Description of Artificial Sequence: Synthetic oligonucleotide
  Target: FXN; (+) strand; PAM type: NRG; PAM sequence: AGG
ggggtctcactttgttgcct

SEQ ID NO: 21019 - DNA, 20 bp, Artificial Sequence
  Description of Artificial Sequence: Synthetic oligonucleotide
  Target: FXN; (+) strand; PAM type: NRG; PAM sequence: TGG
tctcactttgttgcctaggt

SEQ ID NO: 21020 - DNA, 20 bp, Artificial Sequence
  Description of Artificial Sequence: Synthetic oligonucleotide
  Target: FXN; (+) strand; PAM type: NRG; PAM sequence: TGG
ctaggttggtctgaaactcg

SEQ ID NO: 21021 - DNA, 20 bp, Artificial Sequence
  Description of Artificial Sequence: Synthetic oligonucleotide
  Target: FXN; (+) strand; PAM type: NRG; PAM sequence: AAG
ggtctgaaactcgtggcttc

SEQ ID NO: 21022 - DNA, 20 bp, Artificial Sequence
  Description of Artificial Sequence: Synthetic oligonucleotide
  Target: FXN; (+) strand; PAM type: NRG; PAM sequence: CAG
ttcaagcaatcctcccacat

SEQ ID NO: 21023 - DNA, 20 bp, Artificial Sequence
  Description of Artificial Sequence: Synthetic oligonucleotide
  Target: FXN; (+) strand; PAM type: NRG; PAM sequence: AAG
cctcccacatcagcctccca

SEQ ID NO: 21024 - DNA, 20 bp, Artificial Sequence
  Description of Artificial Sequence: Synthetic oligonucleotide
  Target: FXN; (+) strand; PAM type: NRG; PAM sequence: TGG
acatcagcctcccaaagtgc

SEQ ID NO: 21025 - DNA, 20 bp, Artificial Sequence
  Description of Artificial Sequence: Synthetic oligonucleotide
  Target: FXN; (+) strand; PAM type: NRG; PAM sequence: GGG
catcagcctcccaaagtgct

SEQ ID NO: 21026 - DNA, 20 bp, Artificial Sequence
  Description of Artificial Sequence: Synthetic oligonucleotide
  Target: FXN; (+) strand; PAM type: NRG; PAM sequence: GGG
atcagcctcccaaagtgctg

SEQ ID NO: 21027 - DNA, 20 bp, Artificial Sequence
  Description of Artificial Sequence: Synthetic oligonucleotide
  Target: FXN; (+) strand; PAM type: NRG; PAM sequence: TGG
ctcccaaagtgctggggtta

SEQ ID NO: 21028 - DNA, 20 bp, Artificial Sequence
  Description of Artificial Sequence: Synthetic oligonucleotide
  Target: FXN; (+) strand; PAM type: NRG; PAM sequence: GGG
tcccaaagtgctggggttat

SEQ ID NO: 21029 - DNA, 20 bp, Artificial Sequence
  Description of Artificial Sequence: Synthetic oligonucleotide
  Target: FXN; (+) strand; PAM type: NRG; PAM sequence: GAG
agtgctggggttatgggtgt

SEQ ID NO: 21030 - DNA, 20 bp, Artificial Sequence
  Description of Artificial Sequence: Synthetic oligonucleotide
  Target: FXN; (+) strand; PAM type: NRG; PAM sequence: CAG
gttatgggtgtgagccactg

SEQ ID NO: 21031 - DNA, 20 bp, Artificial Sequence
  Description of Artificial Sequence: Synthetic oligonucleotide
  Target: FXN; (+) strand; PAM type: NRG; PAM sequence: CAG
atgggtgtgagccactgcag

SEQ ID NO: 21032 - DNA, 20 bp, Artificial Sequence
  Description of Artificial Sequence: Synthetic oligonucleotide
  Target: FXN; (+) strand; PAM type: NRG; PAM sequence: AAG
tttgttttttttaatttgac

SEQ ID NO: 21033 - DNA, 20 bp, Artificial Sequence
  Description of Artificial Sequence: Synthetic oligonucleotide
  Target: FXN; (+) strand; PAM type: NRG; PAM sequence: CAG
tttttaatttgacaagtttt

SEQ ID NO: 21034 - DNA, 20 bp, Artificial Sequence
  Description of Artificial Sequence: Synthetic oligonucleotide
  Target: FXN; (+) strand; PAM type: NRG; PAM sequence: AGG
ttttaatttgacaagttttc

SEQ ID NO: 21035 - DNA, 20 bp, Artificial Sequence
  Description of Artificial Sequence: Synthetic oligonucleotide
  Target: FXN; (+) strand; PAM type: NRG; PAM sequence: CAG
gttttcaggtcctgtgaaat

SEQ ID NO: 21036 - DNA, 20 bp, Artificial Sequence
  Description of Artificial Sequence: Synthetic oligonucleotide
  Target: FXN; (+) strand; PAM type: NRG; PAM sequence: CAG
ttcaggtcctgtgaaatcag

SEQ ID NO: 21037 - DNA, 20 bp, Artificial Sequence
  Description of Artificial Sequence: Synthetic oligonucleotide
  Target: FXN; (+) strand; PAM type: NRG; PAM sequence: GAG
cctcccaccttgcgcaccct

SEQ ID NO: 21038 - DNA, 20 bp, Artificial Sequence
  Description of Artificial Sequence: Synthetic oligonucleotide
  Target: FXN; (+) strand; PAM type: NRG; PAM sequence: AGG
ctcccaccttgcgcaccctg

SEQ ID NO: 21039 - DNA, 20 bp, Artificial Sequence
  Description of Artificial Sequence: Synthetic oligonucleotide
  Target: FXN; (+) strand; PAM type: NRG; PAM sequence: GAG
cccaccttgcgcaccctgag

SEQ ID NO: 21040 - DNA, 20 bp, Artificial Sequence
  Description of Artificial Sequence: Synthetic oligonucleotide
  Target: FXN; (+) strand; PAM type: NRG; PAM sequence: AGG
ccaccttgcgcaccctgagg

SEQ ID NO: 21041 - DNA, 20 bp, Artificial Sequence
  Description of Artificial Sequence: Synthetic oligonucleotide
  Target: FXN; (+) strand; PAM type: NRG; PAM sequence: CAG
tgcgcaccctgaggaggttg

SEQ ID NO: 21042 - DNA, 20 bp, Artificial Sequence
  Description of Artificial Sequence: Synthetic oligonucleotide
  Target: FXN; (+) strand; PAM type: NRG; PAM sequence: AAG
cctgaggaggttgcagaata

SEQ ID NO: 21043 - DNA, 20 bp, Artificial Sequence
  Description of Artificial Sequence: Synthetic oligonucleotide
  Target: FXN; (+) strand; PAM type: NRG; PAM sequence: AGG
ctgaggaggttgcagaataa

SEQ ID NO: 21044 - DNA, 20 bp, Artificial Sequence
  Description of Artificial Sequence: Synthetic oligonucleotide
  Target: FXN; (+) strand; PAM type: NRG; PAM sequence: GAG
gaggaggttgcagaataaag

SEQ ID NO: 21045 - DNA, 20 bp, Artificial Sequence
  Description of Artificial Sequence: Synthetic oligonucleotide
  Target: FXN; (+) strand; PAM type: NRG; PAM sequence: TAG
tgcagaataaaggagaattc

SEQ ID NO: 21046 - DNA, 20 bp, Artificial Sequence
  Description of Artificial Sequence: Synthetic oligonucleotide
  Target: FXN; (+) strand; PAM type: NRG; PAM sequence: AGG
gcagaataaaggagaattct

SEQ ID NO: 21047 - DNA, 20 bp, Artificial Sequence
  Description of Artificial Sequence: Synthetic oligonucleotide
  Target: FXN; (+) strand; PAM type: NRG; PAM sequence: GGG
cagaataaaggagaattcta

SEQ ID NO: 21048 - DNA, 20 bp, Artificial Sequence
  Description of Artificial Sequence: Synthetic oligonucleotide
  Target: FXN; (+) strand; PAM type: NRG; PAM sequence: TGG
aggagaattctagggacacg

SEQ ID NO: 21049 - DNA, 20 bp, Artificial Sequence
  Description of Artificial Sequence: Synthetic oligonucleotide
  Target: FXN; (+) strand; PAM type: NRG; PAM sequence: GGG
ggagaattctagggacacgt

SEQ ID NO: 21050 - DNA, 20 bp, Artificial Sequence
  Description of Artificial Sequence: Synthetic oligonucleotide
  Target: FXN; (+) strand; PAM type: NRG; PAM sequence: CAG
ttctagggacacgtgggcat

SEQ ID NO: 21051 - DNA, 20 bp, Artificial Sequence
  Description of Artificial Sequence: Synthetic oligonucleotide
  Target: FXN; (+) strand; PAM type: NRG; PAM sequence: CAG
tgggcatcagtgcctgtgct

SEQ ID NO: 21052 - DNA, 20 bp, Artificial Sequence
  Description of Artificial Sequence: Synthetic oligonucleotide
  Target: FXN; (+) strand; PAM type: NRG; PAM sequence: GAG
ggcatcagtgcctgtgctca

SEQ ID NO: 21053 - DNA, 20 bp, Artificial Sequence
  Description of Artificial Sequence: Synthetic oligonucleotide
  Target: FXN; (+) strand; PAM type: NRG; PAM sequence: CAG
tgcctgtgctcagagcacct

SEQ ID NO: 21054 - DNA, 20 bp, Artificial Sequence
  Description of Artificial Sequence: Synthetic oligonucleotide
  Target: FXN; (+) strand; PAM type: NRG; PAM sequence: AGG
gcctgtgctcagagcacctc

SEQ ID NO: 21055 - DNA, 20 bp, Artificial Sequence
  Description of Artificial Sequence: Synthetic oligonucleotide
  Target: FXN; (+) strand; PAM type: NRG; PAM sequence: CAG
tgtgctcagagcacctcagg

SEQ ID NO: 21056 - DNA, 20 bp, Artificial Sequence
  Description of Artificial Sequence: Synthetic oligonucleotide
  Target: FXN; (+) strand; PAM type: NRG; PAM sequence: TGG
tcagagcacctcaggcagtg

SEQ ID NO: 21057 - DNA, 20 bp, Artificial Sequence
  Description of Artificial Sequence: Synthetic oligonucleotide
  Target: FXN; (+) strand; PAM type: NRG; PAM sequence: GAG
agagcacctcaggcagtgtg

SEQ ID NO: 21058 - DNA, 20 bp, Artificial Sequence
  Description of Artificial Sequence: Synthetic oligonucleotide
  Target: FXN; (+) strand; PAM type: NRG; PAM sequence: AGG
gagcacctcaggcagtgtgg

SEQ ID NO: 21059 - DNA, 20 bp, Artificial Sequence
  Description of Artificial Sequence: Synthetic oligonucleotide
  Target: FXN; (+) strand; PAM type: NRG; PAM sequence: GGG
agcacctcaggcagtgtgga

SEQ ID NO: 21060 - DNA, 20 bp, Artificial Sequence
  Description of Artificial Sequence: Synthetic oligonucleotide
  Target: FXN; (+) strand; PAM type: NRG; PAM sequence: GGG
gcacctcaggcagtgtggag

SEQ ID NO: 21061 - DNA, 20 bp, Artificial Sequence
  Description of Artificial Sequence: Synthetic oligonucleotide
  Target: FXN; (+) strand; PAM type: NRG; PAM sequence: TAG
tcaggcagtgtggaggggtc

SEQ ID NO: 21062 - DNA, 20 bp, Artificial Sequence
  Description of Artificial Sequence: Synthetic oligonucleotide
  Target: FXN; (+) strand; PAM type: NRG; PAM sequence: GAG
aggcagtgtggaggggtcta

SEQ ID NO: 21063 - DNA, 20 bp, Artificial Sequence
  Description of Artificial Sequence: Synthetic oligonucleotide
  Target: FXN; (+) strand; PAM type: NRG; PAM sequence: AGG
ggcagtgtggaggggtctag

SEQ ID NO: 21064 - DNA, 20 bp, Artificial Sequence
  Description of Artificial Sequence: Synthetic oligonucleotide
  Target: FXN; (+) strand; PAM type: NRG; PAM sequence: CAG
ggaggggtctagaggttact

SEQ ID NO: 21065 - DNA, 20 bp, Artificial Sequence
  Description of Artificial Sequence: Synthetic oligonucleotide
  Target: FXN; (+) strand; PAM type: NRG; PAM sequence: AGG
gaggggtctagaggttactc

SEQ ID NO: 21066 - DNA, 20 bp, Artificial Sequence
  Description of Artificial Sequence: Synthetic oligonucleotide
  Target: FXN; (+) strand; PAM type: NRG; PAM sequence: TGG
gaggttactcaggctctgcc

SEQ ID NO: 21067 - DNA, 20 bp, Artificial Sequence
  Description of Artificial Sequence: Synthetic oligonucleotide
  Target: FXN; (+) strand; PAM type: NRG; PAM sequence: TAG
ggctctgcctggcaacccga

SEQ ID NO: 21068 - DNA, 20 bp, Artificial Sequence
  Description of Artificial Sequence: Synthetic oligonucleotide
  Target: FXN; (+) strand; PAM type: NRG; PAM sequence: CAG
tctgcctggcaacccgatag

SEQ ID NO: 21069 - DNA, 20 bp, Artificial Sequence
  Description of Artificial Sequence: Synthetic oligonucleotide
  Target: FXN; (+) strand; PAM type: NRG; PAM sequence: CAG
tggcaacccgatagcagtat

SEQ ID NO: 21070 - DNA, 20 bp, Artificial Sequence
  Description of Artificial Sequence: Synthetic oligonucleotide
  Target: FXN; (+) strand; PAM type: NRG; PAM sequence: GAG
gcaacccgatagcagtatca

SEQ ID NO: 21071 - DNA, 20 bp, Artificial Sequence
  Description of Artificial Sequence: Synthetic oligonucleotide
  Target: FXN; (+) strand; PAM type: NRG; PAM sequence: TAG
ccgatagcagtatcagagta

SEQ ID NO: 21072 - DNA, 20 bp, Artificial Sequence
  Description of Artificial Sequence: Synthetic oligonucleotide
  Target: FXN; (+) strand; PAM type: NRG; PAM sequence: AGG
cgatagcagtatcagagtat

SEQ ID NO: 21073 - DNA, 20 bp, Artificial Sequence
  Description of Artificial Sequence: Synthetic oligonucleotide
  Target: FXN; (+) strand; PAM type: NRG; PAM sequence: GGG
gatagcagtatcagagtata

SEQ ID NO: 21074 - DNA, 20 bp, Artificial Sequence
  Description of Artificial Sequence: Synthetic oligonucleotide
  Target: FXN; (+) strand; PAM type: NRG; PAM sequence: AAG
cagtatcagagtatagggcc

SEQ ID NO: 21075 - DNA, 20 bp, Artificial Sequence
  Description of Artificial Sequence: Synthetic oligonucleotide
  Target: FXN; (+) strand; PAM type: NRG; PAM sequence: AGG
agtatcagagtatagggcca

SEQ ID NO: 21076 - DNA, 20 bp, Artificial Sequence
  Description of Artificial Sequence: Synthetic oligonucleotide
  Target: FXN; (+) strand; PAM type: NRG; PAM sequence: GGG
gtatcagagtatagggccaa

SEQ ID NO: 21077 - DNA, 20 bp, Artificial Sequence
  Description of Artificial Sequence: Synthetic oligonucleotide
  Target: FXN; (+) strand; PAM type: NRG; PAM sequence: GGG
tatcagagtatagggccaag

SEQ ID NO: 21078 - DNA, 20 bp, Artificial Sequence
  Description of Artificial Sequence: Synthetic oligonucleotide
  Target: FXN; (+) strand; PAM type: NRG; PAM sequence: CGG
agagtatagggccaagggga

SEQ ID NO: 21079 - DNA, 20 bp, Artificial Sequence
  Description of Artificial Sequence: Synthetic oligonucleotide
  Target: FXN; (+) strand; PAM type: NRG; PAM sequence: TGG
agggccaaggggacggtcct

SEQ ID NO: 21080 - DNA, 20 bp, Artificial Sequence
  Description of Artificial Sequence: Synthetic oligonucleotide
  Target: FXN; (+) strand; PAM type: NRG; PAM sequence: GGG
gggccaaggggacggtcctt

SEQ ID NO: 21081 - DNA, 20 bp, Artificial Sequence
  Description of Artificial Sequence: Synthetic oligonucleotide
  Target: FXN; (+) strand; PAM type: NRG; PAM sequence: TGG
aaggggacggtccttgggct

SEQ ID NO: 21082 - DNA, 20 bp, Artificial Sequence
  Description of Artificial Sequence: Synthetic oligonucleotide
  Target: FXN; (+) strand; PAM type: NRG; PAM sequence: TGG
gacggtccttgggcttggtg

SEQ ID NO: 21083 - DNA, 20 bp, Artificial Sequence
  Description of Artificial Sequence: Synthetic oligonucleotide
  Target: FXN; (+) strand; PAM type: NRG; PAM sequence: TAG
ttgggcttggtgtggtttat

SEQ ID NO: 21084 - DNA, 20 bp, Artificial Sequence
  Description of Artificial Sequence: Synthetic oligonucleotide
  Target: FXN; (+) strand; PAM type: NRG; PAM sequence: TGG
tccttttcctgtgaccctga

SEQ ID NO: 21085 - DNA, 20 bp, Artificial Sequence
  Description of Artificial Sequence: Synthetic oligonucleotide
  Target: FXN; (+) strand; PAM type: NRG; PAM sequence: TGG
ttcctgtgaccctgatggtt

SEQ ID NO: 21086 - DNA, 20 bp, Artificial Sequence
  Description of Artificial Sequence: Synthetic oligonucleotide
  Target: FXN; (+) strand; PAM type: NRG; PAM sequence: TGG
actcatttttatctccatac

SEQ ID NO: 21087 - DNA, 20 bp, Artificial Sequence
  Description of Artificial Sequence: Synthetic oligonucleotide
  Target: FXN; (+) strand; PAM type: NRG; PAM sequence: GGG
ctcatttttatctccatact

SEQ ID NO: 21088 - DNA, 20 bp, Artificial Sequence
  Description of Artificial Sequence: Synthetic oligonucleotide
  Target: FXN; (+) strand; PAM type: NRG; PAM sequence: CAG
ttttatctccatactgggaa

SEQ ID NO: 21089 - DNA, 20 bp, Artificial Sequence
  Description of Artificial Sequence: Synthetic oligonucleotide
  Target: FXN; (+) strand; PAM type: NRG; PAM sequence: AGG
tttatctccatactgggaac

SEQ ID NO: 21090 - DNA, 20 bp, Artificial Sequence
  Description of Artificial Sequence: Synthetic oligonucleotide
  Target: FXN; (+) strand; PAM type: NRG; PAM sequence: AAG
tccatactgggaacaggttc

SEQ ID NO: 21091 - DNA, 20 bp, Artificial Sequence
  Description of Artificial Sequence: Synthetic oligonucleotide
  Target: FXN; (+) strand; PAM type: NRG; PAM sequence: CAG
ctgggaacaggttcaagccc

SEQ ID NO: 21092 - DNA, 20 bp, Artificial Sequence
  Description of Artificial Sequence: Synthetic oligonucleotide
  Target: FXN; (+) strand; PAM type: NRG; PAM sequence: TGG
caggttcaagccccagcatt

SEQ ID NO: 21093 - DNA, 20 bp, Artificial Sequence
  Description of Artificial Sequence: Synthetic oligonucleotide
  Target: FXN; (+) strand; PAM type: NRG; PAM sequence: CAG
ccagcatttggttgataatg

SEQ ID NO: 21094 - DNA, 20 bp, Artificial Sequence
  Description of Artificial Sequence: Synthetic oligonucleotide
  Target: FXN; (+) strand; PAM type: NRG; PAM sequence: AGG
cagcatttggttgataatgc

SEQ ID NO: 21095 - DNA, 20 bp, Artificial Sequence
  Description of Artificial Sequence: Synthetic oligonucleotide
  Target: FXN; (+) strand; PAM type: NRG; PAM sequence: AAG
ccttgatacttttattgccc

SEQ ID NO: 21096 - DNA, 20 bp, Artificial Sequence
  Description of Artificial Sequence: Synthetic oligonucleotide
  Target: FXN; (+) strand; PAM type: NRG; PAM sequence: TGG
attgcccaagcttcccttcc

SEQ ID NO: 21097 - DNA, 20 bp, Artificial Sequence
  Description of Artificial Sequence: Synthetic oligonucleotide
  Target: FXN; (+) strand; PAM type: NRG; PAM sequence: TAG
ccttcctggtgacctcatcc

SEQ ID NO: 21098 - DNA, 20 bp, Artificial Sequence
  Description of Artificial Sequence: Synthetic oligonucleotide
  Target: FXN; (+) strand; PAM type: NRG; PAM sequence: CAG
tggtgacctcatcctagcct

SEQ ID NO: 21099 - DNA, 20 bp, Artificial Sequence
  Description of Artificial Sequence: Synthetic oligonucleotide
  Target: FXN; (+) strand; PAM type: NRG; PAM sequence: TGG
ctcatcctagcctcagtctt

SEQ ID NO: 21100 - DNA, 20 bp, Artificial Sequence
  Description of Artificial Sequence: Synthetic oligonucleotide
  Target: FXN; (+) strand; PAM type: NRG; PAM sequence: AAG
cctagcctcagtctttggaa

SEQ ID NO: 21101 - DNA, 20 bp, Artificial Sequence
  Description of Artificial Sequence: Synthetic oligonucleotide
  Target: FXN; (+) strand; PAM type: NRG; PAM sequence: GAG
tctttggaaaagccctcctt

SEQ ID NO: 21102 - DNA, 20 bp, Artificial Sequence
  Description of Artificial Sequence: Synthetic oligonucleotide
  Target: FXN; (+) strand; PAM type: NRG; PAM sequence: CAG
aaaagccctccttgagtgct

SEQ ID NO: 21103 - DNA, 20 bp, Artificial Sequence
  Description of Artificial Sequence: Synthetic oligonucleotide
  Target: FXN; (+) strand; PAM type: NRG; PAM sequence: AGG
aaagccctccttgagtgctc

SEQ ID NO: 21104 - DNA, 20 bp, Artificial Sequence
  Description of Artificial Sequence: Synthetic oligonucleotide
  Target: FXN; (+) strand; PAM type: NRG; PAM sequence: CAG
gccctccttgagtgctcagg

SEQ ID NO: 21105 - DNA, 20 bp, Artificial Sequence
  Description of Artificial Sequence: Synthetic oligonucleotide
  Target: FXN; (+) strand; PAM type: NRG; PAM sequence: CAG
cttgagtgctcaggcagact

SEQ ID NO: 21106 - DNA, 20 bp, Artificial Sequence
  Description of Artificial Sequence: Synthetic oligonucleotide
  Target: FXN; (+) strand; PAM type: NRG; PAM sequence: AGG
ttgagtgctcaggcagactc

SEQ ID NO: 21107 - DNA, 20 bp, Artificial Sequence
  Description of Artificial Sequence: Synthetic oligonucleotide
  Target: FXN; (+) strand; PAM type: NRG; PAM sequence: TGG
gactcaggtgccctttcttc

SEQ ID NO: 21108 - DNA, 20 bp, Artificial Sequence
  Description of Artificial Sequence: Synthetic oligonucleotide
  Target: FXN; (+) strand; PAM type: NRG; PAM sequence: GGG
actcaggtgccctttcttct

SEQ ID NO: 21109 - DNA, 20 bp, Artificial Sequence
  Description of Artificial Sequence: Synthetic oligonucleotide
  Target: FXN; (+) strand; PAM type: NRG; PAM sequence: CAG
cactctgttcttacctccat

SEQ ID NO: 21110 - DNA, 20 bp, Artificial Sequence
  Description of Artificial Sequence: Synthetic oligonucleotide
  Target: FXN; (+) strand; PAM type: NRG; PAM sequence: AGG
actctgttcttacctccatc

SEQ ID NO: 21111 - DNA, 20 bp, Artificial Sequence
  Description of Artificial Sequence: Synthetic oligonucleotide
  Target: FXN; (+) strand; PAM type: NRG; PAM sequence: GGG
ctctgttcttacctccatca

SEQ ID NO: 21112 - DNA, 20 bp, Artificial Sequence
  Description of Artificial Sequence: Synthetic oligonucleotide
  Target: FXN; (+) strand; PAM type: NRG; PAM sequence: TAG
catcagggtgccacatgcac

SEQ ID NO: 21113 - DNA, 20 bp, Artificial Sequence
  Description of Artificial Sequence: Synthetic oligonucleotide
  Target: FXN; (+) strand; PAM type: NRG; PAM sequence: TGG
actagtgttatctgctgccg

SEQ ID NO: 21114 - DNA, 20 bp, Artificial Sequence
  Description of Artificial Sequence: Synthetic oligonucleotide
  Target: FXN; (+) strand; PAM type: NRG; PAM sequence: GAG
tgccgtggccaatcatccat

SEQ ID NO: 21115 - DNA, 20 bp, Artificial Sequence
  Description of Artificial Sequence: Synthetic oligonucleotide
  Target: FXN; (+) strand; PAM type: NRG; PAM sequence: AGG
gccgtggccaatcatccatg

SEQ ID NO: 21116 - DNA, 20 bp, Artificial Sequence
  Description of Artificial Sequence: Synthetic oligonucleotide
  Target: FXN; (+) strand; PAM type: NRG; PAM sequence: GAG
ccaatcatccatgaggccat

SEQ ID NO: 21117 - DNA, 20 bp, Artificial Sequence
  Description of Artificial Sequence: Synthetic oligonucleotide
  Target: FXN; (+) strand; PAM type: NRG; PAM sequence: AGG
caatcatccatgaggccatg

SEQ ID NO: 21118 - DNA, 20 bp, Artificial Sequence
  Description of Artificial Sequence: Synthetic oligonucleotide
  Target: FXN; (+) strand; PAM type: NRG; PAM sequence: AAG
tcatccatgaggccatgagg

SEQ ID NO: 21119 - DNA, 20 bp, Artificial Sequence
  Description of Artificial Sequence: Synthetic oligonucleotide
  Target: FXN; (+) strand; PAM type: NRG; PAM sequence: TGG
tccatgaggccatgaggaag

SEQ ID NO: 21120 - DNA, 20 bp, Artificial Sequence
  Description of Artificial Sequence: Synthetic oligonucleotide
  Target: FXN; (+) strand; PAM type: NRG; PAM sequence: TGG
gaggaagtggaatgtacatc

SEQ ID NO: 21121 - DNA, 20 bp, Artificial Sequence
  Description of Artificial Sequence: Synthetic oligonucleotide
  Target: FXN; (+) strand; PAM type: NRG; PAM sequence: AAG
gtggaatgtacatctggtat

SEQ ID NO: 21122 - DNA, 20 bp, Artificial Sequence
  Description of Artificial Sequence: Synthetic oligonucleotide
  Target: FXN; (+) strand; PAM type: NRG; PAM sequence: AAG
gaatgtacatctggtataag

SEQ ID NO: 21123 - DNA, 20 bp, Artificial Sequence
  Description of Artificial Sequence: Synthetic oligonucleotide
  Target: FXN; (+) strand; PAM type: NRG; PAM sequence: TGG
acatctggtataagaagaca

SEQ ID NO: 21124 - DNA, 20 bp, Artificial Sequence
  Description of Artificial Sequence: Synthetic oligonucleotide
  Target: FXN; (+) strand; PAM type: NRG; PAM sequence: CAG
tctggtataagaagacatgg

SEQ ID NO: 21125 - DNA, 20 bp, Artificial Sequence
  Description of Artificial Sequence: Synthetic oligonucleotide
  Target: FXN; (+) strand; PAM type: NRG; PAM sequence: AAG
ggtataagaagacatggcag

SEQ ID NO: 21126 - DNA, 20 bp, Artificial Sequence
  Description of Artificial Sequence: Synthetic oligonucleotide
  Target: FXN; (+) strand; PAM type: NRG; PAM sequence: CAG
taagaagacatggcagaagc

SEQ ID NO: 21127 - DNA, 20 bp, Artificial Sequence
  Description of Artificial Sequence: Synthetic oligonucleotide
  Target: FXN; (+) strand; PAM type: NRG; PAM sequence: CAG
ccgatctgtccacacgaata

SEQ ID NO: 21128 - DNA, 20 bp, Artificial Sequence
  Description of Artificial Sequence: Synthetic oligonucleotide
  Target: FXN; (+) strand; PAM type: NRG; PAM sequence: AAG
acacgaatacagcattccca

SEQ ID NO: 21129 - DNA, 20 bp, Artificial Sequence
  Description of Artificial Sequence: Synthetic oligonucleotide
  Target: FXN; (+) strand; PAM type: NRG; PAM sequence: TGG
gtgcatgtgccattattcac

SEQ ID NO: 21130 - DNA, 20 bp, Artificial Sequence
  Description of Artificial Sequence: Synthetic oligonucleotide
  Target: FXN; (+) strand; PAM type: NRG; PAM sequence: GAG
tgtgccattattcactggat

SEQ ID NO: 21131 - DNA, 20 bp, Artificial Sequence
  Description of Artificial Sequence: Synthetic oligonucleotide
  Target: FXN; (+) strand; PAM type: NRG; PAM sequence: GAG
attattcactggatgagctt

SEQ ID NO: 21132 - DNA, 20 bp, Artificial Sequence
  Description of Artificial Sequence: Synthetic oligonucleotide
  Target: FXN; (+) strand; PAM type: NRG; PAM sequence: AGG
ttattcactggatgagcttg

SEQ ID NO: 21133 - DNA, 20 bp, Artificial Sequence
  Description of Artificial Sequence: Synthetic oligonucleotide
  Target: FXN; (+) strand; PAM type: NRG; PAM sequence: TGG
ttcactggatgagcttgagg

SEQ ID NO: 21134 - DNA, 20 bp, Artificial Sequence
  Description of Artificial Sequence: Synthetic oligonucleotide
  Target: FXN; (+) strand; PAM type: NRG; PAM sequence: TAG
tgagcttgaggtggatgaac

SEQ ID NO: 21135 - DNA, 20 bp, Artificial Sequence
  Description of Artificial Sequence: Synthetic oligonucleotide
  Target: FXN; (+) strand; PAM type: NRG; PAM sequence: CAG
aggtggatgaactagcccac

SEQ ID NO: 21136 - DNA, 20 bp, Artificial Sequence
  Description of Artificial Sequence: Synthetic oligonucleotide
  Target: FXN; (+) strand; PAM type: NRG; PAM sequence: AGG
ggtggatgaactagcccacc

SEQ ID NO: 21137 - DNA, 20 bp, Artificial Sequence
  Description of Artificial Sequence: Synthetic oligonucleotide
  Target: FXN; (+) strand; PAM type: NRG; PAM sequence: AAG
catgaatttaacactgaatt

SEQ ID NO: 21138 - DNA, 20 bp, Artificial Sequence
  Description of Artificial Sequence: Synthetic oligonucleotide
  Target: FXN; (+) strand; PAM type: NRG; PAM sequence: TAG
aaaatatgttttaaaaataa

SEQ ID NO: 21139 - DNA, 20 bp, Artificial Sequence
  Description of Artificial Sequence: Synthetic oligonucleotide
  Target: FXN; (+) strand; PAM type: NRG; PAM sequence: TAG
atgttttaaaaataatagtt

SEQ ID NO: 21140 - DNA, 20 bp, Artificial Sequence
  Description of Artificial Sequence: Synthetic oligonucleotide
  Target: FXN; (+) strand; PAM type: NRG; PAM sequence: AGG
tgttttaaaaataatagttt

SEQ ID NO: 21141 - DNA, 20 bp, Artificial Sequence
  Description of Artificial Sequence: Synthetic oligonucleotide
  Target: FXN; (+) strand; PAM type: NRG; PAM sequence: TGG
ataatagtttaggtgattgc

SEQ ID NO: 21142 - DNA, 20 bp, Artificial Sequence
  Description of Artificial Sequence: Synthetic oligonucleotide
  Target: FXN; (+) strand; PAM type: NRG; PAM sequence: GGG
taatagtttaggtgattgct

SEQ ID NO: 21143 - DNA, 20 bp, Artificial Sequence
  Description of Artificial Sequence: Synthetic oligonucleotide
  Target: FXN; (+) strand; PAM type: NRG; PAM sequence: GGG
aatagtttaggtgattgctg

SEQ ID NO: 21144 - DNA, 20 bp, Artificial Sequence
  Description of Artificial Sequence: Synthetic oligonucleotide
  Target: FXN; (+) strand; PAM type: NRG; PAM sequence: TAG
ttaggtgattgctggggtgc

SEQ ID NO: 21145 - DNA, 20 bp, Artificial Sequence
  Description of Artificial Sequence: Synthetic oligonucleotide
  Target: FXN; (+) strand; PAM type: NRG; PAM sequence: AGG
taggtgattgctggggtgct

SEQ ID NO: 21146 - DNA, 20 bp, Artificial Sequence
  Description of Artificial Sequence: Synthetic oligonucleotide
  Target: FXN; (+) strand; PAM type: NRG; PAM sequence: GAG
ggtgattgctggggtgctag

SEQ ID NO: 21147 - DNA, 20 bp, Artificial Sequence
  Description of Artificial Sequence: Synthetic oligonucleotide
  Target: FXN; (+) strand; PAM type: NRG; PAM sequence: GAG
tgattgctggggtgctagga

SEQ ID NO: 21148 - DNA, 20 bp, Artificial Sequence
  Description of Artificial Sequence: Synthetic oligonucleotide
  Target: FXN; (+) strand; PAM type: NRG; PAM sequence: AGG
gattgctggggtgctaggag

SEQ ID NO: 21149 - DNA, 20 bp, Artificial Sequence
  Description of Artificial Sequence: Synthetic oligonucleotide
  Target: FXN; (+) strand; PAM type: NRG; PAM sequence: AAG
tgctggggtgctaggagagg

SEQ ID NO: 21150 - DNA, 20 bp, Artificial Sequence
  Description of Artificial Sequence: Synthetic oligonucleotide
  Target: FXN; (+) strand; PAM type: NRG; PAM sequence: AGG
gctggggtgctaggagagga

SEQ ID NO: 21151 - DNA, 20 bp, Artificial Sequence
  Description of Artificial Sequence: Synthetic oligonucleotide
  Target: FXN; (+) strand; PAM type: NRG; PAM sequence: TGG
ggtgctaggagaggaaggaa

SEQ ID NO: 21152 - DNA, 20 bp, Artificial Sequence
  Description of Artificial Sequence: Synthetic oligonucleotide
  Target: FXN; (+) strand; PAM type: NRG; PAM sequence: GGG
gtgctaggagaggaaggaat

SEQ ID NO: 21153 - DNA, 20 bp, Artificial Sequence
  Description of Artificial Sequence: Synthetic oligonucleotide
  Target: FXN; (+) strand; PAM type: NRG; PAM sequence: GGG
tgctaggagaggaaggaatg

SEQ ID NO: 21154 - DNA, 20 bp, Artificial Sequence
  Description of Artificial Sequence: Synthetic oligonucleotide
  Target: FXN; (+) strand; PAM type: NRG; PAM sequence: TGG
aatggggaataactgtttaa

SEQ ID NO: 21155 - DNA, 20 bp, Artificial Sequence
  Description of Artificial Sequence: Synthetic oligonucleotide
  Target: FXN; (+) strand; PAM type: NRG; PAM sequence: GGG
atggggaataactgtttaat

SEQ ID NO: 21156 - DNA, 20 bp, Artificial Sequence
  Description of Artificial Sequence: Synthetic oligonucleotide
  Target: FXN; (+) strand; PAM type: NRG; PAM sequence: TAG
gaataactgtttaatgggta

SEQ ID NO: 21157 - DNA, 20 bp, Artificial Sequence
  Description of Artificial Sequence: Synthetic oligonucleotide
  Target: FXN; (+) strand; PAM type: NRG; PAM sequence: TGG
aactgtttaatgggtatagt

SEQ ID NO: 21158 - DNA, 20 bp, Artificial Sequence
  Description of Artificial Sequence: Synthetic oligonucleotide
  Target: FXN; (+) strand; PAM type: NRG; PAM sequence: TGG
tagttggccttgtgtatctg

SEQ ID NO: 21159 - DNA, 20 bp, Artificial Sequence
  Description of Artificial Sequence: Synthetic oligonucleotide
  Target: FXN; (+) strand; PAM type: NRG; PAM sequence: GGG
agttggccttgtgtatctgt

SEQ ID NO: 21160 - DNA, 20 bp, Artificial Sequence
  Description of Artificial Sequence: Synthetic oligonucleotide
  Target: FXN; (+) strand; PAM type: NRG; PAM sequence: TGG
acatctgattcaaccaaccg

SEQ ID NO: 21161 - DNA, 20 bp, Artificial Sequence
  Description of Artificial Sequence: Synthetic oligonucleotide
  Target: FXN; (+) strand; PAM type: NRG; PAM sequence: CAG
accaatataacaactattaa

SEQ ID NO: 21162 - DNA, 20 bp, Artificial Sequence
  Description of Artificial Sequence: Synthetic oligonucleotide
  Target: FXN; (+) strand; PAM type: NRG; PAM sequence: TAG
taacagcatttacattgtac

SEQ ID NO: 21163 - DNA, 20 bp, Artificial Sequence
  Description of Artificial Sequence: Synthetic oligonucleotide
  Target: FXN; (+) strand; PAM type: NRG; PAM sequence: AGG
aacagcatttacattgtact

SEQ ID NO: 21164 - DNA, 20 bp, Artificial Sequence
  Description of Artificial Sequence: Synthetic oligonucleotide
  Target: FXN; (+) strand; PAM type: NRG; PAM sequence: AAG
tacattgtactaggcattat

SEQ ID NO: 21165 - DNA, 20 bp, Artificial Sequence
  Description of Artificial Sequence: Synthetic oligonucleotide
  Target: FXN; (+) strand; PAM type: NRG; PAM sequence: TGG
actaggcattataagtaatc

SEQ ID NO: 21166 - DNA, 20 bp, Artificial Sequence
  Description of Artificial Sequence: Synthetic oligonucleotide
  Target: FXN; (+) strand; PAM type: NRG; PAM sequence: GAG
taggcattataagtaatctg

SEQ ID NO: 21167 - DNA, 20 bp, Artificial Sequence
  Description of Artificial Sequence: Synthetic oligonucleotide
  Target: FXN; (+) strand; PAM type: NRG; PAM sequence: AAG
agtaatctggagatgactta

SEQ ID NO: 21168 - DNA, 20 bp, Artificial Sequence
  Description of Artificial Sequence: Synthetic oligonucleotide
  Target: FXN; (+) strand; PAM type: NRG; PAM sequence: CAG
tggagatgacttaaagcata

SEQ ID NO: 21169 - DNA, 20 bp, Artificial Sequence
  Description of Artificial Sequence: Synthetic oligonucleotide
  Target: FXN; (+) strand; PAM type: NRG; PAM sequence: AAG
agatgacttaaagcatacag

SEQ ID NO: 21170 - DNA, 20 bp, Artificial Sequence
  Description of Artificial Sequence: Synthetic oligonucleotide
  Target: FXN; (+) strand; PAM type: NRG; PAM sequence: AGG
gatgacttaaagcatacaga

SEQ ID NO: 21171 - DNA, 20 bp, Artificial Sequence
  Description of Artificial Sequence: Synthetic oligonucleotide
  Target: FXN; (+) strand; PAM type: NRG; PAM sequence: TAG
agcatacagaaggatgtgcc

SEQ ID NO: 21172 - DNA, 20 bp, Artificial Sequence
  Description of Artificial Sequence: Synthetic oligonucleotide
  Target: FXN; (+) strand; PAM type: NRG; PAM sequence: AGG
gcatacagaaggatgtgcct

SEQ ID NO: 21173 - DNA, 20 bp, Artificial Sequence
  Description of Artificial Sequence: Synthetic oligonucleotide
  Target: FXN; (+) strand; PAM type: NRG; PAM sequence: TAG
acagaaggatgtgcctaggt

SEQ ID NO: 21174 - DNA, 20 bp, Artificial Sequence
  Description of Artificial Sequence: Synthetic oligonucleotide
  Target: FXN; (+) strand; PAM type: NRG; PAM sequence: CAG
tgtatcgtaccatttcatat

SEQ ID NO: 21175 - DNA, 20 bp, Artificial Sequence
  Description of Artificial Sequence: Synthetic oligonucleotide
  Target: FXN; (+) strand; PAM type: NRG; PAM sequence: AGG
gtatcgtaccatttcatatc

SEQ ID NO: 21176 - DNA, 20 bp, Artificial Sequence
  Description of Artificial Sequence: Synthetic oligonucleotide
  Target: FXN; (+) strand; PAM type: NRG; PAM sequence: GGG
tatcgtaccatttcatatca

SEQ ID NO: 21177 - DNA, 20 bp, Artificial Sequence
  Description of Artificial Sequence: Synthetic oligonucleotide
  Target: FXN; (+) strand; PAM type: NRG; PAM sequence: GAG
ccatttcatatcagggactt

SEQ ID NO: 21178 - DNA, 20 bp, Artificial Sequence
  Description of Artificial Sequence: Synthetic oligonucleotide
  Target: FXN; (+) strand; PAM type: NRG; PAM sequence: CGG
atcagggacttgagtaccca

SEQ ID NO: 21179 - DNA, 20 bp, Artificial Sequence
  Description of Artificial Sequence: Synthetic oligonucleotide
  Target: FXN; (+) strand; PAM type: NRG; PAM sequence: TGG
acttgagtacccacggattt

SEQ ID NO: 21180 - DNA, 20 bp, Artificial Sequence
  Description of Artificial Sequence: Synthetic oligonucleotide
  Target: FXN; (+) strand; PAM type: NRG; PAM sequence: CAG
cccacggattttggtatctg

SEQ ID NO: 21181 - DNA, 20 bp, Artificial Sequence
  Description of Artificial Sequence: Synthetic oligonucleotide
  Target: FXN; (+) strand; PAM type: NRG; PAM sequence: TGG
attttggtatctgcagatcc

SEQ ID NO: 21182 - DNA, 20 bp, Artificial Sequence
  Description of Artificial Sequence: Synthetic oligonucleotide
  Target: FXN; (+) strand; PAM type: NRG; PAM sequence: TGG
atcctggaaccccttcccta

SEQ ID NO: 21183 - DNA, 20 bp, Artificial Sequence
  Description of Artificial Sequence: Synthetic oligonucleotide
  Target: FXN; (+) strand; PAM type: NRG; PAM sequence: AAG
accccttccctatggatacc

SEQ ID NO: 21184 - DNA, 20 bp, Artificial Sequence
  Description of Artificial Sequence: Synthetic oligonucleotide
  Target: FXN; (+) strand; PAM type: NRG; PAM sequence: AGG
ccccttccctatggatacca

SEQ ID NO: 21185 - DNA, 20 bp, Artificial Sequence
  Description of Artificial Sequence: Synthetic oligonucleotide
  Target: FXN; (+) strand; PAM type: NRG; PAM sequence: CAG
ctatggataccaaggaacaa

SEQ ID NO: 21186 - DNA, 20 bp, Artificial Sequence
  Description of Artificial Sequence: Synthetic oligonucleotide
  Target: FXN; (+) strand; PAM type: NRG; PAM sequence: TGG
ataccaaggaacaacagcac

SEQ ID NO: 21187 - DNA, 20 bp, Artificial Sequence
  Description of Artificial Sequence: Synthetic oligonucleotide
  Target: FXN; (+) strand; PAM type: NRG; PAM sequence: GGG
taccaaggaacaacagcact

SEQ ID NO: 21188 - DNA, 20 bp, Artificial Sequence
  Description of Artificial Sequence: Synthetic oligonucleotide
  Target: FXN; (+) strand; PAM type: NRG; PAM sequence: TGG
aacagcactgggtctccttt

SEQ ID NO: 21189 - DNA, 20 bp, Artificial Sequence
  Description of Artificial Sequence: Synthetic oligonucleotide
  Target: FXN; (+) strand; PAM type: NRG; PAM sequence: GGG
acagcactgggtctcctttt

SEQ ID NO: 21190 - DNA, 20 bp, Artificial Sequence
  Description of Artificial Sequence: Synthetic oligonucleotide
  Target: FXN; (+) strand; PAM type: NRG; PAM sequence: GGG
cagcactgggtctccttttg

SEQ ID NO: 21191 - DNA, 20 bp, Artificial Sequence
  Description of Artificial Sequence: Synthetic oligonucleotide
  Target: FXN; (+) strand; PAM type: NRG; PAM sequence: CAG
ggtctccttttggggtgatg

SEQ ID NO: 21192 - DNA, 20 bp, Artificial Sequence
  Description of Artificial Sequence: Synthetic oligonucleotide
  Target: FXN; (+) strand; PAM type: NRG; PAM sequence: AAG
ggggtgatgcagatgttttg

SEQ ID NO: 21193 - DNA, 20 bp, Artificial Sequence
  Description of Artificial Sequence: Synthetic oligonucleotide
  Target: FXN; (+) strand; PAM type: NRG; PAM sequence: TAG
tgatgcagatgttttgaagc

SEQ ID NO: 21194 - DNA, 20 bp, Artificial Sequence
  Description of Artificial Sequence: Synthetic oligonucleotide
  Target: FXN; (+) strand; PAM type: NRG; PAM sequence: AGG
gatgcagatgttttgaagct

SEQ ID NO: 21195 - DNA, 20 bp, Artificial Sequence
  Description of Artificial Sequence: Synthetic oligonucleotide
  Target: FXN; (+) strand; PAM type: NRG; PAM sequence: CAG
gcagatgttttgaagctagg

SEQ ID NO: 21196 - DNA, 20 bp, Artificial Sequence
  Description of Artificial Sequence: Synthetic oligonucleotide
  Target: FXN; (+) strand; PAM type: NRG; PAM sequence: GAG
agatgttttgaagctaggca

SEQ ID NO: 21197 - DNA, 20 bp, Artificial Sequence
  Description of Artificial Sequence: Synthetic oligonucleotide
  Target: FXN; (+) strand; PAM type: NRG; PAM sequence: AGG
gatgttttgaagctaggcag

SEQ ID NO: 21198 - DNA, 20 bp, Artificial Sequence
  Description of Artificial Sequence: Synthetic oligonucleotide
  Target: FXN; (+) strand; PAM type: NRG; PAM sequence: TAG
gttttgaagctaggcagagg

SEQ ID NO: 21199 - DNA, 20 bp, Artificial Sequence
  Description of Artificial Sequence: Synthetic oligonucleotide
  Target: FXN; (+) strand; PAM type: NRG; PAM sequence: TGG
ttgaagctaggcagaggtag

SEQ ID NO: 21200 - DNA, 20 bp, Artificial Sequence
  Description of Artificial Sequence: Synthetic oligonucleotide
  Target: FXN; (+) strand; PAM type: NRG; PAM sequence: TGG
ccaaattattcatttttaaa

SEQ ID NO: 21201 - DNA, 20 bp, Artificial Sequence
  Description of Artificial Sequence: Synthetic oligonucleotide
  Target: FXN; (+) strand; PAM type: NRG; PAM sequence: TAG
cttaacaactaataatatta

SEQ ID NO: 21202 - DNA, 20 bp, Artificial Sequence
  Description of Artificial Sequence: Synthetic oligonucleotide
  Target: FXN; (+) strand; PAM type: NRG; PAM sequence: AGG
ttaacaactaataatattat

SEQ ID NO: 21203 - DNA, 20 bp, Artificial Sequence
  Description of Artificial Sequence: Synthetic oligonucleotide
  Target: FXN; (+) strand; PAM type: NRG; PAM sequence: AAG
caactaataatattataggt

SEQ ID NO: 21204 - DNA, 20 bp, Artificial Sequence
  Description of Artificial Sequence: Synthetic oligonucleotide
  Target: FXN; (+) strand; PAM type: NRG; PAM sequence: AGG
aactaataatattataggta

SEQ ID NO: 21205 - DNA, 20 bp, Artificial Sequence
  Description of Artificial Sequence: Synthetic oligonucleotide
  Target: FXN; (+) strand; PAM type: NRG; PAM sequence: AAG
taatattataggtaaggcac

SEQ ID NO: 21206 - DNA, 20 bp, Artificial Sequence
  Description of Artificial Sequence: Synthetic oligonucleotide
  Target: FXN; (+) strand; PAM type: NRG; PAM sequence: TAG
taaggcacaagttacatctg

SEQ ID NO: 21207 - DNA, 20 bp, Artificial Sequence
  Description of Artificial Sequence: Synthetic oligonucleotide
  Target: FXN; (+) strand; PAM type: NRG; PAM sequence: TGG
ttacatctgtagcacaaaaa

SEQ ID NO: 21208 - DNA, 20 bp, Artificial Sequence
  Description of Artificial Sequence: Synthetic oligonucleotide
  Target: FXN; (+) strand; PAM type: NRG; PAM sequence: CAG
taatttttaaaacactgctc

SEQ ID NO: 21209 - DNA, 20 bp, Artificial Sequence
  Description of Artificial Sequence: Synthetic oligonucleotide
  Target: FXN; (+) strand; PAM type: NRG; PAM sequence: TAG
tttaaaacactgctccagca

SEQ ID NO: 21210 - DNA, 20 bp, Artificial Sequence
  Description of Artificial Sequence: Synthetic oligonucleotide
  Target: FXN; (+) strand; PAM type: NRG; PAM sequence: CAG
aaaacactgctccagcatag

SEQ ID NO: 21211 - DNA, 20 bp, Artificial Sequence
  Description of Artificial Sequence: Synthetic oligonucleotide
  Target: FXN; (+) strand; PAM type: NRG; PAM sequence: AGG
aaacactgctccagcatagc

SEQ ID NO: 21212 - DNA, 20 bp, Artificial Sequence
  Description of Artificial Sequence: Synthetic oligonucleotide
  Target: FXN; (+) strand; PAM type: NRG; PAM sequence: GAG
gcatagcaggtatcacatgt

SEQ ID NO: 21213 - DNA, 20 bp, Artificial Sequence
  Description of Artificial Sequence: Synthetic oligonucleotide
  Target: FXN; (+) strand; PAM type: NRG; PAM sequence: AGG
catagcaggtatcacatgtg

SEQ ID NO: 21214 - DNA, 20 bp, Artificial Sequence
  Description of Artificial Sequence: Synthetic oligonucleotide
  Target: FXN; (+) strand; PAM type: NRG; PAM sequence: TAG
agcaggtatcacatgtgagg

SEQ ID NO: 21215 - DNA, 20 bp, Artificial Sequence
  Description of Artificial Sequence: Synthetic oligonucleotide
  Target: FXN; (+) strand; PAM type: NRG; PAM sequence: AAG
tatcacatgtgaggtagcaa

SEQ ID NO: 21216 - DNA, 20 bp, Artificial Sequence
  Description of Artificial Sequence: Synthetic oligonucleotide
  Target: FXN; (+) strand; PAM type: NRG; PAM sequence: TGG
acatgtgaggtagcaaaagc

SEQ ID NO: 21217 - DNA, 20 bp, Artificial Sequence
  Description of Artificial Sequence: Synthetic oligonucleotide
  Target: FXN; (+) strand; PAM type: NRG; PAM sequence: GAG
atgtgaggtagcaaaagctg

SEQ ID NO: 21218 - DNA, 20 bp, Artificial Sequence
  Description of Artificial Sequence: Synthetic oligonucleotide
  Target: FXN; (+) strand; PAM type: NRG; PAM sequence: AAG
gtagcaaaagctggagatca

SEQ ID NO: 21219 - DNA, 20 bp, Artificial Sequence
  Description of Artificial Sequence: Synthetic oligonucleotide
  Target: FXN; (+) strand; PAM type: NRG; PAM sequence: TGG
ggagatcaaagtgtgatacc

SEQ ID NO: 21220 - DNA, 20 bp, Artificial Sequence
  Description of Artificial Sequence: Synthetic oligonucleotide
  Target: FXN; (+) strand; PAM type: NRG; PAM sequence: GAG
agatcaaagtgtgatacctg

SEQ ID NO: 21221 - DNA, 20 bp, Artificial Sequence
  Description of Artificial Sequence: Synthetic oligonucleotide
  Target: FXN; (+) strand; PAM type: NRG; PAM sequence: CAG
tgtgatacctggagacttat

SEQ ID NO: 21222 - DNA, 20 bp, Artificial Sequence
  Description of Artificial Sequence: Synthetic oligonucleotide
  Target: FXN; (+) strand; PAM type: NRG; PAM sequence: AAG
atacctggagacttatcagt

SEQ ID NO: 21223 - DNA, 20 bp, Artificial Sequence
  Description of Artificial Sequence: Synthetic oligonucleotide
  Target: FXN; (+) strand; PAM type: NRG; PAM sequence: AGG
tacctggagacttatcagta

SEQ ID NO: 21224 - DNA, 20 bp, Artificial Sequence
  Description of Artificial Sequence: Synthetic oligonucleotide
  Target: FXN; (+) strand; PAM type: NRG; PAM sequence: GGG
acctggagacttatcagtaa

SEQ ID NO: 21225 - DNA, 20 bp, Artificial Sequence
  Description of Artificial Sequence: Synthetic oligonucleotide
  Target: FXN; (+) strand; PAM type: NRG; PAM sequence: CAG
gtaagggtcaaatgtttttt

SEQ ID NO: 21226 - DNA, 20 bp, Artificial Sequence
  Description of Artificial Sequence: Synthetic oligonucleotide
  Target: FXN; (+) strand; PAM type: NRG; PAM sequence: AGG
taagggtcaaatgttttttc

SEQ ID NO: 21227 - DNA, 20 bp, Artificial Sequence
  Description of Artificial Sequence: Synthetic oligonucleotide
  Target: FXN; (+) strand; PAM type: NRG; PAM sequence: GAG
caaatgttttttcaggtttt

SEQ ID NO: 21228 - DNA, 20 bp, Artificial Sequence
  Description of Artificial Sequence: Synthetic oligonucleotide
  Target: FXN; (+) strand; PAM type: NRG; PAM sequence: TGG
caggttttgagaatcattct

SEQ ID NO: 21229 - DNA, 20 bp, Artificial Sequence
  Description of Artificial Sequence: Synthetic oligonucleotide
  Target: FXN; (+) strand; PAM type: NRG; PAM sequence: CAG
aatcattcttggaattgttc

SEQ ID NO: 21230 - DNA, 20 bp, Artificial Sequence
  Description of Artificial Sequence: Synthetic oligonucleotide
  Target: FXN; (+) strand; PAM type: NRG; PAM sequence: AAG
cattcttggaattgttccag

SEQ ID NO: 21231 - DNA, 20 bp, Artificial Sequence
  Description of Artificial Sequence: Synthetic oligonucleotide
  Target: FXN; (+) strand; PAM type: NRG; PAM sequence: TAG
atatatcgtataactcttct

SEQ ID NO: 21232 - DNA, 20 bp, Artificial Sequence
  Description of Artificial Sequence: Synthetic oligonucleotide
  Target: FXN; (+) strand; PAM type: NRG; PAM sequence: AAG
tataactcttcttagatgct

SEQ ID NO: 21233 - DNA, 20 bp, Artificial Sequence
  Description of Artificial Sequence: Synthetic oligonucleotide
  Target: FXN; (+) strand; PAM type: NRG; PAM sequence: AAG
ctcttcttagatgctaagat

SEQ ID NO: 21234 - DNA, 20 bp, Artificial Sequence
  Description of Artificial Sequence: Synthetic oligonucleotide
  Target: FXN; (+) strand; PAM type: NRG; PAM sequence: AAG
ttcttagatgctaagataag

SEQ ID NO: 21235 - DNA, 20 bp, Artificial Sequence
  Description of Artificial Sequence: Synthetic oligonucleotide
  Target: FXN; (+) strand; PAM type: NRG; PAM sequence: AGG
tcttagatgctaagataaga

SEQ ID NO: 21236 - DNA, 20 bp, Artificial Sequence
  Description of Artificial Sequence: Synthetic oligonucleotide
  Target: FXN; (+) strand; PAM type: NRG; PAM sequence: CAG
tagatgctaagataagaagg

SEQ ID NO: 21237 - DNA, 20 bp, Artificial Sequence
  Description of Artificial Sequence: Synthetic oligonucleotide
  Target: FXN; (+) strand; PAM type: NRG; PAM sequence: TAG
ataagaaggcagatatacac

SEQ ID NO: 21238 - DNA, 20 bp, Artificial Sequence
  Description of Artificial Sequence: Synthetic oligonucleotide
  Target: FXN; (+) strand; PAM type: NRG; PAM sequence: TAG
gctcattttgtgttattttc

SEQ ID NO: 21239 - DNA, 20 bp, Artificial Sequence
  Description of Artificial Sequence: Synthetic oligonucleotide
  Target: FXN; (+) strand; PAM type: NRG; PAM sequence: GAG
tcattttgtgttattttcta

SEQ ID NO: 21240 - DNA, 20 bp, Artificial Sequence
  Description of Artificial Sequence: Synthetic oligonucleotide
  Target: FXN; (+) strand; PAM type: NRG; PAM sequence: CAG
tattttctagagctttactc

SEQ ID NO: 21241 - DNA, 20 bp, Artificial Sequence
  Description of Artificial Sequence: Synthetic oligonucleotide
  Target: FXN; (+) strand; PAM type: NRG; PAM sequence: TGG
ctttactccagtcaatttct

SEQ ID NO: 21242 - DNA, 20 bp, Artificial Sequence
  Description of Artificial Sequence: Synthetic oligonucleotide
  Target: FXN; (+) strand; PAM type: NRG; PAM sequence: GGG
tttactccagtcaatttctt

SEQ ID NO: 21243 - DNA, 20 bp, Artificial Sequence
  Description of Artificial Sequence: Synthetic oligonucleotide
  Target: FXN; (+) strand; PAM type: NRG; PAM sequence: GGG
ttactccagtcaatttcttg

SEQ ID NO: 21244 - DNA, 20 bp, Artificial Sequence
  Description of Artificial Sequence: Synthetic oligonucleotide
  Target: FXN; (+) strand; PAM type: NRG; PAM sequence: GGG
tactccagtcaatttcttgg

SEQ ID NO: 21245 - DNA, 20 bp, Artificial Sequence
  Description of Artificial Sequence: Synthetic oligonucleotide
  Target: FXN; (+) strand; PAM type: NRG; PAM sequence: CAG
tccagtcaatttcttggggg

SEQ ID NO: 21246 - DNA, 20 bp, Artificial Sequence
  Description of Artificial Sequence: Synthetic oligonucleotide
  Target: FXN; (+) strand; PAM type: NRG; PAM sequence: TGG
tttcttgggggcagcatttg

SEQ ID NO: 21247 - DNA, 20 bp, Artificial Sequence
  Description of Artificial Sequence: Synthetic oligonucleotide
  Target: FXN; (+) strand; PAM type: NRG; PAM sequence: CAG
gggggcagcatttgtggaat

SEQ ID NO: 21248 - DNA, 20 bp, Artificial Sequence
  Description of Artificial Sequence: Synthetic oligonucleotide
  Target: FXN; (+) strand; PAM type: NRG; PAM sequence: TGG
ggcagcatttgtggaatcag

SEQ ID NO: 21249 - DNA, 20 bp, Artificial Sequence
  Description of Artificial Sequence: Synthetic oligonucleotide
  Target: FXN; (+) strand; PAM type: NRG; PAM sequence: AAG
tggaatcagtggttcatctg

SEQ ID NO: 21250 - DNA, 20 bp, Artificial Sequence
  Description of Artificial Sequence: Synthetic oligonucleotide
  Target: FXN; (+) strand; PAM type: NRG; PAM sequence: AGG
ggaatcagtggttcatctga

SEQ ID NO: 21251 - DNA, 20 bp, Artificial Sequence
  Description of Artificial Sequence: Synthetic oligonucleotide
  Target: FXN; (+) strand; PAM type: NRG; PAM sequence: GGG
gaatcagtggttcatctgaa

SEQ ID NO: 21252 - DNA, 20 bp, Artificial Sequence
  Description of Artificial Sequence: Synthetic oligonucleotide
  Target: FXN; (+) strand; PAM type: NRG; PAM sequence: TGG
tcatctgaagggctgtgctg

SEQ ID NO: 21253 - DNA, 20 bp, Artificial Sequence
  Description of Artificial Sequence: Synthetic oligonucleotide
  Target: FXN; (+) strand; PAM type: NRG; PAM sequence: CAG
tatgcatttgttttgtcttc

SEQ ID NO: 21254 - DNA, 20 bp, Artificial Sequence
  Description of Artificial Sequence: Synthetic oligonucleotide
  Target: FXN; (+) strand; PAM type: NRG; PAM sequence: TGG
gcatttgttttgtcttccag

SEQ ID NO: 21255 - DNA, 20 bp, Artificial Sequence
  Description of Artificial Sequence: Synthetic oligonucleotide
  Target: FXN; (+) strand; PAM type: NRG; PAM sequence: AAG
ttttgtcttccagtggacct

SEQ ID NO: 21256 - DNA, 20 bp, Artificial Sequence
  Description of Artificial Sequence: Synthetic oligonucleotide
  Target: FXN; (+) strand; PAM type: NRG; PAM sequence: TGG
gtggacctaagcgttatgac

SEQ ID NO: 21257 - DNA, 20 bp, Artificial Sequence
  Description of Artificial Sequence: Synthetic oligonucleotide
  Target: FXN; (+) strand; PAM type: NRG; PAM sequence: TGG
cctaagcgttatgactggac

SEQ ID NO: 21258 - DNA, 20 bp, Artificial Sequence
  Description of Artificial Sequence: Synthetic oligonucleotide
  Target: FXN; (+) strand; PAM type: NRG; PAM sequence: GGG
ctaagcgttatgactggact

SEQ ID NO: 21259 - DNA, 20 bp, Artificial Sequence
  Description of Artificial Sequence: Synthetic oligonucleotide
  Target: FXN; (+) strand; PAM type: NRG; PAM sequence: TGG
atgactggactgggaaaaac

SEQ ID NO: 21260 - DNA, 20 bp, Artificial Sequence
  Description of Artificial Sequence: Synthetic oligonucleotide
  Target: FXN; (+) strand; PAM type: NRG; PAM sequence: GGG
tgactggactgggaaaaact

SEQ ID NO: 21261 - DNA, 20 bp, Artificial Sequence
  Description of Artificial Sequence: Synthetic oligonucleotide
  Target: FXN; (+) strand; PAM type: NRG; PAM sequence: CGG
aactgggtgtactcccacga

SEQ ID NO: 21262 - DNA, 20 bp, Artificial Sequence
  Description of Artificial Sequence: Synthetic oligonucleotide
  Target: FXN; (+) strand; PAM type: NRG; PAM sequence: GAG
acgacggcgtgtccctccat

SEQ ID NO: 21263 - DNA, 20 bp, Artificial Sequence
  Description of Artificial Sequence: Synthetic oligonucleotide
  Target: FXN; (+) strand; PAM type: NRG; PAM sequence: TGG
cgtgtccctccatgagctgc

SEQ ID NO: 21264 - DNA, 20 bp, Artificial Sequence
  Description of Artificial Sequence: Synthetic oligonucleotide
  Target: FXN; (+) strand; PAM type: NRG; PAM sequence: CAG
cctccatgagctgctggccg

SEQ ID NO: 21265 - DNA, 20 bp, Artificial Sequence
  Description of Artificial Sequence: Synthetic oligonucleotide
  Target: FXN; (+) strand; PAM type: NRG; PAM sequence: GAG
tccatgagctgctggccgca

SEQ ID NO: 21266 - DNA, 20 bp, Artificial Sequence
  Description of Artificial Sequence: Synthetic oligonucleotide
  Target: FXN; (+) strand; PAM type: NRG; PAM sequence: AAG
gctggccgcagagctcacta

SEQ ID NO: 21267 - DNA, 20 bp, Artificial Sequence
  Description of Artificial Sequence: Synthetic oligonucleotide
  Target: FXN; (+) strand; PAM type: NRG; PAM sequence: TGG
taaagccttaaaaaccaaac

SEQ ID NO: 21268 - DNA, 20 bp, Artificial Sequence
  Description of Artificial Sequence: Synthetic oligonucleotide
  Target: FXN; (+) strand; PAM type: NRG; PAM sequence: TGG
caaactggacttgtcttcct

SEQ ID NO: 21269 - DNA, 20 bp, Artificial Sequence
  Description of Artificial Sequence: Synthetic oligonucleotide
  Target: FXN; (+) strand; PAM type: NRG; PAM sequence: CGG
ttgtcttccttggcctattc

SEQ ID NO: 21270 - DNA, 20 bp, Artificial Sequence
  Description of Artificial Sequence: Synthetic oligonucleotide
  Target: FXN; (+) strand; PAM type: NRG; PAM sequence: AAG
ttccttggcctattccggaa

SEQ ID NO: 21271 - DNA, 20 bp, Artificial Sequence
  Description of Artificial Sequence: Synthetic oligonucleotide
  Target: FXN; (+) strand; PAM type: NRG; PAM sequence: CAG
cggaaaagatgcttgatgcc

SEQ ID NO: 21272 - DNA, 20 bp, Artificial Sequence
  Description of Artificial Sequence: Synthetic oligonucleotide
  Target: FXN; (+) strand; PAM type: NRG; PAM sequence: AAG
ttgatgcccagccccgtttt

SEQ ID NO: 21273 - DNA, 20 bp, Artificial Sequence
  Description of Artificial Sequence: Synthetic oligonucleotide
  Target: FXN; (+) strand; PAM type: NRG; PAM sequence: AGG
tgatgcccagccccgtttta

SEQ ID NO: 21274 - DNA, 20 bp, Artificial Sequence
  Description of Artificial Sequence: Synthetic oligonucleotide
  Target: FXN; (+) strand; PAM type: NRG; PAM sequence: AAG
ccccgttttaaggacattaa

SEQ ID NO: 21275 - DNA, 20 bp, Artificial Sequence
  Description of Artificial Sequence: Synthetic oligonucleotide
  Target: FXN; (+) strand; PAM type: NRG; PAM sequence: CAG
ttaaggacattaaaagctat

SEQ ID NO: 21276 - DNA, 20 bp, Artificial Sequence
  Description of Artificial Sequence: Synthetic oligonucleotide
  Target: FXN; (+) strand; PAM type: NRG; PAM sequence: AGG
taaggacattaaaagctatc

SEQ ID NO: 21277 - DNA, 20 bp, Artificial Sequence
  Description of Artificial Sequence: Synthetic oligonucleotide
  Target: FXN; (+) strand; PAM type: NRG; PAM sequence: AAG
acattaaaagctatcaggcc

SEQ ID NO: 21278 - DNA, 20 bp, Artificial Sequence
  Description of Artificial Sequence: Synthetic oligonucleotide
  Target: FXN; (+) strand; PAM type: NRG; PAM sequence: CAG
aagctatcaggccaagaccc

SEQ ID NO: 21279 - DNA, 20 bp, Artificial Sequence
  Description of Artificial Sequence: Synthetic oligonucleotide
  Target: FXN; (+) strand; PAM type: NRG; PAM sequence: CAG
aagaccccagcttcattatg

SEQ ID NO: 21280 - DNA, 20 bp, Artificial Sequence
  Description of Artificial Sequence: Synthetic oligonucleotide
  Target: FXN; (+) strand; PAM type: NRG; PAM sequence: GAG
cccagcttcattatgcagct

SEQ ID NO: 21281 - DNA, 20 bp, Artificial Sequence
  Description of Artificial Sequence: Synthetic oligonucleotide
  Target: FXN; (+) strand; PAM type: NRG; PAM sequence: AGG
ccagcttcattatgcagctg

SEQ ID NO: 21282 - DNA, 20 bp, Artificial Sequence
  Description of Artificial Sequence: Synthetic oligonucleotide
  Target: FXN; (+) strand; PAM type: NRG; PAM sequence: GAG
ttttttttattcctgctttt

SEQ ID NO: 21283 - DNA, 20 bp, Artificial Sequence
  Description of Artificial Sequence: Synthetic oligonucleotide
  Target: FXN; (+) strand; PAM type: NRG; PAM sequence: AGG
tttttttattcctgcttttg

SEQ ID NO: 21284 - DNA, 20 bp, Artificial Sequence
  Description of Artificial Sequence: Synthetic oligonucleotide
  Target: FXN; (+) strand; PAM type: NRG; PAM sequence: CAG
tttattcctgcttttgagga

SEQ ID NO: 21285 - DNA, 20 bp, Artificial Sequence
  Description of Artificial Sequence: Synthetic oligonucleotide
  Target: FXN; (+) strand; PAM type: NRG; PAM sequence: TGG
ttcctgcttttgaggacagt

SEQ ID NO: 21286 - DNA, 20 bp, Artificial Sequence
  Description of Artificial Sequence: Synthetic oligonucleotide
  Target: FXN; (+) strand; PAM type: NRG; PAM sequence: GGG
tcctgcttttgaggacagtt

SEQ ID NO: 21287 - DNA, 20 bp, Artificial Sequence
  Description of Artificial Sequence: Synthetic oligonucleotide
  Target: FXN; (+) strand; PAM type: NRG; PAM sequence: CAG
gacagttgggctatgtgtca

SEQ ID NO: 21288 - DNA, 20 bp, Artificial Sequence
  Description of Artificial Sequence: Synthetic oligonucleotide
  Target: FXN; (+) strand; PAM type: NRG; PAM sequence: TAG
ggctatgtgtcacagctctg

SEQ ID NO: 21289 - DNA, 20 bp, Artificial Sequence
  Description of Artificial Sequence: Synthetic oligonucleotide
  Target: FXN; (+) strand; PAM type: NRG; PAM sequence: AAG
atgtgtcacagctctgtaga

SEQ ID NO: 21290 - DNA, 20 bp, Artificial Sequence
  Description of Artificial Sequence: Synthetic oligonucleotide
  Target: FXN; (+) strand; PAM type: NRG; PAM sequence: AAG
ttgcctcctaccttgccccc

SEQ ID NO: 21291 - DNA, 20 bp, Artificial Sequence
  Description of Artificial Sequence: Synthetic oligonucleotide
  Target: FXN; (+) strand; PAM type: NRG; PAM sequence: TGG
gttctgatttttaatttcta

SEQ ID NO: 21292 - DNA, 20 bp, Artificial Sequence
  Description of Artificial Sequence: Synthetic oligonucleotide
  Target: FXN; (+) strand; PAM type: NRG; PAM sequence: AAG
ctgatttttaatttctatgg

SEQ ID NO: 21293 - DNA, 20 bp, Artificial Sequence
  Description of Artificial Sequence: Synthetic oligonucleotide
  Target: FXN; (+) strand; PAM type: NRG; PAM sequence: TGG
aatttctatggaagattttt

SEQ ID NO: 21294 - DNA, 20 bp, Artificial Sequence
  Description of Artificial Sequence: Synthetic oligonucleotide
  Target: FXN; (+) strand; PAM type: NRG; PAM sequence: CGG
tggaagattttttggattgt

SEQ ID NO: 21295 - DNA, 20 bp, Artificial Sequence
  Description of Artificial Sequence: Synthetic oligonucleotide
  Target: FXN; (+) strand; PAM type: NRG; PAM sequence: AAG
gaatataacaacctttaaaa

SEQ ID NO: 21296 - DNA, 20 bp, Artificial Sequence
  Description of Artificial Sequence: Synthetic oligonucleotide
  Target: FXN; (+) strand; PAM type: NRG; PAM sequence: AAG
ctttaaaaaagcaaaataat

SEQ ID NO: 21297 - DNA, 20 bp, Artificial Sequence
  Description of Artificial Sequence: Synthetic oligonucleotide
  Target: FXN; (+) strand; PAM type: NRG; PAM sequence: AAG
taaaaaagcaaaataataag

SEQ ID NO: 21298 - DNA, 20 bp, Artificial Sequence
  Description of Artificial Sequence: Synthetic oligonucleotide
  Target: FXN; (+) strand; PAM type: NRG; PAM sequence: AGG
aaaaaagcaaaataataaga

SEQ ID NO: 21299 - DNA, 20 bp, Artificial Sequence
  Description of Artificial Sequence: Synthetic oligonucleotide
  Target: FXN; (+) strand; PAM type: NRG; PAM sequence: CAG
ataataagaaggaaaaattc

SEQ ID NO: 21300 - DNA, 20 bp, Artificial Sequence
  Description of Artificial Sequence: Synthetic oligonucleotide
  Target: FXN; (+) strand; PAM type: NRG; PAM sequence: AGG
taataagaaggaaaaattcc

SEQ ID NO: 21301 - DNA, 20 bp, Artificial Sequence
  Description of Artificial Sequence: Synthetic oligonucleotide
  Target: FXN; (+) strand; PAM type: NRG; PAM sequence: GAG
ataagaaggaaaaattccag

SEQ ID NO: 21302 - DNA, 20 bp, Artificial Sequence
  Description of Artificial Sequence: Synthetic oligonucleotide
  Target: FXN; (+) strand; PAM type: NRG; PAM sequence: AGG
taagaaggaaaaattccagg

SEQ ID NO: 21303 - DNA, 20 bp, Artificial Sequence
  Description of Artificial Sequence: Synthetic oligonucleotide
  Target: FXN; (+) strand; PAM type: NRG; PAM sequence: GGG
aagaaggaaaaattccagga

SEQ ID NO: 21304 - DNA, 20 bp, Artificial Sequence
  Description of Artificial Sequence: Synthetic oligonucleotide
  Target: FXN; (+) strand; PAM type: NRG; PAM sequence: AAG
tcttcactcttcattctttg

SEQ ID NO: 21305 - DNA, 20 bp, Artificial Sequence
  Description of Artificial Sequence: Synthetic oligonucleotide
  Target: FXN; (+) strand; PAM type: NRG; PAM sequence: AGG
cttcactcttcattctttga

SEQ ID NO: 21306 - DNA, 20 bp, Artificial Sequence
  Description of Artificial Sequence: Synthetic oligonucleotide
  Target: FXN; (+) strand; PAM type: NRG; PAM sequence: AAG
ttctttgaaggatttactgc

SEQ ID NO: 21307 - DNA, 20 bp, Artificial Sequence
  Description of Artificial Sequence: Synthetic oligonucleotide
  Target: FXN; (+) strand; PAM type: NRG; PAM sequence: AAG
tttgaaggatttactgcaag

SEQ ID NO: 21308 - DNA, 20 bp, Artificial Sequence
  Description of Artificial Sequence: Synthetic oligonucleotide
  Target: FXN; (+) strand; PAM type: NRG; PAM sequence: AAG
tttactgcaagaagtacatg

SEQ ID NO: 21309 - DNA, 20 bp, Artificial Sequence
  Description of Artificial Sequence: Synthetic oligonucleotide
  Target: FXN; (+) strand; PAM type: NRG; PAM sequence: GAG
tactgcaagaagtacatgaa

SEQ ID NO: 21310 - DNA, 20 bp, Artificial Sequence
  Description of Artificial Sequence: Synthetic oligonucleotide
  Target: FXN; (+) strand; PAM type: NRG; PAM sequence: CAG
tgcaagaagtacatgaagag

SEQ ID NO: 21311 - DNA, 20 bp, Artificial Sequence
  Description of Artificial Sequence: Synthetic oligonucleotide
  Target: FXN; (+) strand; PAM type: NRG; PAM sequence: TGG
agaagtacatgaagagcagc

SEQ ID NO: 21312 - DNA, 20 bp, Artificial Sequence
  Description of Artificial Sequence: Synthetic oligonucleotide
  Target: FXN; (+) strand; PAM type: NRG; PAM sequence: GAG
tcactgttctatctccaaat

SEQ ID NO: 21313 - DNA, 20 bp, Artificial Sequence
  Description of Artificial Sequence: Synthetic oligonucleotide
  Target: FXN; (+) strand; PAM type: NRG; PAM sequence: AAG
tctccaaatgagacacatta

SEQ ID NO: 21314 - DNA, 20 bp, Artificial Sequence
  Description of Artificial Sequence: Synthetic oligonucleotide
  Target: FXN; (+) strand; PAM type: NRG; PAM sequence: AGG
ctccaaatgagacacattaa

SEQ ID NO: 21315 - DNA, 20 bp, Artificial Sequence
  Description of Artificial Sequence: Synthetic oligonucleotide
  Target: FXN; (+) strand; PAM type: NRG; PAM sequence: GGG
tccaaatgagacacattaaa

SEQ ID NO: 21316 - DNA, 20 bp, Artificial Sequence
  Description of Artificial Sequence: Synthetic oligonucleotide
  Target: FXN; (+) strand; PAM type: NRG; PAM sequence: TAG
aaatgagacacattaaaggg

SEQ ID NO: 21317 - DNA, 20 bp, Artificial Sequence
  Description of Artificial Sequence: Synthetic oligonucleotide
  Target: FXN; (+) strand; PAM type: NRG; PAM sequence: CAG
gggtagcctacaaatgtttt

SEQ ID NO: 21318 - DNA, 20 bp, Artificial Sequence
  Description of Artificial Sequence: Synthetic oligonucleotide
  Target: FXN; (+) strand; PAM type: NRG; PAM sequence: AGG
ggtagcctacaaatgttttc

SEQ ID NO: 21319 - DNA, 20 bp, Artificial Sequence
  Description of Artificial Sequence: Synthetic oligonucleotide
  Target: FXN; (+) strand; PAM type: NRG; PAM sequence: AAG
atgttttcaggcttctttca

SEQ ID NO: 21320 - DNA, 20 bp, Artificial Sequence
  Description of Artificial Sequence: Synthetic oligonucleotide
  Target: FXN; (+) strand; PAM type: NRG; PAM sequence: AAG
tcaggcttctttcaaagtgt

SEQ ID NO: 21321 - DNA, 20 bp, Artificial Sequence
  Description of Artificial Sequence: Synthetic oligonucleotide
  Target: FXN; (+) strand; PAM type: NRG; PAM sequence: GAG
ttcaaagtgtaagcacttct

SEQ ID NO: 21322 - DNA, 20 bp, Artificial Sequence
  Description of Artificial Sequence: Synthetic oligonucleotide
  Target: FXN; (+) strand; PAM type: NRG; PAM sequence: TAG
gtaagcacttctgagctctt

SEQ ID NO: 21323 - DNA, 20 bp, Artificial Sequence
  Description of Artificial Sequence: Synthetic oligonucleotide
  Target: FXN; (+) strand; PAM type: NRG; PAM sequence: AAG
ttctgagctctttagcattg

SEQ ID NO: 21324 - DNA, 20 bp, Artificial Sequence
  Description of Artificial Sequence: Synthetic oligonucleotide
  Target: FXN; (+) strand; PAM type: NRG; PAM sequence: AAG
ctttagcattgaagtgtcga

SEQ ID NO: 21325 - DNA, 20 bp, Artificial Sequence
  Description of Artificial Sequence: Synthetic oligonucleotide
  Target: FXN; (+) strand; PAM type: NRG; PAM sequence: CGG
agtgtcgaaagcaactcaca

SEQ ID NO: 21326 - DNA, 20 bp, Artificial Sequence
  Description of Artificial Sequence: Synthetic oligonucleotide
  Target: FXN; (+) strand; PAM type: NRG; PAM sequence: GGG
gtgtcgaaagcaactcacac

SEQ ID NO: 21327 - DNA, 20 bp, Artificial Sequence
  Description of Artificial Sequence: Synthetic oligonucleotide
  Target: FXN; (+) strand; PAM type: NRG; PAM sequence: AAG
tcgaaagcaactcacacggg

SEQ ID NO: 21328 - DNA, 20 bp, Artificial Sequence
  Description of Artificial Sequence: Synthetic oligonucleotide
  Target: FXN; (+) strand; PAM type: NRG; PAM sequence: AAG
atttgtgctctgtgactgcc

SEQ ID NO: 21329 - DNA, 20 bp, Artificial Sequence
  Description of Artificial Sequence: Synthetic oligonucleotide
  Target: FXN; (+) strand; PAM type: NRG; PAM sequence: AGG
tttgtgctctgtgactgcca

SEQ ID NO: 21330 - DNA, 20 bp, Artificial Sequence
  Description of Artificial Sequence: Synthetic oligonucleotide
  Target: FXN; (+) strand; PAM type: NRG; PAM sequence: TGG
gctctgtgactgccaaggtg

SEQ ID NO: 21331 - DNA, 20 bp, Artificial Sequence
  Description of Artificial Sequence: Synthetic oligonucleotide
  Target: FXN; (+) strand; PAM type: NRG; PAM sequence: TGG
tgccaaggtgtggcctgcac

SEQ ID NO: 21332 - DNA, 20 bp, Artificial Sequence
  Description of Artificial Sequence: Synthetic oligonucleotide
  Target: FXN; (+) strand; PAM type: NRG; PAM sequence: GGG
gccaaggtgtggcctgcact

SEQ ID NO: 21333 - DNA, 20 bp, Artificial Sequence
  Description of Artificial Sequence: Synthetic oligonucleotide
  Target: FXN; (+) strand; PAM type: NRG; PAM sequence: CAG
gtggcctgcactgggttgtc

SEQ ID NO: 21334 - DNA, 20 bp, Artificial Sequence
  Description of Artificial Sequence: Synthetic oligonucleotide
  Target: FXN; (+) strand; PAM type: NRG; PAM sequence: AGG
tggcctgcactgggttgtcc

SEQ ID NO: 21335 - DNA, 20 bp, Artificial Sequence
  Description of Artificial Sequence: Synthetic oligonucleotide
  Target: FXN; (+) strand; PAM type: NRG; PAM sequence: GGG
ggcctgcactgggttgtcca

SEQ ID NO: 21336 - DNA, 20 bp, Artificial Sequence
  Description of Artificial Sequence: Synthetic oligonucleotide
  Target: FXN; (+) strand; PAM type: NRG; PAM sequence: GAG
cctgcactgggttgtccagg

SEQ ID NO: 21337 - DNA, 20 bp, Artificial Sequence
  Description of Artificial Sequence: Synthetic oligonucleotide
  Target: FXN; (+) strand; PAM type: NRG; PAM sequence: TAG
ctgggttgtccagggagacc

SEQ ID NO: 21338 - DNA, 20 bp, Artificial Sequence
  Description of Artificial Sequence: Synthetic oligonucleotide
  Target: FXN; (+) strand; PAM type: NRG; PAM sequence: AAG
atatatattttttcaattta

SEQ ID NO: 21339 - DNA, 20 bp, Artificial Sequence
  Description of Artificial Sequence: Synthetic oligonucleotide
  Target: FXN; (+) strand; PAM type: NRG; PAM sequence: AGG
tatatattttttcaatttaa

SEQ ID NO: 21340 - DNA, 20 bp, Artificial Sequence
  Description of Artificial Sequence: Synthetic oligonucleotide
  Target: FXN; (+) strand; PAM type: NRG; PAM sequence: TAG
tattttttcaatttaaaggt

SEQ ID NO: 21341 - DNA, 20 bp, Artificial Sequence
  Description of Artificial Sequence: Synthetic oligonucleotide
  Target: FXN; (+) strand; PAM type: NRG; PAM sequence: TGG
tttcaatttaaaggttagta

SEQ ID NO: 21342 - DNA, 20 bp, Artificial Sequence
  Description of Artificial Sequence: Synthetic oligonucleotide
  Target: FXN; (+) strand; PAM type: NRG; PAM sequence: CAG
tttaaaggttagtatggaat

SEQ ID NO: 21343 - DNA, 20 bp, Artificial Sequence
  Description of Artificial Sequence: Synthetic oligonucleotide
  Target: FXN; (+) strand; PAM type: NRG; PAM sequence: AAG
agtatggaatcagctgctac

SEQ ID NO: 21344 - DNA, 20 bp, Artificial Sequence
  Description of Artificial Sequence: Synthetic oligonucleotide
  Target: FXN; (+) strand; PAM type: NRG; PAM sequence: AAG
agaatgcaaaaaatcttcca

SEQ ID NO: 21345 - DNA, 20 bp, Artificial Sequence
  Description of Artificial Sequence: Synthetic oligonucleotide
  Target: FXN; (+) strand; PAM type: NRG; PAM sequence: AAG
gcaaaaaatcttccaaagac

SEQ ID NO: 21346 - DNA, 20 bp, Artificial Sequence
  Description of Artificial Sequence: Synthetic oligonucleotide
  Target: FXN; (+) strand; PAM type: NRG; PAM sequence: AAG
aaatcttccaaagacaagaa

SEQ ID NO: 21347 - DNA, 20 bp, Artificial Sequence
  Description of Artificial Sequence: Synthetic oligonucleotide
  Target: FXN; (+) strand; PAM type: NRG; PAM sequence: GAG
atcttccaaagacaagaaaa

SEQ ID NO: 21348 - DNA, 20 bp, Artificial Sequence
  Description of Artificial Sequence: Synthetic oligonucleotide
  Target: FXN; (+) strand; PAM type: NRG; PAM sequence: AGG
tcttccaaagacaagaaaag

SEQ ID NO: 21349 - DNA, 20 bp, Artificial Sequence
  Description of Artificial Sequence: Synthetic oligonucleotide
  Target: FXN; (+) strand; PAM type: NRG; PAM sequence: AAG
agacaagaaaagaggaaaaa

SEQ ID NO: 21350 - DNA, 20 bp, Artificial Sequence
  Description of Artificial Sequence: Synthetic oligonucleotide
  Target: FXN; (+) strand; PAM type: NRG; PAM sequence: GAG
ggaaaaaaagccgttttcat

SEQ ID NO: 21351 - DNA, 20 bp, Artificial Sequence
  Description of Artificial Sequence: Synthetic oligonucleotide
  Target: FXN; (+) strand; PAM type: NRG; PAM sequence: GAG
aaaagccgttttcatgagct

SEQ ID NO: 21352 - DNA, 20 bp, Artificial Sequence
  Description of Artificial Sequence: Synthetic oligonucleotide
  Target: FXN; (+) strand; PAM type: NRG; PAM sequence: TAG
ttttcatgagctgagtgatg

SEQ ID NO: 21353 - DNA, 20 bp, Artificial Sequence
  Description of Artificial Sequence: Synthetic oligonucleotide
  Target: FXN; (+) strand; PAM type: NRG; PAM sequence: TGG
tagcgtaacaaacaaaatca

SEQ ID NO: 21354 - DNA, 20 bp, Artificial Sequence
  Description of Artificial Sequence: Synthetic oligonucleotide
  Target: FXN; (+) strand; PAM type: NRG; PAM sequence: GAG
gcgtaacaaacaaaatcatg

SEQ ID NO: 21355 - DNA, 20 bp, Artificial Sequence
  Description of Artificial Sequence: Synthetic oligonucleotide
  Target: FXN; (+) strand; PAM type: NRG; PAM sequence: GAG
acaaacaaaatcatggagct

SEQ ID NO: 21356 - DNA, 20 bp, Artificial Sequence
  Description of Artificial Sequence: Synthetic oligonucleotide
  Target: FXN; (+) strand; PAM type: NRG; PAM sequence: AGG
caaacaaaatcatggagctg

SEQ ID NO: 21357 - DNA, 20 bp, Artificial Sequence
  Description of Artificial Sequence: Synthetic oligonucleotide
  Target: FXN; (+) strand; PAM type: NRG; PAM sequence: GAG
aacaaaatcatggagctgag

SEQ ID NO: 21358 - DNA, 20 bp, Artificial Sequence
  Description of Artificial Sequence: Synthetic oligonucleotide
  Target: FXN; (+) strand; PAM type: NRG; PAM sequence: AGG
acaaaatcatggagctgagg

SEQ ID NO: 21359 - DNA, 20 bp, Artificial Sequence
  Description of Artificial Sequence: Synthetic oligonucleotide
  Target: FXN; (+) strand; PAM type: NRG; PAM sequence: AAG
ggaggtgccttgtaaacatg

SEQ ID NO: 21360 - DNA, 20 bp, Artificial Sequence
  Description of Artificial Sequence: Synthetic oligonucleotide
  Target: FXN; (+) strand; PAM type: NRG; PAM sequence: AGG
gaggtgccttgtaaacatga

SEQ ID NO: 21361 - DNA, 20 bp, Artificial Sequence
  Description of Artificial Sequence: Synthetic oligonucleotide
  Target: FXN; (+) strand; PAM type: NRG; PAM sequence: GGG
aggtgccttgtaaacatgaa

SEQ ID NO: 21362 - DNA, 20 bp, Artificial Sequence
  Description of Artificial Sequence: Synthetic oligonucleotide
  Target: FXN; (+) strand; PAM type: NRG; PAM sequence: GGG
ggtgccttgtaaacatgaag

SEQ ID NO: 21363 - DNA, 20 bp, Artificial Sequence
  Description of Artificial Sequence: Synthetic oligonucleotide
  Target: FXN; (+) strand; PAM type: NRG; PAM sequence: CAG
gccttgtaaacatgaagggg

SEQ ID NO: 21364 - DNA, 20 bp, Artificial Sequence
  Description of Artificial Sequence: Synthetic oligonucleotide
  Target: FXN; (+) strand; PAM type: NRG; PAM sequence: AAG
taaacatgaaggggcagata

SEQ ID NO: 21365 - DNA, 20 bp, Artificial Sequence
  Description of Artificial Sequence: Synthetic oligonucleotide
  Target: FXN; (+) strand; PAM type: NRG; PAM sequence: AGG
aaacatgaaggggcagataa

SEQ ID NO: 21366 - DNA, 20 bp, Artificial Sequence
  Description of Artificial Sequence: Synthetic oligonucleotide
  Target: FXN; (+) strand; PAM type: NRG; PAM sequence: AAG
catgaaggggcagataaagg

SEQ ID NO: 21367 - DNA, 20 bp, Artificial Sequence
  Description of Artificial Sequence: Synthetic oligonucleotide
  Target: FXN; (+) strand; PAM type: NRG; PAM sequence: AGG
atgaaggggcagataaagga

SEQ ID NO: 21368 - DNA, 20 bp, Artificial Sequence
  Description of Artificial Sequence: Synthetic oligonucleotide
  Target: FXN; (+) strand; PAM type: NRG; PAM sequence: GAG
gaaggggcagataaaggaag

SEQ ID NO: 21369 - DNA, 20 bp, Artificial Sequence
  Description of Artificial Sequence: Synthetic oligonucleotide
  Target: FXN; (+) strand; PAM type: NRG; PAM sequence: AAG
aggagatactcatgttgata

SEQ ID NO: 21370 - DNA, 20 bp, Artificial Sequence
  Description of Artificial Sequence: Synthetic oligonucleotide
  Target: FXN; (+) strand; PAM type: NRG; PAM sequence: GAG
gagatactcatgttgataaa

SEQ ID NO: 21371 - DNA, 20 bp, Artificial Sequence
  Description of Artificial Sequence: Synthetic oligonucleotide
  Target: FXN; (+) strand; PAM type: NRG; PAM sequence: GAG
gatactcatgttgataaaga

SEQ ID NO: 21372 - DNA, 20 bp, Artificial Sequence
  Description of Artificial Sequence: Synthetic oligonucleotide
  Target: FXN; (+) strand; PAM type: NRG; PAM sequence: TGG
catgttgataaagagagccc

SEQ ID NO: 21373 - DNA, 20 bp, Artificial Sequence
  Description of Artificial Sequence: Synthetic oligonucleotide
  Target: FXN; (+) strand; PAM type: NRG; PAM sequence: TAG
gataaagagagccctggtcc

SEQ ID NO: 21374 - DNA, 20 bp, Artificial Sequence
  Description of Artificial Sequence: Synthetic oligonucleotide
  Target: FXN; (+) strand; PAM type: NRG; PAM sequence: TAG
gagagccctggtcctagaca

SEQ ID NO: 21375 - DNA, 20 bp, Artificial Sequence
  Description of Artificial Sequence: Synthetic oligonucleotide
  Target: FXN; (+) strand; PAM type: NRG; PAM sequence: CAG
ccctggtcctagacatagtt

SEQ ID NO: 21376 - DNA, 20 bp, Artificial Sequence
  Description of Artificial Sequence: Synthetic oligonucleotide
  Target: FXN; (+) strand; PAM type: NRG; PAM sequence: AAG
ctagacatagttcagccaca

SEQ ID NO: 21377 - DNA, 20 bp, Artificial Sequence
  Description of Artificial Sequence: Synthetic oligonucleotide
  Target: FXN; (+) strand; PAM type: NRG; PAM sequence: TAG
gacatagttcagccacaaag

SEQ ID NO: 21378 - DNA, 20 bp, Artificial Sequence
  Description of Artificial Sequence: Synthetic oligonucleotide
  Target: FXN; (+) strand; PAM type: NRG; PAM sequence: TGG
acaaagtagttgtccctttg

SEQ ID NO: 21379 - DNA, 20 bp, Artificial Sequence
  Description of Artificial Sequence: Synthetic oligonucleotide
  Target: FXN; (+) strand; PAM type: NRG; PAM sequence: AAG
gtagttgtccctttgtggac

SEQ ID NO: 21380 - DNA, 20 bp, Artificial Sequence
  Description of Artificial Sequence: Synthetic oligonucleotide
  Target: FXN; (+) strand; PAM type: NRG; PAM sequence: TGG
gacaagtttcccaaattccc

SEQ ID NO: 21381 - DNA, 20 bp, Artificial Sequence
  Description of Artificial Sequence: Synthetic oligonucleotide
  Target: FXN; (+) strand; PAM type: NRG; PAM sequence: GAG
tgcttccccatctgttaaat

SEQ ID NO: 21382 - DNA, 20 bp, Artificial Sequence
  Description of Artificial Sequence: Synthetic oligonucleotide
  Target: FXN; (+) strand; PAM type: NRG; PAM sequence: GAG
cttccccatctgttaaatga

SEQ ID NO: 21383 - DNA, 20 bp, Artificial Sequence
  Description of Artificial Sequence: Synthetic oligonucleotide
  Target: FXN; (+) strand; PAM type: NRG; PAM sequence: TAG
ccatctgttaaatgagagaa

SEQ ID NO: 21384 - DNA, 20 bp, Artificial Sequence
  Description of Artificial Sequence: Synthetic oligonucleotide
  Target: FXN; (+) strand; PAM type: NRG; PAM sequence: GAG
atctgttaaatgagagaata

SEQ ID NO: 21385 - DNA, 20 bp, Artificial Sequence
  Description of Artificial Sequence: Synthetic oligonucleotide
  Target: FXN; (+) strand; PAM type: NRG; PAM sequence: TGG
ttaaatgagagaatagagta

SEQ ID NO: 21386 - DNA, 20 bp, Artificial Sequence
  Description of Artificial Sequence: Synthetic oligonucleotide
  Target: FXN; (+) strand; PAM type: NRG; PAM sequence: CAG
aatagagtatggttgattcc

SEQ ID NO: 21387 - DNA, 20 bp, Artificial Sequence
  Description of Artificial Sequence: Synthetic oligonucleotide
  Target: FXN; (+) strand; PAM type: NRG; PAM sequence: CAG
tatggttgattcccagcatt

SEQ ID NO: 21388 - DNA, 20 bp, Artificial Sequence
  Description of Artificial Sequence: Synthetic oligonucleotide
  Target: FXN; (+) strand; PAM type: NRG; PAM sequence: TGG
ggttgattcccagcattcag

SEQ ID NO: 21389 - DNA, 20 bp, Artificial Sequence
  Description of Artificial Sequence: Synthetic oligonucleotide
  Target: FXN; (+) strand; PAM type: NRG; PAM sequence: AAG
cagcattcagtggtcctgtc

SEQ ID NO: 21390 - DNA, 20 bp, Artificial Sequence
  Description of Artificial Sequence: Synthetic oligonucleotide
  Target: FXN; (+) strand; PAM type: NRG; PAM sequence: CAG
ggtcctgtcaagcaacctaa

SEQ ID NO: 21391 - DNA, 20 bp, Artificial Sequence
  Description of Artificial Sequence: Synthetic oligonucleotide
  Target: FXN; (+) strand; PAM type: NRG; PAM sequence: AGG
gtcctgtcaagcaacctaac

SEQ ID NO: 21392 - DNA, 20 bp, Artificial Sequence
  Description of Artificial Sequence: Synthetic oligonucleotide
  Target: FXN; (+) strand; PAM type: NRG; PAM sequence: TAG
tgtcaagcaacctaacaggc

SEQ ID NO: 21393 - DNA, 20 bp, Artificial Sequence
  Description of Artificial Sequence: Synthetic oligonucleotide
  Target: FXN; (+) strand; PAM type: NRG; PAM sequence: TGG
ggctagttctaattccctat

SEQ ID NO: 21394 - DNA, 20 bp, Artificial Sequence
  Description of Artificial Sequence: Synthetic oligonucleotide
  Target: FXN; (+) strand; PAM type: NRG; PAM sequence: GGG
gctagttctaattccctatt

SEQ ID NO: 21395 - DNA, 20 bp, Artificial Sequence
  Description of Artificial Sequence: Synthetic oligonucleotide
  Target: FXN; (+) strand; PAM type: NRG; PAM sequence: TAG
agttctaattccctattggg

SEQ ID NO: 21396 - DNA, 20 bp, Artificial Sequence
  Description of Artificial Sequence: Synthetic oligonucleotide
  Target: FXN; (+) strand; PAM type: NRG; PAM sequence: GAG
taattccctattgggtagat

SEQ ID NO: 21397 - DNA, 20 bp, Artificial Sequence
  Description of Artificial Sequence: Synthetic oligonucleotide
  Target: FXN; (+) strand; PAM type: NRG; PAM sequence: AGG
aattccctattgggtagatg

SEQ ID NO: 21398 - DNA, 20 bp, Artificial Sequence
  Description of Artificial Sequence: Synthetic oligonucleotide
  Target: FXN; (+) strand; PAM type: NRG; PAM sequence: GGG
attccctattgggtagatga

SEQ ID NO: 21399 - DNA, 20 bp, Artificial Sequence
  Description of Artificial Sequence: Synthetic oligonucleotide
  Target: FXN; (+) strand; PAM type: NRG; PAM sequence: GGG
ttccctattgggtagatgag

SEQ ID NO: 21400 - DNA, 20 bp, Artificial Sequence
  Description of Artificial Sequence: Synthetic oligonucleotide
  Target: FXN; (+) strand; PAM type: NRG; PAM sequence: AAG
gggtagatgaggggatgaca

SEQ ID NO: 21401 - DNA, 20 bp, Artificial Sequence
  Description of Artificial Sequence: Synthetic oligonucleotide
  Target: FXN; (+) strand; PAM type: NRG; PAM sequence: CAG
gatgaggggatgacaaagaa

SEQ ID NO: 21402 - DNA, 20 bp, Artificial Sequence
  Description of Artificial Sequence: Synthetic oligonucleotide
  Target: FXN; (+) strand; PAM type: NRG; PAM sequence: AAG
gatgacaaagaacagttttt

SEQ ID NO: 21403 - DNA, 20 bp, Artificial Sequence
  Description of Artificial Sequence: Synthetic oligonucleotide
  Target: FXN; (+) strand; PAM type: NRG; PAM sequence: TAG
agaacagtttttaagctata

SEQ ID NO: 21404 - DNA, 20 bp, Artificial Sequence
  Description of Artificial Sequence: Synthetic oligonucleotide
  Target: FXN; (+) strand; PAM type: NRG; PAM sequence: AGG
gaacagtttttaagctatat

SEQ ID NO: 21405 - DNA, 20 bp, Artificial Sequence
  Description of Artificial Sequence: Synthetic oligonucleotide
  Target: FXN; (+) strand; PAM type: NRG; PAM sequence: TGG
tatataggaaacattgttat

SEQ ID NO: 21406 - DNA, 20 bp, Artificial Sequence
  Description of Artificial Sequence: Synthetic oligonucleotide
  Target: FXN; (+) strand; PAM type: NRG; PAM sequence: CAG
gtgttgccctatcgtgattt

SEQ ID NO: 21407 - DNA, 20 bp, Artificial Sequence
  Description of Artificial Sequence: Synthetic oligonucleotide
  Target: FXN; (+) strand; PAM type: NRG; PAM sequence: TAG
ttgaattcatgtgaaaataa

SEQ ID NO: 21408 - DNA, 20 bp, Artificial Sequence
  Description of Artificial Sequence: Synthetic oligonucleotide
  Target: FXN; (+) strand; PAM type: NRG; PAM sequence: TGG
gtgaaaataatagccatcct

SEQ ID NO: 21409 - DNA, 20 bp, Artificial Sequence
  Description of Artificial Sequence: Synthetic oligonucleotide
  Target: FXN; (+) strand; PAM type: NRG; PAM sequence: TGG
aataatagccatccttggcc

SEQ ID NO: 21410 - DNA, 20 bp, Artificial Sequence
  Description of Artificial Sequence: Synthetic oligonucleotide
  Target: FXN; (+) strand; PAM type: NRG; PAM sequence: CGG
tagccatccttggcctggcg

SEQ ID NO: 21411 - DNA, 20 bp, Artificial Sequence
  Description of Artificial Sequence: Synthetic oligonucleotide
  Target: FXN; (+) strand; PAM type: NRG; PAM sequence: TGG
ccatccttggcctggcgcgg

SEQ ID NO: 21412 - DNA, 20 bp, Artificial Sequence
  Description of Artificial Sequence: Synthetic oligonucleotide
  Target: FXN; (+) strand; PAM type: NRG; PAM sequence: CAG
gtggctcacacctgtaatcc

SEQ ID NO: 21413 - DNA, 20 bp, Artificial Sequence
  Description of Artificial Sequence: Synthetic oligonucleotide
  Target: FXN; (+) strand; PAM type: NRG; PAM sequence: TGG
acctgtaatcccagcacttt

SEQ ID NO: 21414 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcacttttg

SEQ ID NO: 21415 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcacttttgg

SEQ ID NO: 21416 - DNA, 20 bp, Artificial Sequence
  Description of Artificial Sequence: Synthetic oligonucleotide
  Target: FXN; (+) strand; PAM type: NRG; PAM sequence: AAG
tcccagcacttttggaggcc

SEQ ID NO: 21417 - DNA, 20 bp, Artificial Sequence
  Description of Artificial Sequence: Synthetic oligonucleotide
  Target: FXN; (+) strand; PAM type: NRG; PAM sequence: AGG
cccagcacttttggaggcca

SEQ ID NO: 21418 - DNA, 20 bp, Artificial Sequence
  Description of Artificial Sequence: Synthetic oligonucleotide
  Target: FXN; (+) strand; PAM type: NRG; PAM sequence: TGG
agcacttttggaggccaagg

SEQ ID NO: 21419 - DNA, 20 bp, Artificial Sequence
  Description of Artificial Sequence: Synthetic oligonucleotide
  Target: FXN; (+) strand; PAM type: NRG; PAM sequence: GGG
gcacttttggaggccaaggt

SEQ ID NO: 21420 - DNA, 20 bp, Artificial Sequence
  Description of Artificial Sequence: Synthetic oligonucleotide
  Target: FXN; (+) strand; PAM type: NRG; PAM sequence: TGG
cttttggaggccaaggtggg

SEQ ID NO: 21421 - DNA, 20 bp, Artificial Sequence
  Description of Artificial Sequence: Synthetic oligonucleotide
  Target: FXN; (+) strand; PAM type: NRG; PAM sequence: GAG
ccaaggtgggtggatcacct

SEQ ID NO: 21422 - DNA, 20 bp, Artificial Sequence
  Description of Artificial Sequence: Synthetic oligonucleotide
  Target: FXN; (+) strand; PAM type: NRG; PAM sequence: AGG
caaggtgggtggatcacctg

SEQ ID NO: 21423 - DNA, 20 bp, Artificial Sequence
  Description of Artificial Sequence: Synthetic oligonucleotide
  Target: FXN; (+) strand; PAM type: NRG; PAM sequence: CAG
gtgggtggatcacctgaggt

SEQ ID NO: 21424 - DNA, 20 bp, Artificial Sequence
  Description of Artificial Sequence: Synthetic oligonucleotide
  Target: FXN; (+) strand; PAM type: NRG; PAM sequence: AGG
tgggtggatcacctgaggtc

SEQ ID NO: 21425 - DNA, 20 bp, Artificial Sequence
  Description of Artificial Sequence: Synthetic oligonucleotide
  Target: FXN; (+) strand; PAM type: NRG; PAM sequence: GAG
ggtggatcacctgaggtcag

SEQ ID NO: 21426 - DNA, 20 bp, Artificial Sequence
  Description of Artificial Sequence: Synthetic oligonucleotide
  Target: FXN; (+) strand; PAM type: NRG; PAM sequence: AAG
tcacctgaggtcaggagttc

SEQ ID NO: 21427 - DNA, 20 bp, Artificial Sequence
  Description of Artificial Sequence: Synthetic oligonucleotide
  Target: FXN; (+) strand; PAM type: NRG; PAM sequence: CAG
tgaggtcaggagttcaagac

SEQ ID NO: 21428 - DNA, 20 bp, Artificial Sequence
  Description of Artificial Sequence: Synthetic oligonucleotide
  Target: FXN; (+) strand; PAM type: NRG; PAM sequence: TGG
tcaggagttcaagaccagcc

SEQ ID NO: 21429 - DNA, 20 bp, Artificial Sequence
  Description of Artificial Sequence: Synthetic oligonucleotide
  Target: FXN; (+) strand; PAM type: NRG; PAM sequence: TAG
ctactaaaaatacaaaaaat

SEQ ID NO: 21430 - DNA, 20 bp, Artificial Sequence
  Description of Artificial Sequence: Synthetic oligonucleotide
  Target: FXN; (+) strand; PAM type: NRG; PAM sequence: CGG
taaaaatacaaaaaattagc

SEQ ID NO: 21431 - DNA, 20 bp, Artificial Sequence
  Description of Artificial Sequence: Synthetic oligonucleotide
  Target: FXN; (+) strand; PAM type: NRG; PAM sequence: GGG
aaaaatacaaaaaattagcc

SEQ ID NO: 21432 - DNA, 20 bp, Artificial Sequence
  Description of Artificial Sequence: Synthetic oligonucleotide
  Target: FXN; (+) strand; PAM type: NRG; PAM sequence: TGG
aaaaaattagccgggcatga

SEQ ID NO: 21433 - DNA, 20 bp, Artificial Sequence
  Description of Artificial Sequence: Synthetic oligonucleotide
  Target: FXN; (+) strand; PAM type: NRG; PAM sequence: CAG
aaattagccgggcatgatgg

SEQ ID NO: 21434 - DNA, 20 bp, Artificial Sequence
  Description of Artificial Sequence: Synthetic oligonucleotide
  Target: FXN; (+) strand; PAM type: NRG; PAM sequence: AGG
aattagccgggcatgatggc

SEQ ID NO: 21435 - DNA, 20 bp, Artificial Sequence
  Description of Artificial Sequence: Synthetic oligonucleotide
  Target: FXN; (+) strand; PAM type: NRG; PAM sequence: CAG
atggcaggtgcctgtaatcc

SEQ ID NO: 21436 - DNA, 20 bp, Artificial Sequence
  Description of Artificial Sequence: Synthetic oligonucleotide
  Target: FXN; (+) strand; PAM type: NRG; PAM sequence: TGG
tgcctgtaatcccagctact

SEQ ID NO: 21437 - DNA, 20 bp, Artificial Sequence
  Description of Artificial Sequence: Synthetic oligonucleotide
  Target: FXN; (+) strand; PAM type: NRG; PAM sequence: GGG
gcctgtaatcccagctactt

SEQ ID NO: 21438 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagctacttgg

SEQ ID NO: 21439 - DNA, 20 bp, Artificial Sequence
  Description of Artificial Sequence: Synthetic oligonucleotide
  Target: FXN; (+) strand; PAM type: NRG; PAM sequence: AGG
tgtaatcccagctacttggg

SEQ ID NO: 21440 - DNA, 20 bp, Artificial Sequence
  Description of Artificial Sequence: Synthetic oligonucleotide
  Target: FXN; (+) strand; PAM type: NRG; PAM sequence: AAG
cccagctacttgggaggctg

SEQ ID NO: 21441 - DNA, 20 bp, Artificial Sequence
  Description of Artificial Sequence: Synthetic oligonucleotide
  Target: FXN; (+) strand; PAM type: NRG; PAM sequence: CGG
agctacttgggaggctgaag

SEQ ID NO: 21442 - DNA, 20 bp, Artificial Sequence
  Description of Artificial Sequence: Synthetic oligonucleotide
  Target: FXN; (+) strand; PAM type: NRG; PAM sequence: AAG
tacttgggaggctgaagcgg

SEQ ID NO: 21443 - DNA, 20 bp, Artificial Sequence
  Description of Artificial Sequence: Synthetic oligonucleotide
  Target: FXN; (+) strand; PAM type: NRG; PAM sequence: CAG
gcggaagaatcgcttgaacc

SEQ ID NO: 21444 - DNA, 20 bp, Artificial Sequence
  Description of Artificial Sequence: Synthetic oligonucleotide
  Target: FXN; (+) strand; PAM type: NRG; PAM sequence: GAG
ggaagaatcgcttgaaccca

SEQ ID NO: 21445 - DNA, 20 bp, Artificial Sequence
  Description of Artificial Sequence: Synthetic oligonucleotide
  Target: FXN; (+) strand; PAM type: NRG; PAM sequence: AGG
gaagaatcgcttgaacccag

SEQ ID NO: 21446 - DNA, 20 bp, Artificial Sequence
  Description of Artificial Sequence: Synthetic oligonucleotide
  Target: FXN; (+) strand; PAM type: NRG; PAM sequence: TGG
gaatcgcttgaacccagagg

SEQ ID NO: 21447 - DNA, 20 bp, Artificial Sequence
  Description of Artificial Sequence: Synthetic oligonucleotide
  Target: FXN; (+) strand; PAM type: NRG; PAM sequence: GAG
atcgcttgaacccagaggtg

SEQ ID NO: 21448 - DNA, 20 bp, Artificial Sequence
  Description of Artificial Sequence: Synthetic oligonucleotide
  Target: FXN; (+) strand; PAM type: NRG; PAM sequence: AGG
tcgcttgaacccagaggtgg

SEQ ID NO: 21449 - DNA, 20 bp, Artificial Sequence
  Description of Artificial Sequence: Synthetic oligonucleotide
  Target: FXN; (+) strand; PAM type: NRG; PAM sequence: CAG
gaacccagaggtggaggttg

SEQ ID NO: 21450 - DNA, 20 bp, Artificial Sequence
  Description of Artificial Sequence: Synthetic oligonucleotide
  Target: FXN; (+) strand; PAM type: NRG; PAM sequence: GAG
ccagaggtggaggttgcagt

SEQ ID NO: 21451 - DNA, 20 bp, Artificial Sequence
  Description of Artificial Sequence: Synthetic oligonucleotide
  Target: FXN; (+) strand; PAM type: NRG; PAM sequence: GAG
ggtggaggttgcagtgagcc

SEQ ID NO: 21452 - DNA, 20 bp, Artificial Sequence
  Description of Artificial Sequence: Synthetic oligonucleotide
  Target: FXN; (+) strand; PAM type: NRG; PAM sequence: TGG
cgtgccattgcactgtaacc

SEQ ID NO: 21453 - DNA, 20 bp, Artificial Sequence
  Description of Artificial Sequence: Synthetic oligonucleotide
  Target: FXN; (+) strand; PAM type: NRG; PAM sequence: GGG
gtgccattgcactgtaacct

SEQ ID NO: 21454 - DNA, 20 bp, Artificial Sequence
  Description of Artificial Sequence: Synthetic oligonucleotide
  Target: FXN; (+) strand; PAM type: NRG; PAM sequence: GAG
gcactgtaacctgggtgact

SEQ ID NO: 21455 - DNA, 20 bp, Artificial Sequence
  Description of Artificial Sequence: Synthetic oligonucleotide
  Target: FXN; (+) strand; PAM type: NRG; PAM sequence: TAG
taacaatataataataataa

SEQ ID NO: 21456 - DNA, 20 bp, Artificial Sequence
  Description of Artificial Sequence: Synthetic oligonucleotide
  Target: FXN; (+) strand; PAM type: NRG; PAM sequence: TGG
atcctttattgtacccttac

SEQ ID NO: 21457 - DNA, 20 bp, Artificial Sequence
  Description of Artificial Sequence: Synthetic oligonucleotide
  Target: FXN; (+) strand; PAM type: NRG; PAM sequence: GGG
tcctttattgtacccttact

SEQ ID NO: 21458 - DNA, 20 bp, Artificial Sequence
  Description of Artificial Sequence: Synthetic oligonucleotide
  Target: FXN; (+) strand; PAM type: NRG; PAM sequence: AAG
actgacctgcactttataca

SEQ ID NO: 21459 - DNA, 20 bp, Artificial Sequence
  Description of Artificial Sequence: Synthetic oligonucleotide
  Target: FXN; (+) strand; PAM type: NRG; PAM sequence: AAG
tgcactttatacaaagcaac

SEQ ID NO: 21460 - DNA, 20 bp, Artificial Sequence
  Description of Artificial Sequence: Synthetic oligonucleotide
  Target: FXN; (+) strand; PAM type: NRG; PAM sequence: CAG
tatacaaagcaacaagcctc

SEQ ID NO: 21461 - DNA, 20 bp, Artificial Sequence
  Description of Artificial Sequence: Synthetic oligonucleotide
  Target: FXN; (+) strand; PAM type: NRG; PAM sequence: AGG
atacaaagcaacaagcctcc

SEQ ID NO: 21462 - DNA, 20 bp, Artificial Sequence
  Description of Artificial Sequence: Synthetic oligonucleotide
  Target: FXN; (+) strand; PAM type: NRG; PAM sequence: AAG
aggacattaaaattcatgca

SEQ ID NO: 21463 - DNA, 20 bp, Artificial Sequence
  Description of Artificial Sequence: Synthetic oligonucleotide
  Target: FXN; (+) strand; PAM type: NRG; PAM sequence: AAG
ttatattattttcttactta

SEQ ID NO: 21464 - DNA, 20 bp, Artificial Sequence
  Description of Artificial Sequence: Synthetic oligonucleotide
  Target: FXN; (+) strand; PAM type: NRG; PAM sequence: AAG
tattattttcttacttaaag

SEQ ID NO: 21465 - DNA, 20 bp, Artificial Sequence
  Description of Artificial Sequence: Synthetic oligonucleotide
  Target: FXN; (+) strand; PAM type: NRG; PAM sequence: AGG
attattttcttacttaaaga

SEQ ID NO: 21466 - DNA, 20 bp, Artificial Sequence
  Description of Artificial Sequence: Synthetic oligonucleotide
  Target: FXN; (+) strand; PAM type: NRG; PAM sequence: TAG
ttacttaaagaaggatttat

SEQ ID NO: 21467 - DNA, 20 bp, Artificial Sequence
  Description of Artificial Sequence: Synthetic oligonucleotide
  Target: FXN; (+) strand; PAM type: NRG; PAM sequence: TGG
cttaaagaaggatttattag

SEQ ID NO: 21468 - DNA, 20 bp, Artificial Sequence
  Description of Artificial Sequence: Synthetic oligonucleotide
  Target: FXN; (+) strand; PAM type: NRG; PAM sequence: TGG
aagaaggatttattagtggc

SEQ ID NO: 21469 - DNA, 20 bp, Artificial Sequence
  Description of Artificial Sequence: Synthetic oligonucleotide
  Target: FXN; (+) strand; PAM type: NRG; PAM sequence: GGG
agaaggatttattagtggct

SEQ ID NO: 21470 - DNA, 20 bp, Artificial Sequence
  Description of Artificial Sequence: Synthetic oligonucleotide
  Target: FXN; (+) strand; PAM type: NRG; PAM sequence: TGG
gatttattagtggctgggca

SEQ ID NO: 21471 - DNA, 20 bp, Artificial Sequence
  Description of Artificial Sequence: Synthetic oligonucleotide
  Target: FXN; (+) strand; PAM type: NRG; PAM sequence: TGG
ttattagtggctgggcatgg

SEQ ID NO: 21472 - DNA, 20 bp, Artificial Sequence
  Description of Artificial Sequence: Synthetic oligonucleotide
  Target: FXN; (+) strand; PAM type: NRG; PAM sequence: CAG
gtggcgtgcacctgtaatcc

SEQ ID NO: 21473 - DNA, 20 bp, Artificial Sequence
  Description of Artificial Sequence: Synthetic oligonucleotide
  Target: FXN; (+) strand; PAM type: NRG; PAM sequence: AGG
tggcgtgcacctgtaatccc

SEQ ID NO: 21474 - DNA, 20 bp, Artificial Sequence
  Description of Artificial Sequence: Synthetic oligonucleotide
  Target: FXN; (+) strand; PAM type: NRG; PAM sequence: CAG
cacctgtaatcccaggtact

SEQ ID NO: 21475 - DNA, 20 bp, Artificial Sequence
  Description of Artificial Sequence: Synthetic oligonucleotide
  Target: FXN; (+) strand; PAM type: NRG; PAM sequence: AGG
acctgtaatcccaggtactc

SEQ ID NO: 21476 - DNA, 20 bp, Artificial Sequence
  Description of Artificial Sequence: Synthetic oligonucleotide
  Target: FXN; (+) strand; PAM type: NRG; PAM sequence: GAG
ctgtaatcccaggtactcag

SEQ ID NO: 21477 - DNA, 20 bp, Artificial Sequence
  Description of Artificial Sequence: Synthetic oligonucleotide
  Target: FXN; (+) strand; PAM type: NRG; PAM sequence: AGG
tgtaatcccaggtactcagg

SEQ ID NO: 21478 - DNA, 20 bp, Artificial Sequence
  Description of Artificial Sequence: Synthetic oligonucleotide
  Target: FXN; (+) strand; PAM type: NRG; PAM sequence: GAG
tcccaggtactcaggaggct

SEQ ID NO: 21479 - DNA, 20 bp, Artificial Sequence
  Description of Artificial Sequence: Synthetic oligonucleotide
  Target: FXN; (+) strand; PAM type: NRG; PAM sequence: CGG
aggtactcaggaggctgaga

SEQ ID NO: 21480 - DNA, 20 bp, Artificial Sequence
  Description of Artificial Sequence: Synthetic oligonucleotide
  Target: FXN; (+) strand; PAM type: NRG; PAM sequence: GGG
ggtactcaggaggctgagac

SEQ ID NO: 21481 - DNA, 20 bp, Artificial Sequence
  Description of Artificial Sequence: Synthetic oligonucleotide
  Target: FXN; (+) strand; PAM type: NRG; PAM sequence: GAG
tactcaggaggctgagacgg

SEQ ID NO: 21482 - DNA, 20 bp, Artificial Sequence
  Description of Artificial Sequence: Synthetic oligonucleotide
  Target: FXN; (+) strand; PAM type: NRG; PAM sequence: CAG
acgggagaattgcttgaccc

SEQ ID NO: 21483 - DNA, 20 bp, Artificial Sequence
  Description of Artificial Sequence: Synthetic oligonucleotide
  Target: FXN; (+) strand; PAM type: NRG; PAM sequence: AGG
cgggagaattgcttgacccc

SEQ ID NO: 21484 - DNA, 20 bp, Artificial Sequence
  Description of Artificial Sequence: Synthetic oligonucleotide
  Target: FXN; (+) strand; PAM type: NRG; PAM sequence: CGG
gagaattgcttgaccccagg

SEQ ID NO: 21485 - DNA, 20 bp, Artificial Sequence
  Description of Artificial Sequence: Synthetic oligonucleotide
  Target: FXN; (+) strand; PAM type: NRG; PAM sequence: GAG
gaattgcttgaccccaggcg

SEQ ID NO: 21486 - DNA, 20 bp, Artificial Sequence
  Description of Artificial Sequence: Synthetic oligonucleotide
  Target: FXN; (+) strand; PAM type: NRG; PAM sequence: AGG
aattgcttgaccccaggcgg

SEQ ID NO: 21487 - DNA, 20 bp, Artificial Sequence
  Description of Artificial Sequence: Synthetic oligonucleotide
  Target: FXN; (+) strand; PAM type: NRG; PAM sequence: GAG
ttgcttgaccccaggcggag

SEQ ID NO: 21488 - DNA, 20 bp, Artificial Sequence
  Description of Artificial Sequence: Synthetic oligonucleotide
  Target: FXN; (+) strand; PAM type: NRG; PAM sequence: AGG
tgcttgaccccaggcggagg

SEQ ID NO: 21489 - DNA, 20 bp, Artificial Sequence
  Description of Artificial Sequence: Synthetic oligonucleotide
  Target: FXN; (+) strand; PAM type: NRG; PAM sequence: CAG
accccaggcggaggaggtta

SEQ ID NO: 21490 - DNA, 20 bp, Artificial Sequence
  Description of Artificial Sequence: Synthetic oligonucleotide
  Target: FXN; (+) strand; PAM type: NRG; PAM sequence: GAG
caggcggaggaggttacagt

SEQ ID NO: 21491 - DNA, 20 bp, Artificial Sequence
  Description of Artificial Sequence: Synthetic oligonucleotide
  Target: FXN; (+) strand; PAM type: NRG; PAM sequence: GAG
ggaggaggttacagtgagtc

SEQ ID NO: 21492 - DNA, 20 bp, Artificial Sequence
  Description of Artificial Sequence: Synthetic oligonucleotide
  Target: FXN; (+) strand; PAM type: NRG; PAM sequence: GAG
agtgagtcgagatcgtacct

SEQ ID NO: 21493 - DNA, 20 bp, Artificial Sequence
  Description of Artificial Sequence: Synthetic oligonucleotide
  Target: FXN; (+) strand; PAM type: NRG; PAM sequence: CAG
tcgagatcgtacctgagcga

SEQ ID NO: 21494 - DNA, 20 bp, Artificial Sequence
  Description of Artificial Sequence: Synthetic oligonucleotide
  Target: FXN; (+) strand; PAM type: NRG; PAM sequence: GAG
gagatcgtacctgagcgaca

SEQ ID NO: 21495 - DNA, 20 bp, Artificial Sequence
  Description of Artificial Sequence: Synthetic oligonucleotide
  Target: FXN; (+) strand; PAM type: NRG; PAM sequence: GAG
tcgtacctgagcgacagagc

SEQ ID NO: 21496 - DNA, 20 bp, Artificial Sequence
  Description of Artificial Sequence: Synthetic oligonucleotide
  Target: FXN; (+) strand; PAM type: NRG; PAM sequence: AAG
tccgtctcaaaaaaaaaaaa

SEQ ID NO: 21497 - DNA, 20 bp, Artificial Sequence
  Description of Artificial Sequence: Synthetic oligonucleotide
  Target: FXN; (+) strand; PAM type: NRG; PAM sequence: AGG
ccgtctcaaaaaaaaaaaaa

SEQ ID NO: 21498 - DNA, 20 bp, Artificial Sequence
  Description of Artificial Sequence: Synthetic oligonucleotide
  Target: FXN; (+) strand; PAM type: NRG; PAM sequence: GAG
gtctcaaaaaaaaaaaaaag

SEQ ID NO: 21499 - DNA, 20 bp, Artificial Sequence
  Description of Artificial Sequence: Synthetic oligonucleotide
  Target: FXN; (+) strand; PAM type: NRG; PAM sequence: AGG
tctcaaaaaaaaaaaaaagg

SEQ ID NO: 21500 - DNA, 20 bp, Artificial Sequence
  Description of Artificial Sequence: Synthetic oligonucleotide
  Target: FXN; (+) strand; PAM type: NRG; PAM sequence: GGG
ctcaaaaaaaaaaaaaagga

SEQ ID NO: 21501 - DNA, 20 bp, Artificial Sequence
  Description of Artificial Sequence: Synthetic oligonucleotide
  Target: FXN; (+) strand; PAM type: NRG; PAM sequence: GAG
aaaaaggagggtttattaat

SEQ ID NO: 21502 - DNA, 20 bp, Artificial Sequence
  Description of Artificial Sequence: Synthetic oligonucleotide
  Target: FXN; (+) strand; PAM type: NRG; PAM sequence: AAG
aaggagggtttattaatgag

SEQ ID NO: 21503 - DNA, 20 bp, Artificial Sequence
  Description of Artificial Sequence: Synthetic oligonucleotide
  Target: FXN; (+) strand; PAM type: NRG; PAM sequence: TAG
gagaagtttgtattaatatg

SEQ ID NO: 21504 - DNA, 20 bp, Artificial Sequence
  Description of Artificial Sequence: Synthetic oligonucleotide
  Target: FXN; (+) strand; PAM type: NRG; PAM sequence: AAG
gtttgtattaatatgtagca

SEQ ID NO: 21505 - DNA, 20 bp, Artificial Sequence
  Description of Artificial Sequence: Synthetic oligonucleotide
  Target: FXN; (+) strand; PAM type: NRG; PAM sequence: AGG
tttgtattaatatgtagcaa

SEQ ID NO: 21506 - DNA, 20 bp, Artificial Sequence
  Description of Artificial Sequence: Synthetic oligonucleotide
  Target: FXN; (+) strand; PAM type: NRG; PAM sequence: TGG
tgtagcaaaggcttttccaa

SEQ ID NO: 21507 - DNA, 20 bp, Artificial Sequence
  Description of Artificial Sequence: Synthetic oligonucleotide
  Target: FXN; (+) strand; PAM type: NRG; PAM sequence: GGG
gtagcaaaggcttttccaat

SEQ ID NO: 21508 - DNA, 20 bp, Artificial Sequence
  Description of Artificial Sequence: Synthetic oligonucleotide
  Target: FXN; (+) strand; PAM type: NRG; PAM sequence: AAG
gaataaaaacacattccatt

SEQ ID NO: 21509 - DNA, 20 bp, Artificial Sequence
  Description of Artificial Sequence: Synthetic oligonucleotide
  Target: FXN; (+) strand; PAM type: NRG; PAM sequence: AAG
aaaacacattccattaagtc

SEQ ID NO: 21510 - DNA, 20 bp, Artificial Sequence
  Description of Artificial Sequence: Synthetic oligonucleotide
  Target: FXN; (+) strand; PAM type: NRG; PAM sequence: TGG
cacattccattaagtcaagc

SEQ ID NO: 21511 - DNA, 20 bp, Artificial Sequence
  Description of Artificial Sequence: Synthetic oligonucleotide
  Target: FXN; (+) strand; PAM type: NRG; PAM sequence: GGG
acattccattaagtcaagct

SEQ ID NO: 21512 - DNA, 20 bp, Artificial Sequence
  Description of Artificial Sequence: Synthetic oligonucleotide
  Target: FXN; (+) strand; PAM type: NRG; PAM sequence: GAG
attccattaagtcaagctgg

SEQ ID NO: 21513 - DNA, 20 bp, Artificial Sequence
  Description of Artificial Sequence: Synthetic oligonucleotide
  Target: FXN; (+) strand; PAM type: NRG; PAM sequence: CAG
ccattaagtcaagctgggag

SEQ ID NO: 21514 - DNA, 20 bp, Artificial Sequence
  Description of Artificial Sequence: Synthetic oligonucleotide
  Target: FXN; (+) strand; PAM type: NRG; PAM sequence: TGG
ttaagtcaagctgggagcag

SEQ ID NO: 21515 - DNA, 20 bp, Artificial Sequence
  Description of Artificial Sequence: Synthetic oligonucleotide
  Target: FXN; (+) strand; PAM type: NRG; PAM sequence: TAG
ggagcagtggcatataccta

SEQ ID NO: 21516 - DNA, 20 bp, Artificial Sequence
  Description of Artificial Sequence: Synthetic oligonucleotide
  Target: FXN; (+) strand; PAM type: NRG; PAM sequence: CAG
gtggcatatacctatagtcc

SEQ ID NO: 21517 - DNA, 20 bp, Artificial Sequence
  Description of Artificial Sequence: Synthetic oligonucleotide
  Target: FXN; (+) strand; PAM type: NRG; PAM sequence: CAG
tacctatagtcccagctgca

SEQ ID NO: 21518 - DNA, 20 bp, Artificial Sequence
  Description of Artificial Sequence: Synthetic oligonucleotide
  Target: FXN; (+) strand; PAM type: NRG; PAM sequence: AGG
acctatagtcccagctgcac

SEQ ID NO: 21519 - DNA, 20 bp, Artificial Sequence
  Description of Artificial Sequence: Synthetic oligonucleotide
  Target: FXN; (+) strand; PAM type: NRG; PAM sequence: GAG
ctatagtcccagctgcacag

SEQ ID NO: 21520 - DNA, 20 bp, Artificial Sequence
  Description of Artificial Sequence: Synthetic oligonucleotide
  Target: FXN; (+) strand; PAM type: NRG; PAM sequence: AGG
tatagtcccagctgcacagg

SEQ ID NO: 21521 - DNA, 20 bp, Artificial Sequence
  Description of Artificial Sequence: Synthetic oligonucleotide
  Target: FXN; (+) strand; PAM type: NRG; PAM sequence: GAG
tcccagctgcacaggaggct

SEQ ID NO: 21522 - DNA, 20 bp, Artificial Sequence
  Description of Artificial Sequence: Synthetic oligonucleotide
  Target: FXN; (+) strand; PAM type: NRG; PAM sequence: CAG
agctgcacaggaggctgaga

SEQ ID NO: 21523 - DNA, 20 bp, Artificial Sequence
  Description of Artificial Sequence: Synthetic oligonucleotide
  Target: FXN; (+) strand; PAM type: NRG; PAM sequence: AGG
gctgcacaggaggctgagac

SEQ ID NO: 21524 - DNA, 20 bp, Artificial Sequence
  Description of Artificial Sequence: Synthetic oligonucleotide
  Target: FXN; (+) strand; PAM type: NRG; PAM sequence: GAG
tgcacaggaggctgagacag

SEQ ID NO: 21525 - DNA, 20 bp, Artificial Sequence
  Description of Artificial Sequence: Synthetic oligonucleotide
  Target: FXN; (+) strand; PAM type: NRG; PAM sequence: AGG
gcacaggaggctgagacagg

SEQ ID NO: 21526 - DNA, 20 bp, Artificial Sequence
  Description of Artificial Sequence: Synthetic oligonucleotide
  Target: FXN; (+) strand; PAM type: NRG; PAM sequence: AAG
tgagacaggaggattgcttg

SEQ ID NO: 21527 - DNA, 20 bp, Artificial Sequence
  Description of Artificial Sequence: Synthetic oligonucleotide
  Target: FXN; (+) strand; PAM type: NRG; PAM sequence: CAG
acaggaggattgcttgaagc

SEQ ID NO: 21528 - DNA, 20 bp, Artificial Sequence
  Description of Artificial Sequence: Synthetic oligonucleotide
  Target: FXN; (+) strand; PAM type: NRG; PAM sequence: AGG
caggaggattgcttgaagcc

SEQ ID NO: 21529 - DNA, 20 bp, Artificial Sequence
  Description of Artificial Sequence: Synthetic oligonucleotide
  Target: FXN; (+) strand; PAM type: NRG; PAM sequence: TGG
gattgcttgaagccaggaat

SEQ ID NO: 21530 - DNA, 20 bp, Artificial Sequence
  Description of Artificial Sequence: Synthetic oligonucleotide
  Target: FXN; (+) strand; PAM type: NRG; PAM sequence: GAG
ttgcttgaagccaggaattg

SEQ ID NO: 21531 - DNA, 20 bp, Artificial Sequence
  Description of Artificial Sequence: Synthetic oligonucleotide
  Target: FXN; (+) strand; PAM type: NRG; PAM sequence: CAG
tgaagccaggaattggagat

SEQ ID NO: 21532 - DNA, 20 bp, Artificial Sequence
  Description of Artificial Sequence: Synthetic oligonucleotide
  Target: FXN; (+) strand; PAM type: NRG; PAM sequence: TGG
ccaggaattggagatcagcc

SEQ ID NO: 21533 - DNA, 20 bp, Artificial Sequence
  Description of Artificial Sequence: Synthetic oligonucleotide
  Target: FXN; (+) strand; PAM type: NRG; PAM sequence: GGG
caggaattggagatcagcct

SEQ ID NO: 21534 - DNA, 20 bp, Artificial Sequence
  Description of Artificial Sequence: Synthetic oligonucleotide
  Target: FXN; (+) strand; PAM type: NRG; PAM sequence: CAG
ggagatcagcctgggcaaca

SEQ ID NO: 21535 - DNA, 20 bp, Artificial Sequence
  Description of Artificial Sequence: Synthetic oligonucleotide
  Target: FXN; (+) strand; PAM type: NRG; PAM sequence: AAG
atcagcctgggcaacacagc

SEQ ID NO: 21536 - DNA, 20 bp, Artificial Sequence
  Description of Artificial Sequence: Synthetic oligonucleotide
  Target: FXN; (+) strand; PAM type: NRG; PAM sequence: AAG
aagatcctatctcttaaaaa

SEQ ID NO: 21537 - DNA, 20 bp, Artificial Sequence
  Description of Artificial Sequence: Synthetic oligonucleotide
  Target: FXN; (+) strand; PAM type: NRG; PAM sequence: CAG
aaaacctattaataataaaa

SEQ ID NO: 21538 - DNA, 20 bp, Artificial Sequence
  Description of Artificial Sequence: Synthetic oligonucleotide
  Target: FXN; (+) strand; PAM type: NRG; PAM sequence: AAG
taataaaacagtataaacaa

SEQ ID NO: 21539 - DNA, 20 bp, Artificial Sequence
  Description of Artificial Sequence: Synthetic oligonucleotide
  Target: FXN; (+) strand; PAM type: NRG; PAM sequence: TAG
cagtataaacaaaagctaaa

SEQ ID NO: 21540 - DNA, 20 bp, Artificial Sequence
  Description of Artificial Sequence: Synthetic oligonucleotide
  Target: FXN; (+) strand; PAM type: NRG; PAM sequence: AGG
agtataaacaaaagctaaat

SEQ ID NO: 21541 - DNA, 20 bp, Artificial Sequence
  Description of Artificial Sequence: Synthetic oligonucleotide
  Target: FXN; (+) strand; PAM type: NRG; PAM sequence: GAG
ctgaaataaaattatttttt

SEQ ID NO: 21542 - DNA, 20 bp, Artificial Sequence
  Description of Artificial Sequence: Synthetic oligonucleotide
  Target: FXN; (+) strand; PAM type: NRG; PAM sequence: TGG
aaattattttttgagtctga

SEQ ID NO: 21543 - DNA, 20 bp, Artificial Sequence
  Description of Artificial Sequence: Synthetic oligonucleotide
  Target: FXN; (+) strand; PAM type: NRG; PAM sequence: AAG
tgagtctgatggaaatgttt

SEQ ID NO: 21544 - DNA, 20 bp, Artificial Sequence
  Description of Artificial Sequence: Synthetic oligonucleotide
  Target: FXN; (+) strand; PAM type: NRG; PAM sequence: CAG
ctgatggaaatgtttaagtg

SEQ ID NO: 21545 - DNA, 20 bp, Artificial Sequence
  Description of Artificial Sequence: Synthetic oligonucleotide
  Target: FXN; (+) strand; PAM type: NRG; PAM sequence: TAG
atggaaatgtttaagtgcag

SEQ ID NO: 21546 - DNA, 20 bp, Artificial Sequence
  Description of Artificial Sequence: Synthetic oligonucleotide
  Target: FXN; (+) strand; PAM type: NRG; PAM sequence: AGG
tggaaatgtttaagtgcagt

SEQ ID NO: 21547 - DNA, 20 bp, Artificial Sequence
  Description of Artificial Sequence: Synthetic oligonucleotide
  Target: FXN; (+) strand; PAM type: NRG; PAM sequence: CAG
aatgtttaagtgcagtaggc

SEQ ID NO: 21548 - DNA, 20 bp, Artificial Sequence
  Description of Artificial Sequence: Synthetic oligonucleotide
  Target: FXN; (+) strand; PAM type: NRG; PAM sequence: CAG
taagtgcagtaggccagtgc

SEQ ID NO: 21549 - DNA, 20 bp, Artificial Sequence
  Description of Artificial Sequence: Synthetic oligonucleotide
  Target: FXN; (+) strand; PAM type: NRG; PAM sequence: GAG
tgcagtaggccagtgccagt

SEQ ID NO: 21550 - DNA, 20 bp, Artificial Sequence
  Description of Artificial Sequence: Synthetic oligonucleotide
  Target: FXN; (+) strand; PAM type: NRG; PAM sequence: AAG
ttgcatcttgcttctactga

SEQ ID NO: 21551 - DNA, 20 bp, Artificial Sequence
  Description of Artificial Sequence: Synthetic oligonucleotide
  Target: FXN; (+) strand; PAM type: NRG; PAM sequence: CAG
cttgcttctactgaaagttt

SEQ ID NO: 21552 - DNA, 20 bp, Artificial Sequence
  Description of Artificial Sequence: Synthetic oligonucleotide
  Target: FXN; (+) strand; PAM type: NRG; PAM sequence: TAG
ttcagtgcaccccacttact

SEQ ID NO: 21553 - DNA, 20 bp, Artificial Sequence
  Description of Artificial Sequence: Synthetic oligonucleotide
  Target: FXN; (+) strand; PAM type: NRG; PAM sequence: CGG
caccccacttacttagaact

SEQ ID NO: 21554 - DNA, 20 bp, Artificial Sequence
  Description of Artificial Sequence: Synthetic oligonucleotide
  Target: FXN; (+) strand; PAM type: NRG; PAM sequence: TGG
acatgatgtactcctttatc

SEQ ID NO: 21555 - DNA, 20 bp, Artificial Sequence
  Description of Artificial Sequence: Synthetic oligonucleotide
  Target: FXN; (+) strand; PAM type: NRG; PAM sequence: GGG
catgatgtactcctttatct

SEQ ID NO: 21556 - DNA, 20 bp, Artificial Sequence
  Description of Artificial Sequence: Synthetic oligonucleotide
  Target: FXN; (+) strand; PAM type: NRG; PAM sequence: CAG
gtactcctttatctgggaca

SEQ ID NO: 21557 - DNA, 20 bp, Artificial Sequence
  Description of Artificial Sequence: Synthetic oligonucleotide
  Target: FXN; (+) strand; PAM type: NRG; PAM sequence: AAG
ttatctgggacacagcacaa

SEQ ID NO: 21558 - DNA, 20 bp, Artificial Sequence
  Description of Artificial Sequence: Synthetic oligonucleotide
  Target: FXN; (+) strand; PAM type: NRG; PAM sequence: GAG
atctgggacacagcacaaaa

SEQ ID NO: 21559 - DNA, 20 bp, Artificial Sequence
  Description of Artificial Sequence: Synthetic oligonucleotide
  Target: FXN; (+) strand; PAM type: NRG; PAM sequence: AGG
tctgggacacagcacaaaag

SEQ ID NO: 21560 - DNA, 20 bp, Artificial Sequence
  Description of Artificial Sequence: Synthetic oligonucleotide
  Target: FXN; (+) strand; PAM type: NRG; PAM sequence: CAG
cacagcacaaaagaggtatg

SEQ ID NO: 21561 - DNA, 20 bp, Artificial Sequence
  Description of Artificial Sequence: Synthetic oligonucleotide
  Target: FXN; (+) strand; PAM type: NRG; PAM sequence: TGG
agcacaaaagaggtatgcag

SEQ ID NO: 21562 - DNA, 20 bp, Artificial Sequence
  Description of Artificial Sequence: Synthetic oligonucleotide
  Target: FXN; (+) strand; PAM type: NRG; PAM sequence: GGG
gcacaaaagaggtatgcagt

SEQ ID NO: 21563 - DNA, 20 bp, Artificial Sequence
  Description of Artificial Sequence: Synthetic oligonucleotide
  Target: FXN; (+) strand; PAM type: NRG; PAM sequence: GGG
cacaaaagaggtatgcagtg

SEQ ID NO: 21564 - DNA, 20 bp, Artificial Sequence
  Description of Artificial Sequence: Synthetic oligonucleotide
  Target: FXN; (+) strand; PAM type: NRG; PAM sequence: AAG
gtggggctgctctgacatga

SEQ ID NO: 21565 - DNA, 20 bp, Artificial Sequence
  Description of Artificial Sequence: Synthetic oligonucleotide
  Target: FXN; (+) strand; PAM type: NRG; PAM sequence: TGG
gggctgctctgacatgaaag

SEQ ID NO: 21566 - DNA, 20 bp, Artificial Sequence
  Description of Artificial Sequence: Synthetic oligonucleotide
  Target: FXN; (+) strand; PAM type: NRG; PAM sequence: AAG
ctgctctgacatgaaagtgg

SEQ ID NO: 21567 - DNA, 20 bp, Artificial Sequence
  Description of Artificial Sequence: Synthetic oligonucleotide
  Target: FXN; (+) strand; PAM type: NRG; PAM sequence: AAG
ctgacatgaaagtggaagtt

SEQ ID NO: 21568 - DNA, 20 bp, Artificial Sequence
  Description of Artificial Sequence: Synthetic oligonucleotide
  Target: FXN; (+) strand; PAM type: NRG; PAM sequence: AGG
tgacatgaaagtggaagtta

SEQ ID NO: 21569 - DNA, 20 bp, Artificial Sequence
  Description of Artificial Sequence: Synthetic oligonucleotide
  Target: FXN; (+) strand; PAM type: NRG; PAM sequence: TGG
aaagtggaagttaaggaatc

SEQ ID NO: 21570 - DNA, 20 bp, Artificial Sequence
  Description of Artificial Sequence: Synthetic oligonucleotide
  Target: FXN; (+) strand; PAM type: NRG; PAM sequence: GGG
aagtggaagttaaggaatct

SEQ ID NO: 21571 - DNA, 20 bp, Artificial Sequence
  Description of Artificial Sequence: Synthetic oligonucleotide
  Target: FXN; (+) strand; PAM type: NRG; PAM sequence: TGG
ttaaggaatctgggctctta

SEQ ID NO: 21572 - DNA, 20 bp, Artificial Sequence
  Description of Artificial Sequence: Synthetic oligonucleotide
  Target: FXN; (+) strand; PAM type: NRG; PAM sequence: GGG
taaggaatctgggctcttat

SEQ ID NO: 21573 - DNA, 20 bp, Artificial Sequence
  Description of Artificial Sequence: Synthetic oligonucleotide
  Target: FXN; (+) strand; PAM type: NRG; PAM sequence: GGG
aaggaatctgggctcttatg

SEQ ID NO: 21574 - DNA, 20 bp, Artificial Sequence
  Description of Artificial Sequence: Synthetic oligonucleotide
  Target: FXN; (+) strand; PAM type: NRG; PAM sequence: TGG
gggctcttatggggtccttg

SEQ ID NO: 21575 - DNA, 20 bp, Artificial Sequence
  Description of Artificial Sequence: Synthetic oligonucleotide
  Target: FXN; (+) strand; PAM type: NRG; PAM sequence: GGG
ggctcttatggggtccttgt

SEQ ID NO: 21576 - DNA, 20 bp, Artificial Sequence
  Description of Artificial Sequence: Synthetic oligonucleotide
  Target: FXN; (+) strand; PAM type: NRG; PAM sequence: CAG
cttatggggtccttgtgggc

SEQ ID NO: 21577 - DNA, 20 bp, Artificial Sequence
  Description of Artificial Sequence: Synthetic oligonucleotide
  Target: FXN; (+) strand; PAM type: NRG; PAM sequence: CAG
gtccttgtgggccagccctt

SEQ ID NO: 21578 - DNA, 20 bp, Artificial Sequence
  Description of Artificial Sequence: Synthetic oligonucleotide
  Target: FXN; (+) strand; PAM type: NRG; PAM sequence: AGG
tccttgtgggccagcccttc

SEQ ID NO: 21579 - DNA, 20 bp, Artificial Sequence
  Description of Artificial Sequence: Synthetic oligonucleotide
  Target: FXN; (+) strand; PAM type: NRG; PAM sequence: TAG
ttttactttcattttacata

SEQ ID NO: 21580 - DNA, 20 bp, Artificial Sequence
  Description of Artificial Sequence: Synthetic oligonucleotide
  Target: FXN; (+) strand; PAM type: NRG; PAM sequence: TGG
attttacatatagctctaat

SEQ ID NO: 21581 - DNA, 20 bp, Artificial Sequence
  Description of Artificial Sequence: Synthetic oligonucleotide
  Target: FXN; (+) strand; PAM type: NRG; PAM sequence: AAG
ggtttgattatctcgttccc

SEQ ID NO: 21582 - DNA, 20 bp, Artificial Sequence
  Description of Artificial Sequence: Synthetic oligonucleotide
  Target: FXN; (+) strand; PAM type: NRG; PAM sequence: AGG
gtttgattatctcgttccca

SEQ ID NO: 21583 - DNA, 20 bp, Artificial Sequence
  Description of Artificial Sequence: Synthetic oligonucleotide
  Target: FXN; (+) strand; PAM type: NRG; PAM sequence: CAG
tgattatctcgttcccaagg

SEQ ID NO: 21584 - DNA, 20 bp, Artificial Sequence
  Description of Artificial Sequence: Synthetic oligonucleotide
  Target: FXN; (+) strand; PAM type: NRG; PAM sequence: TGG
ttatctcgttcccaaggcag

SEQ ID NO: 21585 - DNA, 20 bp, Artificial Sequence
  Description of Artificial Sequence: Synthetic oligonucleotide
  Target: FXN; (+) strand; PAM type: NRG; PAM sequence: GGG
tatctcgttcccaaggcagt

SEQ ID NO: 21586 - DNA, 20 bp, Artificial Sequence
  Description of Artificial Sequence: Synthetic oligonucleotide
  Target: FXN; (+) strand; PAM type: NRG; PAM sequence: GAG
tctcgttcccaaggcagtgg

SEQ ID NO: 21587 - DNA, 20 bp, Artificial Sequence
  Description of Artificial Sequence: Synthetic oligonucleotide
  Target: FXN; (+) strand; PAM type: NRG; PAM sequence: AAG
gcagtgggagatccccattt

SEQ ID NO: 21588 - DNA, 20 bp, Artificial Sequence
  Description of Artificial Sequence: Synthetic oligonucleotide
  Target: FXN; (+) strand; PAM type: NRG; PAM sequence: AGG
cagtgggagatccccattta

SEQ ID NO: 21589 - DNA, 20 bp, Artificial Sequence
  Description of Artificial Sequence: Synthetic oligonucleotide
  Target: FXN; (+) strand; PAM type: NRG; PAM sequence: AAG
gggagatccccatttaagga

SEQ ID NO: 21590 - DNA, 20 bp, Artificial Sequence
  Description of Artificial Sequence: Synthetic oligonucleotide
  Target: FXN; (+) strand; PAM type: NRG; PAM sequence: AAG
atccccatttaaggaaagaa

SEQ ID NO: 21591 - DNA, 20 bp, Artificial Sequence
  Description of Artificial Sequence: Synthetic oligonucleotide
  Target: FXN; (+) strand; PAM type: NRG; PAM sequence: AGG
tccccatttaaggaaagaaa

SEQ ID NO: 21592 - DNA, 20 bp, Artificial Sequence
  Description of Artificial Sequence: Synthetic oligonucleotide
  Target: FXN; (+) strand; PAM type: NRG; PAM sequence: GGG
ccccatttaaggaaagaaaa

SEQ ID NO: 21593 - DNA, 20 bp, Artificial Sequence
  Description of Artificial Sequence: Synthetic oligonucleotide
  Target: FXN; (+) strand; PAM type: NRG; PAM sequence: GGG
cccatttaaggaaagaaaag

SEQ ID NO: 21594 - DNA, 20 bp, Artificial Sequence
  Description of Artificial Sequence: Synthetic oligonucleotide
  Target: FXN; (+) strand; PAM type: NRG; PAM sequence: TGG
ttaaggaaagaaaaggggcc

SEQ ID NO: 21595 - DNA, 20 bp, Artificial Sequence
  Description of Artificial Sequence: Synthetic oligonucleotide
  Target: FXN; (+) strand; PAM type: NRG; PAM sequence: CAG
gaaagaaaaggggcctggca

SEQ ID NO: 21596 - DNA, 20 bp, Artificial Sequence
  Description of Artificial Sequence: Synthetic oligonucleotide
  Target: FXN; (+) strand; PAM type: NRG; PAM sequence: TGG
agaaaaggggcctggcacag

SEQ ID NO: 21597 - DNA, 20 bp, Artificial Sequence
  Description of Artificial Sequence: Synthetic oligonucleotide
  Target: FXN; (+) strand; PAM type: NRG; PAM sequence: CAG
gtggctcatgcctgtaatcc

SEQ ID NO: 21598 - DNA, 20 bp, Artificial Sequence
  Description of Artificial Sequence: Synthetic oligonucleotide
  Target: FXN; (+) strand; PAM type: NRG; PAM sequence: TGG
tgcctgtaatcccagcactt

SEQ ID NO: 21599 - DNA, 20 bp, Artificial Sequence
  Description of Artificial Sequence: Synthetic oligonucleotide
  Target: FXN; (+) strand; PAM type: NRG; PAM sequence: GGG
gcctgtaatcccagcacttt

SEQ ID NO: 21600 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttgg

SEQ ID NO: 21601 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttggg

SEQ ID NO: 21602 - DNA, 20 bp, Artificial Sequence
  Description of Artificial Sequence: Synthetic oligonucleotide
  Target: FXN; (+) strand; PAM type: NRG; PAM sequence: GAG
tcccagcactttgggaggct

SEQ ID NO: 21603 - DNA, 20 bp, Artificial Sequence
  Description of Artificial Sequence: Synthetic oligonucleotide
  Target: FXN; (+) strand; PAM type: NRG; PAM sequence: AGG
cccagcactttgggaggctg

SEQ ID NO: 21604 - DNA, 20 bp, Artificial Sequence
  Description of Artificial Sequence: Synthetic oligonucleotide
  Target: FXN; (+) strand; PAM type: NRG; PAM sequence: AAG
gcactttgggaggctgaggc

SEQ ID NO: 21605 - DNA, 20 bp, Artificial Sequence
  Description of Artificial Sequence: Synthetic oligonucleotide
  Target: FXN; (+) strand; PAM type: NRG; PAM sequence: GAG
ctgaggcaagtgtatcacct

SEQ ID NO: 21606 - DNA, 20 bp, Artificial Sequence
  Description of Artificial Sequence: Synthetic oligonucleotide
  Target: FXN; (+) strand; PAM type: NRG; PAM sequence: AGG
tgaggcaagtgtatcacctg

SEQ ID NO: 21607 - DNA, 20 bp, Artificial Sequence
  Description of Artificial Sequence: Synthetic oligonucleotide
  Target: FXN; (+) strand; PAM type: NRG; PAM sequence: CAG
gcaagtgtatcacctgaggt

SEQ ID NO: 21608 - DNA, 20 bp, Artificial Sequence
  Description of Artificial Sequence: Synthetic oligonucleotide
  Target: FXN; (+) strand; PAM type: NRG; PAM sequence: AGG
caagtgtatcacctgaggtc

SEQ ID NO: 21609 - DNA, 20 bp, Artificial Sequence
  Description of Artificial Sequence: Synthetic oligonucleotide
  Target: FXN; (+) strand; PAM type: NRG; PAM sequence: GAG
agtgtatcacctgaggtcag

SEQ ID NO: 21610 - DNA, 20 bp, Artificial Sequence
  Description of Artificial Sequence: Synthetic oligonucleotide
  Target: FXN; (+) strand; PAM type: NRG; PAM sequence: AAG
tcacctgaggtcaggagttc

SEQ ID NO: 21611 - DNA, 20 bp, Artificial Sequence
  Description of Artificial Sequence: Synthetic oligonucleotide
  Target: FXN; (+) strand; PAM type: NRG; PAM sequence: CAG
tgaggtcaggagttcaagac

SEQ ID NO: 21612 - DNA, 20 bp, Artificial Sequence
  Description of Artificial Sequence: Synthetic oligonucleotide
  Target: FXN; (+) strand; PAM type: NRG; PAM sequence: TGG
tcaggagttcaagaccagcc

SEQ ID NO: 21613 - DNA, 20 bp, Artificial Sequence
  Description of Artificial Sequence: Synthetic oligonucleotide
  Target: FXN; (+) strand; PAM type: NRG; PAM sequence: TGG
caagaccagcctggccaaca

SEQ ID NO: 21614 - DNA, 20 bp, Artificial Sequence
  Description of Artificial Sequence: Synthetic oligonucleotide
  Target: FXN; (+) strand; PAM type: NRG; PAM sequence: TGG
tactaaaaatattaaaaaat

SEQ ID NO: 21615 - DNA, 20 bp, Artificial Sequence
  Description of Artificial Sequence: Synthetic oligonucleotide
  Target: FXN; (+) strand; PAM type: NRG; PAM sequence: TGG
aaaaatattaaaaaattggc

SEQ ID NO: 21616 - DNA, 20 bp, Artificial Sequence
  Description of Artificial Sequence: Synthetic oligonucleotide
  Target: FXN; (+) strand; PAM type: NRG; PAM sequence: GGG
aaaatattaaaaaattggct

SEQ ID NO: 21617 - DNA, 20 bp, Artificial Sequence
  Description of Artificial Sequence: Synthetic oligonucleotide
  Target: FXN; (+) strand; PAM type: NRG; PAM sequence: TGG
attaaaaaattggctgggcg

SEQ ID NO: 21618 - DNA, 20 bp, Artificial Sequence
  Description of Artificial Sequence: Synthetic oligonucleotide
  Target: FXN; (+) strand; PAM type: NRG; PAM sequence: TGG
aaaaaattggctgggcgtgg

SEQ ID NO: 21619 - DNA, 20 bp, Artificial Sequence
  Description of Artificial Sequence: Synthetic oligonucleotide
  Target: FXN; (+) strand; PAM type: NRG; PAM sequence: CAG
gtggttcgtgcctataattt

SEQ ID NO: 21620 - DNA, 20 bp, Artificial Sequence
  Description of Artificial Sequence: Synthetic oligonucleotide
  Target: FXN; (+) strand; PAM type: NRG; PAM sequence: CAG
tgcctataatttcagctact

SEQ ID NO: 21621 - DNA, 20 bp, Artificial Sequence
  Description of Artificial Sequence: Synthetic oligonucleotide
  Target: FXN; (+) strand; PAM type: NRG; PAM sequence: AGG
gcctataatttcagctactc

SEQ ID NO: 21622 - DNA, 20 bp, Artificial Sequence
  Description of Artificial Sequence: Synthetic oligonucleotide
  Target: FXN; (+) strand; PAM type: NRG; PAM sequence: GAG
ctataatttcagctactcag

SEQ ID NO: 21623 - DNA, 20 bp, Artificial Sequence
  Description of Artificial Sequence: Synthetic oligonucleotide
  Target: FXN; (+) strand; PAM type: NRG; PAM sequence: AGG
tataatttcagctactcagg

SEQ ID NO: 21624 - DNA, 20 bp, Artificial Sequence
  Description of Artificial Sequence: Synthetic oligonucleotide
  Target: FXN; (+) strand; PAM type: NRG; PAM sequence: GAG
tttcagctactcaggaggct

SEQ ID NO: 21625 - DNA, 20 bp, Artificial Sequence
  Description of Artificial Sequence: Synthetic oligonucleotide
  Target: FXN; (+) strand; PAM type: NRG; PAM sequence: AGG
ttcagctactcaggaggctg

SEQ ID NO: 21626 - DNA, 20 bp, Artificial Sequence
  Description of Artificial Sequence: Synthetic oligonucleotide
  Target: FXN; (+) strand; PAM type: NRG; PAM sequence: CAG
agctactcaggaggctgagg

SEQ ID NO: 21627 - DNA, 20 bp, Artificial Sequence
  Description of Artificial Sequence: Synthetic oligonucleotide
  Target: FXN; (+) strand; PAM type: NRG; PAM sequence: AGG
gctactcaggaggctgaggc

SEQ ID NO: 21628 - DNA, 20 bp, Artificial Sequence
  Description of Artificial Sequence: Synthetic oligonucleotide
  Target: FXN; (+) strand; PAM type: NRG; PAM sequence: GAG
tactcaggaggctgaggcag

SEQ ID NO: 21629 - DNA, 20 bp, Artificial Sequence
  Description of Artificial Sequence: Synthetic oligonucleotide
  Target: FXN; (+) strand; PAM type: NRG; PAM sequence: TGG
gcaggagaatcgctgtaacc

SEQ ID NO: 21630 - DNA, 20 bp, Artificial Sequence
  Description of Artificial Sequence: Synthetic oligonucleotide
  Target: FXN; (+) strand; PAM type: NRG; PAM sequence: GGG
caggagaatcgctgtaacct

SEQ ID NO: 21631 - DNA, 20 bp, Artificial Sequence
  Description of Artificial Sequence: Synthetic oligonucleotide
  Target: FXN; (+) strand; PAM type: NRG; PAM sequence: GGG
aggagaatcgctgtaacctg

SEQ ID NO: 21632 - DNA, 20 bp, Artificial Sequence
  Description of Artificial Sequence: Synthetic oligonucleotide
  Target: FXN; (+) strand; PAM type: NRG; PAM sequence: GGG
ggagaatcgctgtaacctgg

SEQ ID NO: 21633 - DNA, 20 bp, Artificial Sequence
  Description of Artificial Sequence: Synthetic oligonucleotide
  Target: FXN; (+) strand; PAM type: NRG; PAM sequence: GGG
gagaatcgctgtaacctggg

SEQ ID NO: 21634 - DNA, 20 bp, Artificial Sequence
  Description of Artificial Sequence: Synthetic oligonucleotide
  Target: FXN; (+) strand; PAM type: NRG; PAM sequence: TGG
aatcgctgtaacctgggggg

SEQ ID NO: 21635 - DNA, 20 bp, Artificial Sequence
  Description of Artificial Sequence: Synthetic oligonucleotide
  Target: FXN; (+) strand; PAM type: NRG; PAM sequence: GAG
tcgctgtaacctggggggtg

SEQ ID NO: 21636 - DNA, 20 bp, Artificial Sequence
  Description of Artificial Sequence: Synthetic oligonucleotide
  Target: FXN; (+) strand; PAM type: NRG; PAM sequence: AGG
cgctgtaacctggggggtgg

SEQ ID NO: 21637 - DNA, 20 bp, Artificial Sequence
  Description of Artificial Sequence: Synthetic oligonucleotide
  Target: FXN; (+) strand; PAM type: NRG; PAM sequence: CAG
aacctggggggtggaggttg

SEQ ID NO: 21638 - DNA, 20 bp, Artificial Sequence
  Description of Artificial Sequence: Synthetic oligonucleotide
  Target: FXN; (+) strand; PAM type: NRG; PAM sequence: GAG
tggggggtggaggttgcagt

SEQ ID NO: 21639 - DNA, 20 bp, Artificial Sequence
  Description of Artificial Sequence: Synthetic oligonucleotide
  Target: FXN; (+) strand; PAM type: NRG; PAM sequence: GAG
ggtggaggttgcagtgagac

SEQ ID NO: 21640 - DNA, 20 bp, Artificial Sequence
  Description of Artificial Sequence: Synthetic oligonucleotide
  Target: FXN; (+) strand; PAM type: NRG; PAM sequence: CAG
gagatcatgccacttcactc

SEQ ID NO: 21641 - DNA, 20 bp, Artificial Sequence
  Description of Artificial Sequence: Synthetic oligonucleotide
  Target: FXN; (+) strand; PAM type: NRG; PAM sequence: TGG
catgccacttcactccagcc

SEQ ID NO: 21642 - DNA, 20 bp, Artificial Sequence
  Description of Artificial Sequence: Synthetic oligonucleotide
  Target: FXN; (+) strand; PAM type: NRG; PAM sequence: CAG
cttcactccagcctggccaa

SEQ ID NO: 21643 - DNA, 20 bp, Artificial Sequence
  Description of Artificial Sequence: Synthetic oligonucleotide
  Target: FXN; (+) strand; PAM type: NRG; PAM sequence: GAG
tcactccagcctggccaaca

SEQ ID NO: 21644 - DNA, 20 bp, Artificial Sequence
  Description of Artificial Sequence: Synthetic oligonucleotide
  Target: FXN; (+) strand; PAM type: NRG; PAM sequence: AAG
aataaataaataaataaata

SEQ ID NO: 21645 - DNA, 20 bp, Artificial Sequence
  Description of Artificial Sequence: Synthetic oligonucleotide
  Target: FXN; (+) strand; PAM type: NRG; PAM sequence: AGG
ataaataaataaataaataa

SEQ ID NO: 21646 - DNA, 20 bp, Artificial Sequence
  Description of Artificial Sequence: Synthetic oligonucleotide
  Target: FXN; (+) strand; PAM type: NRG; PAM sequence: GGG
taaataaataaataaataaa

SEQ ID NO: 21647 - DNA, 20 bp, Artificial Sequence
  Description of Artificial Sequence: Synthetic oligonucleotide
  Target: FXN; (+) strand; PAM type: NRG; PAM sequence: CAG
agggacttcaaacacatgaa

SEQ ID NO: 21648 - DNA, 20 bp, Artificial Sequence
  Description of Artificial Sequence: Synthetic oligonucleotide
  Target: FXN; (+) strand; PAM type: NRG; PAM sequence: CAG
gacttcaaacacatgaacag

SEQ ID NO: 21649 - DNA, 20 bp, Artificial Sequence
  Description of Artificial Sequence: Synthetic oligonucleotide
  Target: FXN; (+) strand; PAM type: NRG; PAM sequence: CAG
tcaaacacatgaacagcagc

SEQ ID NO: 21650 - DNA, 20 bp, Artificial Sequence
  Description of Artificial Sequence: Synthetic oligonucleotide
  Target: FXN; (+) strand; PAM type: NRG; PAM sequence: AGG
caaacacatgaacagcagcc

SEQ ID NO: 21651 - DNA, 20 bp, Artificial Sequence
  Description of Artificial Sequence: Synthetic oligonucleotide
  Target: FXN; (+) strand; PAM type: NRG; PAM sequence: GGG
aaacacatgaacagcagcca

SEQ ID NO: 21652 - DNA, 20 bp, Artificial Sequence
  Description of Artificial Sequence: Synthetic oligonucleotide
  Target: FXN; (+) strand; PAM type: NRG; PAM sequence: GGG
aacacatgaacagcagccag

SEQ ID NO: 21653 - DNA, 20 bp, Artificial Sequence
  Description of Artificial Sequence: Synthetic oligonucleotide
  Target: FXN; (+) strand; PAM type: NRG; PAM sequence: AAG
acatgaacagcagccagggg

SEQ ID NO: 21654 - DNA, 20 bp, Artificial Sequence
  Description of Artificial Sequence: Synthetic oligonucleotide
  Target: FXN; (+) strand; PAM type: NRG; PAM sequence: AAG
aatcaaaatcatattctgtc

SEQ ID NO: 21655 - DNA, 20 bp, Artificial Sequence
  Description of Artificial Sequence: Synthetic oligonucleotide
  Target: FXN; (+) strand; PAM type: NRG; PAM sequence: TGG
tcatattctgtcaagcaaac

SEQ ID NO: 21656 - DNA, 20 bp, Artificial Sequence
  Description of Artificial Sequence: Synthetic oligonucleotide
  Target: FXN; (+) strand; PAM type: NRG; PAM sequence: AAG
ttctgtcaagcaaactggaa

SEQ ID NO: 21657 - DNA, 20 bp, Artificial Sequence
  Description of Artificial Sequence: Synthetic oligonucleotide
  Target: FXN; (+) strand; PAM type: NRG; PAM sequence: TAG
agtaccactgtgtgtaccaa

SEQ ID NO: 21658 - DNA, 20 bp, Artificial Sequence
  Description of Artificial Sequence: Synthetic oligonucleotide
  Target: FXN; (+) strand; PAM type: NRG; PAM sequence: CAG
taccaatagcctccccacca

SEQ ID NO: 21659 - DNA, 20 bp, Artificial Sequence
  Description of Artificial Sequence: Synthetic oligonucleotide
  Target: FXN; (+) strand; PAM type: NRG; PAM sequence: TGG
agcctccccaccacagaccc

SEQ ID NO: 21660 - DNA, 20 bp, Artificial Sequence
  Description of Artificial Sequence: Synthetic oligonucleotide
  Target: FXN; (+) strand; PAM type: NRG; PAM sequence: GGG
gcctccccaccacagaccct

SEQ ID NO: 21661 - DNA, 20 bp, Artificial Sequence
  Description of Artificial Sequence: Synthetic oligonucleotide
  Target: FXN; (+) strand; PAM type: NRG; PAM sequence: GAG
ctccccaccacagaccctgg

SEQ ID NO: 21662 - DNA, 20 bp, Artificial Sequence
  Description of Artificial Sequence: Synthetic oligonucleotide
  Target: FXN; (+) strand; PAM type: NRG; PAM sequence: TGG
tgggagcatcgcctcattta

SEQ ID NO: 21663 - DNA, 20 bp, Artificial Sequence
  Description of Artificial Sequence: Synthetic oligonucleotide
  Target: FXN; (+) strand; PAM type: NRG; PAM sequence: TGG
gcatcgcctcatttatggtg

SEQ ID NO: 21664 - DNA, 20 bp, Artificial Sequence
  Description of Artificial Sequence: Synthetic oligonucleotide
  Target: FXN; (+) strand; PAM type: NRG; PAM sequence: CAG
gcctcatttatggtgtggtc

SEQ ID NO: 21665 - DNA, 20 bp, Artificial Sequence
  Description of Artificial Sequence: Synthetic oligonucleotide
  Target: FXN; (+) strand; PAM type: NRG; PAM sequence: AAG
gtggtccagtcatccatgtg

SEQ ID NO: 21666 - DNA, 20 bp, Artificial Sequence
  Description of Artificial Sequence: Synthetic oligonucleotide
  Target: FXN; (+) strand; PAM type: NRG; PAM sequence: AGG
tggtccagtcatccatgtga

SEQ ID NO: 21667 - DNA, 20 bp, Artificial Sequence
  Description of Artificial Sequence: Synthetic oligonucleotide
  Target: FXN; (+) strand; PAM type: NRG; PAM sequence: GAG
cagtcatccatgtgaaggat

SEQ ID NO: 21668 - DNA, 20 bp, Artificial Sequence
  Description of Artificial Sequence: Synthetic oligonucleotide
  Target: FXN; (+) strand; PAM type: NRG; PAM sequence: CAG
ccatgtgaaggatgagtttc

SEQ ID NO: 21669 - DNA, 20 bp, Artificial Sequence
  Description of Artificial Sequence: Synthetic oligonucleotide
  Target: FXN; (+) strand; PAM type: NRG; PAM sequence: AGG
catgtgaaggatgagtttcc

SEQ ID NO: 21670 - DNA, 20 bp, Artificial Sequence
  Description of Artificial Sequence: Synthetic oligonucleotide
  Target: FXN; (+) strand; PAM type: NRG; PAM sequence: AAG
gaaggatgagtttccaggaa

SEQ ID NO: 21671 - DNA, 20 bp, Artificial Sequence
  Description of Artificial Sequence: Synthetic oligonucleotide
  Target: FXN; (+) strand; PAM type: NRG; PAM sequence: AGG
aaggatgagtttccaggaaa

SEQ ID NO: 21672 - DNA, 20 bp, Artificial Sequence
  Description of Artificial Sequence: Synthetic oligonucleotide
  Target: FXN; (+) strand; PAM type: NRG; PAM sequence: TGG
aaatattcactgtaacatac

SEQ ID NO: 21673 - DNA, 20 bp, Artificial Sequence
  Description of Artificial Sequence: Synthetic oligonucleotide
  Target: FXN; (+) strand; PAM type: NRG; PAM sequence: GAG
atattcactgtaacatactg

SEQ ID NO: 21674 - DNA, 20 bp, Artificial Sequence
  Description of Artificial Sequence: Synthetic oligonucleotide
  Target: FXN; (+) strand; PAM type: NRG; PAM sequence: AGG
tattcactgtaacatactgg

SEQ ID NO: 21675 - DNA, 20 bp, Artificial Sequence
  Description of Artificial Sequence: Synthetic oligonucleotide
  Target: FXN; (+) strand; PAM type: NRG; PAM sequence: GAG
ttcactgtaacatactggag

SEQ ID NO: 21676 - DNA, 20 bp, Artificial Sequence
  Description of Artificial Sequence: Synthetic oligonucleotide
  Target: FXN; (+) strand; PAM type: NRG; PAM sequence: AGG
tcactgtaacatactggagg

SEQ ID NO: 21677 - DNA, 20 bp, Artificial Sequence
  Description of Artificial Sequence: Synthetic oligonucleotide
  Target: FXN; (+) strand; PAM type: NRG; PAM sequence: GAG
tgtaacatactggaggaggt

SEQ ID NO: 21678 - DNA, 20 bp, Artificial Sequence
  Description of Artificial Sequence: Synthetic oligonucleotide
  Target: FXN; (+) strand; PAM type: NRG; PAM sequence: AGG
gtaacatactggaggaggtg

SEQ ID NO: 21679 - DNA, 20 bp, Artificial Sequence
  Description of Artificial Sequence: Synthetic oligonucleotide
  Target: FXN; (+) strand; PAM type: NRG; PAM sequence: TAG
ggaattgcataatacaatct

SEQ ID NO: 21680 - DNA, 20 bp, Artificial Sequence
  Description of Artificial Sequence: Synthetic oligonucleotide
  Target: FXN; (+) strand; PAM type: NRG; PAM sequence: GAG
ttttcccctttctatttttt

SEQ ID NO: 21681 - DNA, 20 bp, Artificial Sequence
  Description of Artificial Sequence: Synthetic oligonucleotide
  Target: FXN; (+) strand; PAM type: NRG; PAM sequence: CAG
cccctttctattttttgaga

SEQ ID NO: 21682 - DNA, 20 bp, Artificial Sequence
  Description of Artificial Sequence: Synthetic oligonucleotide
  Target: FXN; (+) strand; PAM type: NRG; PAM sequence: AGG
ccctttctattttttgagac

SEQ ID NO: 21683 - DNA, 20 bp, Artificial Sequence
  Description of Artificial Sequence: Synthetic oligonucleotide
  Target: FXN; (+) strand; PAM type: NRG; PAM sequence: TGG
tttgagacaggatctcactt

SEQ ID NO: 21684 - DNA, 20 bp, Artificial Sequence
  Description of Artificial Sequence: Synthetic oligonucleotide
  Target: FXN; (+) strand; PAM type: NRG; PAM sequence: CAG
caggatctcactttggcact

SEQ ID NO: 21685 - DNA, 20 bp, Artificial Sequence
  Description of Artificial Sequence: Synthetic oligonucleotide
  Target: FXN; (+) strand; PAM type: NRG; PAM sequence: AGG
aggatctcactttggcactc

SEQ ID NO: 21686 - DNA, 20 bp, Artificial Sequence
  Description of Artificial Sequence: Synthetic oligonucleotide
  Target: FXN; (+) strand; PAM type: NRG; PAM sequence: TGG
tctcactttggcactcaggc

SEQ ID NO: 21687 - DNA, 20 bp, Artificial Sequence
  Description of Artificial Sequence: Synthetic oligonucleotide
  Target: FXN; (+) strand; PAM type: NRG; PAM sequence: GAG
tcactttggcactcaggctg

SEQ ID NO: 21688 - DNA, 20 bp, Artificial Sequence
  Description of Artificial Sequence: Synthetic oligonucleotide
  Target: FXN; (+) strand; PAM type: NRG; PAM sequence: AGG
cactttggcactcaggctgg

SEQ ID NO: 21689 - DNA, 20 bp, Artificial Sequence
  Description of Artificial Sequence: Synthetic oligonucleotide
  Target: FXN; (+) strand; PAM type: NRG; PAM sequence: CAG
ttggcactcaggctggagga

SEQ ID NO: 21690 - DNA, 20 bp, Artificial Sequence
  Description of Artificial Sequence: Synthetic oligonucleotide
  Target: FXN; (+) strand; PAM type: NRG; PAM sequence: TGG
gcactcaggctggaggacag

SEQ ID NO: 21691 - DNA, 20 bp, Artificial Sequence
  Description of Artificial Sequence: Synthetic oligonucleotide
  Target: FXN; (+) strand; PAM type: NRG; PAM sequence: AAG
ggaggacagtggtacaatca

SEQ ID NO: 21692 - DNA, 20 bp, Artificial Sequence
  Description of Artificial Sequence: Synthetic oligonucleotide
  Target: FXN; (+) strand; PAM type: NRG; PAM sequence: TGG
agtggtacaatcaaagctca

SEQ ID NO: 21693 - DNA, 20 bp, Artificial Sequence
  Description of Artificial Sequence: Synthetic oligonucleotide
  Target: FXN; (+) strand; PAM type: NRG; PAM sequence: CAG
ggtacaatcaaagctcatgg

SEQ ID NO: 21694 - DNA, 20 bp, Artificial Sequence
  Description of Artificial Sequence: Synthetic oligonucleotide
  Target: FXN; (+) strand; PAM type: NRG; PAM sequence: TGG
catggcagcctcgacctccc

SEQ ID NO: 21695 - DNA, 20 bp, Artificial Sequence
  Description of Artificial Sequence: Synthetic oligonucleotide
  Target: FXN; (+) strand; PAM type: NRG; PAM sequence: GGG
atggcagcctcgacctccct

SEQ ID NO: 21696 - DNA, 20 bp, Artificial Sequence
  Description of Artificial Sequence: Synthetic oligonucleotide
  Target: FXN; (+) strand; PAM type: NRG; PAM sequence: TGG
agcctcgacctccctgggct

SEQ ID NO: 21697 - DNA, 20 bp, Artificial Sequence
  Description of Artificial Sequence: Synthetic oligonucleotide
  Target: FXN; (+) strand; PAM type: NRG; PAM sequence: GGG
gcctcgacctccctgggctt

SEQ ID NO: 21698 - DNA, 20 bp, Artificial Sequence
  Description of Artificial Sequence: Synthetic oligonucleotide
  Target: FXN; (+) strand; PAM type: NRG; PAM sequence: CAG
gggcttgggcaatcctccca

SEQ ID NO: 21699 - DNA, 20 bp, Artificial Sequence
  Description of Artificial Sequence: Synthetic oligonucleotide
  Target: FXN; (+) strand; PAM type: NRG; PAM sequence: AGG
ggcttgggcaatcctcccac

SEQ ID NO: 21700 - DNA, 20 bp, Artificial Sequence
  Description of Artificial Sequence: Synthetic oligonucleotide
  Target: FXN; (+) strand; PAM type: NRG; PAM sequence: TAG
cccacaggtgtgcacctcca

SEQ ID NO: 21701 - DNA, 20 bp, Artificial Sequence
  Description of Artificial Sequence: Synthetic oligonucleotide
  Target: FXN; (+) strand; PAM type: NRG; PAM sequence: TGG
caggtgtgcacctccatagc

SEQ ID NO: 21702 - DNA, 20 bp, Artificial Sequence
  Description of Artificial Sequence: Synthetic oligonucleotide
  Target: FXN; (+) strand; PAM type: NRG; PAM sequence: TAG
gctaatttgtgtattttttg

SEQ ID NO: 21703 - DNA, 20 bp, Artificial Sequence
  Description of Artificial Sequence: Synthetic oligonucleotide
  Target: FXN; (+) strand; PAM type: NRG; PAM sequence: GAG
taatttgtgtattttttgta

SEQ ID NO: 21704 - DNA, 20 bp, Artificial Sequence
  Description of Artificial Sequence: Synthetic oligonucleotide
  Target: FXN; (+) strand; PAM type: NRG; PAM sequence: TGG
ttgtgtattttttgtagaga

SEQ ID NO: 21705 - DNA, 20 bp, Artificial Sequence
  Description of Artificial Sequence: Synthetic oligonucleotide
  Target: FXN; (+) strand; PAM type: NRG; PAM sequence: GGG
tgtgtattttttgtagagat

SEQ ID NO: 21706 - DNA, 20 bp, Artificial Sequence
  Description of Artificial Sequence: Synthetic oligonucleotide
  Target: FXN; (+) strand; PAM type: NRG; PAM sequence: GGG
gtgtattttttgtagagatg

SEQ ID NO: 21707 - DNA, 20 bp, Artificial Sequence
  Description of Artificial Sequence: Synthetic oligonucleotide
  Target: FXN; (+) strand; PAM type: NRG; PAM sequence: CAG
tggggtttcaccatgttgcc

SEQ ID NO: 21708 - DNA, 20 bp, Artificial Sequence
  Description of Artificial Sequence: Synthetic oligonucleotide
  Target: FXN; (+) strand; PAM type: NRG; PAM sequence: AGG
ggggtttcaccatgttgccc

SEQ ID NO: 21709 - DNA, 20 bp, Artificial Sequence
  Description of Artificial Sequence: Synthetic oligonucleotide
  Target: FXN; (+) strand; PAM type: NRG; PAM sequence: TGG
tttcaccatgttgcccaggc

SEQ ID NO: 21710 - DNA, 20 bp, Artificial Sequence
  Description of Artificial Sequence: Synthetic oligonucleotide
  Target: FXN; (+) strand; PAM type: NRG; PAM sequence: TAG
ccaggctggtctctaacact

SEQ ID NO: 21711 - DNA, 20 bp, Artificial Sequence
  Description of Artificial Sequence: Synthetic oligonucleotide
  Target: FXN; (+) strand; PAM type: NRG; PAM sequence: AGG
caggctggtctctaacactt

SEQ ID NO: 21712 - DNA, 20 bp, Artificial Sequence
  Description of Artificial Sequence: Synthetic oligonucleotide
  Target: FXN; (+) strand; PAM type: NRG; PAM sequence: AAG
ggtctctaacacttaggctc

SEQ ID NO: 21713 - DNA, 20 bp, Artificial Sequence
  Description of Artificial Sequence: Synthetic oligonucleotide
  Target: FXN; (+) strand; PAM type: NRG; PAM sequence: AAG
tccacctgcctcgtcctccc

SEQ ID NO: 21714 - DNA, 20 bp, Artificial Sequence
  Description of Artificial Sequence: Synthetic oligonucleotide
  Target: FXN; (+) strand; PAM type: NRG; PAM sequence: TGG
gcctcgtcctcccaagatgc

SEQ ID NO: 21715 - DNA, 20 bp, Artificial Sequence
  Description of Artificial Sequence: Synthetic oligonucleotide
  Target: FXN; (+) strand; PAM type: NRG; PAM sequence: GGG
cctcgtcctcccaagatgct

SEQ ID NO: 21716 - DNA, 20 bp, Artificial Sequence
  Description of Artificial Sequence: Synthetic oligonucleotide
  Target: FXN; (+) strand; PAM type: NRG; PAM sequence: CAG
ctcccaagatgctgggatta

SEQ ID NO: 21717 - DNA, 20 bp, Artificial Sequence
  Description of Artificial Sequence: Synthetic oligonucleotide
  Target: FXN; (+) strand; PAM type: NRG; PAM sequence: AGG
tcccaagatgctgggattac

SEQ ID NO: 21718 - DNA, 20 bp, Artificial Sequence
  Description of Artificial Sequence: Synthetic oligonucleotide
  Target: FXN; (+) strand; PAM type: NRG; PAM sequence: CAG
gggattacaggtgtgtgcca

SEQ ID NO: 21719 - DNA, 20 bp, Artificial Sequence
  Description of Artificial Sequence: Synthetic oligonucleotide
  Target: FXN; (+) strand; PAM type: NRG; PAM sequence: AGG
ggattacaggtgtgtgccac

SEQ ID NO: 21720 - DNA, 20 bp, Artificial Sequence
  Description of Artificial Sequence: Synthetic oligonucleotide
  Target: FXN; (+) strand; PAM type: NRG; PAM sequence: CAG
tgtgtgccacaggtgttcat

SEQ ID NO: 21721 - DNA, 20 bp, Artificial Sequence
  Description of Artificial Sequence: Synthetic oligonucleotide
  Target: FXN; (+) strand; PAM type: NRG; PAM sequence: AAG
tgccacaggtgttcatcaga

SEQ ID NO: 21722 - DNA, 20 bp, Artificial Sequence
  Description of Artificial Sequence: Synthetic oligonucleotide
  Target: FXN; (+) strand; PAM type: NRG; PAM sequence: GAG
tctattatttttaccttctt

SEQ ID NO: 21723 - DNA, 20 bp, Artificial Sequence
  Description of Artificial Sequence: Synthetic oligonucleotide
  Target: FXN; (+) strand; PAM type: NRG; PAM sequence: TGG
attatttttaccttcttgag

SEQ ID NO: 21724 - DNA, 20 bp, Artificial Sequence
  Description of Artificial Sequence: Synthetic oligonucleotide
  Target: FXN; (+) strand; PAM type: NRG; PAM sequence: GGG
ttatttttaccttcttgagt

SEQ ID NO: 21725 - DNA, 20 bp, Artificial Sequence
  Description of Artificial Sequence: Synthetic oligonucleotide
  Target: FXN; (+) strand; PAM type: NRG; PAM sequence: TAG
tttttaccttcttgagtggg

SEQ ID NO: 21726 - DNA, 20 bp, Artificial Sequence
  Description of Artificial Sequence: Synthetic oligonucleotide
  Target: FXN; (+) strand; PAM type: NRG; PAM sequence: CAG
ttcttgagtgggtagaacct

SEQ ID NO: 21727 - DNA, 20 bp, Artificial Sequence
  Description of Artificial Sequence: Synthetic oligonucleotide
  Target: FXN; (+) strand; PAM type: NRG; PAM sequence: TAG
tgggtagaacctcagccaca

SEQ ID NO: 21728 - DNA, 20 bp, Artificial Sequence
  Description of Artificial Sequence: Synthetic oligonucleotide
  Target: FXN; (+) strand; PAM type: NRG; PAM sequence: TGG
acatagaaaataaaatgttc

SEQ ID NO: 21729 - DNA, 20 bp, Artificial Sequence
  Description of Artificial Sequence: Synthetic oligonucleotide
  Target: FXN; (+) strand; PAM type: NRG; PAM sequence: TAG
atgttctggcatgacttatt

SEQ ID NO: 21730 - DNA, 20 bp, Artificial Sequence
  Description of Artificial Sequence: Synthetic oligonucleotide
  Target: FXN; (+) strand; PAM type: NRG; PAM sequence: TGG
gcatgacttatttagctctc

SEQ ID NO: 21731 - DNA, 20 bp, Artificial Sequence
  Description of Artificial Sequence: Synthetic oligonucleotide
  Target: FXN; (+) strand; PAM type: NRG; PAM sequence: AAG
tttagctctctggaattaca

SEQ ID NO: 21732 - DNA, 20 bp, Artificial Sequence
  Description of Artificial Sequence: Synthetic oligonucleotide
  Target: FXN; (+) strand; PAM type: NRG; PAM sequence: AAG
agctctctggaattacaaag

SEQ ID NO: 21733 - DNA, 20 bp, Artificial Sequence
  Description of Artificial Sequence: Synthetic oligonucleotide
  Target: FXN; (+) strand; PAM type: NRG; PAM sequence: AGG
gctctctggaattacaaaga

SEQ ID NO: 21734 - DNA, 20 bp, Artificial Sequence
  Description of Artificial Sequence: Synthetic oligonucleotide
  Target: FXN; (+) strand; PAM type: NRG; PAM sequence: GAG
tggaattacaaagaaggaat

SEQ ID NO: 21735 - DNA, 20 bp, Artificial Sequence
  Description of Artificial Sequence: Synthetic oligonucleotide
  Target: FXN; (+) strand; PAM type: NRG; PAM sequence: AGG
ggaattacaaagaaggaatg

SEQ ID NO: 21736 - DNA, 20 bp, Artificial Sequence
  Description of Artificial Sequence: Synthetic oligonucleotide
  Target: FXN; (+) strand; PAM type: NRG; PAM sequence: AAG
agaaggaatgaggtgtgtaa

SEQ ID NO: 21737 - DNA, 20 bp, Artificial Sequence
  Description of Artificial Sequence: Synthetic oligonucleotide
  Target: FXN; (+) strand; PAM type: NRG; PAM sequence: GAG
aaggaatgaggtgtgtaaaa

SEQ ID NO: 21738 - DNA, 20 bp, Artificial Sequence
  Description of Artificial Sequence: Synthetic oligonucleotide
  Target: FXN; (+) strand; PAM type: NRG; PAM sequence: TGG
gaggtgtgtaaaagagaacc

SEQ ID NO: 21739 - DNA, 20 bp, Artificial Sequence
  Description of Artificial Sequence: Synthetic oligonucleotide
  Target: FXN; (+) strand; PAM type: NRG; PAM sequence: GGG
aggtgtgtaaaagagaacct

SEQ ID NO: 21740 - DNA, 20 bp, Artificial Sequence
  Description of Artificial Sequence: Synthetic oligonucleotide
  Target: FXN; (+) strand; PAM type: NRG; PAM sequence: TAG
gggtttttgaatcacaaatt

SEQ ID NO: 21741 - DNA, 20 bp, Artificial Sequence
  Description of Artificial Sequence: Synthetic oligonucleotide
  Target: FXN; (+) strand; PAM type: NRG; PAM sequence: TAG
ctctgcctcttacttgtttg

SEQ ID NO: 21742 - DNA, 20 bp, Artificial Sequence
  Description of Artificial Sequence: Synthetic oligonucleotide
  Target: FXN; (+) strand; PAM type: NRG; PAM sequence: CAG
tacttgtttgtagacactga

SEQ ID NO: 21743 - DNA, 20 bp, Artificial Sequence
  Description of Artificial Sequence: Synthetic oligonucleotide
  Target: FXN; (+) strand; PAM type: NRG; PAM sequence: TGG
ttgtttgtagacactgacag

SEQ ID NO: 21744 - DNA, 20 bp, Artificial Sequence
  Description of Artificial Sequence: Synthetic oligonucleotide
  Target: FXN; (+) strand; PAM type: NRG; PAM sequence: TGG
tttttttttaatctataaaa

SEQ ID NO: 21745 - DNA, 20 bp, Artificial Sequence
  Description of Artificial Sequence: Synthetic oligonucleotide
  Target: FXN; (+) strand; PAM type: NRG; PAM sequence: GAG
tttttttaatctataaaatg

SEQ ID NO: 21746 - DNA, 20 bp, Artificial Sequence
  Description of Artificial Sequence: Synthetic oligonucleotide
  Target: FXN; (+) strand; PAM type: NRG; PAM sequence: GAG
atggagatatctaacatgtt

SEQ ID NO: 21747 - DNA, 20 bp, Artificial Sequence
  Description of Artificial Sequence: Synthetic oligonucleotide
  Target: FXN; (+) strand; PAM type: NRG; PAM sequence: TGG
gatatctaacatgttgagcc

SEQ ID NO: 21748 - DNA, 20 bp, Artificial Sequence
  Description of Artificial Sequence: Synthetic oligonucleotide
  Target: FXN; (+) strand; PAM type: NRG; PAM sequence: GGG
atatctaacatgttgagcct

SEQ ID NO: 21749 - DNA, 20 bp, Artificial Sequence
  Description of Artificial Sequence: Synthetic oligonucleotide
  Target: FXN; (+) strand; PAM type: NRG; PAM sequence: CAG
acatgttgagcctgggccca

SEQ ID NO: 21750 - DNA, 20 bp, Artificial Sequence
  Description of Artificial Sequence: Synthetic oligonucleotide
  Target: FXN; (+) strand; PAM type: NRG; PAM sequence: AGG
catgttgagcctgggcccac

SEQ ID NO: 21751 - DNA, 20 bp, Artificial Sequence
  Description of Artificial Sequence: Synthetic oligonucleotide
  Target: FXN; (+) strand; PAM type: NRG; PAM sequence: AAG
tgagcctgggcccacaggca

SEQ ID NO: 21752 - DNA, 20 bp, Artificial Sequence
  Description of Artificial Sequence: Synthetic oligonucleotide
  Target: FXN; (+) strand; PAM type: NRG; PAM sequence: GAG
gcaaagcacaatcctgatgt

SEQ ID NO: 21753 - DNA, 20 bp, Artificial Sequence
  Description of Artificial Sequence: Synthetic oligonucleotide
  Target: FXN; (+) strand; PAM type: NRG; PAM sequence: AAG
aagcacaatcctgatgtgag

SEQ ID NO: 21754 - DNA, 20 bp, Artificial Sequence
  Description of Artificial Sequence: Synthetic oligonucleotide
  Target: FXN; (+) strand; PAM type: NRG; PAM sequence: CAG
atcctgatgtgagaagtact

SEQ ID NO: 21755 - DNA, 20 bp, Artificial Sequence
  Description of Artificial Sequence: Synthetic oligonucleotide
  Target: FXN; (+) strand; PAM type: NRG; PAM sequence: TAG
aactgttgttctcacatgca

SEQ ID NO: 21756 - DNA, 20 bp, Artificial Sequence
  Description of Artificial Sequence: Synthetic oligonucleotide
  Target: FXN; (+) strand; PAM type: NRG; PAM sequence: TGG
gcataatttcatattcacat

SEQ ID NO: 21757 - DNA, 20 bp, Artificial Sequence
  Description of Artificial Sequence: Synthetic oligonucleotide
  Target: FXN; (+) strand; PAM type: NRG; PAM sequence: GAG
ataatttcatattcacattg

SEQ ID NO: 21758 - DNA, 20 bp, Artificial Sequence
  Description of Artificial Sequence: Synthetic oligonucleotide
  Target: FXN; (+) strand; PAM type: NRG; PAM sequence: AGG
taatttcatattcacattgg

SEQ ID NO: 21759 - DNA, 20 bp, Artificial Sequence
  Description of Artificial Sequence: Synthetic oligonucleotide
  Target: FXN; (+) strand; PAM type: NRG; PAM sequence: TGG
ggaggacttctcccaaaata

SEQ ID NO: 21760 - DNA, 20 bp, Artificial Sequence
  Description of Artificial Sequence: Synthetic oligonucleotide
  Target: FXN; (+) strand; PAM type: NRG; PAM sequence: CAG
ttgaacttaatcaaaatact

SEQ ID NO: 21761 - DNA, 20 bp, Artificial Sequence
  Description of Artificial Sequence: Synthetic oligonucleotide
  Target: FXN; (+) strand; PAM type: NRG; PAM sequence: TAG
cagtttacttaacttcgtat

SEQ ID NO: 21762 - DNA, 20 bp, Artificial Sequence
  Description of Artificial Sequence: Synthetic oligonucleotide
  Target: FXN; (+) strand; PAM type: NRG; PAM sequence: TGG
cgtattagattctgattccc

SEQ ID NO: 21763 - DNA, 20 bp, Artificial Sequence
  Description of Artificial Sequence: Synthetic oligonucleotide
  Target: FXN; (+) strand; PAM type: NRG; PAM sequence: TAG
cataccttctaaaactattt

SEQ ID NO: 21764 - DNA, 20 bp, Artificial Sequence
  Description of Artificial Sequence: Synthetic oligonucleotide
  Target: FXN; (+) strand; PAM type: NRG; PAM sequence: CAG
ttagccaatttaaaatttga

SEQ ID NO: 21765 - DNA, 20 bp, Artificial Sequence
  Description of Artificial Sequence: Synthetic oligonucleotide
  Target: FXN; (+) strand; PAM type: NRG; PAM sequence: TAG
tgacagtttgcattaaatta

SEQ ID NO: 21766 - DNA, 20 bp, Artificial Sequence
  Description of Artificial Sequence: Synthetic oligonucleotide
  Target: FXN; (+) strand; PAM type: NRG; PAM sequence: AGG
gacagtttgcattaaattat

SEQ ID NO: 21767 - DNA, 20 bp, Artificial Sequence
  Description of Artificial Sequence: Synthetic oligonucleotide
  Target: FXN; (+) strand; PAM type: NRG; PAM sequence: CAG
ggtttacaatatgctttatc

SEQ ID NO: 21768 - DNA, 20 bp, Artificial Sequence
  Description of Artificial Sequence: Synthetic oligonucleotide
  Target: FXN; (+) strand; PAM type: NRG; PAM sequence: CAG
atacctgccccaaattctga

SEQ ID NO: 21769 - DNA, 20 bp, Artificial Sequence
  Description of Artificial Sequence: Synthetic oligonucleotide
  Target: FXN; (+) strand; PAM type: NRG; PAM sequence: AAG
agatgcttttgccacctcta

SEQ ID NO: 21770 - DNA, 20 bp, Artificial Sequence
  Description of Artificial Sequence: Synthetic oligonucleotide
  Target: FXN; (+) strand; PAM type: NRG; PAM sequence: AGG
gatgcttttgccacctctaa

SEQ ID NO: 21771 - DNA, 20 bp, Artificial Sequence
  Description of Artificial Sequence: Synthetic oligonucleotide
  Target: FXN; (+) strand; PAM type: NRG; PAM sequence: AAG
gcttttgccacctctaaagg

SEQ ID NO: 21772 - DNA, 20 bp, Artificial Sequence
  Description of Artificial Sequence: Synthetic oligonucleotide
  Target: FXN; (+) strand; PAM type: NRG; PAM sequence: TAG
taaaggaagacccatgttca

SEQ ID NO: 21773 - DNA, 20 bp, Artificial Sequence
  Description of Artificial Sequence: Synthetic oligonucleotide
  Target: FXN; (+) strand; PAM type: NRG; PAM sequence: TGG
aagacccatgttcatagtga

SEQ ID NO: 21774 - DNA, 20 bp, Artificial Sequence
  Description of Artificial Sequence: Synthetic oligonucleotide
  Target: FXN; (+) strand; PAM type: NRG; PAM sequence: GAG
gacccatgttcatagtgatg

SEQ ID NO: 21775 - DNA, 20 bp, Artificial Sequence
  Description of Artificial Sequence: Synthetic oligonucleotide
  Target: FXN; (+) strand; PAM type: NRG; PAM sequence: TGG
tcatagtgatggagtttgtg

SEQ ID NO: 21776 - DNA, 20 bp, Artificial Sequence
  Description of Artificial Sequence: Synthetic oligonucleotide
  Target: FXN; (+) strand; PAM type: NRG; PAM sequence: AAG
tttgtgtggactaaccatgc

SEQ ID NO: 21777 - DNA, 20 bp, Artificial Sequence
  Description of Artificial Sequence: Synthetic oligonucleotide
  Target: FXN; (+) strand; PAM type: NRG; PAM sequence: AGG
ttgtgtggactaaccatgca

SEQ ID NO: 21778 - DNA, 20 bp, Artificial Sequence
  Description of Artificial Sequence: Synthetic oligonucleotide
  Target: FXN; (+) strand; PAM type: NRG; PAM sequence: AAG
actaaccatgcaaggttgcc

SEQ ID NO: 21779 - DNA, 20 bp, Artificial Sequence
  Description of Artificial Sequence: Synthetic oligonucleotide
  Target: FXN; (+) strand; PAM type: NRG; PAM sequence: AGG
ctaaccatgcaaggttgcca

SEQ ID NO: 21780 - DNA, 20 bp, Artificial Sequence
  Description of Artificial Sequence: Synthetic oligonucleotide
  Target: FXN; (+) strand; PAM type: NRG; PAM sequence: AAG
aaaaatcgctttacgcttcc

SEQ ID NO: 21781 - DNA, 20 bp, Artificial Sequence
  Description of Artificial Sequence: Synthetic oligonucleotide
  Target: FXN; (+) strand; PAM type: NRG; PAM sequence: AGG
aaaatcgctttacgcttcca

SEQ ID NO: 21782 - DNA, 20 bp, Artificial Sequence
  Description of Artificial Sequence: Synthetic oligonucleotide
  Target: FXN; (+) strand; PAM type: NRG; PAM sequence: AAG
acgcttccaaggtacacact

SEQ ID NO: 21783 - DNA, 20 bp, Artificial Sequence
  Description of Artificial Sequence: Synthetic oligonucleotide
  Target: FXN; (+) strand; PAM type: NRG; PAM sequence: AAG
caaggtacacactaagatga

SEQ ID NO: 21784 - DNA, 20 bp, Artificial Sequence
  Description of Artificial Sequence: Synthetic oligonucleotide
  Target: FXN; (+) strand; PAM type: NRG; PAM sequence: TAG
cactaagatgaaagtaattt

SEQ ID NO: 21785 - DNA, 20 bp, Artificial Sequence
  Description of Artificial Sequence: Synthetic oligonucleotide
  Target: FXN; (+) strand; PAM type: NRG; PAM sequence: CAG
aagtaattttagtccgtgtc

SEQ ID NO: 21786 - DNA, 20 bp, Artificial Sequence
  Description of Artificial Sequence: Synthetic oligonucleotide
  Target: FXN; (+) strand; PAM type: NRG; PAM sequence: TGG
aattttagtccgtgtccagt

SEQ ID NO: 21787 - DNA, 20 bp, Artificial Sequence
  Description of Artificial Sequence: Synthetic oligonucleotide
  Target: FXN; (+) strand; PAM type: NRG; PAM sequence: TGG
tccgtgtccagttggattct

SEQ ID NO: 21788 - DNA, 20 bp, Artificial Sequence
  Description of Artificial Sequence: Synthetic oligonucleotide
  Target: FXN; (+) strand; PAM type: NRG; PAM sequence: TAG
ccagttggattcttggcaca

SEQ ID NO: 21789 - DNA, 20 bp, Artificial Sequence
  Description of Artificial Sequence: Synthetic oligonucleotide
  Target: FXN; (+) strand; PAM type: NRG; PAM sequence: TAG
ggcacatagttatcttctgc

SEQ ID NO: 21790 - DNA, 20 bp, Artificial Sequence
  Description of Artificial Sequence: Synthetic oligonucleotide
  Target: FXN; (+) strand; PAM type: NRG; PAM sequence: CAG
tctgctagaacaaactaaaa

SEQ ID NO: 21791 - DNA, 20 bp, Artificial Sequence
  Description of Artificial Sequence: Synthetic oligonucleotide
  Target: FXN; (+) strand; PAM type: NRG; PAM sequence: CAG
aaactaaaacagctacatgc

SEQ ID NO: 21792 - DNA, 20 bp, Artificial Sequence
  Description of Artificial Sequence: Synthetic oligonucleotide
  Target: FXN; (+) strand; PAM type: NRG; PAM sequence: AAG
taaaacagctacatgccagc

SEQ ID NO: 21793 - DNA, 20 bp, Artificial Sequence
  Description of Artificial Sequence: Synthetic oligonucleotide
  Target: FXN; (+) strand; PAM type: NRG; PAM sequence: AGG
aaaacagctacatgccagca

SEQ ID NO: 21794 - DNA, 20 bp, Artificial Sequence
  Description of Artificial Sequence: Synthetic oligonucleotide
  Target: FXN; (+) strand; PAM type: NRG; PAM sequence: GGG
aaacagctacatgccagcaa

SEQ ID NO: 21795 - DNA, 20 bp, Artificial Sequence
  Description of Artificial Sequence: Synthetic oligonucleotide
  Target: FXN; (+) strand; PAM type: NRG; PAM sequence: GAG
acagctacatgccagcaagg

SEQ ID NO: 21796 - DNA, 20 bp, Artificial Sequence
  Description of Artificial Sequence: Synthetic oligonucleotide
  Target: FXN; (+) strand; PAM type: NRG; PAM sequence: AAG
ctacatgccagcaagggaga

SEQ ID NO: 21797 - DNA, 20 bp, Artificial Sequence
  Description of Artificial Sequence: Synthetic oligonucleotide
  Target: FXN; (+) strand; PAM type: NRG; PAM sequence: AGG
tacatgccagcaagggagaa

SEQ ID NO: 21798 - DNA, 20 bp, Artificial Sequence
  Description of Artificial Sequence: Synthetic oligonucleotide
  Target: FXN; (+) strand; PAM type: NRG; PAM sequence: GGG
acatgccagcaagggagaaa

SEQ ID NO: 21799 - DNA, 20 bp, Artificial Sequence
  Description of Artificial Sequence: Synthetic oligonucleotide
  Target: FXN; (+) strand; PAM type: NRG; PAM sequence: GGG
catgccagcaagggagaaag

SEQ ID NO: 21800 - DNA, 20 bp, Artificial Sequence
  Description of Artificial Sequence: Synthetic oligonucleotide
  Target: FXN; (+) strand; PAM type: NRG; PAM sequence: AAG
gccagcaagggagaaagggg

SEQ ID NO: 21801 - DNA, 20 bp, Artificial Sequence
  Description of Artificial Sequence: Synthetic oligonucleotide
  Target: FXN; (+) strand; PAM type: NRG; PAM sequence: AGG
ccagcaagggagaaagggga

SEQ ID NO: 21802 - DNA, 20 bp, Artificial Sequence
  Description of Artificial Sequence: Synthetic oligonucleotide
  Target: FXN; (+) strand; PAM type: NRG; PAM sequence: GAG
agcaagggagaaaggggaag

SEQ ID NO: 21803 - DNA, 20 bp, Artificial Sequence
  Description of Artificial Sequence: Synthetic oligonucleotide
  Target: FXN; (+) strand; PAM type: NRG; PAM sequence: AGG
gcaagggagaaaggggaagg

SEQ ID NO: 21804 - DNA, 20 bp, Artificial Sequence
  Description of Artificial Sequence: Synthetic oligonucleotide
  Target: FXN; (+) strand; PAM type: NRG; PAM sequence: GGG
caagggagaaaggggaagga

SEQ ID NO: 21805 - DNA, 20 bp, Artificial Sequence
  Description of Artificial Sequence: Synthetic oligonucleotide
  Target: FXN; (+) strand; PAM type: NRG; PAM sequence: GGG
aagggagaaaggggaaggag

SEQ ID NO: 21806 - DNA, 20 bp, Artificial Sequence
  Description of Artificial Sequence: Synthetic oligonucleotide
  Target: FXN; (+) strand; PAM type: NRG; PAM sequence: AAG
agaaaggggaaggaggggca

SEQ ID NO: 21807 - DNA, 20 bp, Artificial Sequence
  Description of Artificial Sequence: Synthetic oligonucleotide
  Target: FXN; (+) strand; PAM type: NRG; PAM sequence: GAG
tttatgctgttcaaaacgac

SEQ ID NO: 21808 - DNA, 20 bp, Artificial Sequence
  Description of Artificial Sequence: Synthetic oligonucleotide
  Target: FXN; (+) strand; PAM type: NRG; PAM sequence: TAG
cgagttcatgactttgtgta

SEQ ID NO: 21809 - DNA, 20 bp, Artificial Sequence
  Description of Artificial Sequence: Synthetic oligonucleotide
  Target: FXN; (+) strand; PAM type: NRG; PAM sequence: GAG
agttcatgactttgtgtata

SEQ ID NO: 21810 - DNA, 20 bp, Artificial Sequence
  Description of Artificial Sequence: Synthetic oligonucleotide
  Target: FXN; (+) strand; PAM type: NRG; PAM sequence: AAG
catgactttgtgtatagagt

SEQ ID NO: 21811 - DNA, 20 bp, Artificial Sequence
  Description of Artificial Sequence: Synthetic oligonucleotide
  Target: FXN; (+) strand; PAM type: NRG; PAM sequence: GAG
agaaatgccttttctttttt

SEQ ID NO: 21812 - DNA, 20 bp, Artificial Sequence
  Description of Artificial Sequence: Synthetic oligonucleotide
  Target: FXN; (+) strand; PAM type: NRG; PAM sequence: CAG
atgccttttcttttttgaga

SEQ ID NO: 21813 - DNA, 20 bp, Artificial Sequence
  Description of Artificial Sequence: Synthetic oligonucleotide
  Target: FXN; (+) strand; PAM type: NRG; PAM sequence: GAG
gccttttcttttttgagaca

SEQ ID NO: 21814 - DNA, 20 bp, Artificial Sequence
  Description of Artificial Sequence: Synthetic oligonucleotide
  Target: FXN; (+) strand; PAM type: NRG; PAM sequence: CAG
cagagtcttgctctgtcacc

SEQ ID NO: 21815 - DNA, 20 bp, Artificial Sequence
  Description of Artificial Sequence: Synthetic oligonucleotide
  Target: FXN; (+) strand; PAM type: NRG; PAM sequence: AGG
agagtcttgctctgtcaccc

SEQ ID NO: 21816 - DNA, 20 bp, Artificial Sequence
  Description of Artificial Sequence: Synthetic oligonucleotide
  Target: FXN; (+) strand; PAM type: NRG; PAM sequence: TGG
tcttgctctgtcacccaggc

SEQ ID NO: 21817 - DNA, 20 bp, Artificial Sequence
  Description of Artificial Sequence: Synthetic oligonucleotide
  Target: FXN; (+) strand; PAM type: NRG; PAM sequence: GAG
ttgctctgtcacccaggctg

SEQ ID NO: 21818 - DNA, 20 bp, Artificial Sequence
  Description of Artificial Sequence: Synthetic oligonucleotide
  Target: FXN; (+) strand; PAM type: NRG; PAM sequence: CAG
ctgtcacccaggctggagtg

SEQ ID NO: 21819 - DNA, 20 bp, Artificial Sequence
  Description of Artificial Sequence: Synthetic oligonucleotide
  Target: FXN; (+) strand; PAM type: NRG; PAM sequence: TGG
tcacccaggctggagtgcag

SEQ ID NO: 21820 - DNA, 20 bp, Artificial Sequence
  Description of Artificial Sequence: Synthetic oligonucleotide
  Target: FXN; (+) strand; PAM type: NRG; PAM sequence: TGG
tggagtgcagtggcacgatc

SEQ ID NO: 21821 - DNA, 20 bp, Artificial Sequence
  Description of Artificial Sequence: Synthetic oligonucleotide
  Target: FXN; (+) strand; PAM type: NRG; PAM sequence: GGG
ggagtgcagtggcacgatct

SEQ ID NO: 21822 - DNA, 20 bp, Artificial Sequence
  Description of Artificial Sequence: Synthetic oligonucleotide
  Target: FXN; (+) strand; PAM type: NRG; PAM sequence: TGG
tcactacaacctccgcctcc

SEQ ID NO: 21823 - DNA, 20 bp, Artificial Sequence
  Description of Artificial Sequence: Synthetic oligonucleotide
  Target: FXN; (+) strand; PAM type: NRG; PAM sequence: GGG
cactacaacctccgcctcct

SEQ ID NO: 21824 - DNA, 20 bp, Artificial Sequence
  Description of Artificial Sequence: Synthetic oligonucleotide
  Target: FXN; (+) strand; PAM type: NRG; PAM sequence: AAG
aacctccgcctcctgggttc

SEQ ID NO: 21825 - DNA, 20 bp, Artificial Sequence
  Description of Artificial Sequence: Synthetic oligonucleotide
  Target: FXN; (+) strand; PAM type: NRG; PAM sequence: CAG
gttcaagcaattctctgcct

SEQ ID NO: 21826 - DNA, 20 bp, Artificial Sequence
  Description of Artificial Sequence: Synthetic oligonucleotide
  Target: FXN; (+) strand; PAM type: NRG; PAM sequence: GAG
attctctgcctcagcctccc

SEQ ID NO: 21827 - DNA, 20 bp, Artificial Sequence
  Description of Artificial Sequence: Synthetic oligonucleotide
  Target: FXN; (+) strand; PAM type: NRG; PAM sequence: TAG
ctctgcctcagcctcccgag

SEQ ID NO: 21828 - DNA, 20 bp, Artificial Sequence
  Description of Artificial Sequence: Synthetic oligonucleotide
  Target: FXN; (+) strand; PAM type: NRG; PAM sequence: TGG
gcctcagcctcccgagtagc

SEQ ID NO: 21829 - DNA, 20 bp, Artificial Sequence
  Description of Artificial Sequence: Synthetic oligonucleotide
  Target: FXN; (+) strand; PAM type: NRG; PAM sequence: GGG
cctcagcctcccgagtagct

SEQ ID NO: 21830 - DNA, 20 bp, Artificial Sequence
  Description of Artificial Sequence: Synthetic oligonucleotide
  Target: FXN; (+) strand; PAM type: NRG; PAM sequence: CAG
ctcccgagtagctgggatta

SEQ ID NO: 21831 - DNA, 20 bp, Artificial Sequence
  Description of Artificial Sequence: Synthetic oligonucleotide
  Target: FXN; (+) strand; PAM type: NRG; PAM sequence: AGG
tcccgagtagctgggattac

SEQ ID NO: 21832 - DNA, 20 bp, Artificial Sequence
  Description of Artificial Sequence: Synthetic oligonucleotide
  Target: FXN; (+) strand; PAM type: NRG; PAM sequence: CGG
caggtgcctgccaccacacc

SEQ ID NO: 21833 - DNA, 20 bp, Artificial Sequence
  Description of Artificial Sequence: Synthetic oligonucleotide
  Target: FXN; (+) strand; PAM type: NRG; PAM sequence: TAG
ccggctaatttttgtatttt

SEQ ID NO: 21834 - DNA, 20 bp, Artificial Sequence
  Description of Artificial Sequence: Synthetic oligonucleotide
  Target: FXN; (+) strand; PAM type: NRG; PAM sequence: TAG
gctaatttttgtatttttag

SEQ ID NO: 21835 - DNA, 20 bp, Artificial Sequence
  Description of Artificial Sequence: Synthetic oligonucleotide
  Target: FXN; (+) strand; PAM type: NRG; PAM sequence: GAG
taatttttgtatttttagta

SEQ ID NO: 21836 - DNA, 20 bp, Artificial Sequence
  Description of Artificial Sequence: Synthetic oligonucleotide
  Target: FXN; (+) strand; PAM type: NRG; PAM sequence: CGG
ttttgtatttttagtagaga

SEQ ID NO: 21837 - DNA, 20 bp, Artificial Sequence
  Description of Artificial Sequence: Synthetic oligonucleotide
  Target: FXN; (+) strand; PAM type: NRG; PAM sequence: GGG
tttgtatttttagtagagac

SEQ ID NO: 21838 - DNA, 20 bp, Artificial Sequence
  Description of Artificial Sequence: Synthetic oligonucleotide
  Target: FXN; (+) strand; PAM type: NRG; PAM sequence: GGG
ttgtatttttagtagagacg

SEQ ID NO: 21839 - DNA, 20 bp, Artificial Sequence
  Description of Artificial Sequence: Synthetic oligonucleotide
  Target: FXN; (+) strand; PAM type: NRG; PAM sequence: TGG
gagacggggtttcaccatca

SEQ ID NO: 21840 - DNA, 20 bp, Artificial Sequence
  Description of Artificial Sequence: Synthetic oligonucleotide
  Target: FXN; (+) strand; PAM type: NRG; PAM sequence: CAG
cggggtttcaccatcatggc

SEQ ID NO: 21841 - DNA, 20 bp, Artificial Sequence
  Description of Artificial Sequence: Synthetic oligonucleotide
  Target: FXN; (+) strand; PAM type: NRG; PAM sequence: AGG
ggggtttcaccatcatggcc

SEQ ID NO: 21842 - DNA, 20 bp, Artificial Sequence
  Description of Artificial Sequence: Synthetic oligonucleotide
  Target: FXN; (+) strand; PAM type: NRG; PAM sequence: TGG
tttcaccatcatggccaggc

SEQ ID NO: 21843 - DNA, 20 bp, Artificial Sequence
  Description of Artificial Sequence: Synthetic oligonucleotide
  Target: FXN; (+) strand; PAM type: NRG; PAM sequence: TAG
ctggtcttgaactcctgacc

SEQ ID NO: 21844 - DNA, 20 bp, Artificial Sequence
  Description of Artificial Sequence: Synthetic oligonucleotide
  Target: FXN; (+) strand; PAM type: NRG; PAM sequence: AAG
ccacctgcctccgcctccca

SEQ ID NO: 21845 - DNA, 20 bp, Artificial Sequence
  Description of Artificial Sequence: Synthetic oligonucleotide
  Target: FXN; (+) strand; PAM type: NRG; PAM sequence: TGG
gcctccgcctcccaaagtgc

SEQ ID NO: 21846 - DNA, 20 bp, Artificial Sequence
  Description of Artificial Sequence: Synthetic oligonucleotide
  Target: FXN; (+) strand; PAM type: NRG; PAM sequence: GGG
cctccgcctcccaaagtgct

SEQ ID NO: 21847 - DNA, 20 bp, Artificial Sequence
  Description of Artificial Sequence: Synthetic oligonucleotide
  Target: FXN; (+) strand; PAM type: NRG; PAM sequence: CAG
ctcccaaagtgctgggatta

SEQ ID NO: 21848 - DNA, 20 bp, Artificial Sequence
  Description of Artificial Sequence: Synthetic oligonucleotide
  Target: FXN; (+) strand; PAM type: NRG; PAM sequence: AGG
tcccaaagtgctgggattac

SEQ ID NO: 21849 - DNA, 20 bp, Artificial Sequence
  Description of Artificial Sequence: Synthetic oligonucleotide
  Target: FXN; (+) strand; PAM type: NRG; PAM sequence: GAG
agtgctgggattacaggcgt

SEQ ID NO: 21850 - DNA, 20 bp, Artificial Sequence
  Description of Artificial Sequence: Synthetic oligonucleotide
  Target: FXN; (+) strand; PAM type: NRG; PAM sequence: CAG
caggcgtgagccactgcacc

SEQ ID NO: 21851 - DNA, 20 bp, Artificial Sequence
  Description of Artificial Sequence: Synthetic oligonucleotide
  Target: FXN; (+) strand; PAM type: NRG; PAM sequence: CAG
cgtgagccactgcacccagc

SEQ ID NO: 21852 - DNA, 20 bp, Artificial Sequence
  Description of Artificial Sequence: Synthetic oligonucleotide
  Target: FXN; (+) strand; PAM type: NRG; PAM sequence: TGG
cagaaatgccttctaatctt

SEQ ID NO: 21853 - DNA, 20 bp, Artificial Sequence
  Description of Artificial Sequence: Synthetic oligonucleotide
  Target: FXN; (+) strand; PAM type: NRG; PAM sequence: TAG
aatctttggtttatcttaat

SEQ ID NO: 21854 - DNA, 20 bp, Artificial Sequence
  Description of Artificial Sequence: Synthetic oligonucleotide
  Target: FXN; (+) strand; PAM type: NRG; PAM sequence: CAG
tttggtttatcttaattagc

SEQ ID NO: 21855 - DNA, 20 bp, Artificial Sequence
  Description of Artificial Sequence: Synthetic oligonucleotide
  Target: FXN; (+) strand; PAM type: NRG; PAM sequence: AGG
ttggtttatcttaattagcc

SEQ ID NO: 21856 - DNA, 20 bp, Artificial Sequence
  Description of Artificial Sequence: Synthetic oligonucleotide
  Target: FXN; (+) strand; PAM type: NRG; PAM sequence: TGG
tcttaattagccaggacact

SEQ ID NO: 21857 - DNA, 20 bp, Artificial Sequence
  Description of Artificial Sequence: Synthetic oligonucleotide
  Target: FXN; (+) strand; PAM type: NRG; PAM sequence: GAG
ttaattagccaggacacttg

SEQ ID NO: 21858 - DNA, 20 bp, Artificial Sequence
  Description of Artificial Sequence: Synthetic oligonucleotide
  Target: FXN; (+) strand; PAM type: NRG; PAM sequence: AAG
gacacttggagtgcatcccg

SEQ ID NO: 21859 - DNA, 20 bp, Artificial Sequence
  Description of Artificial Sequence: Synthetic oligonucleotide
  Target: FXN; (+) strand; PAM type: NRG; PAM sequence: CAG
tgcatcccgaagtacctgat

SEQ ID NO: 21860 - DNA, 20 bp, Artificial Sequence
  Description of Artificial Sequence: Synthetic oligonucleotide
  Target: FXN; (+) strand; PAM type: NRG; PAM sequence: TGG
atcccgaagtacctgatcag

SEQ ID NO: 21861 - DNA, 20 bp, Artificial Sequence
  Description of Artificial Sequence: Synthetic oligonucleotide
  Target: FXN; (+) strand; PAM type: NRG; PAM sequence: TGG
tacctgatcagtggcccctt

SEQ ID NO: 21862 - DNA, 20 bp, Artificial Sequence
  Description of Artificial Sequence: Synthetic oligonucleotide
  Target: FXN; (+) strand; PAM type: NRG; PAM sequence: CAG
cctttggaatgtgtaaaact

SEQ ID NO: 21863 - DNA, 20 bp, Artificial Sequence
  Description of Artificial Sequence: Synthetic oligonucleotide
  Target: FXN; (+) strand; PAM type: NRG; PAM sequence: CAG
ttatatccctgcatccgcta

SEQ ID NO: 21864 - DNA, 20 bp, Artificial Sequence
  Description of Artificial Sequence: Synthetic oligonucleotide
  Target: FXN; (+) strand; PAM type: NRG; PAM sequence: GAG
atatccctgcatccgctaca

SEQ ID NO: 21865 - DNA, 20 bp, Artificial Sequence
  Description of Artificial Sequence: Synthetic oligonucleotide
  Target: FXN; (+) strand; PAM type: NRG; PAM sequence: CAG
ccctgcatccgctacagaga

SEQ ID NO: 21866 - DNA, 20 bp, Artificial Sequence
  Description of Artificial Sequence: Synthetic oligonucleotide
  Target: FXN; (+) strand; PAM type: NRG; PAM sequence: AAG
ccgctacagagacagaatcc

SEQ ID NO: 21867 - DNA, 20 bp, Artificial Sequence
  Description of Artificial Sequence: Synthetic oligonucleotide
  Target: FXN; (+) strand; PAM type: NRG; PAM sequence: TGG
ctcatatgttccatcttctc

SEQ ID NO: 21868 - DNA, 20 bp, Artificial Sequence
  Description of Artificial Sequence: Synthetic oligonucleotide
  Target: FXN; (+) strand; PAM type: NRG; PAM sequence: TAG
ttccatcttctctggctgta

SEQ ID NO: 21869 - DNA, 20 bp, Artificial Sequence
  Description of Artificial Sequence: Synthetic oligonucleotide
  Target: FXN; (+) strand; PAM type: NRG; PAM sequence: AAG
cttctctggctgtatagttt

SEQ ID NO: 21870 - DNA, 20 bp, Artificial Sequence
  Description of Artificial Sequence: Synthetic oligonucleotide
  Target: FXN; (+) strand; PAM type: NRG; PAM sequence: AGG
ttctctggctgtatagttta

SEQ ID NO: 21871 - DNA, 20 bp, Artificial Sequence
  Description of Artificial Sequence: Synthetic oligonucleotide
  Target: FXN; (+) strand; PAM type: NRG; PAM sequence: TGG
tggctgtatagtttaaggaa

SEQ ID NO: 21872 - DNA, 20 bp, Artificial Sequence
  Description of Artificial Sequence: Synthetic oligonucleotide
  Target: FXN; (+) strand; PAM type: NRG; PAM sequence: AAG
ctgtatagtttaaggaatgg

SEQ ID NO: 21873 - DNA, 20 bp, Artificial Sequence
  Description of Artificial Sequence: Synthetic oligonucleotide
  Target: FXN; (+) strand; PAM type: NRG; PAM sequence: AGG
tgtatagtttaaggaatgga

SEQ ID NO: 21874 - DNA, 20 bp, Artificial Sequence
  Description of Artificial Sequence: Synthetic oligonucleotide
  Target: FXN; (+) strand; PAM type: NRG; PAM sequence: CAG
gtttaaggaatggaaggcac

SEQ ID NO: 21875 - DNA, 20 bp, Artificial Sequence
  Description of Artificial Sequence: Synthetic oligonucleotide
  Target: FXN; (+) strand; PAM type: NRG; PAM sequence: CAG
aggaatggaaggcaccagaa

SEQ ID NO: 21876 - DNA, 20 bp, Artificial Sequence
  Description of Artificial Sequence: Synthetic oligonucleotide
  Target: FXN; (+) strand; PAM type: NRG; PAM sequence: TAG
agatttattgaaatgtttat

SEQ ID NO: 21877 - DNA, 20 bp, Artificial Sequence
  Description of Artificial Sequence: Synthetic oligonucleotide
  Target: FXN; (+) strand; PAM type: NRG; PAM sequence: AAG
attgaaatgtttattagctg

SEQ ID NO: 21878 - DNA, 20 bp, Artificial Sequence
  Description of Artificial Sequence: Synthetic oligonucleotide
  Target: FXN; (+) strand; PAM type: NRG; PAM sequence: TAG
ttattagctgaagatttatt

SEQ ID NO: 21879 - DNA, 20 bp, Artificial Sequence
  Description of Artificial Sequence: Synthetic oligonucleotide
  Target: FXN; (+) strand; PAM type: NRG; PAM sequence: CAG
tagctgaagatttatttaga

SEQ ID NO: 21880 - DNA, 20 bp, Artificial Sequence
  Description of Artificial Sequence: Synthetic oligonucleotide
  Target: FXN; (+) strand; PAM type: NRG; PAM sequence: GAG
gaagatttatttagacagtt

SEQ ID NO: 21881 - DNA, 20 bp, Artificial Sequence
  Description of Artificial Sequence: Synthetic oligonucleotide
  Target: FXN; (+) strand; PAM type: NRG; PAM sequence: AGG
aagatttatttagacagttg

SEQ ID NO: 21882 - DNA, 20 bp, Artificial Sequence
  Description of Artificial Sequence: Synthetic oligonucleotide
  Target: FXN; (+) strand; PAM type: NRG; PAM sequence: CAG
tagacagttgaggaaaacat

SEQ ID NO: 21883 - DNA, 20 bp, Artificial Sequence
  Description of Artificial Sequence: Synthetic oligonucleotide
  Target: FXN; (+) strand; PAM type: NRG; PAM sequence: CAG
ttgaggaaaacatcagcacc

SEQ ID NO: 21884 - DNA, 20 bp, Artificial Sequence
  Description of Artificial Sequence: Synthetic oligonucleotide
  Target: FXN; (+) strand; PAM type: NRG; PAM sequence: CAG
aggaaaacatcagcacccag

SEQ ID NO: 21885 - DNA, 20 bp, Artificial Sequence
  Description of Artificial Sequence: Synthetic oligonucleotide
  Target: FXN; (+) strand; PAM type: NRG; PAM sequence: TGG
tcagcacccagcagtaaaat

SEQ ID NO: 21886 - DNA, 20 bp, Artificial Sequence
  Description of Artificial Sequence: Synthetic oligonucleotide
  Target: FXN; (+) strand; PAM type: NRG; PAM sequence: AAG
agcagtaaaattggctctca

SEQ ID NO: 21887 - DNA, 20 bp, Artificial Sequence
  Description of Artificial Sequence: Synthetic oligonucleotide
  Target: FXN; (+) strand; PAM type: NRG; PAM sequence: TGG
tcaaagattttcttctcctg

SEQ ID NO: 21888 - DNA, 20 bp, Artificial Sequence
  Description of Artificial Sequence: Synthetic oligonucleotide
  Target: FXN; (+) strand; PAM type: NRG; PAM sequence: AAG
agattttcttctcctgtgga

SEQ ID NO: 21889 - DNA, 20 bp, Artificial Sequence
  Description of Artificial Sequence: Synthetic oligonucleotide
  Target: FXN; (+) strand; PAM type: NRG; PAM sequence: CAG
tttcttctcctgtggaaagt

SEQ ID NO: 21890 - DNA, 20 bp, Artificial Sequence
  Description of Artificial Sequence: Synthetic oligonucleotide
  Target: FXN; (+) strand; PAM type: NRG; PAM sequence: GAG
ctgtggaaagtcagacctct

SEQ ID NO: 21891 - DNA, 20 bp, Artificial Sequence
  Description of Artificial Sequence: Synthetic oligonucleotide
  Target: FXN; (+) strand; PAM type: NRG; PAM sequence: AGG
tgtggaaagtcagacctctg

SEQ ID NO: 21892 - DNA, 20 bp, Artificial Sequence
  Description of Artificial Sequence: Synthetic oligonucleotide
  Target: FXN; (+) strand; PAM type: NRG; PAM sequence: CAG
cagacctctgaggccccatc

SEQ ID NO: 21893 - DNA, 20 bp, Artificial Sequence
  Description of Artificial Sequence: Synthetic oligonucleotide
  Target: FXN; (+) strand; PAM type: NRG; PAM sequence: AGG
agacctctgaggccccatcc

SEQ ID NO: 21894 - DNA, 20 bp, Artificial Sequence
  Description of Artificial Sequence: Synthetic oligonucleotide
  Target: FXN; (+) strand; PAM type: NRG; PAM sequence: TAG
cctctgaggccccatccagg

SEQ ID NO: 21895 - DNA, 20 bp, Artificial Sequence
  Description of Artificial Sequence: Synthetic oligonucleotide
  Target: FXN; (+) strand; PAM type: NRG; PAM sequence: AAG
ctgaggccccatccaggtag

SEQ ID NO: 21896 - DNA, 20 bp, Artificial Sequence
  Description of Artificial Sequence: Synthetic oligonucleotide
  Target: FXN; (+) strand; PAM type: NRG; PAM sequence: TAG
ccccatccaggtagaagtac

SEQ ID NO: 21897 - DNA, 20 bp, Artificial Sequence
  Description of Artificial Sequence: Synthetic oligonucleotide
  Target: FXN; (+) strand; PAM type: NRG; PAM sequence: AAG
ccaggtagaagtactagtgc

SEQ ID NO: 21898 - DNA, 20 bp, Artificial Sequence
  Description of Artificial Sequence: Synthetic oligonucleotide
  Target: FXN; (+) strand; PAM type: NRG; PAM sequence: AAG
ggtagaagtactagtgcaag

SEQ ID NO: 21899 - DNA, 20 bp, Artificial Sequence
  Description of Artificial Sequence: Synthetic oligonucleotide
  Target: FXN; (+) strand; PAM type: NRG; PAM sequence: AGG
gtagaagtactagtgcaaga

SEQ ID NO: 21900 - DNA, 20 bp, Artificial Sequence
  Description of Artificial Sequence: Synthetic oligonucleotide
  Target: FXN; (+) strand; PAM type: NRG; PAM sequence: GGG
tagaagtactagtgcaagaa

SEQ ID NO: 21901 - DNA, 20 bp, Artificial Sequence
  Description of Artificial Sequence: Synthetic oligonucleotide
  Target: FXN; (+) strand; PAM type: NRG; PAM sequence: TGG
acttgtgtttctgtgatctg

SEQ ID NO: 21902 - DNA, 20 bp, Artificial Sequence
  Description of Artificial Sequence: Synthetic oligonucleotide
  Target: FXN; (+) strand; PAM type: NRG; PAM sequence: GGG
cttgtgtttctgtgatctgt

SEQ ID NO: 21903 - DNA, 20 bp, Artificial Sequence
  Description of Artificial Sequence: Synthetic oligonucleotide
  Target: FXN; (+) strand; PAM type: NRG; PAM sequence: TAG
catcttgacctcaaattgtt

SEQ ID NO: 21904 - DNA, 20 bp, Artificial Sequence
  Description of Artificial Sequence: Synthetic oligonucleotide
  Target: FXN; (+) strand; PAM type: NRG; PAM sequence: TGG
acctcaaattgtttagctcc

SEQ ID NO: 21905 - DNA, 20 bp, Artificial Sequence
  Description of Artificial Sequence: Synthetic oligonucleotide
  Target: FXN; (+) strand; PAM type: NRG; PAM sequence: CAG
caaattgtttagctcctggc

SEQ ID NO: 21906 - DNA, 20 bp, Artificial Sequence
  Description of Artificial Sequence: Synthetic oligonucleotide
  Target: FXN; (+) strand; PAM type: NRG; PAM sequence: CGG
gtttagctcctggccagaca

SEQ ID NO: 21907 - DNA, 20 bp, Artificial Sequence
  Description of Artificial Sequence: Synthetic oligonucleotide
  Target: FXN; (+) strand; PAM type: NRG; PAM sequence: TGG
tagctcctggccagacacgg

SEQ ID NO: 21908 - DNA, 20 bp, Artificial Sequence
  Description of Artificial Sequence: Synthetic oligonucleotide
  Target: FXN; (+) strand; PAM type: NRG; PAM sequence: CAG
gtggctcacacctgtaatcc

SEQ ID NO: 21909 - DNA, 20 bp, Artificial Sequence
  Description of Artificial Sequence: Synthetic oligonucleotide
  Target: FXN; (+) strand; PAM type: NRG; PAM sequence: GAG
acctgtaatcccagcacttt

SEQ ID NO: 21910 - DNA, 20 bp, Artificial Sequence
  Description of Artificial Sequence: Synthetic oligonucleotide
  Target: FXN; (+) strand; PAM type: NRG; PAM sequence: GAG
ctgtaatcccagcactttga

SEQ ID NO: 21911 - DNA, 20 bp, Artificial Sequence
  Description of Artificial Sequence: Synthetic oligonucleotide
  Target: FXN; (+) strand; PAM type: NRG; PAM sequence: AGG
tgtaatcccagcactttgag

SEQ ID NO: 21912 - DNA, 20 bp, Artificial Sequence
  Description of Artificial Sequence: Synthetic oligonucleotide
  Target: FXN; (+) strand; PAM type: NRG; PAM sequence: GAG
tcccagcactttgagaggct

SEQ ID NO: 21913 - DNA, 20 bp, Artificial Sequence
  Description of Artificial Sequence: Synthetic oligonucleotide
  Target: FXN; (+) strand; PAM type: NRG; PAM sequence: AGG
cccagcactttgagaggctg

SEQ ID NO: 21914 - DNA, 20 bp, Artificial Sequence
  Description of Artificial Sequence: Synthetic oligonucleotide
  Target: FXN; (+) strand; PAM type: NRG; PAM sequence: CAG
agcactttgagaggctgagg

SEQ ID NO: 21915 - DNA, 20 bp, Artificial Sequence
  Description of Artificial Sequence: Synthetic oligonucleotide
  Target: FXN; (+) strand; PAM type: NRG; PAM sequence: AGG
gcactttgagaggctgaggc

SEQ ID NO: 21916 - DNA, 20 bp, Artificial Sequence
  Description of Artificial Sequence: Synthetic oligonucleotide
  Target: FXN; (+) strand; PAM type: NRG; PAM sequence: TGG
ctttgagaggctgaggcagg

SEQ ID NO: 21917 - DNA, 20 bp, Artificial Sequence
  Description of Artificial Sequence: Synthetic oligonucleotide
  Target: FXN; (+) strand; PAM type: NRG; PAM sequence: GAG
ctgaggcaggtggatcacct

SEQ ID NO: 21918 - DNA, 20 bp, Artificial Sequence
  Description of Artificial Sequence: Synthetic oligonucleotide
  Target: FXN; (+) strand; PAM type: NRG; PAM sequence: AGG
tgaggcaggtggatcacctg

SEQ ID NO: 21919 - DNA, 20 bp, Artificial Sequence
  Description of Artificial Sequence: Synthetic oligonucleotide
  Target: FXN; (+) strand; PAM type: NRG; PAM sequence: TAG
gcaggtggatcacctgaggt

SEQ ID NO: 21920 - DNA, 20 bp, Artificial Sequence
  Description of Artificial Sequence: Synthetic oligonucleotide
  Target: FXN; (+) strand; PAM type: NRG; PAM sequence: AGG
caggtggatcacctgaggtt

SEQ ID NO: 21921 - DNA, 20 bp, Artificial Sequence
  Description of Artificial Sequence: Synthetic oligonucleotide
  Target: FXN; (+) strand; PAM type: NRG; PAM sequence: GAG
ggtggatcacctgaggttag

SEQ ID NO: 21922 - DNA, 20 bp, Artificial Sequence
  Description of Artificial Sequence: Synthetic oligonucleotide
  Target: FXN; (+) strand; PAM type: NRG; PAM sequence: GAG
tcacctgaggttaggagttc

SEQ ID NO: 21923 - DNA, 20 bp, Artificial Sequence
  Description of Artificial Sequence: Synthetic oligonucleotide
  Target: FXN; (+) strand; PAM type: NRG; PAM sequence: AGG
cacctgaggttaggagttcg

SEQ ID NO: 21924 - DNA, 20 bp, Artificial Sequence
  Description of Artificial Sequence: Synthetic oligonucleotide
  Target: FXN; (+) strand; PAM type: NRG; PAM sequence: CAG
tgaggttaggagttcgaggc

SEQ ID NO: 21925 - DNA, 20 bp, Artificial Sequence
  Description of Artificial Sequence: Synthetic oligonucleotide
  Target: FXN; (+) strand; PAM type: NRG; PAM sequence: TGG
ttaggagttcgaggccagcc

SEQ ID NO: 21926 - DNA, 20 bp, Artificial Sequence
  Description of Artificial Sequence: Synthetic oligonucleotide
  Target: FXN; (+) strand; PAM type: NRG; PAM sequence: TGG
cgaggccagcctggtcaaca

SEQ ID NO: 21927 - DNA, 20 bp, Artificial Sequence
  Description of Artificial Sequence: Synthetic oligonucleotide
  Target: FXN; (+) strand; PAM type: NRG; PAM sequence: TAG
tctactaaaaatacaaaaat

SEQ ID NO: 21928 - DNA, 20 bp, Artificial Sequence
  Description of Artificial Sequence: Synthetic oligonucleotide
  Target: FXN; (+) strand; PAM type: NRG; PAM sequence: TGG
ctaaaaatacaaaaattagc

SEQ ID NO: 21929 - DNA, 20 bp, Artificial Sequence
  Description of Artificial Sequence: Synthetic oligonucleotide
  Target: FXN; (+) strand; PAM type: NRG; PAM sequence: TAG
atacaaaaattagctggccg

SEQ ID NO: 21930 - DNA, 20 bp, Artificial Sequence
  Description of Artificial Sequence: Synthetic oligonucleotide
  Target: FXN; (+) strand; PAM type: NRG; PAM sequence: TGG
caaaaattagctggccgtag

SEQ ID NO: 21931 - DNA, 20 bp, Artificial Sequence
  Description of Artificial Sequence: Synthetic oligonucleotide
  Target: FXN; (+) strand; PAM type: NRG; PAM sequence: CAG
gtggcgcacgcctgttatcc

SEQ ID NO: 21932 - DNA, 20 bp, Artificial Sequence
  Description of Artificial Sequence: Synthetic oligonucleotide
  Target: FXN; (+) strand; PAM type: NRG; PAM sequence: CGG
cgcctgttatcccagctact

SEQ ID NO: 21933 - DNA, 20 bp, Artificial Sequence
  Description of Artificial Sequence: Synthetic oligonucleotide
  Target: FXN; (+) strand; PAM type: NRG; PAM sequence: GGG
gcctgttatcccagctactc

SEQ ID NO: 21934 - DNA, 20 bp, Artificial Sequence
  Description of Artificial Sequence: Synthetic oligonucleotide
  Target: FXN; (+) strand; PAM type: NRG; PAM sequence: GAG
ctgttatcccagctactcgg

SEQ ID NO: 21935 - DNA, 20 bp, Artificial Sequence
  Description of Artificial Sequence: Synthetic oligonucleotide
  Target: FXN; (+) strand; PAM type: NRG; PAM sequence: AGG
tgttatcccagctactcggg

SEQ ID NO: 21936 - DNA, 20 bp, Artificial Sequence
  Description of Artificial Sequence: Synthetic oligonucleotide
  Target: FXN; (+) strand; PAM type: NRG; PAM sequence: GAG
tcccagctactcgggaggct

SEQ ID NO: 21937 - DNA, 20 bp, Artificial Sequence
  Description of Artificial Sequence: Synthetic oligonucleotide
  Target: FXN; (+) strand; PAM type: NRG; PAM sequence: AGG
cccagctactcgggaggctg

SEQ ID NO: 21938 - DNA, 20 bp, Artificial Sequence
  Description of Artificial Sequence: Synthetic oligonucleotide
  Target: FXN; (+) strand; PAM type: NRG; PAM sequence: CAG
agctactcgggaggctgagg

SEQ ID NO: 21939 - DNA, 20 bp, Artificial Sequence
  Description of Artificial Sequence: Synthetic oligonucleotide
  Target: FXN; (+) strand; PAM type: NRG; PAM sequence: AGG
gctactcgggaggctgaggc

SEQ ID NO: 21940 - DNA, 20 bp, Artificial Sequence
  Description of Artificial Sequence: Synthetic oligonucleotide
  Target: FXN; (+) strand; PAM type: NRG; PAM sequence: GAG
tactcgggaggctgaggcag

SEQ ID NO: 21941 - DNA, 20 bp, Artificial Sequence
  Description of Artificial Sequence: Synthetic oligonucleotide
  Target: FXN; (+) strand; PAM type: NRG; PAM sequence: TGG
gcaggagaattgcttgaacc

SEQ ID NO: 21942 - DNA, 20 bp, Artificial Sequence
  Description of Artificial Sequence: Synthetic oligonucleotide
  Target: FXN; (+) strand; PAM type: NRG; PAM sequence: GGG
caggagaattgcttgaacct

SEQ ID NO: 21943 - DNA, 20 bp, Artificial Sequence
  Description of Artificial Sequence: Synthetic oligonucleotide
  Target: FXN; (+) strand; PAM type: NRG; PAM sequence: TGG
gagaattgcttgaacctggg

SEQ ID NO: 21944 - DNA, 20 bp, Artificial Sequence
  Description of Artificial Sequence: Synthetic oligonucleotide
  Target: FXN; (+) strand; PAM type: NRG; PAM sequence: TGG
aattgcttgaacctgggtgg

SEQ ID NO: 21945 - DNA, 20 bp, Artificial Sequence
  Description of Artificial Sequence: Synthetic oligonucleotide
  Target: FXN; (+) strand; PAM type: NRG; PAM sequence: GAG
ttgcttgaacctgggtggtg

SEQ ID NO: 21946 - DNA, 20 bp, Artificial Sequence
  Description of Artificial Sequence: Synthetic oligonucleotide
  Target: FXN; (+) strand; PAM type: NRG; PAM sequence: AGG
tgcttgaacctgggtggtgg

SEQ ID NO: 21947 - DNA, 20 bp, Artificial Sequence
  Description of Artificial Sequence: Synthetic oligonucleotide
  Target: FXN; (+) strand; PAM type: NRG; PAM sequence: CAG
aacctgggtggtggaggttg

SEQ ID NO: 21948 - DNA, 20 bp, Artificial Sequence
  Description of Artificial Sequence: Synthetic oligonucleotide
  Target: FXN; (+) strand; PAM type: NRG; PAM sequence: GAG
tgggtggtggaggttgcagt

SEQ ID NO: 21949 - DNA, 20 bp, Artificial Sequence
  Description of Artificial Sequence: Synthetic oligonucleotide
  Target: FXN; (+) strand; PAM type: NRG; PAM sequence: GAG
ggtggaggttgcagtgagcc

SEQ ID NO: 21950 - DNA, 20 bp, Artificial Sequence
  Description of Artificial Sequence: Synthetic oligonucleotide
  Target: FXN; (+) strand; PAM type: NRG; PAM sequence: CAG
gagattacaccactgcactc

SEQ ID NO: 21951 - DNA, 20 bp, Artificial Sequence
  Description of Artificial Sequence: Synthetic oligonucleotide
  Target: FXN; (+) strand; PAM type: NRG; PAM sequence: TGG
tacaccactgcactccagcc

SEQ ID NO: 21952 - DNA, 20 bp, Artificial Sequence
  Description of Artificial Sequence: Synthetic oligonucleotide
  Target: FXN; (+) strand; PAM type: NRG; PAM sequence: GGG
acaccactgcactccagcct

SEQ ID NO: 21953 - DNA, 20 bp, Artificial Sequence
  Description of Artificial Sequence: Synthetic oligonucleotide
  Target: FXN; (+) strand; PAM type: NRG; PAM sequence: AAG
tgcactccagcctgggtgac

SEQ ID NO: 21954 - DNA, 20 bp, Artificial Sequence
  Description of Artificial Sequence: Synthetic oligonucleotide
  Target: FXN; (+) strand; PAM type: NRG; PAM sequence: GAG
cactccagcctgggtgacaa

SEQ ID NO: 21955 - DNA, 20 bp, Artificial Sequence
  Description of Artificial Sequence: Synthetic oligonucleotide
  Target: FXN; (+) strand; PAM type: NRG; PAM sequence: AGG
actccagcctgggtgacaag

SEQ ID NO: 21956 - DNA, 20 bp, Artificial Sequence
  Description of Artificial Sequence: Synthetic oligonucleotide
  Target: FXN; (+) strand; PAM type: NRG; PAM sequence: GGG
ctccagcctgggtgacaaga

SEQ ID NO: 21957 - DNA, 20 bp, Artificial Sequence
  Description of Artificial Sequence: Synthetic oligonucleotide
  Target: FXN; (+) strand; PAM type: NRG; PAM sequence: AAG
attcccgtgtctgccatctt

SEQ ID NO: 21958 - DNA, 20 bp, Artificial Sequence
  Description of Artificial Sequence: Synthetic oligonucleotide
  Target: FXN; (+) strand; PAM type: NRG; PAM sequence: AAG
tgtctgccatcttaagtgta

SEQ ID NO: 21959 - DNA, 20 bp, Artificial Sequence
  Description of Artificial Sequence: Synthetic oligonucleotide
  Target: FXN; (+) strand; PAM type: NRG; PAM sequence: AGG
gtctgccatcttaagtgtaa

SEQ ID NO: 21960 - DNA, 20 bp, Artificial Sequence
  Description of Artificial Sequence: Synthetic oligonucleotide
  Target: FXN; (+) strand; PAM type: NRG; PAM sequence: TGG
tgccatcttaagtgtaaagg

SEQ ID NO: 21961 - DNA, 20 bp, Artificial Sequence
  Description of Artificial Sequence: Synthetic oligonucleotide
  Target: FXN; (+) strand; PAM type: NRG; PAM sequence: TAG
gtaaaggtggctaaattata

SEQ ID NO: 21962 - DNA, 20 bp, Artificial Sequence
  Description of Artificial Sequence: Synthetic oligonucleotide
  Target: FXN; (+) strand; PAM type: NRG; PAM sequence: AAG
gctaaattatatagaaaaat

SEQ ID NO: 21963 - DNA, 20 bp, Artificial Sequence
  Description of Artificial Sequence: Synthetic oligonucleotide
  Target: FXN; (+) strand; PAM type: NRG; PAM sequence: TAG
cctaccgcactctatgatgc

SEQ ID NO: 21964 - DNA, 20 bp, Artificial Sequence
  Description of Artificial Sequence: Synthetic oligonucleotide
  Target: FXN; (+) strand; PAM type: NRG; PAM sequence: GAG
cgcactctatgatgctagct

SEQ ID NO: 21965 - DNA, 20 bp, Artificial Sequence
  Description of Artificial Sequence: Synthetic oligonucleotide
  Target: FXN; (+) strand; PAM type: NRG; PAM sequence: AAG
gctagctgagatttttccaa

SEQ ID NO: 21966 - DNA, 20 bp, Artificial Sequence
  Description of Artificial Sequence: Synthetic oligonucleotide
  Target: FXN; (+) strand; PAM type: NRG; PAM sequence: TGG
gagatttttccaaaagaaaa

SEQ ID NO: 21967 - DNA, 20 bp, Artificial Sequence
  Description of Artificial Sequence: Synthetic oligonucleotide
  Target: FXN; (+) strand; PAM type: NRG; PAM sequence: AAG
aatggcttaaataaaaccct

SEQ ID NO: 21968 - DNA, 20 bp, Artificial Sequence
  Description of Artificial Sequence: Synthetic oligonucleotide
  Target: FXN; (+) strand; PAM type: NRG; PAM sequence: GAG
tggcttaaataaaaccctaa

SEQ ID NO: 21969 - DNA, 20 bp, Artificial Sequence
  Description of Artificial Sequence: Synthetic oligonucleotide
  Target: FXN; (+) strand; PAM type: NRG; PAM sequence: AAG
ttaaataaaaccctaagaga

SEQ ID NO: 21970 - DNA, 20 bp, Artificial Sequence
  Description of Artificial Sequence: Synthetic oligonucleotide
  Target: FXN; (+) strand; PAM type: NRG; PAM sequence: AAG
aaaaactttaaatccctcca

SEQ ID NO: 21971 - DNA, 20 bp, Artificial Sequence
  Description of Artificial Sequence: Synthetic oligonucleotide
  Target: FXN; (+) strand; PAM type: NRG; PAM sequence: AAG
taaatccctccaaagctcaa

SEQ ID NO: 21972 - DNA, 20 bp, Artificial Sequence
  Description of Artificial Sequence: Synthetic oligonucleotide
  Target: FXN; (+) strand; PAM type: NRG; PAM sequence: TAG
cctccaaagctcaaaagtaa

SEQ ID NO: 21973 - DNA, 20 bp, Artificial Sequence
  Description of Artificial Sequence: Synthetic oligonucleotide
  Target: FXN; (+) strand; PAM type: NRG; PAM sequence: CAG
aagctcaaaagtaatagaaa

SEQ ID NO: 21974 - DNA, 20 bp, Artificial Sequence
  Description of Artificial Sequence: Synthetic oligonucleotide
  Target: FXN; (+) strand; PAM type: NRG; PAM sequence: GAG
caaaagtaatagaaacagat

SEQ ID NO: 21975 - DNA, 20 bp, Artificial Sequence
  Description of Artificial Sequence: Synthetic oligonucleotide
  Target: FXN; (+) strand; PAM type: NRG; PAM sequence: TGG
gtaatagaaacagatgagtt

SEQ ID NO: 21976 - DNA, 20 bp, Artificial Sequence
  Description of Artificial Sequence: Synthetic oligonucleotide
  Target: FXN; (+) strand; PAM type: NRG; PAM sequence: GAG
aatagaaacagatgagtttg

SEQ ID NO: 21977 - DNA, 20 bp, Artificial Sequence
  Description of Artificial Sequence: Synthetic oligonucleotide
  Target: FXN; (+) strand; PAM type: NRG; PAM sequence: CAG
gaaacagatgagtttggagt

SEQ ID NO: 21978 - DNA, 20 bp, Artificial Sequence
  Description of Artificial Sequence: Synthetic oligonucleotide
  Target: FXN; (+) strand; PAM type: NRG; PAM sequence: AGG
aaacagatgagtttggagtc

SEQ ID NO: 21979 - DNA, 20 bp, Artificial Sequence
  Description of Artificial Sequence: Synthetic oligonucleotide
  Target: FXN; (+) strand; PAM type: NRG; PAM sequence: AAG
tggagtcaggatttctctgt

SEQ ID NO: 21980 - DNA, 20 bp, Artificial Sequence
  Description of Artificial Sequence: Synthetic oligonucleotide
  Target: FXN; (+) strand; PAM type: NRG; PAM sequence: TAG
gatttctctgtaagattgcc

SEQ ID NO: 21981 - DNA, 20 bp, Artificial Sequence
  Description of Artificial Sequence: Synthetic oligonucleotide
  Target: FXN; (+) strand; PAM type: NRG; PAM sequence: AGG
atttctctgtaagattgcct

SEQ ID NO: 21982 - DNA, 20 bp, Artificial Sequence
  Description of Artificial Sequence: Synthetic oligonucleotide
  Target: FXN; (+) strand; PAM type: NRG; PAM sequence: CAG
ggctgtgtactgcacatctc

SEQ ID NO: 21983 - DNA, 20 bp, Artificial Sequence
  Description of Artificial Sequence: Synthetic oligonucleotide
  Target: FXN; (+) strand; PAM type: NRG; PAM sequence: AGG
gctgtgtactgcacatctcc

SEQ ID NO: 21984 - DNA, 20 bp, Artificial Sequence
  Description of Artificial Sequence: Synthetic oligonucleotide
  Target: FXN; (+) strand; PAM type: NRG; PAM sequence: CAG
tctccaggtgccactgttga

SEQ ID NO: 21985 - DNA, 20 bp, Artificial Sequence
  Description of Artificial Sequence: Synthetic oligonucleotide
  Target: FXN; (+) strand; PAM type: NRG; PAM sequence: GAG
tccaggtgccactgttgaca

SEQ ID NO: 21986 - DNA, 20 bp, Artificial Sequence
  Description of Artificial Sequence: Synthetic oligonucleotide
  Target: FXN; (+) strand; PAM type: NRG; PAM sequence: AAG
gagattataactacaatgtg

SEQ ID NO: 21987 - DNA, 20 bp, Artificial Sequence
  Description of Artificial Sequence: Synthetic oligonucleotide
  Target: FXN; (+) strand; PAM type: NRG; PAM sequence: TGG
taactacaatgtgaagtgaa

SEQ ID NO: 21988 - DNA, 20 bp, Artificial Sequence
  Description of Artificial Sequence: Synthetic oligonucleotide
  Target: FXN; (+) strand; PAM type: NRG; PAM sequence: CAG
gaagtgaatggtgccactga

SEQ ID NO: 21989 - DNA, 20 bp, Artificial Sequence
  Description of Artificial Sequence: Synthetic oligonucleotide
  Target: FXN; (+) strand; PAM type: NRG; PAM sequence: CAG
tgacagttatgcaaaccgtc

SEQ ID NO: 21990 - DNA, 20 bp, Artificial Sequence
  Description of Artificial Sequence: Synthetic oligonucleotide
  Target: FXN; (+) strand; PAM type: NRG; PAM sequence: GAG
acagttatgcaaaccgtcca

SEQ ID NO: 21991 - DNA, 20 bp, Artificial Sequence
  Description of Artificial Sequence: Synthetic oligonucleotide
  Target: FXN; (+) strand; PAM type: NRG; PAM sequence: TAG
tatgcaaaccgtccagagca

SEQ ID NO: 21992 - DNA, 20 bp, Artificial Sequence
  Description of Artificial Sequence: Synthetic oligonucleotide
  Target: FXN; (+) strand; PAM type: NRG; PAM sequence: TGG
gcatagccacctgatcctgc

SEQ ID NO: 21993 - DNA, 20 bp, Artificial Sequence
  Description of Artificial Sequence: Synthetic oligonucleotide
  Target: FXN; (+) strand; PAM type: NRG; PAM sequence: GGG
catagccacctgatcctgct

SEQ ID NO: 21994 - DNA, 20 bp, Artificial Sequence
  Description of Artificial Sequence: Synthetic oligonucleotide
  Target: FXN; (+) strand; PAM type: NRG; PAM sequence: CAG
cctgctgggattcctcttgc

SEQ ID NO: 21995 - DNA, 20 bp, Artificial Sequence
  Description of Artificial Sequence: Synthetic oligonucleotide
  Target: FXN; (+) strand; PAM type: NRG; PAM sequence: CAG
gattcctcttgccagtccat

SEQ ID NO: 21996 - DNA, 20 bp, Artificial Sequence
  Description of Artificial Sequence: Synthetic oligonucleotide
  Target: FXN; (+) strand; PAM type: NRG; PAM sequence: CAG
tcctcttgccagtccatcag

SEQ ID NO: 21997 - DNA, 20 bp, Artificial Sequence
  Description of Artificial Sequence: Synthetic oligonucleotide
  Target: FXN; (+) strand; PAM type: NRG; PAM sequence: AAG
ccatcagcagttccccttga

SEQ ID NO: 21998 - DNA, 20 bp, Artificial Sequence
  Description of Artificial Sequence: Synthetic oligonucleotide
  Target: FXN; (+) strand; PAM type: NRG; PAM sequence: CAG
tgccctctcctgcccgtccc

SEQ ID NO: 21999 - DNA, 20 bp, Artificial Sequence
  Description of Artificial Sequence: Synthetic oligonucleotide
  Target: FXN; (+) strand; PAM type: NRG; PAM sequence: TGG
cctctcctgcccgtccccag

SEQ ID NO: 22000 - DNA, 20 bp, Artificial Sequence
  Description of Artificial Sequence: Synthetic oligonucleotide
  Target: FXN; (+) strand; PAM type: NRG; PAM sequence: GAG
tctcctgcccgtccccagtg

SEQ ID NO: 22001 - DNA, 20 bp, Artificial Sequence
  Description of Artificial Sequence: Synthetic oligonucleotide
  Target: FXN; (+) strand; PAM type: NRG; PAM sequence: AGG
ctcctgcccgtccccagtgg

SEQ ID NO: 22002 - DNA, 20 bp, Artificial Sequence
  Description of Artificial Sequence: Synthetic oligonucleotide
  Target: FXN; (+) strand; PAM type: NRG; PAM sequence: CAG
atttttcacctgcatttttg

SEQ ID NO: 22003 - DNA, 20 bp, Artificial Sequence
  Description of Artificial Sequence: Synthetic oligonucleotide
  Target: FXN; (+) strand; PAM type: NRG; PAM sequence: AGG
tttttcacctgcatttttgc

SEQ ID NO: 22004 - DNA, 20 bp, Artificial Sequence
  Description of Artificial Sequence: Synthetic oligonucleotide
  Target: FXN; (+) strand; PAM type: NRG; PAM sequence: GAG
tttcacctgcatttttgcag

SEQ ID NO: 22005 - DNA, 20 bp, Artificial Sequence
  Description of Artificial Sequence: Synthetic oligonucleotide
  Target: FXN; (+) strand; PAM type: NRG; PAM sequence: CAG
ccaccttcctccttttctct

SEQ ID NO: 22006 - DNA, 20 bp, Artificial Sequence
  Description of Artificial Sequence: Synthetic oligonucleotide
  Target: FXN; (+) strand; PAM type: NRG; PAM sequence: TAG
ttttctctcagcccatcatc

SEQ ID NO: 22007 - DNA, 20 bp, Artificial Sequence
  Description of Artificial Sequence: Synthetic oligonucleotide
  Target: FXN; (+) strand; PAM type: NRG; PAM sequence: CAG
cagcccatcatctagctaca

SEQ ID NO: 22008 - DNA, 20 bp, Artificial Sequence
  Description of Artificial Sequence: Synthetic oligonucleotide
  Target: FXN; (+) strand; PAM type: NRG; PAM sequence: CAG
tcatctagctacacagtctc

SEQ ID NO: 22009 - DNA, 20 bp, Artificial Sequence
  Description of Artificial Sequence: Synthetic oligonucleotide
  Target: FXN; (+) strand; PAM type: NRG; PAM sequence: AGG
catctagctacacagtctcc

SEQ ID NO: 22010 - DNA, 20 bp, Artificial Sequence
  Description of Artificial Sequence: Synthetic oligonucleotide
  Target: FXN; (+) strand; PAM type: NRG; PAM sequence: GGG
atctagctacacagtctcca

SEQ ID NO: 22011 - DNA, 20 bp, Artificial Sequence
  Description of Artificial Sequence: Synthetic oligonucleotide
  Target: FXN; (+) strand; PAM type: NRG; PAM sequence: AAG
agctacacagtctccagggt

SEQ ID NO: 22012 - DNA, 20 bp, Artificial Sequence
  Description of Artificial Sequence: Synthetic oligonucleotide
  Target: FXN; (+) strand; PAM type: NRG; PAM sequence: CAG
cagtctccagggtaagcttt

SEQ ID NO: 22013 - DNA, 20 bp, Artificial Sequence
  Description of Artificial Sequence: Synthetic oligonucleotide
  Target: FXN; (+) strand; PAM type: NRG; PAM sequence: AAG
ctccagggtaagctttcaga

SEQ ID NO: 22014 - DNA, 20 bp, Artificial Sequence
  Description of Artificial Sequence: Synthetic oligonucleotide
  Target: FXN; (+) strand; PAM type: NRG; PAM sequence: AGG
tccagggtaagctttcagaa

SEQ ID NO: 22015 - DNA, 20 bp, Artificial Sequence
  Description of Artificial Sequence: Synthetic oligonucleotide
  Target: FXN; (+) strand; PAM type: NRG; PAM sequence: AAG
atctcttgtctgtaaaacct

SEQ ID NO: 22016 - DNA, 20 bp, Artificial Sequence
  Description of Artificial Sequence: Synthetic oligonucleotide
  Target: FXN; (+) strand; PAM type: NRG; PAM sequence: CAG
tcttgtctgtaaaacctaag

SEQ ID NO: 22017 - DNA, 20 bp, Artificial Sequence
  Description of Artificial Sequence: Synthetic oligonucleotide
  Target: FXN; (+) strand; PAM type: NRG; PAM sequence: AGG
cttgtctgtaaaacctaagc

SEQ ID NO: 22018 - DNA, 20 bp, Artificial Sequence
  Description of Artificial Sequence: Synthetic oligonucleotide
  Target: FXN; (+) strand; PAM type: NRG; PAM sequence: AAG
tgtaaaacctaagcaggacc

SEQ ID NO: 22019 - DNA, 20 bp, Artificial Sequence
  Description of Artificial Sequence: Synthetic oligonucleotide
  Target: FXN; (+) strand; PAM type: NRG; PAM sequence: AGG
gtaaaacctaagcaggacca

SEQ ID NO: 22020 - DNA, 20 bp, Artificial Sequence
  Description of Artificial Sequence: Synthetic oligonucleotide
  Target: FXN; (+) strand; PAM type: NRG; PAM sequence: AAG
acctaagcaggaccaaggcc

SEQ ID NO: 22021 - DNA, 20 bp, Artificial Sequence
  Description of Artificial Sequence: Synthetic oligonucleotide
  Target: FXN; (+) strand; PAM type: NRG; PAM sequence: TAG
aggaccaaggccaagtttct

SEQ ID NO: 22022 - DNA, 20 bp, Artificial Sequence
  Description of Artificial Sequence: Synthetic oligonucleotide
  Target: FXN; (+) strand; PAM type: NRG; PAM sequence: CAG
gcttttctgactgaactgtt

SEQ ID NO: 22023 - DNA, 20 bp, Artificial Sequence
  Description of Artificial Sequence: Synthetic oligonucleotide
  Target: FXN; (+) strand; PAM type: NRG; PAM sequence: AGG
cttttctgactgaactgttc

SEQ ID NO: 22024 - DNA, 20 bp, Artificial Sequence
  Description of Artificial Sequence: Synthetic oligonucleotide
  Target: FXN; (+) strand; PAM type: NRG; PAM sequence: CAG
cacactcaacactttgactc

SEQ ID NO: 22025 - DNA, 20 bp, Artificial Sequence
  Description of Artificial Sequence: Synthetic oligonucleotide
  Target: FXN; (+) strand; PAM type: NRG; PAM sequence: CAG
ctccagcaatcccaaatccc

SEQ ID NO: 22026 - DNA, 20 bp, Artificial Sequence
  Description of Artificial Sequence: Synthetic oligonucleotide
  Target: FXN; (+) strand; PAM type: NRG; PAM sequence: AAG
tcccaaatccccagatccct

SEQ ID NO: 22027 - DNA, 20 bp, Artificial Sequence
  Description of Artificial Sequence: Synthetic oligonucleotide
  Target: FXN; (+) strand; PAM type: NRG; PAM sequence: TGG
tgtgctgtgctattttcacg

SEQ ID NO: 22028 - DNA, 20 bp, Artificial Sequence
  Description of Artificial Sequence: Synthetic oligonucleotide
  Target: FXN; (+) strand; PAM type: NRG; PAM sequence: CAG
tgctattttcacgtggctct

SEQ ID NO: 22029 - DNA, 20 bp, Artificial Sequence
  Description of Artificial Sequence: Synthetic oligonucleotide
  Target: FXN; (+) strand; PAM type: NRG; PAM sequence: TGG
tttcacgtggctctcagact

SEQ ID NO: 22030 - DNA, 20 bp, Artificial Sequence
  Description of Artificial Sequence: Synthetic oligonucleotide
  Target: FXN; (+) strand; PAM type: NRG; PAM sequence: CAG
acgtggctctcagacttggc

SEQ ID NO: 22031 - DNA, 20 bp, Artificial Sequence
  Description of Artificial Sequence: Synthetic oligonucleotide
  Target: FXN; (+) strand; PAM type: NRG; PAM sequence: TGG
ggccagtgctgtttccattt

SEQ ID NO: 22032 - DNA, 20 bp, Artificial Sequence
  Description of Artificial Sequence: Synthetic oligonucleotide
  Target: FXN; (+) strand; PAM type: NRG; PAM sequence: TGG
ttattccccacatctctgcc

SEQ ID NO: 22033 - DNA, 20 bp, Artificial Sequence
  Description of Artificial Sequence: Synthetic oligonucleotide
  Target: FXN; (+) strand; PAM type: NRG; PAM sequence: GGG
tattccccacatctctgcct

SEQ ID NO: 22034 - DNA, 20 bp, Artificial Sequence
  Description of Artificial Sequence: Synthetic oligonucleotide
  Target: FXN; (+) strand; PAM type: NRG; PAM sequence: GGG
attccccacatctctgcctg

SEQ ID NO: 22035 - DNA, 20 bp, Artificial Sequence
  Description of Artificial Sequence: Synthetic oligonucleotide
  Target: FXN; (+) strand; PAM type: NRG; PAM sequence: GGG
ttccccacatctctgcctgg

SEQ ID NO: 22036 - DNA, 20 bp, Artificial Sequence
  Description of Artificial Sequence: Synthetic oligonucleotide
  Target: FXN; (+) strand; PAM type: NRG; PAM sequence: GGG
tccccacatctctgcctggg

SEQ ID NO: 22037 - DNA, 20 bp, Artificial Sequence
  Description of Artificial Sequence: Synthetic oligonucleotide
  Target: FXN; (+) strand; PAM type: NRG; PAM sequence: TAG
ccacatctctgcctgggggg

SEQ ID NO: 22038 - DNA, 20 bp, Artificial Sequence
  Description of Artificial Sequence: Synthetic oligonucleotide
  Target: FXN; (+) strand; PAM type: NRG; PAM sequence: TGG
tctaccctgaaaaatgttct

SEQ ID NO: 22039 - DNA, 20 bp, Artificial Sequence
  Description of Artificial Sequence: Synthetic oligonucleotide
  Target: FXN; (+) strand; PAM type: NRG; PAM sequence: CAG
cctgaaaaatgttcttggca

SEQ ID NO: 22040 - DNA, 20 bp, Artificial Sequence
  Description of Artificial Sequence: Synthetic oligonucleotide
  Target: FXN; (+) strand; PAM type: NRG; PAM sequence: CAG
ttgcaaactcctcctccact

SEQ ID NO: 22041 - DNA, 20 bp, Artificial Sequence
  Description of Artificial Sequence: Synthetic oligonucleotide
  Target: FXN; (+) strand; PAM type: NRG; PAM sequence: TGG
tcctccactcagcctctgcc

SEQ ID NO: 22042 - DNA, 20 bp, Artificial Sequence
  Description of Artificial Sequence: Synthetic oligonucleotide
  Target: FXN; (+) strand; PAM type: NRG; PAM sequence: CAG
ccttgattgttccatgtcct

SEQ ID NO: 22043 - DNA, 20 bp, Artificial Sequence
  Description of Artificial Sequence: Synthetic oligonucleotide
  Target: FXN; (+) strand; PAM type: NRG; PAM sequence: CAG
cataccatgtttgtctttcc

SEQ ID NO: 22044 - DNA, 20 bp, Artificial Sequence
  Description of Artificial Sequence: Synthetic oligonucleotide
  Target: FXN; (+) strand; PAM type: NRG; PAM sequence: TGG
taccatgtgtcacccctgct

SEQ ID NO: 22045 - DNA, 20 bp, Artificial Sequence
  Description of Artificial Sequence: Synthetic oligonucleotide
  Target: FXN; (+) strand; PAM type: NRG; PAM sequence: GAG
tgcttggctgtaccttccat

SEQ ID NO: 22046 - DNA, 20 bp, Artificial Sequence
  Description of Artificial Sequence: Synthetic oligonucleotide
  Target: FXN; (+) strand; PAM type: NRG; PAM sequence: AGG
gcttggctgtaccttccatg

SEQ ID NO: 22047 - DNA, 20 bp, Artificial Sequence
  Description of Artificial Sequence: Synthetic oligonucleotide
  Target: FXN; (+) strand; PAM type: NRG; PAM sequence: TAG
ggctgtaccttccatgaggc

SEQ ID NO: 22048 - DNA, 20 bp, Artificial Sequence
  Description of Artificial Sequence: Synthetic oligonucleotide
  Target: FXN; (+) strand; PAM type: NRG; PAM sequence: AGG
gctgtaccttccatgaggct

SEQ ID NO: 22049 - DNA, 20 bp, Artificial Sequence
  Description of Artificial Sequence: Synthetic oligonucleotide
  Target: FXN; (+) strand; PAM type: NRG; PAM sequence: TAG
tttgttgactgctgttgccc

SEQ ID NO: 22050 - DNA, 20 bp, Artificial Sequence
  Description of Artificial Sequence: Synthetic oligonucleotide
  Target: FXN; (+) strand; PAM type: NRG; PAM sequence: CAG
tgttgccctagcatcttgca

SEQ ID NO: 22051 - DNA, 20 bp, Artificial Sequence
  Description of Artificial Sequence: Synthetic oligonucleotide
  Target: FXN; (+) strand; PAM type: NRG; PAM sequence: TAG
cacagttccttgcacacaat

SEQ ID NO: 22052 - DNA, 20 bp, Artificial Sequence
  Description of Artificial Sequence: Synthetic oligonucleotide
  Target: FXN; (+) strand; PAM type: NRG; PAM sequence: GAG
cagttccttgcacacaatta

SEQ ID NO: 22053 - DNA, 20 bp, Artificial Sequence
  Description of Artificial Sequence: Synthetic oligonucleotide
  Target: FXN; (+) strand; PAM type: NRG; PAM sequence: AAG
tgtgttataattatatgttt

SEQ ID NO: 22054 - DNA, 20 bp, Artificial Sequence
  Description of Artificial Sequence: Synthetic oligonucleotide
  Target: FXN; (+) strand; PAM type: NRG; PAM sequence: TAG
ttataattatatgtttaaga

SEQ ID NO: 22055 - DNA, 20 bp, Artificial Sequence
  Description of Artificial Sequence: Synthetic oligonucleotide
  Target: FXN; (+) strand; PAM type: NRG; PAM sequence: AAG
ctctaaataaccccaactcc

SEQ ID NO: 22056 - DNA, 20 bp, Artificial Sequence
  Description of Artificial Sequence: Synthetic oligonucleotide
  Target: FXN; (+) strand; PAM type: NRG; PAM sequence: GAG
ctaaataaccccaactccaa

SEQ ID NO: 22057 - DNA, 20 bp, Artificial Sequence
  Description of Artificial Sequence: Synthetic oligonucleotide
  Target: FXN; (+) strand; PAM type: NRG; PAM sequence: TAG
aaccccaactccaagagtgt

SEQ ID NO: 22058 - DNA, 20 bp, Artificial Sequence
  Description of Artificial Sequence: Synthetic oligonucleotide
  Target: FXN; (+) strand; PAM type: NRG; PAM sequence: AAG
ccaactccaagagtgttagc

SEQ ID NO: 22059 - DNA, 20 bp, Artificial Sequence
  Description of Artificial Sequence: Synthetic oligonucleotide
  Target: FXN; (+) strand; PAM type: NRG; PAM sequence: CAG
agcaagaaatataaatttta

SEQ ID NO: 22060 - DNA, 20 bp, Artificial Sequence
  Description of Artificial Sequence: Synthetic oligonucleotide
  Target: FXN; (+) strand; PAM type: NRG; PAM sequence: AAG
aagaaatataaattttacag

SEQ ID NO: 22061 - DNA, 20 bp, Artificial Sequence
  Description of Artificial Sequence: Synthetic oligonucleotide
  Target: FXN; (+) strand; PAM type: NRG; PAM sequence: TGG
atataaattttacagaagaa

SEQ ID NO: 22062 - DNA, 20 bp, Artificial Sequence
  Description of Artificial Sequence: Synthetic oligonucleotide
  Target: FXN; (+) strand; PAM type: NRG; PAM sequence: TGG
aaattttacagaagaatggt

SEQ ID NO: 22063 - DNA, 20 bp, Artificial Sequence
  Description of Artificial Sequence: Synthetic oligonucleotide
  Target: FXN; (+) strand; PAM type: NRG; PAM sequence: GAG
attttacagaagaatggttg

SEQ ID NO: 22064 - DNA, 20 bp, Artificial Sequence
  Description of Artificial Sequence: Synthetic oligonucleotide
  Target: FXN; (+) strand; PAM type: NRG; PAM sequence: AGG
ttttacagaagaatggttgg

SEQ ID NO: 22065 - DNA, 20 bp, Artificial Sequence
  Description of Artificial Sequence: Synthetic oligonucleotide
  Target: FXN; (+) strand; PAM type: NRG; PAM sequence: TGG
tacagaagaatggttggagg

SEQ ID NO: 22066 - DNA, 20 bp, Artificial Sequence
  Description of Artificial Sequence: Synthetic oligonucleotide
  Target: FXN; (+) strand; PAM type: NRG; PAM sequence: GGG
acagaagaatggttggaggt

SEQ ID NO: 22067 - DNA, 20 bp, Artificial Sequence
  Description of Artificial Sequence: Synthetic oligonucleotide
  Target: FXN; (+) strand; PAM type: NRG; PAM sequence: GGG
cagaagaatggttggaggtg

SEQ ID NO: 22068 - DNA, 20 bp, Artificial Sequence
  Description of Artificial Sequence: Synthetic oligonucleotide
  Target: FXN; (+) strand; PAM type: NRG; PAM sequence: GAG
gaagaatggttggaggtggg

SEQ ID NO: 22069 - DNA, 20 bp, Artificial Sequence
  Description of Artificial Sequence: Synthetic oligonucleotide
  Target: FXN; (+) strand; PAM type: NRG; PAM sequence: AGG
aagaatggttggaggtgggg

SEQ ID NO: 22070 - DNA, 20 bp, Artificial Sequence
  Description of Artificial Sequence: Synthetic oligonucleotide
  Target: FXN; (+) strand; PAM type: NRG; PAM sequence: GGG
agaatggttggaggtgggga

SEQ ID NO: 22071 - DNA, 20 bp, Artificial Sequence
  Description of Artificial Sequence: Synthetic oligonucleotide
  Target: FXN; (+) strand; PAM type: NRG; PAM sequence: CGG
ggaggtggggagggtgtcca

SEQ ID NO: 22072 - DNA, 20 bp, Artificial Sequence
  Description of Artificial Sequence: Synthetic oligonucleotide
  Target: FXN; (+) strand; PAM type: NRG; PAM sequence: GAG
aggtggggagggtgtccacg

SEQ ID NO: 22073 - DNA, 20 bp, Artificial Sequence
  Description of Artificial Sequence: Synthetic oligonucleotide
  Target: FXN; (+) strand; PAM type: NRG; PAM sequence: GAG
ggggagggtgtccacggagt

SEQ ID NO: 22074 - DNA, 20 bp, Artificial Sequence
  Description of Artificial Sequence: Synthetic oligonucleotide
  Target: FXN; (+) strand; PAM type: NRG; PAM sequence: CAG
acggagtgagttacctcaca

SEQ ID NO: 22075 - DNA, 20 bp, Artificial Sequence
  Description of Artificial Sequence: Synthetic oligonucleotide
  Target: FXN; (+) strand; PAM type: NRG; PAM sequence: AGG
cggagtgagttacctcacac

SEQ ID NO: 22076 - DNA, 20 bp, Artificial Sequence
  Description of Artificial Sequence: Synthetic oligonucleotide
  Target: FXN; (+) strand; PAM type: NRG; PAM sequence: CGG
tgagttacctcacacaggca

SEQ ID NO: 22077 - DNA, 20 bp, Artificial Sequence
  Description of Artificial Sequence: Synthetic oligonucleotide
  Target: FXN; (+) strand; PAM type: NRG; PAM sequence: AAG
cggaaaaacttgaacctcct

SEQ ID NO: 22078 - DNA, 20 bp, Artificial Sequence
  Description of Artificial Sequence: Synthetic oligonucleotide
  Target: FXN; (+) strand; PAM type: NRG; PAM sequence: AGG
ggaaaaacttgaacctccta

SEQ ID NO: 22079 - DNA, 20 bp, Artificial Sequence
  Description of Artificial Sequence: Synthetic oligonucleotide
  Target: FXN; (+) strand; PAM type: NRG; PAM sequence: AAG
aacctcctaaggacattttt

SEQ ID NO: 22080 - DNA, 20 bp, Artificial Sequence
  Description of Artificial Sequence: Synthetic oligonucleotide
  Target: FXN; (-) strand; PAM type: YTN; PAM sequence: TTA
gtgtatagtttcactttgaa

SEQ ID NO: 22081 - DNA, 20 bp, Artificial Sequence
  Description of Artificial Sequence: Synthetic oligonucleotide
  Target: FXN; (-) strand; PAM type: YTN; PAM sequence: TTT
agtgtatagtttcactttga

SEQ ID NO: 22082 - DNA, 20 bp, Artificial Sequence
  Description of Artificial Sequence: Synthetic oligonucleotide
  Target: FXN; (-) strand; PAM type: YTN; PAM sequence: CTG
tgggaggaatttagtgtata

SEQ ID NO: 22083 - DNA, 20 bp, Artificial Sequence
  Description of Artificial Sequence: Synthetic oligonucleotide
  Target: FXN; (-) strand; PAM type: YTN; PAM sequence: CTA
actgtgggaggaatttagtg

SEQ ID NO: 22084 - DNA, 20 bp, Artificial Sequence
  Description of Artificial Sequence: Synthetic oligonucleotide
  Target: FXN; (-) strand; PAM type: YTN; PAM sequence: CTG
ggcatataacaaaggccacg

SEQ ID NO: 22085 - DNA, 20 bp, Artificial Sequence
  Description of Artificial Sequence: Synthetic oligonucleotide
  Target: FXN; (-) strand; PAM type: YTN; PAM sequence: TTC
ctgggcatataacaaaggcc

SEQ ID NO: 22086 - DNA, 20 bp, Artificial Sequence
  Description of Artificial Sequence: Synthetic oligonucleotide
  Target: FXN; (-) strand; PAM type: YTN; PAM sequence: TTA
ttcctgggcatataacaaag

SEQ ID NO: 22087 - DNA, 20 bp, Artificial Sequence
  Description of Artificial Sequence: Synthetic oligonucleotide
  Target: FXN; (-) strand; PAM type: YTN; PAM sequence: CTT
attcctgggcatataacaaa

SEQ ID NO: 22088 - DNA, 20 bp, Artificial Sequence
  Description of Artificial Sequence: Synthetic oligonucleotide
  Target: FXN; (-) strand; PAM type: YTN; PAM sequence: CTC
acttattcctgggcatataa

SEQ ID NO: 22089 - DNA, 20 bp, Artificial Sequence
  Description of Artificial Sequence: Synthetic oligonucleotide
  Target: FXN; (-) strand; PAM type: YTN; PAM sequence: CTG
tcctcacttattcctgggca

SEQ ID NO: 22090 - DNA, 20 bp, Artificial Sequence
  Description of Artificial Sequence: Synthetic oligonucleotide
  Target: FXN; (-) strand; PAM type: YTN; PAM sequence: CTG
gctgtcctcacttattcctg

SEQ ID NO: 22091 - DNA, 20 bp, Artificial Sequence
  Description of Artificial Sequence: Synthetic oligonucleotide
  Target: FXN; (-) strand; PAM type: YTN; PAM sequence: CTC
ataggctggctgtcctcact

SEQ ID NO: 22092 - DNA, 20 bp, Artificial Sequence
  Description of Artificial Sequence: Synthetic oligonucleotide
  Target: FXN; (-) strand; PAM type: YTN; PAM sequence: CTA
gtctcataggctggctgtcc

SEQ ID NO: 22093 - DNA, 20 bp, Artificial Sequence
  Description of Artificial Sequence: Synthetic oligonucleotide
  Target: FXN; (-) strand; PAM type: YTN; PAM sequence: TTC
tagtctcataggctggctgt

SEQ ID NO: 22094 - DNA, 20 bp, Artificial Sequence
  Description of Artificial Sequence: Synthetic oligonucleotide
  Target: FXN; (-) strand; PAM type: YTN; PAM sequence: CTT
ctagtctcataggctggctg

SEQ ID NO: 22095 - DNA, 20 bp, Artificial Sequence
  Description of Artificial Sequence: Synthetic oligonucleotide
  Target: FXN; (-) strand; PAM type: YTN; PAM sequence: TTG
cttctagtctcataggctgg

SEQ ID NO: 22096 - DNA, 20 bp, Artificial Sequence
  Description of Artificial Sequence: Synthetic oligonucleotide
  Target: FXN; (-) strand; PAM type: YTN; PAM sequence: CTT
gcttctagtctcataggctg

SEQ ID NO: 22097 - DNA, 20 bp, Artificial Sequence
  Description of Artificial Sequence: Synthetic oligonucleotide
  Target: FXN; (-) strand; PAM type: YTN; PAM sequence: CTC
catcttgcttctagtctcat

SEQ ID NO: 22098 - DNA, 20 bp, Artificial Sequence
  Description of Artificial Sequence: Synthetic oligonucleotide
  Target: FXN; (-) strand; PAM type: YTN; PAM sequence: CTG
actccatcttgcttctagtc

SEQ ID NO: 22099 - DNA, 20 bp, Artificial Sequence
  Description of Artificial Sequence: Synthetic oligonucleotide
  Target: FXN; (-) strand; PAM type: YTN; PAM sequence: TTG
gctgactccatcttgcttct

SEQ ID NO: 22100 - DNA, 20 bp, Artificial Sequence
  Description of Artificial Sequence: Synthetic oligonucleotide
  Target: FXN; (-) strand; PAM type: YTN; PAM sequence: CTT
ggctgactccatcttgcttc

SEQ ID NO: 22101 - DNA, 20 bp, Artificial Sequence
  Description of Artificial Sequence: Synthetic oligonucleotide
  Target: FXN; (-) strand; PAM type: YTN; PAM sequence: TTA
gcttggctgactccatcttg

SEQ ID NO: 22102 - DNA, 20 bp, Artificial Sequence
  Description of Artificial Sequence: Synthetic oligonucleotide
  Target: FXN; (-) strand; PAM type: YTN; PAM sequence: TTT
agcttggctgactccatctt

SEQ ID NO: 22103 - DNA, 20 bp, Artificial Sequence
  Description of Artificial Sequence: Synthetic oligonucleotide
  Target: FXN; (-) strand; PAM type: YTN; PAM sequence: TTA
tgacagtgagagaaatttag

SEQ ID NO: 22104 - DNA, 20 bp, Artificial Sequence
  Description of Artificial Sequence: Synthetic oligonucleotide
  Target: FXN; (-) strand; PAM type: YTN; PAM sequence: TTG
taaaggttatgacagtgaga

SEQ ID NO: 22105 - DNA, 20 bp, Artificial Sequence
  Description of Artificial Sequence: Synthetic oligonucleotide
  Target: FXN; (-) strand; PAM type: YTN; PAM sequence: TTT
gtaaaggttatgacagtgag

SEQ ID NO: 22106 - DNA, 20 bp, Artificial Sequence
  Description of Artificial Sequence: Synthetic oligonucleotide
  Target: FXN; (-) strand; PAM type: YTN; PAM sequence: CTT
tgtaaaggttatgacagtga

SEQ ID NO: 22107 - DNA, 20 bp, Artificial Sequence
  Description of Artificial Sequence: Synthetic oligonucleotide
  Target: FXN; (-) strand; PAM type: YTN; PAM sequence: CTA
atgaaaccacctttgtaaag

SEQ ID NO: 22108 - DNA, 20 bp, Artificial Sequence
  Description of Artificial Sequence: Synthetic oligonucleotide
  Target: FXN; (-) strand; PAM type: YTN; PAM sequence: TTA
atatgcctaatgaaaccacc

SEQ ID NO: 22109 - DNA, 20 bp, Artificial Sequence
  Description of Artificial Sequence: Synthetic oligonucleotide
  Target: FXN; (-) strand; PAM type: YTN; PAM sequence: TTG
cattaatatgcctaatgaaa

SEQ ID NO: 22110 - DNA, 20 bp, Artificial Sequence
  Description of Artificial Sequence: Synthetic oligonucleotide
  Target: FXN; (-) strand; PAM type: YTN; PAM sequence: TTT
gcattaatatgcctaatgaa

SEQ ID NO: 22111 - DNA, 20 bp, Artificial Sequence
  Description of Artificial Sequence: Synthetic oligonucleotide
  Target: FXN; (-) strand; PAM type: YTN; PAM sequence: CTA
aggaatttgcattaatatgc

SEQ ID NO: 22112 - DNA, 20 bp, Artificial Sequence
  Description of Artificial Sequence: Synthetic oligonucleotide
  Target: FXN; (-) strand; PAM type: YTN; PAM sequence: TTA
actaaggaatttgcattaat

SEQ ID NO: 22113 - DNA, 20 bp, Artificial Sequence
  Description of Artificial Sequence: Synthetic oligonucleotide
  Target: FXN; (-) strand; PAM type: YTN; PAM sequence: TTT
aactaaggaatttgcattaa

SEQ ID NO: 22114 - DNA, 20 bp, Artificial Sequence
  Description of Artificial Sequence: Synthetic oligonucleotide
  Target: FXN; (-) strand; PAM type: YTN; PAM sequence: TTT
taactaaggaatttgcatta

SEQ ID NO: 22115 - DNA, 20 bp, Artificial Sequence
  Description of Artificial Sequence: Synthetic oligonucleotide
  Target: FXN; (-) strand; PAM type: YTN; PAM sequence: TTG
ttttaactaaggaatttgca

SEQ ID NO: 22116 - DNA, 20 bp, Artificial Sequence
  Description of Artificial Sequence: Synthetic oligonucleotide
  Target: FXN; (-) strand; PAM type: YTN; PAM sequence: CTT
gttttaactaaggaatttgc

SEQ ID NO: 22117 - DNA, 20 bp, Artificial Sequence
  Description of Artificial Sequence: Synthetic oligonucleotide
  Target: FXN; (-) strand; PAM type: YTN; PAM sequence: TTC
ttgttttaactaaggaattt

SEQ ID NO: 22118 - DNA, 20 bp, Artificial Sequence
  Description of Artificial Sequence: Synthetic oligonucleotide
  Target: FXN; (-) strand; PAM type: YTN; PAM sequence: TTA
gagagtcattcttgttttaa

SEQ ID NO: 22119 - DNA, 20 bp, Artificial Sequence
  Description of Artificial Sequence: Synthetic oligonucleotide
  Target: FXN; (-) strand; PAM type: YTN; PAM sequence: TTT
agagagtcattcttgtttta

SEQ ID NO: 22120 - DNA, 20 bp, Artificial Sequence
  Description of Artificial Sequence: Synthetic oligonucleotide
  Target: FXN; (-) strand; PAM type: YTN; PAM sequence: CTT
tagagagtcattcttgtttt

SEQ ID NO: 22121 - DNA, 20 bp, Artificial Sequence
  Description of Artificial Sequence: Synthetic oligonucleotide
  Target: FXN; (-) strand; PAM type: YTN; PAM sequence: CTG
aaatatagcctttagagagt

SEQ ID NO: 22122 - DNA, 20 bp, Artificial Sequence
  Description of Artificial Sequence: Synthetic oligonucleotide
  Target: FXN; (-) strand; PAM type: YTN; PAM sequence: TTG
aggggacaagaggaaagaag

SEQ ID NO: 22123 - DNA, 20 bp, Artificial Sequence
  Description of Artificial Sequence: Synthetic oligonucleotide
  Target: FXN; (-) strand; PAM type: YTN; PAM sequence: CTG
ttgaggggacaagaggaaag

SEQ ID NO: 22124 - DNA, 20 bp, Artificial Sequence
  Description of Artificial Sequence: Synthetic oligonucleotide
  Target: FXN; (-) strand; PAM type: YTN; PAM sequence: TTA
ctgttgaggggacaagagga

SEQ ID NO: 22125 - DNA, 20 bp, Artificial Sequence
  Description of Artificial Sequence: Synthetic oligonucleotide
  Target: FXN; (-) strand; PAM type: YTN; PAM sequence: CTT
actgttgaggggacaagagg

SEQ ID NO: 22126 - DNA, 20 bp, Artificial Sequence
  Description of Artificial Sequence: Synthetic oligonucleotide
  Target: FXN; (-) strand; PAM type: YTN; PAM sequence: TTG
cttactgttgaggggacaag

SEQ ID NO: 22127 - DNA, 20 bp, Artificial Sequence
  Description of Artificial Sequence: Synthetic oligonucleotide
  Target: FXN; (-) strand; PAM type: YTN; PAM sequence: CTT
gcttactgttgaggggacaa

SEQ ID NO: 22128 - DNA, 20 bp, Artificial Sequence
  Description of Artificial Sequence: Synthetic oligonucleotide
  Target: FXN; (-) strand; PAM type: YTN; PAM sequence: TTC
ttgcttactgttgaggggac

SEQ ID NO: 22129 - DNA, 20 bp, Artificial Sequence
  Description of Artificial Sequence: Synthetic oligonucleotide
  Target: FXN; (-) strand; PAM type: YTN; PAM sequence: CTT
cttgcttactgttgagggga

SEQ ID NO: 22130 - DNA, 20 bp, Artificial Sequence
  Description of Artificial Sequence: Synthetic oligonucleotide
  Target: FXN; (-) strand; PAM type: YTN; PAM sequence: CTC
ttcttgcttactgttgaggg

SEQ ID NO: 22131 - DNA, 20 bp, Artificial Sequence
  Description of Artificial Sequence: Synthetic oligonucleotide
  Target: FXN; (-) strand; PAM type: YTN; PAM sequence: TTG
tacaaaaatactcttcttgc

SEQ ID NO: 22132 - DNA, 20 bp, Artificial Sequence
  Description of Artificial Sequence: Synthetic oligonucleotide
  Target: FXN; (-) strand; PAM type: YTN; PAM sequence: CTT
gtacaaaaatactcttcttg

SEQ ID NO: 22133 - DNA, 20 bp, Artificial Sequence
  Description of Artificial Sequence: Synthetic oligonucleotide
  Target: FXN; (-) strand; PAM type: YTN; PAM sequence: CTC
ttgtacaaaaatactcttct

SEQ ID NO: 22134 - DNA, 20 bp, Artificial Sequence
  Description of Artificial Sequence: Synthetic oligonucleotide
  Target: FXN; (-) strand; PAM type: YTN; PAM sequence: CTC
tcttgtacaaaaatactctt

SEQ ID NO: 22135 - DNA, 20 bp, Artificial Sequence
  Description of Artificial Sequence: Synthetic oligonucleotide
  Target: FXN; (-) strand; PAM type: YTN; PAM sequence: CTC
tctcttgtacaaaaatactc

SEQ ID NO: 22136 - DNA, 20 bp, Artificial Sequence
  Description of Artificial Sequence: Synthetic oligonucleotide
  Target: FXN; (-) strand; PAM type: YTN; PAM sequence: TTC
aggcagaggcctctctcttg

SEQ ID NO: 22137 - DNA, 20 bp, Artificial Sequence
  Description of Artificial Sequence: Synthetic oligonucleotide
  Target: FXN; (-) strand; PAM type: YTN; PAM sequence: CTT
caggcagaggcctctctctt

SEQ ID NO: 22138 - DNA, 20 bp, Artificial Sequence
  Description of Artificial Sequence: Synthetic oligonucleotide
  Target: FXN; (-) strand; PAM type: YTN; PAM sequence: TTA
agggagcttcaggcagaggc

SEQ ID NO: 22139 - DNA, 20 bp, Artificial Sequence
  Description of Artificial Sequence: Synthetic oligonucleotide
  Target: FXN; (-) strand; PAM type: YTN; PAM sequence: CTG
acagattaagggagcttcag

SEQ ID NO: 22140 - DNA, 20 bp, Artificial Sequence
  Description of Artificial Sequence: Synthetic oligonucleotide
  Target: FXN; (-) strand; PAM type: YTN; PAM sequence: CTG
tgatctgacagattaaggga

SEQ ID NO: 22141 - DNA, 20 bp, Artificial Sequence
  Description of Artificial Sequence: Synthetic oligonucleotide
  Target: FXN; (-) strand; PAM type: YTN; PAM sequence: TTG
atctgtgatctgacagatta

SEQ ID NO: 22142 - DNA, 20 bp, Artificial Sequence
  Description of Artificial Sequence: Synthetic oligonucleotide
  Target: FXN; (-) strand; PAM type: YTN; PAM sequence: TTT
gatctgtgatctgacagatt

SEQ ID NO: 22143 - DNA, 20 bp, Artificial Sequence
  Description of Artificial Sequence: Synthetic oligonucleotide
  Target: FXN; (-) strand; PAM type: YTN; PAM sequence: TTT
tgatctgtgatctgacagat

SEQ ID NO: 22144 - DNA, 20 bp, Artificial Sequence
  Description of Artificial Sequence: Synthetic oligonucleotide
  Target: FXN; (-) strand; PAM type: YTN; PAM sequence: CTT
ttgatctgtgatctgacaga

SEQ ID NO: 22145 - DNA, 20 bp, Artificial Sequence
  Description of Artificial Sequence: Synthetic oligonucleotide
  Target: FXN; (-) strand; PAM type: YTN; PAM sequence: TTG
ggcagtgtgtgatagctttt

SEQ ID NO: 22146 - DNA, 20 bp, Artificial Sequence
  Description of Artificial Sequence: Synthetic oligonucleotide
  Target: FXN; (-) strand; PAM type: YTN; PAM sequence: CTT
gggcagtgtgtgatagcttt

SEQ ID NO: 22147 - DNA, 20 bp, Artificial Sequence
  Description of Artificial Sequence: Synthetic oligonucleotide
  Target: FXN; (-) strand; PAM type: YTN; PAM sequence: TTA
gggtcccttgggcagtgtgt

SEQ ID NO: 22148 - DNA, 20 bp, Artificial Sequence
  Description of Artificial Sequence: Synthetic oligonucleotide
  Target: FXN; (-) strand; PAM type: YTN; PAM sequence: TTT
agggtcccttgggcagtgtg

SEQ ID NO: 22149 - DNA, 20 bp, Artificial Sequence
  Description of Artificial Sequence: Synthetic oligonucleotide
  Target: FXN; (-) strand; PAM type: YTN; PAM sequence: CTT
tagggtcccttgggcagtgt

SEQ ID NO: 22150 - DNA, 20 bp, Artificial Sequence
  Description of Artificial Sequence: Synthetic oligonucleotide
  Target: FXN; (-) strand; PAM type: YTN; PAM sequence: CTC
cctttagggtcccttgggca

SEQ ID NO: 22151 - DNA, 20 bp, Artificial Sequence
  Description of Artificial Sequence: Synthetic oligonucleotide
  Target: FXN; (-) strand; PAM type: YTN; PAM sequence: CTG
agagtggctccctttagggt

SEQ ID NO: 22152 - DNA, 20 bp, Artificial Sequence
  Description of Artificial Sequence: Synthetic oligonucleotide
  Target: FXN; (-) strand; PAM type: YTN; PAM sequence: TTC
tgagagtggctccctttagg

SEQ ID NO: 22153 - DNA, 20 bp, Artificial Sequence
  Description of Artificial Sequence: Synthetic oligonucleotide
  Target: FXN; (-) strand; PAM type: YTN; PAM sequence: TTT
ctgagagtggctccctttag

SEQ ID NO: 22154 - DNA, 20 bp, Artificial Sequence
  Description of Artificial Sequence: Synthetic oligonucleotide
  Target: FXN; (-) strand; PAM type: YTN; PAM sequence: TTT
tctgagagtggctcccttta

SEQ ID NO: 22155 - DNA, 20 bp, Artificial Sequence
  Description of Artificial Sequence: Synthetic oligonucleotide
  Target: FXN; (-) strand; PAM type: YTN; PAM sequence: TTA
ttttctgagagtggctccct

SEQ ID NO: 22156 - DNA, 20 bp, Artificial Sequence
  Description of Artificial Sequence: Synthetic oligonucleotide
  Target: FXN; (-) strand; PAM type: YTN; PAM sequence: TTT
attttctgagagtggctccc

SEQ ID NO: 22157 - DNA, 20 bp, Artificial Sequence
  Description of Artificial Sequence: Synthetic oligonucleotide
  Target: FXN; (-) strand; PAM type: YTN; PAM sequence: TTG
gatttattttctgagagtgg

SEQ ID NO: 22158 - DNA, 20 bp, Artificial Sequence
  Description of Artificial Sequence: Synthetic oligonucleotide
  Target: FXN; (-) strand; PAM type: YTN; PAM sequence: TTT
ggatttattttctgagagtg

SEQ ID NO: 22159 - DNA, 20 bp, Artificial Sequence
  Description of Artificial Sequence: Synthetic oligonucleotide
  Target: FXN; (-) strand; PAM type: YTN; PAM sequence: TTC
agtggccagaaaaaaggagg

SEQ ID NO: 22160 - DNA, 20 bp, Artificial Sequence
  Description of Artificial Sequence: Synthetic oligonucleotide
  Target: FXN; (-) strand; PAM type: YTN; PAM sequence: TTT
cagtggccagaaaaaaggag

SEQ ID NO: 22161 - DNA, 20 bp, Artificial Sequence
  Description of Artificial Sequence: Synthetic oligonucleotide
  Target: FXN; (-) strand; PAM type: YTN; PAM sequence: TTG
aacgtttcagtggccagaaa

SEQ ID NO: 22162 - DNA, 20 bp, Artificial Sequence
  Description of Artificial Sequence: Synthetic oligonucleotide
  Target: FXN; (-) strand; PAM type: YTN; PAM sequence: TTA
ttgaacgtttcagtggccag

SEQ ID NO: 22163 - DNA, 20 bp, Artificial Sequence
  Description of Artificial Sequence: Synthetic oligonucleotide
  Target: FXN; (-) strand; PAM type: YTN; PAM sequence: CTA
attattgaacgtttcagtgg

SEQ ID NO: 22164 - DNA, 20 bp, Artificial Sequence
  Description of Artificial Sequence: Synthetic oligonucleotide
  Target: FXN; (-) strand; PAM type: YTN; PAM sequence: TTA
aacatgtgaatgatgtagat

SEQ ID NO: 22165 - DNA, 20 bp, Artificial Sequence
  Description of Artificial Sequence: Synthetic oligonucleotide
  Target: FXN; (-) strand; PAM type: YTN; PAM sequence: TTC
caaagtcaataaatattaaa

SEQ ID NO: 22166 - DNA, 20 bp, Artificial Sequence
  Description of Artificial Sequence: Synthetic oligonucleotide
  Target: FXN; (-) strand; PAM type: YTN; PAM sequence: CTC
agcaaagtaatcaataattc

SEQ ID NO: 22167 - DNA, 20 bp, Artificial Sequence
  Description of Artificial Sequence: Synthetic oligonucleotide
  Target: FXN; (-) strand; PAM type: YTN; PAM sequence: TTC
ataagatactcagcaaagta

SEQ ID NO: 22168 - DNA, 20 bp, Artificial Sequence
  Description of Artificial Sequence: Synthetic oligonucleotide
  Target: FXN; (-) strand; PAM type: YTN; PAM sequence: TTA
aattcataagatactcagca

SEQ ID NO: 22169 - DNA, 20 bp, Artificial Sequence
  Description of Artificial Sequence: Synthetic oligonucleotide
  Target: FXN; (-) strand; PAM type: YTN; PAM sequence: TTA
atatagattaaattcataag

SEQ ID NO: 22170 - DNA, 20 bp, Artificial Sequence
  Description of Artificial Sequence: Synthetic oligonucleotide
  Target: FXN; (-) strand; PAM type: YTN; PAM sequence: TTA
atattaatatagattaaatt

SEQ ID NO: 22171 - DNA, 20 bp, Artificial Sequence
  Description of Artificial Sequence: Synthetic oligonucleotide
  Target: FXN; (-) strand; PAM type: YTN; PAM sequence: CTT
aatattaatatagattaaat

SEQ ID NO: 22172 - DNA, 20 bp, Artificial Sequence
  Description of Artificial Sequence: Synthetic oligonucleotide
  Target: FXN; (-) strand; PAM type: YTN; PAM sequence: TTG
atacatcaccttaatattaa

SEQ ID NO: 22173 - DNA, 20 bp, Artificial Sequence
  Description of Artificial Sequence: Synthetic oligonucleotide
  Target: FXN; (-) strand; PAM type: YTN; PAM sequence: TTT
gatacatcaccttaatatta

SEQ ID NO: 22174 - DNA, 20 bp, Artificial Sequence
  Description of Artificial Sequence: Synthetic oligonucleotide
  Target: FXN; (-) strand; PAM type: YTN; PAM sequence: CTG
gaatgcaatttgatacatca

SEQ ID NO: 22175 - DNA, 20 bp, Artificial Sequence
  Description of Artificial Sequence: Synthetic oligonucleotide
  Target: FXN; (-) strand; PAM type: YTN; PAM sequence: CTC
tggaatgcaatttgatacat

SEQ ID NO: 22176 - DNA, 20 bp, Artificial Sequence
  Description of Artificial Sequence: Synthetic oligonucleotide
  Target: FXN; (-) strand; PAM type: YTN; PAM sequence: CTA
gagtcaaatccacactctgg

SEQ ID NO: 22177 - DNA, 20 bp, Artificial Sequence
  Description of Artificial Sequence: Synthetic oligonucleotide
  Target: FXN; (-) strand; PAM type: YTN; PAM sequence: TTA
tggcactagagtcaaatcca

SEQ ID NO: 22178 - DNA, 20 bp, Artificial Sequence
  Description of Artificial Sequence: Synthetic oligonucleotide
  Target: FXN; (-) strand; PAM type: YTN; PAM sequence: CTG
attatggcactagagtcaaa

SEQ ID NO: 22179 - DNA, 20 bp, Artificial Sequence
  Description of Artificial Sequence: Synthetic oligonucleotide
  Target: FXN; (-) strand; PAM type: YTN; PAM sequence: TTG
tcccaggagactgattatgg

SEQ ID NO: 22180 - DNA, 20 bp, Artificial Sequence
  Description of Artificial Sequence: Synthetic oligonucleotide
  Target: FXN; (-) strand; PAM type: YTN; PAM sequence: TTT
gtcccaggagactgattatg

SEQ ID NO: 22181 - DNA, 20 bp, Artificial Sequence
  Description of Artificial Sequence: Synthetic oligonucleotide
  Target: FXN; (-) strand; PAM type: YTN; PAM sequence: CTG
tttgtcccaggagactgatt

SEQ ID NO: 22182 - DNA, 20 bp, Artificial Sequence
  Description of Artificial Sequence: Synthetic oligonucleotide
  Target: FXN; (-) strand; PAM type: YTN; PAM sequence: CTA
taatgagggaagagaaacag

SEQ ID NO: 22183 - DNA, 20 bp, Artificial Sequence
  Description of Artificial Sequence: Synthetic oligonucleotide
  Target: FXN; (-) strand; PAM type: YTN; PAM sequence: TTC
tataatgagggaagagaaac

SEQ ID NO: 22184 - DNA, 20 bp, Artificial Sequence
  Description of Artificial Sequence: Synthetic oligonucleotide
  Target: FXN; (-) strand; PAM type: YTN; PAM sequence: TTT
ctataatgagggaagagaaa

SEQ ID NO: 22185 - DNA, 20 bp, Artificial Sequence
  Description of Artificial Sequence: Synthetic oligonucleotide
  Target: FXN; (-) strand; PAM type: YTN; PAM sequence: TTT
tctataatgagggaagagaa

SEQ ID NO: 22186 - DNA, 20 bp, Artificial Sequence
  Description of Artificial Sequence: Synthetic oligonucleotide
  Target: FXN; (-) strand; PAM type: YTN; PAM sequence: TTT
ttctataatgagggaagaga

SEQ ID NO: 22187 - DNA, 20 bp, Artificial Sequence
  Description of Artificial Sequence: Synthetic oligonucleotide
  Target: FXN; (-) strand; PAM type: YTN; PAM sequence: TTT
tttctataatgagggaagag

SEQ ID NO: 22188 - DNA, 20 bp, Artificial Sequence
  Description of Artificial Sequence: Synthetic oligonucleotide
  Target: FXN; (-) strand; PAM type: YTN; PAM sequence: TTT
ttttctataatgagggaaga

SEQ ID NO: 22189 - DNA, 20 bp, Artificial Sequence
  Description of Artificial Sequence: Synthetic oligonucleotide
  Target: FXN; (-) strand; PAM type: YTN; PAM sequence: TTG
ccaagggcaatttttttcta

SEQ ID NO: 22190 - DNA, 20 bp, Artificial Sequence
  Description of Artificial Sequence: Synthetic oligonucleotide
  Target: FXN; (-) strand; PAM type: YTN; PAM sequence: TTT
gccaagggcaatttttttct

SEQ ID NO: 22191 - DNA, 20 bp, Artificial Sequence
  Description of Artificial Sequence: Synthetic oligonucleotide
  Target: FXN; (-) strand; PAM type: YTN; PAM sequence: TTG
acatttgccaagggcaattt

SEQ ID NO: 22192 - DNA, 20 bp, Artificial Sequence
  Description of Artificial Sequence: Synthetic oligonucleotide
  Target: FXN; (-) strand; PAM type: YTN; PAM sequence: TTT
gacatttgccaagggcaatt

SEQ ID NO: 22193 - DNA, 20 bp, Artificial Sequence
  Description of Artificial Sequence: Synthetic oligonucleotide
  Target: FXN; (-) strand; PAM type: YTN; PAM sequence: CTT
tgacatttgccaagggcaat

SEQ ID NO: 22194 - DNA, 20 bp, Artificial Sequence
  Description of Artificial Sequence: Synthetic oligonucleotide
  Target: FXN; (-) strand; PAM type: YTN; PAM sequence: TTC
tttgacatttgccaagggca

SEQ ID NO: 22195 - DNA, 20 bp, Artificial Sequence
  Description of Artificial Sequence: Synthetic oligonucleotide
  Target: FXN; (-) strand; PAM type: YTN; PAM sequence: TTG
ataaaaggatgttctttgac

SEQ ID NO: 22196 - DNA, 20 bp, Artificial Sequence
  Description of Artificial Sequence: Synthetic oligonucleotide
  Target: FXN; (-) strand; PAM type: YTN; PAM sequence: TTG
gtaagagagattgataaaag

SEQ ID NO: 22197 - DNA, 20 bp, Artificial Sequence
  Description of Artificial Sequence: Synthetic oligonucleotide
  Target: FXN; (-) strand; PAM type: YTN; PAM sequence: TTG
attggtaagagagattgata

SEQ ID NO: 22198 - DNA, 20 bp, Artificial Sequence
  Description of Artificial Sequence: Synthetic oligonucleotide
  Target: FXN; (-) strand; PAM type: YTN; PAM sequence: TTG
gattgattggtaagagagat

SEQ ID NO: 22199 - DNA, 20 bp, Artificial Sequence
  Description of Artificial Sequence: Synthetic oligonucleotide
  Target: FXN; (-) strand; PAM type: YTN; PAM sequence: CTT
ggattgattggtaagagaga

SEQ ID NO: 22200 - DNA, 20 bp, Artificial Sequence
  Description of Artificial Sequence: Synthetic oligonucleotide
  Target: FXN; (-) strand; PAM type: YTN; PAM sequence: TTG
cttggattgattggtaagag

SEQ ID NO: 22201 - DNA, 20 bp, Artificial Sequence
  Description of Artificial Sequence: Synthetic oligonucleotide
  Target: FXN; (-) strand; PAM type: YTN; PAM sequence: TTT
gcttggattgattggtaaga

SEQ ID NO: 22202 - DNA, 20 bp, Artificial Sequence
  Description of Artificial Sequence: Synthetic oligonucleotide
  Target: FXN; (-) strand; PAM type: YTN; PAM sequence: CTG
catttgcttggattgattgg

SEQ ID NO: 22203 - DNA, 20 bp, Artificial Sequence
  Description of Artificial Sequence: Synthetic oligonucleotide
  Target: FXN; (-) strand; PAM type: YTN; PAM sequence: CTG
gggaaaagaaatcccactgc

SEQ ID NO: 22204 - DNA, 20 bp, Artificial Sequence
  Description of Artificial Sequence: Synthetic oligonucleotide
  Target: FXN; (-) strand; PAM type: YTN; PAM sequence: CTC
tggggaaaagaaatcccact

SEQ ID NO: 22205 - DNA, 20 bp, Artificial Sequence
  Description of Artificial Sequence: Synthetic oligonucleotide
  Target: FXN; (-) strand; PAM type: YTN; PAM sequence: TTC
aactctggggaaaagaaatc

SEQ ID NO: 22206 - DNA, 20 bp, Artificial Sequence
  Description of Artificial Sequence: Synthetic oligonucleotide
  Target: FXN; (-) strand; PAM type: YTN; PAM sequence: CTT
caactctggggaaaagaaat

SEQ ID NO: 22207 - DNA, 20 bp, Artificial Sequence
  Description of Artificial Sequence: Synthetic oligonucleotide
  Target: FXN; (-) strand; PAM type: YTN; PAM sequence: CTG
tcaggaggtgacttcaactc

SEQ ID NO: 22208 - DNA, 20 bp, Artificial Sequence
  Description of Artificial Sequence: Synthetic oligonucleotide
  Target: FXN; (-) strand; PAM type: YTN; PAM sequence: TTC
ctgtcaggaggtgacttcaa

SEQ ID NO: 22209 - DNA, 20 bp, Artificial Sequence
  Description of Artificial Sequence: Synthetic oligonucleotide
  Target: FXN; (-) strand; PAM type: YTN; PAM sequence: CTT
cctgtcaggaggtgacttca

SEQ ID NO: 22210 - DNA, 20 bp, Artificial Sequence
  Description of Artificial Sequence: Synthetic oligonucleotide
  Target: FXN; (-) strand; PAM type: YTN; PAM sequence: TTA
acttcctgtcaggaggtgac

SEQ ID NO: 22211 - DNA, 20 bp, Artificial Sequence
  Description of Artificial Sequence: Synthetic oligonucleotide
  Target: FXN; (-) strand; PAM type: YTN; PAM sequence: CTT
aacttcctgtcaggaggtga

SEQ ID NO: 22212 - DNA, 20 bp, Artificial Sequence
  Description of Artificial Sequence: Synthetic oligonucleotide
  Target: FXN; (-) strand; PAM type: YTN; PAM sequence: CTA
aagacttaacttcctgtcag

SEQ ID NO: 22213 - DNA, 20 bp, Artificial Sequence
  Description of Artificial Sequence: Synthetic oligonucleotide
  Target: FXN; (-) strand; PAM type: YTN; PAM sequence: TTC
agtgcctaaagacttaactt

SEQ ID NO: 22214 - DNA, 20 bp, Artificial Sequence
  Description of Artificial Sequence: Synthetic oligonucleotide
  Target: FXN; (-) strand; PAM type: YTN; PAM sequence: CTA
tgattcagtgcctaaagact

SEQ ID NO: 22215 - DNA, 20 bp, Artificial Sequence
  Description of Artificial Sequence: Synthetic oligonucleotide
  Target: FXN; (-) strand; PAM type: YTN; PAM sequence: CTC
agtgctatgattcagtgcct

SEQ ID NO: 22216 - DNA, 20 bp, Artificial Sequence
  Description of Artificial Sequence: Synthetic oligonucleotide
  Target: FXN; (-) strand; PAM type: YTN; PAM sequence: TTC
agctcagtgctatgattcag

SEQ ID NO: 22217 - DNA, 20 bp, Artificial Sequence
  Description of Artificial Sequence: Synthetic oligonucleotide
  Target: FXN; (-) strand; PAM type: YTN; PAM sequence: CTT
cagctcagtgctatgattca

SEQ ID NO: 22218 - DNA, 20 bp, Artificial Sequence
  Description of Artificial Sequence: Synthetic oligonucleotide
  Target: FXN; (-) strand; PAM type: YTN; PAM sequence: CTG
ggcttcagctcagtgctatg

SEQ ID NO: 22219 - DNA, 20 bp, Artificial Sequence
  Description of Artificial Sequence: Synthetic oligonucleotide
  Target: FXN; (-) strand; PAM type: YTN; PAM sequence: TTA
gtcctgggcttcagctcagt

SEQ ID NO: 22220 - DNA, 20 bp, Artificial Sequence
  Description of Artificial Sequence: Synthetic oligonucleotide
  Target: FXN; (-) strand; PAM type: YTN; PAM sequence: CTT
agtcctgggcttcagctcag

SEQ ID NO: 22221 - DNA, 20 bp, Artificial Sequence
  Description of Artificial Sequence: Synthetic oligonucleotide
  Target: FXN; (-) strand; PAM type: YTN; PAM sequence: TTG
cttagtcctgggcttcagct

SEQ ID NO: 22222 - DNA, 20 bp, Artificial Sequence
  Description of Artificial Sequence: Synthetic oligonucleotide
  Target: FXN; (-) strand; PAM type: YTN; PAM sequence: CTT
gcttagtcctgggcttcagc

SEQ ID NO: 22223 - DNA, 20 bp, Artificial Sequence
  Description of Artificial Sequence: Synthetic oligonucleotide
  Target: FXN; (-) strand; PAM type: YTN; PAM sequence: TTC
ttgcttagtcctgggcttca

SEQ ID NO: 22224 - DNA, 20 bp, Artificial Sequence
  Description of Artificial Sequence: Synthetic oligonucleotide
  Target: FXN; (-) strand; PAM type: YTN; PAM sequence: CTC
attcttgcttagtcctgggc

SEQ ID NO: 22225 - DNA, 20 bp, Artificial Sequence
  Description of Artificial Sequence: Synthetic oligonucleotide
  Target: FXN; (-) strand; PAM type: YTN; PAM sequence: CTC
actcattcttgcttagtcct

SEQ ID NO: 22226 - DNA, 20 bp, Artificial Sequence
  Description of Artificial Sequence: Synthetic oligonucleotide
  Target: FXN; (-) strand; PAM type: YTN; PAM sequence: TTC
tcactcattcttgcttagtc

SEQ ID NO: 22227 - DNA, 20 bp, Artificial Sequence
  Description of Artificial Sequence: Synthetic oligonucleotide
  Target: FXN; (-) strand; PAM type: YTN; PAM sequence: CTC
caaattctcactcattcttg

SEQ ID NO: 22228 - DNA, 20 bp, Artificial Sequence
  Description of Artificial Sequence: Synthetic oligonucleotide
  Target: FXN; (-) strand; PAM type: YTN; PAM sequence: TTA
agtctccaaattctcactca

SEQ ID NO: 22229 - DNA, 20 bp, Artificial Sequence
  Description of Artificial Sequence: Synthetic oligonucleotide
  Target: FXN; (-) strand; PAM type: YTN; PAM sequence: CTT
aagtctccaaattctcactc

SEQ ID NO: 22230 - DNA, 20 bp, Artificial Sequence
  Description of Artificial Sequence: Synthetic oligonucleotide
  Target: FXN; (-) strand; PAM type: YTN; PAM sequence: CTA
cagatgaccaaaccttaagt

SEQ ID NO: 22231 - DNA, 20 bp, Artificial Sequence
  Description of Artificial Sequence: Synthetic oligonucleotide
  Target: FXN; (-) strand; PAM type: YTN; PAM sequence: CTC
tacagatgaccaaaccttaa

SEQ ID NO: 22232 - DNA, 20 bp, Artificial Sequence
  Description of Artificial Sequence: Synthetic oligonucleotide
  Target: FXN; (-) strand; PAM type: YTN; PAM sequence: TTG
caggacaccaaaacaaaaac

SEQ ID NO: 22233 - DNA, 20 bp, Artificial Sequence
  Description of Artificial Sequence: Synthetic oligonucleotide
  Target: FXN; (-) strand; PAM type: YTN; PAM sequence: CTT
gcaggacaccaaaacaaaaa

SEQ ID NO: 22234 - DNA, 20 bp, Artificial Sequence
  Description of Artificial Sequence: Synthetic oligonucleotide
  Target: FXN; (-) strand; PAM type: YTN; PAM sequence: CTG
atgaagggcagtgagaaacc

SEQ ID NO: 22235 - DNA, 20 bp, Artificial Sequence
  Description of Artificial Sequence: Synthetic oligonucleotide
  Target: FXN; (-) strand; PAM type: YTN; PAM sequence: TTA
cctgatgaagggcagtgaga

SEQ ID NO: 22236 - DNA, 20 bp, Artificial Sequence
  Description of Artificial Sequence: Synthetic oligonucleotide
  Target: FXN; (-) strand; PAM type: YTN; PAM sequence: TTC
agggacagggcatattacct

SEQ ID NO: 22237 - DNA, 20 bp, Artificial Sequence
  Description of Artificial Sequence: Synthetic oligonucleotide
  Target: FXN; (-) strand; PAM type: YTN; PAM sequence: TTG
gccagttcagggacagggca

SEQ ID NO: 22238 - DNA, 20 bp, Artificial Sequence
  Description of Artificial Sequence: Synthetic oligonucleotide
  Target: FXN; (-) strand; PAM type: YTN; PAM sequence: CTA
agggaatggggtaacacaat

SEQ ID NO: 22239 - DNA, 20 bp, Artificial Sequence
  Description of Artificial Sequence: Synthetic oligonucleotide
  Target: FXN; (-) strand; PAM type: YTN; PAM sequence: TTG
ctaagggaatggggtaacac

SEQ ID NO: 22240 - DNA, 20 bp, Artificial Sequence
  Description of Artificial Sequence: Synthetic oligonucleotide
  Target: FXN; (-) strand; PAM type: YTN; PAM sequence: CTG
ttgctaagggaatggggtaa

SEQ ID NO: 22241 - DNA, 20 bp, Artificial Sequence
  Description of Artificial Sequence: Synthetic oligonucleotide
  Target: FXN; (-) strand; PAM type: YTN; PAM sequence: TTC
agtagcaatcactgttgcta

SEQ ID NO: 22242 - DNA, 20 bp, Artificial Sequence
  Description of Artificial Sequence: Synthetic oligonucleotide
  Target: FXN; (-) strand; PAM type: YTN; PAM sequence: CTT
cagtagcaatcactgttgct

SEQ ID NO: 22243 - DNA, 20 bp, Artificial Sequence
  Description of Artificial Sequence: Synthetic oligonucleotide
  Target: FXN; (-) strand; PAM type: YTN; PAM sequence: TTC
ttcagtagcaatcactgttg

SEQ ID NO: 22244 - DNA, 20 bp, Artificial Sequence
  Description of Artificial Sequence: Synthetic oligonucleotide
  Target: FXN; (-) strand; PAM type: YTN; PAM sequence: TTT
cttcagtagcaatcactgtt

SEQ ID NO: 22245 - DNA, 20 bp, Artificial Sequence
  Description of Artificial Sequence: Synthetic oligonucleotide
  Target: FXN; (-) strand; PAM type: YTN; PAM sequence: CTG
tttcttcagtagcaatcact

SEQ ID NO: 22246 - DNA, 20 bp, Artificial Sequence
  Description of Artificial Sequence: Synthetic oligonucleotide
  Target: FXN; (-) strand; PAM type: YTN; PAM sequence: CTC
ctgtttcttcagtagcaatc

SEQ ID NO: 22247 - DNA, 20 bp, Artificial Sequence
  Description of Artificial Sequence: Synthetic oligonucleotide
  Target: FXN; (-) strand; PAM type: YTN; PAM sequence: TTG
gcctcctgtttcttcagtag

SEQ ID NO: 22248 - DNA, 20 bp, Artificial Sequence
  Description of Artificial Sequence: Synthetic oligonucleotide
  Target: FXN; (-) strand; PAM type: YTN; PAM sequence: TTG
ttggcctcctgtttcttcag

SEQ ID NO: 22249 - DNA, 20 bp, Artificial Sequence
  Description of Artificial Sequence: Synthetic oligonucleotide
  Target: FXN; (-) strand; PAM type: YTN; PAM sequence: TTT
gttggcctcctgtttcttca

SEQ ID NO: 22250 - DNA, 20 bp, Artificial Sequence
  Description of Artificial Sequence: Synthetic oligonucleotide
  Target: FXN; (-) strand; PAM type: YTN; PAM sequence: CTT
tgttggcctcctgtttcttc

SEQ ID NO: 22251 - DNA, 20 bp, Artificial Sequence
  Description of Artificial Sequence: Synthetic oligonucleotide
  Target: FXN; (-) strand; PAM type: YTN; PAM sequence: TTC
tttgttggcctcctgtttct

SEQ ID NO: 22252 - DNA, 20 bp, Artificial Sequence
  Description of Artificial Sequence: Synthetic oligonucleotide
  Target: FXN; (-) strand; PAM type: YTN; PAM sequence: CTG
gtgaatgagtgatattcttt

SEQ ID NO: 22253 - DNA, 20 bp, Artificial Sequence
  Description of Artificial Sequence: Synthetic oligonucleotide
  Target: FXN; (-) strand; PAM type: YTN; PAM sequence: CTA
ctggtgaatgagtgatattc

SEQ ID NO: 22254 - DNA, 20 bp, Artificial Sequence
  Description of Artificial Sequence: Synthetic oligonucleotide
  Target: FXN; (-) strand; PAM type: YTN; PAM sequence: CTC
tactggtgaatgagtgatat

SEQ ID NO: 22255 - DNA, 20 bp, Artificial Sequence
  Description of Artificial Sequence: Synthetic oligonucleotide
  Target: FXN; (-) strand; PAM type: YTN; PAM sequence: CTG
acatagacactctactggtg

SEQ ID NO: 22256 - DNA, 20 bp, Artificial Sequence
  Description of Artificial Sequence: Synthetic oligonucleotide
  Target: FXN; (-) strand; PAM type: YTN; PAM sequence: CTC
tgacatagacactctactgg

SEQ ID NO: 22257 - DNA, 20 bp, Artificial Sequence
  Description of Artificial Sequence: Synthetic oligonucleotide
  Target: FXN; (-) strand; PAM type: YTN; PAM sequence: CTA
atatctctgacatagacact

SEQ ID NO: 22258 - DNA, 20 bp, Artificial Sequence
  Description of Artificial Sequence: Synthetic oligonucleotide
  Target: FXN; (-) strand; PAM type: YTN; PAM sequence: TTA
tctaatatctctgacataga

SEQ ID NO: 22259 - DNA, 20 bp, Artificial Sequence
  Description of Artificial Sequence: Synthetic oligonucleotide
  Target: FXN; (-) strand; PAM type: YTN; PAM sequence: TTT
atctaatatctctgacatag

SEQ ID NO: 22260 - DNA, 20 bp, Artificial Sequence
  Description of Artificial Sequence: Synthetic oligonucleotide
  Target: FXN; (-) strand; PAM type: YTN; PAM sequence: CTG
tttatctaatatctctgaca

SEQ ID NO: 22261 - DNA, 20 bp, Artificial Sequence
  Description of Artificial Sequence: Synthetic oligonucleotide
  Target: FXN; (-) strand; PAM type: YTN; PAM sequence: TTC
ctgtttatctaatatctctg

SEQ ID NO: 22262 - DNA, 20 bp, Artificial Sequence
  Description of Artificial Sequence: Synthetic oligonucleotide
  Target: FXN; (-) strand; PAM type: YTN; PAM sequence: TTT
cctgtttatctaatatctct

SEQ ID NO: 22263 - DNA, 20 bp, Artificial Sequence
  Description of Artificial Sequence: Synthetic oligonucleotide
  Target: FXN; (-) strand; PAM type: YTN; PAM sequence: TTT
tcctgtttatctaatatctc

SEQ ID NO: 22264 - DNA, 20 bp, Artificial Sequence
  Description of Artificial Sequence: Synthetic oligonucleotide
  Target: FXN; (-) strand; PAM type: YTN; PAM sequence: TTA
gttttcctgtttatctaata

SEQ ID NO: 22265 - DNA, 20 bp, Artificial Sequence
  Description of Artificial Sequence: Synthetic oligonucleotide
  Target: FXN; (-) strand; PAM type: YTN; PAM sequence: TTG
ttagttttcctgtttatcta

SEQ ID NO: 22266 - DNA, 20 bp, Artificial Sequence
  Description of Artificial Sequence: Synthetic oligonucleotide
  Target: FXN; (-) strand; PAM type: YTN; PAM sequence: CTG
caatgtaattgttagttttc

SEQ ID NO: 22267 - DNA, 20 bp, Artificial Sequence
  Description of Artificial Sequence: Synthetic oligonucleotide
  Target: FXN; (-) strand; PAM type: YTN; PAM sequence: TTC
cacagcctgcaatgtaattg

SEQ ID NO: 22268 - DNA, 20 bp, Artificial Sequence
  Description of Artificial Sequence: Synthetic oligonucleotide
  Target: FXN; (-) strand; PAM type: YTN; PAM sequence: TTT
ccacagcctgcaatgtaatt

SEQ ID NO: 22269 - DNA, 20 bp, Artificial Sequence
  Description of Artificial Sequence: Synthetic oligonucleotide
  Target: FXN; (-) strand; PAM type: YTN; PAM sequence: CTG
tttccacagcctgcaatgta

SEQ ID NO: 22270 - DNA, 20 bp, Artificial Sequence
  Description of Artificial Sequence: Synthetic oligonucleotide
  Target: FXN; (-) strand; PAM type: YTN; PAM sequence: CTC
tgtttccacagcctgcaatg

SEQ ID NO: 22271 - DNA, 20 bp, Artificial Sequence
  Description of Artificial Sequence: Synthetic oligonucleotide
  Target: FXN; (-) strand; PAM type: YTN; PAM sequence: CTC
tctgtttccacagcctgcaa

SEQ ID NO: 22272 - DNA, 20 bp, Artificial Sequence
  Description of Artificial Sequence: Synthetic oligonucleotide
  Target: FXN; (-) strand; PAM type: YTN; PAM sequence: CTC
tctctgtttccacagcctgc

SEQ ID NO: 22273 - DNA, 20 bp, Artificial Sequence
  Description of Artificial Sequence: Synthetic oligonucleotide
  Target: FXN; (-) strand; PAM type: YTN; PAM sequence: TTA
ggtacctctctctgtttcca

SEQ ID NO: 22274 - DNA, 20 bp, Artificial Sequence
  Description of Artificial Sequence: Synthetic oligonucleotide
  Target: FXN; (-) strand; PAM type: YTN; PAM sequence: CTT
aggtacctctctctgtttcc

SEQ ID NO: 22275 - DNA, 20 bp, Artificial Sequence
  Description of Artificial Sequence: Synthetic oligonucleotide
  Target: FXN; (-) strand; PAM type: YTN; PAM sequence: TTC
ccacaggtgtgccttaggta

SEQ ID NO: 22276 - DNA, 20 bp, Artificial Sequence
  Description of Artificial Sequence: Synthetic oligonucleotide
  Target: FXN; (-) strand; PAM type: YTN; PAM sequence: TTC
atattcccacaggtgtgcct

SEQ ID NO: 22277 - DNA, 20 bp, Artificial Sequence
  Description of Artificial Sequence: Synthetic oligonucleotide
  Target: FXN; (-) strand; PAM type: YTN; PAM sequence: TTT
catattcccacaggtgtgcc

SEQ ID NO: 22278 - DNA, 20 bp, Artificial Sequence
  Description of Artificial Sequence: Synthetic oligonucleotide
  Target: FXN; (-) strand; PAM type: YTN; PAM sequence: CTT
tcatattcccacaggtgtgc

SEQ ID NO: 22279 - DNA, 20 bp, Artificial Sequence
  Description of Artificial Sequence: Synthetic oligonucleotide
  Target: FXN; (-) strand; PAM type: YTN; PAM sequence: TTA
tgaaaccaaactttcatatt

SEQ ID NO: 22280 - DNA, 20 bp, Artificial Sequence
  Description of Artificial Sequence: Synthetic oligonucleotide
  Target: FXN; (-) strand; PAM type: YTN; PAM sequence: TTT
atgaaaccaaactttcatat

SEQ ID NO: 22281 - DNA, 20 bp, Artificial Sequence
  Description of Artificial Sequence: Synthetic oligonucleotide
  Target: FXN; (-) strand; PAM type: YTN; PAM sequence: TTT
tatgaaaccaaactttcata

SEQ ID NO: 22282 - DNA, 20 bp, Artificial Sequence
  Description of Artificial Sequence: Synthetic oligonucleotide
  Target: FXN; (-) strand; PAM type: YTN; PAM sequence: CTT
ttatgaaaccaaactttcat

SEQ ID NO: 22283 - DNA, 20 bp, Artificial Sequence
  Description of Artificial Sequence: Synthetic oligonucleotide
  Target: FXN; (-) strand; PAM type: YTN; PAM sequence: CTC
cagaatccttttatgaaacc

SEQ ID NO: 22284 - DNA, 20 bp, Artificial Sequence
  Description of Artificial Sequence: Synthetic oligonucleotide
  Target: FXN; (-) strand; PAM type: YTN; PAM sequence: TTC
ctccagaatccttttatgaa

SEQ ID NO: 22285 - DNA, 20 bp, Artificial Sequence
  Description of Artificial Sequence: Synthetic oligonucleotide
  Target: FXN; (-) strand; PAM type: YTN; PAM sequence: CTT
cctccagaatccttttatga

SEQ ID NO: 22286 - DNA, 20 bp, Artificial Sequence
  Description of Artificial Sequence: Synthetic oligonucleotide
  Target: FXN; (-) strand; PAM type: YTN; PAM sequence: CTC
aaatgtcagaggtgacttcc

SEQ ID NO: 22287 - DNA, 20 bp, Artificial Sequence
  Description of Artificial Sequence: Synthetic oligonucleotide
  Target: FXN; (-) strand; PAM type: YTN; PAM sequence: CTC
aactcaaatgtcagaggtga

SEQ ID NO: 22288 - DNA, 20 bp, Artificial Sequence
  Description of Artificial Sequence: Synthetic oligonucleotide
  Target: FXN; (-) strand; PAM type: YTN; PAM sequence: CTG
taggactcaactcaaatgtc

SEQ ID NO: 22289 - DNA, 20 bp, Artificial Sequence
  Description of Artificial Sequence: Synthetic oligonucleotide
  Target: FXN; (-) strand; PAM type: YTN; PAM sequence: TTC
atatcctgtaggactcaact

SEQ ID NO: 22290 - DNA, 20 bp, Artificial Sequence
  Description of Artificial Sequence: Synthetic oligonucleotide
  Target: FXN; (-) strand; PAM type: YTN; PAM sequence: CTT
catatcctgtaggactcaac

SEQ ID NO: 22291 - DNA, 20 bp, Artificial Sequence
  Description of Artificial Sequence: Synthetic oligonucleotide
  Target: FXN; (-) strand; PAM type: YTN; PAM sequence: TTC
ttcatatcctgtaggactca

SEQ ID NO: 22292 - DNA, 20 bp, Artificial Sequence
  Description of Artificial Sequence: Synthetic oligonucleotide
  Target: FXN; (-) strand; PAM type: YTN; PAM sequence: TTT
cttcatatcctgtaggactc

SEQ ID NO: 22293 - DNA, 20 bp, Artificial Sequence
  Description of Artificial Sequence: Synthetic oligonucleotide
  Target: FXN; (-) strand; PAM type: YTN; PAM sequence: CTT
tcttcatatcctgtaggact

SEQ ID NO: 22294 - DNA, 20 bp, Artificial Sequence
  Description of Artificial Sequence: Synthetic oligonucleotide
  Target: FXN; (-) strand; PAM type: YTN; PAM sequence: CTA
ctttcttcatatcctgtagg

SEQ ID NO: 22295 - DNA, 20 bp, Artificial Sequence
  Description of Artificial Sequence: Synthetic oligonucleotide
  Target: FXN; (-) strand; PAM type: YTN; PAM sequence: TTA
cacagccatagtaaccggaa

SEQ ID NO: 22296 - DNA, 20 bp, Artificial Sequence
  Description of Artificial Sequence: Synthetic oligonucleotide
  Target: FXN; (-) strand; PAM type: YTN; PAM sequence: TTA
ttacacagccatagtaaccg

SEQ ID NO: 22297 - DNA, 20 bp, Artificial Sequence
  Description of Artificial Sequence: Synthetic oligonucleotide
  Target: FXN; (-) strand; PAM type: YTN; PAM sequence: TTT
attacacagccatagtaacc

SEQ ID NO: 22298 - DNA, 20 bp, Artificial Sequence
  Description of Artificial Sequence: Synthetic oligonucleotide
  Target: FXN; (-) strand; PAM type: YTN; PAM sequence: TTA
ggtaatttattacacagcca

SEQ ID NO: 22299 - DNA, 20 bp, Artificial Sequence
  Description of Artificial Sequence: Synthetic oligonucleotide
  Target: FXN; (-) strand; PAM type: YTN; PAM sequence: TTT
aggtaatttattacacagcc

SEQ ID NO: 22300 - DNA, 20 bp, Artificial Sequence
  Description of Artificial Sequence: Synthetic oligonucleotide
  Target: FXN; (-) strand; PAM type: YTN; PAM sequence: TTT
taggtaatttattacacagc

SEQ ID NO: 22301 - DNA, 20 bp, Artificial Sequence
  Description of Artificial Sequence: Synthetic oligonucleotide
  Target: FXN; (-) strand; PAM type: YTN; PAM sequence: TTA
atccagtatgttttaggtaa

SEQ ID NO: 22302 - DNA, 20 bp, Artificial Sequence
  Description of Artificial Sequence: Synthetic oligonucleotide
  Target: FXN; (-) strand; PAM type: YTN; PAM sequence: TTT
aatccagtatgttttaggta

SEQ ID NO: 22303 - DNA, 20 bp, Artificial Sequence
  Description of Artificial Sequence: Synthetic oligonucleotide
  Target: FXN; (-) strand; PAM type: YTN; PAM sequence: CTT
taatccagtatgttttaggt

SEQ ID NO: 22304 - DNA, 20 bp, Artificial Sequence
  Description of Artificial Sequence: Synthetic oligonucleotide
  Target: FXN; (-) strand; PAM type: YTN; PAM sequence: TTC
atagctttaatccagtatgt

SEQ ID NO: 22305 - DNA, 20 bp, Artificial Sequence
  Description of Artificial Sequence: Synthetic oligonucleotide
  Target: FXN; (-) strand; PAM type: YTN; PAM sequence: TTT
catagctttaatccagtatg

SEQ ID NO: 22306 - DNA, 20 bp, Artificial Sequence
  Description of Artificial Sequence: Synthetic oligonucleotide
  Target: FXN; (-) strand; PAM type: YTN; PAM sequence: TTT
tcatagctttaatccagtat

SEQ ID NO: 22307 - DNA, 20 bp, Artificial Sequence
  Description of Artificial Sequence: Synthetic oligonucleotide
  Target: FXN; (-) strand; PAM type: YTN; PAM sequence: CTG
ggcagaaaagatgttttcat

SEQ ID NO: 22308 - DNA, 20 bp, Artificial Sequence
  Description of Artificial Sequence: Synthetic oligonucleotide
  Target: FXN; (-) strand; PAM type: YTN; PAM sequence: CTC
tgggcagaaaagatgttttc

SEQ ID NO: 22309 - DNA, 20 bp, Artificial Sequence
  Description of Artificial Sequence: Synthetic oligonucleotide
  Target: FXN; (-) strand; PAM type: YTN; PAM sequence: TTC
aggcccacagaatctctggg

SEQ ID NO: 22310 - DNA, 20 bp, Artificial Sequence
  Description of Artificial Sequence: Synthetic oligonucleotide
  Target: FXN; (-) strand; PAM type: YTN; PAM sequence: TTT
caggcccacagaatctctgg

SEQ ID NO: 22311 - DNA, 20 bp, Artificial Sequence
  Description of Artificial Sequence: Synthetic oligonucleotide
  Target: FXN; (-) strand; PAM type: YTN; PAM sequence: TTC
catgtgaatttcaggcccac

SEQ ID NO: 22312 - DNA, 20 bp, Artificial Sequence
  Description of Artificial Sequence: Synthetic oligonucleotide
  Target: FXN; (-) strand; PAM type: YTN; PAM sequence: TTA
tgtgttccatgtgaatttca

SEQ ID NO: 22313 - DNA, 20 bp, Artificial Sequence
  Description of Artificial Sequence: Synthetic oligonucleotide
  Target: FXN; (-) strand; PAM type: YTN; PAM sequence: CTT
atgtgttccatgtgaatttc

SEQ ID NO: 22314 - DNA, 20 bp, Artificial Sequence
  Description of Artificial Sequence: Synthetic oligonucleotide
  Target: FXN; (-) strand; PAM type: YTN; PAM sequence: TTA
gacatcatggagcagaaaca

SEQ ID NO: 22315 - DNA, 20 bp, Artificial Sequence
  Description of Artificial Sequence: Synthetic oligonucleotide
  Target: FXN; (-) strand; PAM type: YTN; PAM sequence: CTT
agacatcatggagcagaaac

SEQ ID NO: 22316 - DNA, 20 bp, Artificial Sequence
  Description of Artificial Sequence: Synthetic oligonucleotide
  Target: FXN; (-) strand; PAM type: YTN; PAM sequence: CTG
aatccttagacatcatggag

SEQ ID NO: 22317 - DNA, 20 bp, Artificial Sequence
  Description of Artificial Sequence: Synthetic oligonucleotide
  Target: FXN; (-) strand; PAM type: YTN; PAM sequence: TTC
cagctgaatccttagacatc

SEQ ID NO: 22318 - DNA, 20 bp, Artificial Sequence
  Description of Artificial Sequence: Synthetic oligonucleotide
  Target: FXN; (-) strand; PAM type: YTN; PAM sequence: CTT
ccagctgaatccttagacat

SEQ ID NO: 22319 - DNA, 20 bp, Artificial Sequence
  Description of Artificial Sequence: Synthetic oligonucleotide
  Target: FXN; (-) strand; PAM type: YTN; PAM sequence: CTC
ccagtcttccagctgaatcc

SEQ ID NO: 22320 - DNA, 20 bp, Artificial Sequence
  Description of Artificial Sequence: Synthetic oligonucleotide
  Target: FXN; (-) strand; PAM type: YTN; PAM sequence: TTC
cagcccccagcctcccagtc

SEQ ID NO: 22321 - DNA, 20 bp, Artificial Sequence
  Description of Artificial Sequence: Synthetic oligonucleotide
  Target: FXN; (-) strand; PAM type: YTN; PAM sequence: TTC
agataaattccagcccccag

SEQ ID NO: 22322 - DNA, 20 bp, Artificial Sequence
  Description of Artificial Sequence: Synthetic oligonucleotide
  Target: FXN; (-) strand; PAM type: YTN; PAM sequence: CTT
cagataaattccagccccca

SEQ ID NO: 22323 - DNA, 20 bp, Artificial Sequence
  Description of Artificial Sequence: Synthetic oligonucleotide
  Target: FXN; (-) strand; PAM type: YTN; PAM sequence: TTC
ttcagataaattccagcccc

SEQ ID NO: 22324 - DNA, 20 bp, Artificial Sequence
  Description of Artificial Sequence: Synthetic oligonucleotide
  Target: FXN; (-) strand; PAM type: YTN; PAM sequence: CTC
agccaacagccagggtcaac

SEQ ID NO: 22325 - DNA, 20 bp, Artificial Sequence
  Description of Artificial Sequence: Synthetic oligonucleotide
  Target: FXN; (-) strand; PAM type: YTN; PAM sequence: CTG
aggccccctcagccaacagc

SEQ ID NO: 22326 - DNA, 20 bp, Artificial Sequence
  Description of Artificial Sequence: Synthetic oligonucleotide
  Target: FXN; (-) strand; PAM type: YTN; PAM sequence: CTA
gccaaagtagagaaacaatg

SEQ ID NO: 22327 - DNA, 20 bp, Artificial Sequence
  Description of Artificial Sequence: Synthetic oligonucleotide
  Target: FXN; (-) strand; PAM type: YTN; PAM sequence: TTG
aggaaatccaaactagccaa

SEQ ID NO: 22328 - DNA, 20 bp, Artificial Sequence
  Description of Artificial Sequence: Synthetic oligonucleotide
  Target: FXN; (-) strand; PAM type: YTN; PAM sequence: TTT
gaggaaatccaaactagcca

SEQ ID NO: 22329 - DNA, 20 bp, Artificial Sequence
  Description of Artificial Sequence: Synthetic oligonucleotide
  Target: FXN; (-) strand; PAM type: YTN; PAM sequence: TTT
tgaggaaatccaaactagcc

SEQ ID NO: 22330 - DNA, 20 bp, Artificial Sequence
  Description of Artificial Sequence: Synthetic oligonucleotide
  Target: FXN; (-) strand; PAM type: YTN; PAM sequence: CTG
aggaccagccatcatgtttt

SEQ ID NO: 22331 - DNA, 20 bp, Artificial Sequence
  Description of Artificial Sequence: Synthetic oligonucleotide
  Target: FXN; (-) strand; PAM type: YTN; PAM sequence: CTG
acactgaggaccagccatca

SEQ ID NO: 22332 - DNA, 20 bp, Artificial Sequence
  Description of Artificial Sequence: Synthetic oligonucleotide
  Target: FXN; (-) strand; PAM type: YTN; PAM sequence: TTG
ggatgctgacactgaggacc

SEQ ID NO: 22333 - DNA, 20 bp, Artificial Sequence
  Description of Artificial Sequence: Synthetic oligonucleotide
  Target: FXN; (-) strand; PAM type: YTN; PAM sequence: TTT
gggatgctgacactgaggac

SEQ ID NO: 22334 - DNA, 20 bp, Artificial Sequence
  Description of Artificial Sequence: Synthetic oligonucleotide
  Target: FXN; (-) strand; PAM type: YTN; PAM sequence: TTT
tgggatgctgacactgagga

SEQ ID NO: 22335 - DNA, 20 bp, Artificial Sequence
  Description of Artificial Sequence: Synthetic oligonucleotide
  Target: FXN; (-) strand; PAM type: YTN; PAM sequence: TTT
ttgggatgctgacactgagg

SEQ ID NO: 22336 - DNA, 20 bp, Artificial Sequence
  Description of Artificial Sequence: Synthetic oligonucleotide
  Target: FXN; (-) strand; PAM type: YTN; PAM sequence: CTT
tttgggatgctgacactgag

SEQ ID NO: 22337 - DNA, 20 bp, Artificial Sequence
  Description of Artificial Sequence: Synthetic oligonucleotide
  Target: FXN; (-) strand; PAM type: YTN; PAM sequence: CTC
tttttgggatgctgacactg

SEQ ID NO: 22338 - DNA, 20 bp, Artificial Sequence
  Description of Artificial Sequence: Synthetic oligonucleotide
  Target: FXN; (-) strand; PAM type: YTN; PAM sequence: TTC
tctttttgggatgctgacac

SEQ ID NO: 22339 - DNA, 20 bp, Artificial Sequence
  Description of Artificial Sequence: Synthetic oligonucleotide
  Target: FXN; (-) strand; PAM type: YTN; PAM sequence: CTG
tgtccggcattctctttttg

SEQ ID NO: 22340 - DNA, 20 bp, Artificial Sequence
  Description of Artificial Sequence: Synthetic oligonucleotide
  Target: FXN; (-) strand; PAM type: YTN; PAM sequence: TTA
caggtgtgagccactgtgtc

SEQ ID NO: 22341 - DNA, 20 bp, Artificial Sequence
  Description of Artificial Sequence: Synthetic oligonucleotide
  Target: FXN; (-) strand; PAM type: YTN; PAM sequence: CTG
aggttacaggtgtgagccac

SEQ ID NO: 22342 - DNA, 20 bp, Artificial Sequence
  Description of Artificial Sequence: Synthetic oligonucleotide
  Target: FXN; (-) strand; PAM type: YTN; PAM sequence: TTG
ctgaggttacaggtgtgagc

SEQ ID NO: 22343 - DNA, 20 bp, Artificial Sequence
  Description of Artificial Sequence: Synthetic oligonucleotide
  Target: FXN; (-) strand; PAM type: YTN; PAM sequence: CTC
ccaaattgctgaggttacag

SEQ ID NO: 22344 - DNA, 20 bp, Artificial Sequence
  Description of Artificial Sequence: Synthetic oligonucleotide
  Target: FXN; (-) strand; PAM type: YTN; PAM sequence: CTC
agcctcccaaattgctgagg

SEQ ID NO: 22345 - DNA, 20 bp, Artificial Sequence
  Description of Artificial Sequence: Synthetic oligonucleotide
  Target: FXN; (-) strand; PAM type: YTN; PAM sequence: CTC
ccacctcagcctcccaaatt

SEQ ID NO: 22346 - DNA, 20 bp, Artificial Sequence
  Description of Artificial Sequence: Synthetic oligonucleotide
  Target: FXN; (-) strand; PAM type: YTN; PAM sequence: CTC
aagcaacctcccacctcagc

SEQ ID NO: 22347 - DNA, 20 bp, Artificial Sequence
  Description of Artificial Sequence: Synthetic oligonucleotide
  Target: FXN; (-) strand; PAM type: YTN; PAM sequence: CTG
aactcaagcaacctcccacc

SEQ ID NO: 22348 - DNA, 20 bp, Artificial Sequence
  Description of Artificial Sequence: Synthetic oligonucleotide
  Target: FXN; (-) strand; PAM type: YTN; PAM sequence: CTC
ctgaactcaagcaacctccc

SEQ ID NO: 22349 - DNA, 20 bp, Artificial Sequence
  Description of Artificial Sequence: Synthetic oligonucleotide
  Target: FXN; (-) strand; PAM type: YTN; PAM sequence: TTG
aactcctgaactcaagcaac

SEQ ID NO: 22350 - DNA, 20 bp, Artificial Sequence
  Description of Artificial Sequence: Synthetic oligonucleotide
  Target: FXN; (-) strand; PAM type: YTN; PAM sequence: CTT
gaactcctgaactcaagcaa

SEQ ID NO: 22351 - DNA, 20 bp, Artificial Sequence
  Description of Artificial Sequence: Synthetic oligonucleotide
  Target: FXN; (-) strand; PAM type: YTN; PAM sequence: CTG
gtcttgaactcctgaactca

SEQ ID NO: 22352 - DNA, 20 bp, Artificial Sequence
  Description of Artificial Sequence: Synthetic oligonucleotide
  Target: FXN; (-) strand; PAM type: YTN; PAM sequence: TTG
cccaggctggtcttgaactc

SEQ ID NO: 22353 - DNA, 20 bp, Artificial Sequence
  Description of Artificial Sequence: Synthetic oligonucleotide
  Target: FXN; (-) strand; PAM type: YTN; PAM sequence: CTA
tgttgcccaggctggtcttg

SEQ ID NO: 22354 - DNA, 20 bp, Artificial Sequence
  Description of Artificial Sequence: Synthetic oligonucleotide
  Target: FXN; (-) strand; PAM type: YTN; PAM sequence: CTC
actatgttgcccaggctggt

SEQ ID NO: 22355 - DNA, 20 bp, Artificial Sequence
  Description of Artificial Sequence: Synthetic oligonucleotide
  Target: FXN; (-) strand; PAM type: YTN; PAM sequence: TTG
gtagagacagagtctcacta

SEQ ID NO: 22356 - DNA, 20 bp, Artificial Sequence
  Description of Artificial Sequence: Synthetic oligonucleotide
  Target: FXN; (-) strand; PAM type: YTN; PAM sequence: TTT
ggtagagacagagtctcact

SEQ ID NO: 22357 - DNA, 20 bp, Artificial Sequence
  Description of Artificial Sequence: Synthetic oligonucleotide
  Target: FXN; (-) strand; PAM type: YTN; PAM sequence: TTT
tggtagagacagagtctcac

SEQ ID NO: 22358 - DNA, 20 bp, Artificial Sequence
  Description of Artificial Sequence: Synthetic oligonucleotide
  Target: FXN; (-) strand; PAM type: YTN; PAM sequence: TTT
ttggtagagacagagtctca

SEQ ID NO: 22359 - DNA, 20 bp, Artificial Sequence
  Description of Artificial Sequence: Synthetic oligonucleotide
  Target: FXN; (-) strand; PAM type: YTN; PAM sequence: TTA
aaaatttttggtagagacag

SEQ ID NO: 22360 - DNA, 20 bp, Artificial Sequence
  Description of Artificial Sequence: Synthetic oligonucleotide
  Target: FXN; (-) strand; PAM type: YTN; PAM sequence: TTT
aaaaatttttggtagagaca

SEQ ID NO: 22361 - DNA, 20 bp, Artificial Sequence
  Description of Artificial Sequence: Synthetic oligonucleotide
  Target: FXN; (-) strand; PAM type: YTN; PAM sequence: TTT
taaaaatttttggtagagac

SEQ ID NO: 22362 - DNA, 20 bp, Artificial Sequence
  Description of Artificial Sequence: Synthetic oligonucleotide
  Target: FXN; (-) strand; PAM type: YTN; PAM sequence: TTA
aaattttaaaaatttttggt

SEQ ID NO: 22363 - DNA, 20 bp, Artificial Sequence
  Description of Artificial Sequence: Synthetic oligonucleotide
  Target: FXN; (-) strand; PAM type: YTN; PAM sequence: TTT
aaaattttaaaaatttttgg

SEQ ID NO: 22364 - DNA, 20 bp, Artificial Sequence
  Description of Artificial Sequence: Synthetic oligonucleotide
  Target: FXN; (-) strand; PAM type: YTN; PAM sequence: TTT
taaaattttaaaaatttttg

SEQ ID NO: 22365 - DNA, 20 bp, Artificial Sequence
  Description of Artificial Sequence: Synthetic oligonucleotide
  Target: FXN; (-) strand; PAM type: YTN; PAM sequence: TTT
ttaaaattttaaaaattttt

SEQ ID NO: 22366 - DNA, 20 bp, Artificial Sequence
  Description of Artificial Sequence: Synthetic oligonucleotide
  Target: FXN; (-) strand; PAM type: YTN; PAM sequence: CTG
atttttaaaattttaaaaat

SEQ ID NO: 22367 - DNA, 20 bp, Artificial Sequence
  Description of Artificial Sequence: Synthetic oligonucleotide
  Target: FXN; (-) strand; PAM type: YTN; PAM sequence: CTG
gctgatttttaaaattttaa

SEQ ID NO: 22368 - DNA, 20 bp, Artificial Sequence
  Description of Artificial Sequence: Synthetic oligonucleotide
  Target: FXN; (-) strand; PAM type: YTN; PAM sequence: CTA
taggtgtgcataaccacacc

SEQ ID NO: 22369 - DNA, 20 bp, Artificial Sequence
  Description of Artificial Sequence: Synthetic oligonucleotide
  Target: FXN; (-) strand; PAM type: YTN; PAM sequence: CTG
ggactataggtgtgcataac

SEQ ID NO: 22370 - DNA, 20 bp, Artificial Sequence
  Description of Artificial Sequence: Synthetic oligonucleotide
  Target: FXN; (-) strand; PAM type: YTN; PAM sequence: CTA
agtaactgggactataggtg

SEQ ID NO: 22371 - DNA, 20 bp, Artificial Sequence
  Description of Artificial Sequence: Synthetic oligonucleotide
  Target: FXN; (-) strand; PAM type: YTN; PAM sequence: CTC
ctaagtaactgggactatag

SEQ ID NO: 22372 - DNA, 20 bp, Artificial Sequence
  Description of Artificial Sequence: Synthetic oligonucleotide
  Target: FXN; (-) strand; PAM type: YTN; PAM sequence: CTC
agcctcctaagtaactggga

SEQ ID NO: 22373 - DNA, 20 bp, Artificial Sequence
  Description of Artificial Sequence: Synthetic oligonucleotide
  Target: FXN; (-) strand; PAM type: YTN; PAM sequence: CTG
cctcagcctcctaagtaact

SEQ ID NO: 22374 - DNA, 20 bp, Artificial Sequence
  Description of Artificial Sequence: Synthetic oligonucleotide
  Target: FXN; (-) strand; PAM type: YTN; PAM sequence: CTC
ctgcctcagcctcctaagta

SEQ ID NO: 22375 - DNA, 20 bp, Artificial Sequence
  Description of Artificial Sequence: Synthetic oligonucleotide
  Target: FXN; (-) strand; PAM type: YTN; PAM sequence: CTG
gaatcaagtgatcctcctgc

SEQ ID NO: 22376 - DNA, 20 bp, Artificial Sequence
  Description of Artificial Sequence: Synthetic oligonucleotide
  Target: FXN; (-) strand; PAM type: YTN; PAM sequence: CTC
ctggaatcaagtgatcctcc

SEQ ID NO: 22377 - DNA, 20 bp, Artificial Sequence
  Description of Artificial Sequence: Synthetic oligonucleotide
  Target: FXN; (-) strand; PAM type: YTN; PAM sequence: TTG
acctcctggaatcaagtgat

SEQ ID NO: 22378 - DNA, 20 bp, Artificial Sequence
  Description of Artificial Sequence: Synthetic oligonucleotide
  Target: FXN; (-) strand; PAM type: YTN; PAM sequence: CTT
gacctcctggaatcaagtga

SEQ ID NO: 22379 - DNA, 20 bp, Artificial Sequence
  Description of Artificial Sequence: Synthetic oligonucleotide
  Target: FXN; (-) strand; PAM type: YTN; PAM sequence: CTC
acagcagccttgacctcctg

SEQ ID NO: 22380 - DNA, 20 bp, Artificial Sequence
  Description of Artificial Sequence: Synthetic oligonucleotide
  Target: FXN; (-) strand; PAM type: YTN; PAM sequence: CTG
aaatgcagtggtgtggtcat

SEQ ID NO: 22381 - DNA, 20 bp, Artificial Sequence
  Description of Artificial Sequence: Synthetic oligonucleotide
  Target: FXN; (-) strand; PAM type: YTN; PAM sequence: TTA
cccaggctgaaatgcagtgg

SEQ ID NO: 22382 - DNA, 20 bp, Artificial Sequence
  Description of Artificial Sequence: Synthetic oligonucleotide
  Target: FXN; (-) strand; PAM type: YTN; PAM sequence: CTG
ttacccaggctgaaatgcag

SEQ ID NO: 22383 - DNA, 20 bp, Artificial Sequence
  Description of Artificial Sequence: Synthetic oligonucleotide
  Target: FXN; (-) strand; PAM type: YTN; PAM sequence: TTC
tgttacccaggctgaaatgc

SEQ ID NO: 22384 - DNA, 20 bp, Artificial Sequence
  Description of Artificial Sequence: Synthetic oligonucleotide
  Target: FXN; (-) strand; PAM type: YTN; PAM sequence: CTC
attctgttacccaggctgaa

SEQ ID NO: 22385 - DNA, 20 bp, Artificial Sequence
  Description of Artificial Sequence: Synthetic oligonucleotide
  Target: FXN; (-) strand; PAM type: YTN; PAM sequence: TTG
aaacagagtctcattctgtt

SEQ ID NO: 22386 - DNA, 20 bp, Artificial Sequence
  Description of Artificial Sequence: Synthetic oligonucleotide
  Target: FXN; (-) strand; PAM type: YTN; PAM sequence: TTT
gaaacagagtctcattctgt

SEQ ID NO: 22387 - DNA, 20 bp, Artificial Sequence
  Description of Artificial Sequence: Synthetic oligonucleotide
  Target: FXN; (-) strand; PAM type: YTN; PAM sequence: TTG
tttgaaacagagtctcattc

SEQ ID NO: 22388 - DNA, 20 bp, Artificial Sequence
  Description of Artificial Sequence: Synthetic oligonucleotide
  Target: FXN; (-) strand; PAM type: YTN; PAM sequence: TTT
gtttgaaacagagtctcatt

SEQ ID NO: 22389 - DNA, 20 bp, Artificial Sequence
  Description of Artificial Sequence: Synthetic oligonucleotide
  Target: FXN; (-) strand; PAM type: YTN; PAM sequence: TTG
tttgtttgaaacagagtctc

SEQ ID NO: 22390 - DNA, 20 bp, Artificial Sequence
  Description of Artificial Sequence: Synthetic oligonucleotide
  Target: FXN; (-) strand; PAM type: YTN; PAM sequence: TTT
gtttgtttgaaacagagtct

SEQ ID NO: 22391 - DNA, 20 bp, Artificial Sequence
  Description of Artificial Sequence: Synthetic oligonucleotide
  Target: FXN; (-) strand; PAM type: YTN; PAM sequence: TTT
tgtttgtttgaaacagagtc

SEQ ID NO: 22392 - DNA, 20 bp, Artificial Sequence
  Description of Artificial Sequence: Synthetic oligonucleotide
  Target: FXN; (-) strand; PAM type: YTN; PAM sequence: TTT
ttgtttgtttgaaacagagt

SEQ ID NO: 22393 - DNA, 20 bp, Artificial Sequence
  Description of Artificial Sequence: Synthetic oligonucleotide
  Target: FXN; (-) strand; PAM type: YTN; PAM sequence: TTG
ggtttttgtttgtttgaaac

SEQ ID NO: 22394 - DNA, 20 bp, Artificial Sequence
  Description of Artificial Sequence: Synthetic oligonucleotide
  Target: FXN; (-) strand; PAM type: YTN; PAM sequence: TTT
gggtttttgtttgtttgaaa

SEQ ID NO: 22395 - DNA, 20 bp, Artificial Sequence
  Description of Artificial Sequence: Synthetic oligonucleotide
  Target: FXN; (-) strand; PAM type: YTN; PAM sequence: TTT
tgggtttttgtttgtttgaa

SEQ ID NO: 22396 - DNA, 20 bp, Artificial Sequence
  Description of Artificial Sequence: Synthetic oligonucleotide
  Target: FXN; (-) strand; PAM type: YTN; PAM sequence: TTT
ttgggtttttgtttgtttga

SEQ ID NO: 22397 - DNA, 20 bp, Artificial Sequence
  Description of Artificial Sequence: Synthetic oligonucleotide
  Target: FXN; (-) strand; PAM type: YTN; PAM sequence: TTT
tttgggtttttgtttgtttg

SEQ ID NO: 22398 - DNA, 20 bp, Artificial Sequence
  Description of Artificial Sequence: Synthetic oligonucleotide
  Target: FXN; (-) strand; PAM type: YTN; PAM sequence: TTT
ttttgggtttttgtttgttt

SEQ ID NO: 22399 - DNA, 20 bp, Artificial Sequence
  Description of Artificial Sequence: Synthetic oligonucleotide
  Target: FXN; (-) strand; PAM type: YTN; PAM sequence: TTT
tttttgggtttttgtttgtt

SEQ ID NO: 22400 - DNA, 20 bp, Artificial Sequence
  Description of Artificial Sequence: Synthetic oligonucleotide
  Target: FXN; (-) strand; PAM type: YTN; PAM sequence: TTT
ttttttgggtttttgtttgt

SEQ ID NO: 22401 - DNA, 20 bp, Artificial Sequence
  Description of Artificial Sequence: Synthetic oligonucleotide
  Target: FXN; (-) strand; PAM type: YTN; PAM sequence: TTT
tttttttgggtttttgtttg

SEQ ID NO: 22402 - DNA, 20 bp, Artificial Sequence
  Description of Artificial Sequence: Synthetic oligonucleotide
  Target: FXN; (-) strand; PAM type: YTN; PAM sequence: TTT
ttttttttgggtttttgttt

SEQ ID NO: 22403 - DNA, 20 bp, Artificial Sequence
  Description of Artificial Sequence: Synthetic oligonucleotide
  Target: FXN; (-) strand; PAM type: YTN; PAM sequence: TTT
tttttttttgggtttttgtt

SEQ ID NO: 22404 - DNA, 20 bp, Artificial Sequence
  Description of Artificial Sequence: Synthetic oligonucleotide
  Target: FXN; (-) strand; PAM type: YTN; PAM sequence: TTT
ttttttttttgggtttttgt

SEQ ID NO: 22405 - DNA, 20 bp, Artificial Sequence
  Description of Artificial Sequence: Synthetic oligonucleotide
  Target: FXN; (-) strand; PAM type: YTN; PAM sequence: TTT
tttttttttttgggtttttg

SEQ ID NO: 22406 - DNA, 20 bp, Artificial Sequence
  Description of Artificial Sequence: Synthetic oligonucleotide
  Target: FXN; (-) strand; PAM type: YTN; PAM sequence: CTT
ttttttttttttgggttttt

SEQ ID NO: 22407 - DNA, 20 bp, Artificial Sequence
  Description of Artificial Sequence: Synthetic oligonucleotide
  Target: FXN; (-) strand; PAM type: YTN; PAM sequence: CTC
ttttttttttttttgggttt

SEQ ID NO: 22408 - DNA, 20 bp, Artificial Sequence
  Description of Artificial Sequence: Synthetic oligonucleotide
  Target: FXN; (-) strand; PAM type: YTN; PAM sequence: CTC
tcttttttttttttttgggt

SEQ ID NO: 22409 - DNA, 20 bp, Artificial Sequence
  Description of Artificial Sequence: Synthetic oligonucleotide
  Target: FXN; (-) strand; PAM type: YTN; PAM sequence: CTC
tctcttttttttttttttgg

SEQ ID NO: 22410 - DNA, 20 bp, Artificial Sequence
  Description of Artificial Sequence: Synthetic oligonucleotide
  Target: FXN; (-) strand; PAM type: YTN; PAM sequence: CTC
tctctctttttttttttttt

SEQ ID NO: 22411 - DNA, 20 bp, Artificial Sequence
  Description of Artificial Sequence: Synthetic oligonucleotide
  Target: FXN; (-) strand; PAM type: YTN; PAM sequence: CTC
tctctctctttttttttttt

SEQ ID NO: 22412 - DNA, 20 bp, Artificial Sequence
  Description of Artificial Sequence: Synthetic oligonucleotide
  Target: FXN; (-) strand; PAM type: YTN; PAM sequence: CTC
cctctctctctctttttttt

SEQ ID NO: 22413 - DNA, 20 bp, Artificial Sequence
  Description of Artificial Sequence: Synthetic oligonucleotide
  Target: FXN; (-) strand; PAM type: YTN; PAM sequence: CTA
actccctctctctctctttt

SEQ ID NO: 22414 - DNA, 20 bp, Artificial Sequence
  Description of Artificial Sequence: Synthetic oligonucleotide
  Target: FXN; (-) strand; PAM type: YTN; PAM sequence: TTC
taactccctctctctctctt

SEQ ID NO: 22415 - DNA, 20 bp, Artificial Sequence
  Description of Artificial Sequence: Synthetic oligonucleotide
  Target: FXN; (-) strand; PAM type: YTN; PAM sequence: CTT
ctaactccctctctctctct

SEQ ID NO: 22416 - DNA, 20 bp, Artificial Sequence
  Description of Artificial Sequence: Synthetic oligonucleotide
  Target: FXN; (-) strand; PAM type: YTN; PAM sequence: TTC
cttctaactccctctctctc

SEQ ID NO: 22417 - DNA, 20 bp, Artificial Sequence
  Description of Artificial Sequence: Synthetic oligonucleotide
  Target: FXN; (-) strand; PAM type: YTN; PAM sequence: CTT
ccttctaactccctctctct

SEQ ID NO: 22418 - DNA, 20 bp, Artificial Sequence
  Description of Artificial Sequence: Synthetic oligonucleotide
  Target: FXN; (-) strand; PAM type: YTN; PAM sequence: TTC
caagtccaggtcataaaaat

SEQ ID NO: 22419 - DNA, 20 bp, Artificial Sequence
  Description of Artificial Sequence: Synthetic oligonucleotide
  Target: FXN; (-) strand; PAM type: YTN; PAM sequence: CTT
ccaagtccaggtcataaaaa

SEQ ID NO: 22420 - DNA, 20 bp, Artificial Sequence
  Description of Artificial Sequence: Synthetic oligonucleotide
  Target: FXN; (-) strand; PAM type: YTN; PAM sequence: TTG
gtgacttccaagtccaggtc

SEQ ID NO: 22421 - DNA, 20 bp, Artificial Sequence
  Description of Artificial Sequence: Synthetic oligonucleotide
  Target: FXN; (-) strand; PAM type: YTN; PAM sequence: CTT
ggtgacttccaagtccaggt

SEQ ID NO: 22422 - DNA, 20 bp, Artificial Sequence
  Description of Artificial Sequence: Synthetic oligonucleotide
  Target: FXN; (-) strand; PAM type: YTN; PAM sequence: CTG
cttggtgacttccaagtcca

SEQ ID NO: 22423 - DNA, 20 bp, Artificial Sequence
  Description of Artificial Sequence: Synthetic oligonucleotide
  Target: FXN; (-) strand; PAM type: YTN; PAM sequence: CTG
cagaagtgctgcttggtgac

SEQ ID NO: 22424 - DNA, 20 bp, Artificial Sequence
  Description of Artificial Sequence: Synthetic oligonucleotide
  Target: FXN; (-) strand; PAM type: YTN; PAM sequence: TTC
caaccaacagggtactgcag

SEQ ID NO: 22425 - DNA, 20 bp, Artificial Sequence
  Description of Artificial Sequence: Synthetic oligonucleotide
  Target: FXN; (-) strand; PAM type: YTN; PAM sequence: CTA
ttccaaccaacagggtactg

SEQ ID NO: 22426 - DNA, 20 bp, Artificial Sequence
  Description of Artificial Sequence: Synthetic oligonucleotide
  Target: FXN; (-) strand; PAM type: YTN; PAM sequence: CTA
caactattccaaccaacagg

SEQ ID NO: 22427 - DNA, 20 bp, Artificial Sequence
  Description of Artificial Sequence: Synthetic oligonucleotide
  Target: FXN; (-) strand; PAM type: YTN; PAM sequence: TTG
ggctacaactattccaacca

SEQ ID NO: 22428 - DNA, 20 bp, Artificial Sequence
  Description of Artificial Sequence: Synthetic oligonucleotide
  Target: FXN; (-) strand; PAM type: YTN; PAM sequence: TTT
gggctacaactattccaacc

SEQ ID NO: 22429 - DNA, 20 bp, Artificial Sequence
  Description of Artificial Sequence: Synthetic oligonucleotide
  Target: FXN; (-) strand; PAM type: YTN; PAM sequence: TTC
gggtttgggctacaactatt

SEQ ID NO: 22430 - DNA, 20 bp, Artificial Sequence
  Description of Artificial Sequence: Synthetic oligonucleotide
  Target: FXN; (-) strand; PAM type: YTN; PAM sequence: TTC
gaattcgggtttgggctaca

SEQ ID NO: 22431 - DNA, 20 bp, Artificial Sequence
  Description of Artificial Sequence: Synthetic oligonucleotide
  Target: FXN; (-) strand; PAM type: YTN; PAM sequence: CTT
cgaattcgggtttgggctac

SEQ ID NO: 22432 - DNA, 20 bp, Artificial Sequence
  Description of Artificial Sequence: Synthetic oligonucleotide
  Target: FXN; (-) strand; PAM type: YTN; PAM sequence: CTC
ccttcgaattcgggtttggg

SEQ ID NO: 22433 - DNA, 20 bp, Artificial Sequence
  Description of Artificial Sequence: Synthetic oligonucleotide
  Target: FXN; (-) strand; PAM type: YTN; PAM sequence: CTC
ctcccttcgaattcgggttt

SEQ ID NO: 22434 - DNA, 20 bp, Artificial Sequence
  Description of Artificial Sequence: Synthetic oligonucleotide
  Target: FXN; (-) strand; PAM type: YTN; PAM sequence: TTC
tcctcccttcgaattcgggt

SEQ ID NO: 22435 - DNA, 20 bp, Artificial Sequence
  Description of Artificial Sequence: Synthetic oligonucleotide
  Target: FXN; (-) strand; PAM type: YTN; PAM sequence: CTA
ttctcctcccttcgaattcg

SEQ ID NO: 22436 - DNA, 20 bp, Artificial Sequence
  Description of Artificial Sequence: Synthetic oligonucleotide
  Target: FXN; (-) strand; PAM type: YTN; PAM sequence: TTA
tctattctcctcccttcgaa

SEQ ID NO: 22437 - DNA, 20 bp, Artificial Sequence
  Description of Artificial Sequence: Synthetic oligonucleotide
  Target: FXN; (-) strand; PAM type: YTN; PAM sequence: CTG
tcacccagggatgttatcta

SEQ ID NO: 22438 - DNA, 20 bp, Artificial Sequence
  Description of Artificial Sequence: Synthetic oligonucleotide
  Target: FXN; (-) strand; PAM type: YTN; PAM sequence: TTC
ctgtcacccagggatgttat

SEQ ID NO: 22439 - DNA, 20 bp, Artificial Sequence
  Description of Artificial Sequence: Synthetic oligonucleotide
  Target: FXN; (-) strand; PAM type: YTN; PAM sequence: TTG
acattcctgtcacccaggga

SEQ ID NO: 22440 - DNA, 20 bp, Artificial Sequence
  Description of Artificial Sequence: Synthetic oligonucleotide
  Target: FXN; (-) strand; PAM type: YTN; PAM sequence: TTT
gacattcctgtcacccaggg

SEQ ID NO: 22441 - DNA, 20 bp, Artificial Sequence
  Description of Artificial Sequence: Synthetic oligonucleotide
  Target: FXN; (-) strand; PAM type: YTN; PAM sequence: CTT
tgacattcctgtcacccagg

SEQ ID NO: 22442 - DNA, 20 bp, Artificial Sequence
  Description of Artificial Sequence: Synthetic oligonucleotide
  Target: FXN; (-) strand; PAM type: YTN; PAM sequence: TTG
ggactttgacattcctgtca

SEQ ID NO: 22443 - DNA, 20 bp, Artificial Sequence
  Description of Artificial Sequence: Synthetic oligonucleotide
  Target: FXN; (-) strand; PAM type: YTN; PAM sequence: TTT
gggactttgacattcctgtc

SEQ ID NO: 22444 - DNA, 20 bp, Artificial Sequence
  Description of Artificial Sequence: Synthetic oligonucleotide
  Target: FXN; (-) strand; PAM type: YTN; PAM sequence: CTG
tttgggactttgacattcct

SEQ ID NO: 22445 - DNA, 20 bp, Artificial Sequence
  Description of Artificial Sequence: Synthetic oligonucleotide
  Target: FXN; (-) strand; PAM type: YTN; PAM sequence: TTG
tcacatgtcatatgctgttt

SEQ ID NO: 22446 - DNA, 20 bp, Artificial Sequence
  Description of Artificial Sequence: Synthetic oligonucleotide
  Target: FXN; (-) strand; PAM type: YTN; PAM sequence: TTT
gtcacatgtcatatgctgtt

SEQ ID NO: 22447 - DNA, 20 bp, Artificial Sequence
  Description of Artificial Sequence: Synthetic oligonucleotide
  Target: FXN; (-) strand; PAM type: YTN; PAM sequence: TTC
caaagaaggccacaccaata

SEQ ID NO: 22448 - DNA, 20 bp, Artificial Sequence
  Description of Artificial Sequence: Synthetic oligonucleotide
  Target: FXN; (-) strand; PAM type: YTN; PAM sequence: CTT
ccaaagaaggccacaccaat

SEQ ID NO: 22449 - DNA, 20 bp, Artificial Sequence
  Description of Artificial Sequence: Synthetic oligonucleotide
  Target: FXN; (-) strand; PAM type: YTN; PAM sequence: TTG
gatcttccaaagaaggccac

SEQ ID NO: 22450 - DNA, 20 bp, Artificial Sequence
  Description of Artificial Sequence: Synthetic oligonucleotide
  Target: FXN; (-) strand; PAM type: YTN; PAM sequence: CTG
gtatggaagattggatcttc

SEQ ID NO: 22451 - DNA, 20 bp, Artificial Sequence
  Description of Artificial Sequence: Synthetic oligonucleotide
  Target: FXN; (-) strand; PAM type: YTN; PAM sequence: TTG
cctggtatggaagattggat

SEQ ID NO: 22452 - DNA, 20 bp, Artificial Sequence
  Description of Artificial Sequence: Synthetic oligonucleotide
  Target: FXN; (-) strand; PAM type: YTN; PAM sequence: TTT
gcctggtatggaagattgga

SEQ ID NO: 22453 - DNA, 20 bp, Artificial Sequence
  Description of Artificial Sequence: Synthetic oligonucleotide
  Target: FXN; (-) strand; PAM type: YTN; PAM sequence: CTT
tgcctggtatggaagattgg

SEQ ID NO: 22454 - DNA, 20 bp, Artificial Sequence
  Description of Artificial Sequence: Synthetic oligonucleotide
  Target: FXN; (-) strand; PAM type: YTN; PAM sequence: TTC
catccctttgcctggtatgg

SEQ ID NO: 22455 - DNA, 20 bp, Artificial Sequence
  Description of Artificial Sequence: Synthetic oligonucleotide
  Target: FXN; (-) strand; PAM type: YTN; PAM sequence: CTT
ccatccctttgcctggtatg

SEQ ID NO: 22456 - DNA, 20 bp, Artificial Sequence
  Description of Artificial Sequence: Synthetic oligonucleotide
  Target: FXN; (-) strand; PAM type: YTN; PAM sequence: TTA
gtcttccatccctttgcctg

SEQ ID NO: 22457 - DNA, 20 bp, Artificial Sequence
  Description of Artificial Sequence: Synthetic oligonucleotide
  Target: FXN; (-) strand; PAM type: YTN; PAM sequence: CTT
agtcttccatccctttgcct

SEQ ID NO: 22458 - DNA, 20 bp, Artificial Sequence
  Description of Artificial Sequence: Synthetic oligonucleotide
  Target: FXN; (-) strand; PAM type: YTN; PAM sequence: TTC
cttagtcttccatccctttg

SEQ ID NO: 22459 - DNA, 20 bp, Artificial Sequence
  Description of Artificial Sequence: Synthetic oligonucleotide
  Target: FXN; (-) strand; PAM type: YTN; PAM sequence: TTG
ttccttagtcttccatccct

SEQ ID NO: 22460 - DNA, 20 bp, Artificial Sequence
  Description of Artificial Sequence: Synthetic oligonucleotide
  Target: FXN; (-) strand; PAM type: YTN; PAM sequence: CTC
atgttgttccttagtcttcc

SEQ ID NO: 22461 - DNA, 20 bp, Artificial Sequence
  Description of Artificial Sequence: Synthetic oligonucleotide
  Target: FXN; (-) strand; PAM type: YTN; PAM sequence: CTA
tccctcatgttgttccttag

SEQ ID NO: 22462 - DNA, 20 bp, Artificial Sequence
  Description of Artificial Sequence: Synthetic oligonucleotide
  Target: FXN; (-) strand; PAM type: YTN; PAM sequence: CTG
gctatccctcatgttgttcc

SEQ ID NO: 22463 - DNA, 20 bp, Artificial Sequence
  Description of Artificial Sequence: Synthetic oligonucleotide
  Target: FXN; (-) strand; PAM type: YTN; PAM sequence: CTC
tggctatccctcatgttgtt

SEQ ID NO: 22464 - DNA, 20 bp, Artificial Sequence
  Description of Artificial Sequence: Synthetic oligonucleotide
  Target: FXN; (-) strand; PAM type: YTN; PAM sequence: CTC
tctggctatccctcatgttg

SEQ ID NO: 22465 - DNA, 20 bp, Artificial Sequence
  Description of Artificial Sequence: Synthetic oligonucleotide
  Target: FXN; (-) strand; PAM type: YTN; PAM sequence: TTC
cctctctggctatccctcat

SEQ ID NO: 22466 - DNA, 20 bp, Artificial Sequence
  Description of Artificial Sequence: Synthetic oligonucleotide
  Target: FXN; (-) strand; PAM type: YTN; PAM sequence: TTT
ccctctctggctatccctca

SEQ ID NO: 22467 - DNA, 20 bp, Artificial Sequence
  Description of Artificial Sequence: Synthetic oligonucleotide
  Target: FXN; (-) strand; PAM type: YTN; PAM sequence: TTT
tccctctctggctatccctc

SEQ ID NO: 22468 - DNA, 20 bp, Artificial Sequence
  Description of Artificial Sequence: Synthetic oligonucleotide
  Target: FXN; (-) strand; PAM type: YTN; PAM sequence: TTT
ttccctctctggctatccct

SEQ ID NO: 22469 - DNA, 20 bp, Artificial Sequence
  Description of Artificial Sequence: Synthetic oligonucleotide
  Target: FXN; (-) strand; PAM type: YTN; PAM sequence: CTT
tttccctctctggctatccc

SEQ ID NO: 22470 - DNA, 20 bp, Artificial Sequence
  Description of Artificial Sequence: Synthetic oligonucleotide
  Target: FXN; (-) strand; PAM type: YTN; PAM sequence: CTA
gaacaagtgatgctttttcc

SEQ ID NO: 22471 - DNA, 20 bp, Artificial Sequence
  Description of Artificial Sequence: Synthetic oligonucleotide
  Target: FXN; (-) strand; PAM type: YTN; PAM sequence: TTC
ctagaacaagtgatgctttt

SEQ ID NO: 22472 - DNA, 20 bp, Artificial Sequence
  Description of Artificial Sequence: Synthetic oligonucleotide
  Target: FXN; (-) strand; PAM type: YTN; PAM sequence: TTG
tagttcctagaacaagtgat

SEQ ID NO: 22473 - DNA, 20 bp, Artificial Sequence
  Description of Artificial Sequence: Synthetic oligonucleotide
  Target: FXN; (-) strand; PAM type: YTN; PAM sequence: TTT
gtagttcctagaacaagtga

SEQ ID NO: 22474 - DNA, 20 bp, Artificial Sequence
  Description of Artificial Sequence: Synthetic oligonucleotide
  Target: FXN; (-) strand; PAM type: YTN; PAM sequence: CTA
tttgtagttcctagaacaag

SEQ ID NO: 22475 - DNA, 20 bp, Artificial Sequence
  Description of Artificial Sequence: Synthetic oligonucleotide
  Target: FXN; (-) strand; PAM type: YTN; PAM sequence: TTC
aagctatttgtagttcctag

SEQ ID NO: 22476 - DNA, 20 bp, Artificial Sequence
  Description of Artificial Sequence: Synthetic oligonucleotide
  Target: FXN; (-) strand; PAM type: YTN; PAM sequence: CTT
caagctatttgtagttccta

SEQ ID NO: 22477 - DNA, 20 bp, Artificial Sequence
  Description of Artificial Sequence: Synthetic oligonucleotide
  Target: FXN; (-) strand; PAM type: YTN; PAM sequence: TTC
ttcaagctatttgtagttcc

SEQ ID NO: 22478 - DNA, 20 bp, Artificial Sequence
  Description of Artificial Sequence: Synthetic oligonucleotide
  Target: FXN; (-) strand; PAM type: YTN; PAM sequence: CTT
cttcaagctatttgtagttc

SEQ ID NO: 22479 - DNA, 20 bp, Artificial Sequence
  Description of Artificial Sequence: Synthetic oligonucleotide
  Target: FXN; (-) strand; PAM type: YTN; PAM sequence: TTG
cttcttcaagctatttgtag

SEQ ID NO: 22480 - DNA, 20 bp, Artificial Sequence
  Description of Artificial Sequence: Synthetic oligonucleotide
  Target: FXN; (-) strand; PAM type: YTN; PAM sequence: TTT
gcttcttcaagctatttgta

SEQ ID NO: 22481 - DNA, 20 bp, Artificial Sequence
  Description of Artificial Sequence: Synthetic oligonucleotide
  Target: FXN; (-) strand; PAM type: YTN; PAM sequence: CTT
tgcttcttcaagctatttgt

SEQ ID NO: 22482 - DNA, 20 bp, Artificial Sequence
  Description of Artificial Sequence: Synthetic oligonucleotide
  Target: FXN; (-) strand; PAM type: YTN; PAM sequence: CTA
gacatctttgcttcttcaag

SEQ ID NO: 22483 - DNA, 20 bp, Artificial Sequence
  Description of Artificial Sequence: Synthetic oligonucleotide
  Target: FXN; (-) strand; PAM type: YTN; PAM sequence: TTG
ggaggcatctagacatcttt

SEQ ID NO: 22484 - DNA, 20 bp, Artificial Sequence
  Description of Artificial Sequence: Synthetic oligonucleotide
  Target: FXN; (-) strand; PAM type: YTN; PAM sequence: CTG
catattgggaggcatctaga

SEQ ID NO: 22485 - DNA, 20 bp, Artificial Sequence
  Description of Artificial Sequence: Synthetic oligonucleotide
  Target: FXN; (-) strand; PAM type: YTN; PAM sequence: CTC
tgcatattgggaggcatcta

SEQ ID NO: 22486 - DNA, 20 bp, Artificial Sequence
  Description of Artificial Sequence: Synthetic oligonucleotide
  Target: FXN; (-) strand; PAM type: YTN; PAM sequence: CTG
tacaccccactctgcatatt

SEQ ID NO: 22487 - DNA, 20 bp, Artificial Sequence
  Description of Artificial Sequence: Synthetic oligonucleotide
  Target: FXN; (-) strand; PAM type: YTN; PAM sequence: TTC
tgtacaccccactctgcata

SEQ ID NO: 22488 - DNA, 20 bp, Artificial Sequence
  Description of Artificial Sequence: Synthetic oligonucleotide
  Target: FXN; (-) strand; PAM type: YTN; PAM sequence: CTT
ctgtacaccccactctgcat

SEQ ID NO: 22489 - DNA, 20 bp, Artificial Sequence
  Description of Artificial Sequence: Synthetic oligonucleotide
  Target: FXN; (-) strand; PAM type: YTN; PAM sequence: CTC
ttctgtacaccccactctgc

SEQ ID NO: 22490 - DNA, 20 bp, Artificial Sequence
  Description of Artificial Sequence: Synthetic oligonucleotide
  Target: FXN; (-) strand; PAM type: YTN; PAM sequence: CTC
tcttctgtacaccccactct

SEQ ID NO: 22491 - DNA, 20 bp, Artificial Sequence
  Description of Artificial Sequence: Synthetic oligonucleotide
  Target: FXN; (-) strand; PAM type: YTN; PAM sequence: TTA
ccactctcttctgtacaccc

SEQ ID NO: 22492 - DNA, 20 bp, Artificial Sequence
  Description of Artificial Sequence: Synthetic oligonucleotide
  Target: FXN; (-) strand; PAM type: YTN; PAM sequence: CTT
accactctcttctgtacacc

SEQ ID NO: 22493 - DNA, 20 bp, Artificial Sequence
  Description of Artificial Sequence: Synthetic oligonucleotide
  Target: FXN; (-) strand; PAM type: YTN; PAM sequence: CTC
ccagcgcccttaccactctc

SEQ ID NO: 22494 - DNA, 20 bp, Artificial Sequence
  Description of Artificial Sequence: Synthetic oligonucleotide
  Target: FXN; (-) strand; PAM type: YTN; PAM sequence: CTC
tcccagcgcccttaccactc

SEQ ID NO: 22495 - DNA, 20 bp, Artificial Sequence
  Description of Artificial Sequence: Synthetic oligonucleotide
  Target: FXN; (-) strand; PAM type: YTN; PAM sequence: TTA
gctctcccagcgcccttacc

SEQ ID NO: 22496 - DNA, 20 bp, Artificial Sequence
  Description of Artificial Sequence: Synthetic oligonucleotide
  Target: FXN; (-) strand; PAM type: YTN; PAM sequence: CTT
agctctcccagcgcccttac

SEQ ID NO: 22497 - DNA, 20 bp, Artificial Sequence
  Description of Artificial Sequence: Synthetic oligonucleotide
  Target: FXN; (-) strand; PAM type: YTN; PAM sequence: TTG
cccaccttagctctcccagc

SEQ ID NO: 22498 - DNA, 20 bp, Artificial Sequence
  Description of Artificial Sequence: Synthetic oligonucleotide
  Target: FXN; (-) strand; PAM type: YTN; PAM sequence: CTT
gcccaccttagctctcccag

SEQ ID NO: 22499 - DNA, 20 bp, Artificial Sequence
  Description of Artificial Sequence: Synthetic oligonucleotide
  Target: FXN; (-) strand; PAM type: YTN; PAM sequence: CTC
ttgcccaccttagctctccc

SEQ ID NO: 22500 - DNA, 20 bp, Artificial Sequence
  Description of Artificial Sequence: Synthetic oligonucleotide
  Target: FXN; (-) strand; PAM type: YTN; PAM sequence: CTC
tcttgcccaccttagctctc

SEQ ID NO: 22501 - DNA, 20 bp, Artificial Sequence
  Description of Artificial Sequence: Synthetic oligonucleotide
  Target: FXN; (-) strand; PAM type: YTN; PAM sequence: TTA
gcatgacagaggaagctctc

SEQ ID NO: 22502 - DNA, 20 bp, Artificial Sequence
  Description of Artificial Sequence: Synthetic oligonucleotide
  Target: FXN; (-) strand; PAM type: YTN; PAM sequence: CTT
agcatgacagaggaagctct

SEQ ID NO: 22503 - DNA, 20 bp, Artificial Sequence
  Description of Artificial Sequence: Synthetic oligonucleotide
  Target: FXN; (-) strand; PAM type: YTN; PAM sequence: TTC
ttagcatgacagaggaagct

SEQ ID NO: 22504 - DNA, 20 bp, Artificial Sequence
  Description of Artificial Sequence: Synthetic oligonucleotide
  Target: FXN; (-) strand; PAM type: YTN; PAM sequence: TTT
cttagcatgacagaggaagc

SEQ ID NO: 22505 - DNA, 20 bp, Artificial Sequence
  Description of Artificial Sequence: Synthetic oligonucleotide
  Target: FXN; (-) strand; PAM type: YTN; PAM sequence: CTT
tcttagcatgacagaggaag

SEQ ID NO: 22506 - DNA, 20 bp, Artificial Sequence
  Description of Artificial Sequence: Synthetic oligonucleotide
  Target: FXN; (-) strand; PAM type: YTN; PAM sequence: TTC
caactttcttagcatgacag

SEQ ID NO: 22507 - DNA, 20 bp, Artificial Sequence
  Description of Artificial Sequence: Synthetic oligonucleotide
  Target: FXN; (-) strand; PAM type: YTN; PAM sequence: TTC
accaccatcaagataaattc

SEQ ID NO: 22508 - DNA, 20 bp, Artificial Sequence
  Description of Artificial Sequence: Synthetic oligonucleotide
  Target: FXN; (-) strand; PAM type: YTN; PAM sequence: TTT
caccaccatcaagataaatt

SEQ ID NO: 22509 - DNA, 20 bp, Artificial Sequence
  Description of Artificial Sequence: Synthetic oligonucleotide
  Target: FXN; (-) strand; PAM type: YTN; PAM sequence: CTT
tcaccaccatcaagataaat

SEQ ID NO: 22510 - DNA, 20 bp, Artificial Sequence
  Description of Artificial Sequence: Synthetic oligonucleotide
  Target: FXN; (-) strand; PAM type: YTN; PAM sequence: CTG
ctttcaccaccatcaagata

SEQ ID NO: 22511 - DNA, 20 bp, Artificial Sequence
  Description of Artificial Sequence: Synthetic oligonucleotide
  Target: FXN; (-) strand; PAM type: YTN; PAM sequence: CTC
tgctttcaccaccatcaaga

SEQ ID NO: 22512 - DNA, 20 bp, Artificial Sequence
  Description of Artificial Sequence: Synthetic oligonucleotide
  Target: FXN; (-) strand; PAM type: YTN; PAM sequence: CTA
accatagccctctgctttca

SEQ ID NO: 22513 - DNA, 20 bp, Artificial Sequence
  Description of Artificial Sequence: Synthetic oligonucleotide
  Target: FXN; (-) strand; PAM type: YTN; PAM sequence: CTC
aaatgtgaatctaaccatag

SEQ ID NO: 22514 - DNA, 20 bp, Artificial Sequence
  Description of Artificial Sequence: Synthetic oligonucleotide
  Target: FXN; (-) strand; PAM type: YTN; PAM sequence: CTA
aatctcaaatgtgaatctaa

SEQ ID NO: 22515 - DNA, 20 bp, Artificial Sequence
  Description of Artificial Sequence: Synthetic oligonucleotide
  Target: FXN; (-) strand; PAM type: YTN; PAM sequence: CTA
aaaatctaaatctcaaatgt

SEQ ID NO: 22516 - DNA, 20 bp, Artificial Sequence
  Description of Artificial Sequence: Synthetic oligonucleotide
  Target: FXN; (-) strand; PAM type: YTN; PAM sequence: TTA
aatctaaaaatctaaatctc

SEQ ID NO: 22517 - DNA, 20 bp, Artificial Sequence
  Description of Artificial Sequence: Synthetic oligonucleotide
  Target: FXN; (-) strand; PAM type: YTN; PAM sequence: TTT
aaatctaaaaatctaaatct

SEQ ID NO: 22518 - DNA, 20 bp, Artificial Sequence
  Description of Artificial Sequence: Synthetic oligonucleotide
  Target: FXN; (-) strand; PAM type: YTN; PAM sequence: TTT
taaatctaaaaatctaaatc

SEQ ID NO: 22519 - DNA, 20 bp, Artificial Sequence
  Description of Artificial Sequence: Synthetic oligonucleotide
  Target: FXN; (-) strand; PAM type: YTN; PAM sequence: TTA
agccagtgtcaccagggtga

SEQ ID NO: 22520 - DNA, 20 bp, Artificial Sequence
  Description of Artificial Sequence: Synthetic oligonucleotide
  Target: FXN; (-) strand; PAM type: YTN; PAM sequence: TTG
tgagttaagccagtgtcacc

SEQ ID NO: 22521 - DNA, 20 bp, Artificial Sequence
  Description of Artificial Sequence: Synthetic oligonucleotide
  Target: FXN; (-) strand; PAM type: YTN; PAM sequence: TTG
ggcaaaattgtgagttaagc

SEQ ID NO: 22522 - DNA, 20 bp, Artificial Sequence
  Description of Artificial Sequence: Synthetic oligonucleotide
  Target: FXN; (-) strand; PAM type: YTN; PAM sequence: CTT
gggcaaaattgtgagttaag

SEQ ID NO: 22523 - DNA, 20 bp, Artificial Sequence
  Description of Artificial Sequence: Synthetic oligonucleotide
  Target: FXN; (-) strand; PAM type: YTN; PAM sequence: CTG
tggtagcataggccttgggc

SEQ ID NO: 22524 - DNA, 20 bp, Artificial Sequence
  Description of Artificial Sequence: Synthetic oligonucleotide
  Target: FXN; (-) strand; PAM type: YTN; PAM sequence: TTC
agaagcactgtggtagcata

SEQ ID NO: 22525 - DNA, 20 bp, Artificial Sequence
  Description of Artificial Sequence: Synthetic oligonucleotide
  Target: FXN; (-) strand; PAM type: YTN; PAM sequence: TTT
cagaagcactgtggtagcat

SEQ ID NO: 22526 - DNA, 20 bp, Artificial Sequence
  Description of Artificial Sequence: Synthetic oligonucleotide
  Target: FXN; (-) strand; PAM type: YTN; PAM sequence: TTA
aagtttcagaagcactgtgg

SEQ ID NO: 22527 - DNA, 20 bp, Artificial Sequence
  Description of Artificial Sequence: Synthetic oligonucleotide
  Target: FXN; (-) strand; PAM type: YTN; PAM sequence: TTT
aaagtttcagaagcactgtg

SEQ ID NO: 22528 - DNA, 20 bp, Artificial Sequence
  Description of Artificial Sequence: Synthetic oligonucleotide
  Target: FXN; (-) strand; PAM type: YTN; PAM sequence: CTT
taaagtttcagaagcactgt

SEQ ID NO: 22529 - DNA, 20 bp, Artificial Sequence
  Description of Artificial Sequence: Synthetic oligonucleotide
  Target: FXN; (-) strand; PAM type: YTN; PAM sequence: CTA
atgtgctttaaagtttcaga

SEQ ID NO: 22530 - DNA, 20 bp, Artificial Sequence
  Description of Artificial Sequence: Synthetic oligonucleotide
  Target: FXN; (-) strand; PAM type: YTN; PAM sequence: TTC
taatgtgctttaaagtttca

SEQ ID NO: 22531 - DNA, 20 bp, Artificial Sequence
  Description of Artificial Sequence: Synthetic oligonucleotide
  Target: FXN; (-) strand; PAM type: YTN; PAM sequence: CTC
caggtgattctaatgtgctt

SEQ ID NO: 22532 - DNA, 20 bp, Artificial Sequence
  Description of Artificial Sequence: Synthetic oligonucleotide
  Target: FXN; (-) strand; PAM type: YTN; PAM sequence: TTA
acaagacctccaggtgattc

SEQ ID NO: 22533 - DNA, 20 bp, Artificial Sequence
  Description of Artificial Sequence: Synthetic oligonucleotide
  Target: FXN; (-) strand; PAM type: YTN; PAM sequence: TTT
aacaagacctccaggtgatt

SEQ ID NO: 22534 - DNA, 20 bp, Artificial Sequence
  Description of Artificial Sequence: Synthetic oligonucleotide
  Target: FXN; (-) strand; PAM type: YTN; PAM sequence: TTC
aaggcccagcaatccatggt

SEQ ID NO: 22535 - DNA, 20 bp, Artificial Sequence
  Description of Artificial Sequence: Synthetic oligonucleotide
  Target: FXN; (-) strand; PAM type: YTN; PAM sequence: TTT
caaggcccagcaatccatgg

SEQ ID NO: 22536 - DNA, 20 bp, Artificial Sequence
  Description of Artificial Sequence: Synthetic oligonucleotide
  Target: FXN; (-) strand; PAM type: YTN; PAM sequence: CTG
gggtttcaaggcccagcaat

SEQ ID NO: 22537 - DNA, 20 bp, Artificial Sequence
  Description of Artificial Sequence: Synthetic oligonucleotide
  Target: FXN; (-) strand; PAM type: YTN; PAM sequence: CTC
tggggtttcaaggcccagca

SEQ ID NO: 22538 - DNA, 20 bp, Artificial Sequence
  Description of Artificial Sequence: Synthetic oligonucleotide
  Target: FXN; (-) strand; PAM type: YTN; PAM sequence: CTG
aatcagaatctctggggttt

SEQ ID NO: 22539 - DNA, 20 bp, Artificial Sequence
  Description of Artificial Sequence: Synthetic oligonucleotide
  Target: FXN; (-) strand; PAM type: YTN; PAM sequence: CTA
ctgaatcagaatctctgggg

SEQ ID NO: 22540 - DNA, 20 bp, Artificial Sequence
  Description of Artificial Sequence: Synthetic oligonucleotide
  Target: FXN; (-) strand; PAM type: YTN; PAM sequence: CTC
gatctactgaatcagaatct

SEQ ID NO: 22541 - DNA, 20 bp, Artificial Sequence
  Description of Artificial Sequence: Synthetic oligonucleotide
  Target: FXN; (-) strand; PAM type: YTN; PAM sequence: TTC
tcgatctactgaatcagaat

SEQ ID NO: 22542 - DNA, 20 bp, Artificial Sequence
  Description of Artificial Sequence: Synthetic oligonucleotide
  Target: FXN; (-) strand; PAM type: YTN; PAM sequence: CTA
ttctcgatctactgaatcag

SEQ ID NO: 22543 - DNA, 20 bp, Artificial Sequence
  Description of Artificial Sequence: Synthetic oligonucleotide
  Target: FXN; (-) strand; PAM type: YTN; PAM sequence: CTC
aggccctattctcgatctac

SEQ ID NO: 22544 - DNA, 20 bp, Artificial Sequence
  Description of Artificial Sequence: Synthetic oligonucleotide
  Target: FXN; (-) strand; PAM type: YTN; PAM sequence: TTC
tcaggccctattctcgatct

SEQ ID NO: 22545 - DNA, 20 bp, Artificial Sequence
  Description of Artificial Sequence: Synthetic oligonucleotide
  Target: FXN; (-) strand; PAM type: YTN; PAM sequence: TTA
gaaatacaaattctcaggcc

SEQ ID NO: 22546 - DNA, 20 bp, Artificial Sequence
  Description of Artificial Sequence: Synthetic oligonucleotide
  Target: FXN; (-) strand; PAM type: YTN; PAM sequence: TTG
ttagaaatacaaattctcag

SEQ ID NO: 22547 - DNA, 20 bp, Artificial Sequence
  Description of Artificial Sequence: Synthetic oligonucleotide
  Target: FXN; (-) strand; PAM type: YTN; PAM sequence: CTT
gttagaaatacaaattctca

SEQ ID NO: 22548 - DNA, 20 bp, Artificial Sequence
  Description of Artificial Sequence: Synthetic oligonucleotide
  Target: FXN; (-) strand; PAM type: YTN; PAM sequence: CTG
gaaacttgttagaaatacaa

SEQ ID NO: 22549 - DNA, 20 bp, Artificial Sequence
  Description of Artificial Sequence: Synthetic oligonucleotide
  Target: FXN; (-) strand; PAM type: YTN; PAM sequence: CTC
agcatcacctggaaacttgt

SEQ ID NO: 22550 - DNA, 20 bp, Artificial Sequence
  Description of Artificial Sequence: Synthetic oligonucleotide
  Target: FXN; (-) strand; PAM type: YTN; PAM sequence: CTG
ggccagcagcctcagcatca

SEQ ID NO: 22551 - DNA, 20 bp, Artificial Sequence
  Description of Artificial Sequence: Synthetic oligonucleotide
  Target: FXN; (-) strand; PAM type: YTN; PAM sequence: TTA
tcaaatgtggtcgctgggcc

SEQ ID NO: 22552 - DNA, 20 bp, Artificial Sequence
  Description of Artificial Sequence: Synthetic oligonucleotide
  Target: FXN; (-) strand; PAM type: YTN; PAM sequence: CTA
tgattatcaaatgtggtcgc

SEQ ID NO: 22553 - DNA, 20 bp, Artificial Sequence
  Description of Artificial Sequence: Synthetic oligonucleotide
  Target: FXN; (-) strand; PAM type: YTN; PAM sequence: TTA
tcagagggctatgattatca

SEQ ID NO: 22554 - DNA, 20 bp, Artificial Sequence
  Description of Artificial Sequence: Synthetic oligonucleotide
  Target: FXN; (-) strand; PAM type: YTN; PAM sequence: TTT
atcagagggctatgattatc

SEQ ID NO: 22555 - DNA, 20 bp, Artificial Sequence
  Description of Artificial Sequence: Synthetic oligonucleotide
  Target: FXN; (-) strand; PAM type: YTN; PAM sequence: TTG
ataggatttatcagagggct

SEQ ID NO: 22556 - DNA, 20 bp, Artificial Sequence
  Description of Artificial Sequence: Synthetic oligonucleotide
  Target: FXN; (-) strand; PAM type: YTN; PAM sequence: TTT
gataggatttatcagagggc

SEQ ID NO: 22557 - DNA, 20 bp, Artificial Sequence
  Description of Artificial Sequence: Synthetic oligonucleotide
  Target: FXN; (-) strand; PAM type: YTN; PAM sequence: TTT
tgataggatttatcagaggg

SEQ ID NO: 22558 - DNA, 20 bp, Artificial Sequence
  Description of Artificial Sequence: Synthetic oligonucleotide
  Target: FXN; (-) strand; PAM type: YTN; PAM sequence: TTA
ggatattttgataggattta

SEQ ID NO: 22559 - DNA, 20 bp, Artificial Sequence
  Description of Artificial Sequence: Synthetic oligonucleotide
  Target: FXN; (-) strand; PAM type: YTN; PAM sequence: CTG
ccattaggatattttgatag

SEQ ID NO: 22560 - DNA, 20 bp, Artificial Sequence
  Description of Artificial Sequence: Synthetic oligonucleotide
  Target: FXN; (-) strand; PAM type: YTN; PAM sequence: CTC
tgccattaggatattttgat

SEQ ID NO: 22561 - DNA, 20 bp, Artificial Sequence
  Description of Artificial Sequence: Synthetic oligonucleotide
  Target: FXN; (-) strand; PAM type: YTN; PAM sequence: TTG
ctctgccattaggatatttt

SEQ ID NO: 22562 - DNA, 20 bp, Artificial Sequence
  Description of Artificial Sequence: Synthetic oligonucleotide
  Target: FXN; (-) strand; PAM type: YTN; PAM sequence: CTT
gctctgccattaggatattt

SEQ ID NO: 22563 - DNA, 20 bp, Artificial Sequence
  Description of Artificial Sequence: Synthetic oligonucleotide
  Target: FXN; (-) strand; PAM type: YTN; PAM sequence: TTC
ccttgctctgccattaggat

SEQ ID NO: 22564 - DNA, 20 bp, Artificial Sequence
  Description of Artificial Sequence: Synthetic oligonucleotide
  Target: FXN; (-) strand; PAM type: YTN; PAM sequence: TTA
tgggtaggggaggatatcac

SEQ ID NO: 22565 - DNA, 20 bp, Artificial Sequence
  Description of Artificial Sequence: Synthetic oligonucleotide
  Target: FXN; (-) strand; PAM type: YTN; PAM sequence: CTG
tcaggttatgggtaggggag

SEQ ID NO: 22566 - DNA, 20 bp, Artificial Sequence
  Description of Artificial Sequence: Synthetic oligonucleotide
  Target: FXN; (-) strand; PAM type: YTN; PAM sequence: CTA
atagctgtcaggttatgggt

SEQ ID NO: 22567 - DNA, 20 bp, Artificial Sequence
  Description of Artificial Sequence: Synthetic oligonucleotide
  Target: FXN; (-) strand; PAM type: YTN; PAM sequence: CTC
aagtaggcagatcctaatag

SEQ ID NO: 22568 - DNA, 20 bp, Artificial Sequence
  Description of Artificial Sequence: Synthetic oligonucleotide
  Target: FXN; (-) strand; PAM type: YTN; PAM sequence: TTA
gcctcaagtaggcagatcct

SEQ ID NO: 22569 - DNA, 20 bp, Artificial Sequence
  Description of Artificial Sequence: Synthetic oligonucleotide
  Target: FXN; (-) strand; PAM type: YTN; PAM sequence: TTT
agcctcaagtaggcagatcc

SEQ ID NO: 22570 - DNA, 20 bp, Artificial Sequence
  Description of Artificial Sequence: Synthetic oligonucleotide
  Target: FXN; (-) strand; PAM type: YTN; PAM sequence: TTT
tagcctcaagtaggcagatc

SEQ ID NO: 22571 - DNA, 20 bp, Artificial Sequence
  Description of Artificial Sequence: Synthetic oligonucleotide
  Target: FXN; (-) strand; PAM type: YTN; PAM sequence: CTT
ttagcctcaagtaggcagat

SEQ ID NO: 22572 - DNA, 20 bp, Artificial Sequence
  Description of Artificial Sequence: Synthetic oligonucleotide
  Target: FXN; (-) strand; PAM type: YTN; PAM sequence: TTG
cttttagcctcaagtaggca

SEQ ID NO: 22573 - DNA, 20 bp, Artificial Sequence
  Description of Artificial Sequence: Synthetic oligonucleotide
  Target: FXN; (-) strand; PAM type: YTN; PAM sequence: TTG
gttgcttttagcctcaagta

SEQ ID NO: 22574 - DNA, 20 bp, Artificial Sequence
  Description of Artificial Sequence: Synthetic oligonucleotide
  Target: FXN; (-) strand; PAM type: YTN; PAM sequence: CTT
ggttgcttttagcctcaagt

SEQ ID NO: 22575 - DNA, 20 bp, Artificial Sequence
  Description of Artificial Sequence: Synthetic oligonucleotide
  Target: FXN; (-) strand; PAM type: YTN; PAM sequence: CTC
ttggttgcttttagcctcaa

SEQ ID NO: 22576 - DNA, 20 bp, Artificial Sequence
  Description of Artificial Sequence: Synthetic oligonucleotide
  Target: FXN; (-) strand; PAM type: YTN; PAM sequence: CTC
tcttggttgcttttagcctc

SEQ ID NO: 22577 - DNA, 20 bp, Artificial Sequence
  Description of Artificial Sequence: Synthetic oligonucleotide
  Target: FXN; (-) strand; PAM type: YTN; PAM sequence: TTC
ctctcttggttgcttttagc

SEQ ID NO: 22578 - DNA, 20 bp, Artificial Sequence
  Description of Artificial Sequence: Synthetic oligonucleotide
  Target: FXN; (-) strand; PAM type: YTN; PAM sequence: CTG
ttcctctcttggttgctttt

SEQ ID NO: 22579 - DNA, 20 bp, Artificial Sequence
  Description of Artificial Sequence: Synthetic oligonucleotide
  Target: FXN; (-) strand; PAM type: YTN; PAM sequence: CTG
tagctgttcctctcttggtt

SEQ ID NO: 22580 - DNA, 20 bp, Artificial Sequence
  Description of Artificial Sequence: Synthetic oligonucleotide
  Target: FXN; (-) strand; PAM type: YTN; PAM sequence: CTG
tggtacactgtagctgttcc

SEQ ID NO: 22581 - DNA, 20 bp, Artificial Sequence
  Description of Artificial Sequence: Synthetic oligonucleotide
  Target: FXN; (-) strand; PAM type: YTN; PAM sequence: CTC
tgtggtacactgtagctgtt

SEQ ID NO: 22582 - DNA, 20 bp, Artificial Sequence
  Description of Artificial Sequence: Synthetic oligonucleotide
  Target: FXN; (-) strand; PAM type: YTN; PAM sequence: TTG
agggactctgtggtacactg

SEQ ID NO: 22583 - DNA, 20 bp, Artificial Sequence
  Description of Artificial Sequence: Synthetic oligonucleotide
  Target: FXN; (-) strand; PAM type: YTN; PAM sequence: CTG
gggcaccgtggcgtgggcaa

SEQ ID NO: 22584 - DNA, 20 bp, Artificial Sequence
  Description of Artificial Sequence: Synthetic oligonucleotide
  Target: FXN; (-) strand; PAM type: YTN; PAM sequence: TTG
gtaagaagctggggcaccgt

SEQ ID NO: 22585 - DNA, 20 bp, Artificial Sequence
  Description of Artificial Sequence: Synthetic oligonucleotide
  Target: FXN; (-) strand; PAM type: YTN; PAM sequence: CTT
ggtaagaagctggggcaccg

SEQ ID NO: 22586 - DNA, 20 bp, Artificial Sequence
  Description of Artificial Sequence: Synthetic oligonucleotide
  Target: FXN; (-) strand; PAM type: YTN; PAM sequence: TTG
gaggtagtcaagaggaatca

SEQ ID NO: 22587 - DNA, 20 bp, Artificial Sequence
  Description of Artificial Sequence: Synthetic oligonucleotide
  Target: FXN; (-) strand; PAM type: YTN; PAM sequence: CTT
ggaggtagtcaagaggaatc

SEQ ID NO: 22588 - DNA, 20 bp, Artificial Sequence
  Description of Artificial Sequence: Synthetic oligonucleotide
  Target: FXN; (-) strand; PAM type: YTN; PAM sequence: TTC
cttggaggtagtcaagagga

SEQ ID NO: 22589 - DNA, 20 bp, Artificial Sequence
  Description of Artificial Sequence: Synthetic oligonucleotide
  Target: FXN; (-) strand; PAM type: YTN; PAM sequence: CTT
ccttggaggtagtcaagagg

SEQ ID NO: 22590 - DNA, 20 bp, Artificial Sequence
  Description of Artificial Sequence: Synthetic oligonucleotide
  Target: FXN; (-) strand; PAM type: YTN; PAM sequence: CTC
cacttccttggaggtagtca

SEQ ID NO: 22591 - DNA, 20 bp, Artificial Sequence
  Description of Artificial Sequence: Synthetic oligonucleotide
  Target: FXN; (-) strand; PAM type: YTN; PAM sequence: TTC
tccacttccttggaggtagt

SEQ ID NO: 22592 - DNA, 20 bp, Artificial Sequence
  Description of Artificial Sequence: Synthetic oligonucleotide
  Target: FXN; (-) strand; PAM type: YTN; PAM sequence: TTT
ctccacttccttggaggtag

SEQ ID NO: 22593 - DNA, 20 bp, Artificial Sequence
  Description of Artificial Sequence: Synthetic oligonucleotide
  Target: FXN; (-) strand; PAM type: YTN; PAM sequence: CTT
tctccacttccttggaggta

SEQ ID NO: 22594 - DNA, 20 bp, Artificial Sequence
  Description of Artificial Sequence: Synthetic oligonucleotide
  Target: FXN; (-) strand; PAM type: YTN; PAM sequence: TTG
tctttctccacttccttgga

SEQ ID NO: 22595 - DNA, 20 bp, Artificial Sequence
  Description of Artificial Sequence: Synthetic oligonucleotide
  Target: FXN; (-) strand; PAM type: YTN; PAM sequence: CTT
gtctttctccacttccttgg

SEQ ID NO: 22596 - DNA, 20 bp, Artificial Sequence
  Description of Artificial Sequence: Synthetic oligonucleotide
  Target: FXN; (-) strand; PAM type: YTN; PAM sequence: TTC
gcaagaacttgtctttctcc

SEQ ID NO: 22597 - DNA, 20 bp, Artificial Sequence
  Description of Artificial Sequence: Synthetic oligonucleotide
  Target: FXN; (-) strand; PAM type: YTN; PAM sequence: CTT
cgcaagaacttgtctttctc

SEQ ID NO: 22598 - DNA, 20 bp, Artificial Sequence
  Description of Artificial Sequence: Synthetic oligonucleotide
  Target: FXN; (-) strand; PAM type: YTN; PAM sequence: TTG
gccaaagaaatagacataga

SEQ ID NO: 22599 - DNA, 20 bp, Artificial Sequence
  Description of Artificial Sequence: Synthetic oligonucleotide
  Target: FXN; (-) strand; PAM type: YTN; PAM sequence: TTT
ggccaaagaaatagacatag

SEQ ID NO: 22600 - DNA, 20 bp, Artificial Sequence
  Description of Artificial Sequence: Synthetic oligonucleotide
  Target: FXN; (-) strand; PAM type: YTN; PAM sequence: TTT
tggccaaagaaatagacata

SEQ ID NO: 22601 - DNA, 20 bp, Artificial Sequence
  Description of Artificial Sequence: Synthetic oligonucleotide
  Target: FXN; (-) strand; PAM type: YTN; PAM sequence: TTT
ttggccaaagaaatagacat

SEQ ID NO: 22602 - DNA, 20 bp, Artificial Sequence
  Description of Artificial Sequence: Synthetic oligonucleotide
  Target: FXN; (-) strand; PAM type: YTN; PAM sequence: CTT
tttggccaaagaaatagaca

SEQ ID NO: 22603 - DNA, 20 bp, Artificial Sequence
  Description of Artificial Sequence: Synthetic oligonucleotide
  Target: FXN; (-) strand; PAM type: YTN; PAM sequence: TTG
ccccatctttttggccaaag

SEQ ID NO: 22604 - DNA, 20 bp, Artificial Sequence
  Description of Artificial Sequence: Synthetic oligonucleotide
  Target: FXN; (-) strand; PAM type: YTN; PAM sequence: TTG
atatcattgccccatctttt

SEQ ID NO: 22605 - DNA, 20 bp, Artificial Sequence
  Description of Artificial Sequence: Synthetic oligonucleotide
  Target: FXN; (-) strand; PAM type: YTN; PAM sequence: CTG
caaagttgatatcattgccc

SEQ ID NO: 22606 - DNA, 20 bp, Artificial Sequence
  Description of Artificial Sequence: Synthetic oligonucleotide
  Target: FXN; (-) strand; PAM type: YTN; PAM sequence: CTC
cctgcaaagttgatatcatt

SEQ ID NO: 22607 - DNA, 20 bp, Artificial Sequence
  Description of Artificial Sequence: Synthetic oligonucleotide
  Target: FXN; (-) strand; PAM type: YTN; PAM sequence: CTC
cagctccctgcaaagttgat

SEQ ID NO: 22608 - DNA, 20 bp, Artificial Sequence
  Description of Artificial Sequence: Synthetic oligonucleotide
  Target: FXN; (-) strand; PAM type: YTN; PAM sequence: CTA
gcaaatgctccagctccctg

SEQ ID NO: 22609 - DNA, 20 bp, Artificial Sequence
  Description of Artificial Sequence: Synthetic oligonucleotide
  Target: FXN; (-) strand; PAM type: YTN; PAM sequence: CTG
gcatagaaaggtcactagca

SEQ ID NO: 22610 - DNA, 20 bp, Artificial Sequence
  Description of Artificial Sequence: Synthetic oligonucleotide
  Target: FXN; (-) strand; PAM type: YTN; PAM sequence: TTC
tggcatagaaaggtcactag

SEQ ID NO: 22611 - DNA, 20 bp, Artificial Sequence
  Description of Artificial Sequence: Synthetic oligonucleotide
  Target: FXN; (-) strand; PAM type: YTN; PAM sequence: TTA
gcaagttctggcatagaaag

SEQ ID NO: 22612 - DNA, 20 bp, Artificial Sequence
  Description of Artificial Sequence: Synthetic oligonucleotide
  Target: FXN; (-) strand; PAM type: YTN; PAM sequence: CTT
agcaagttctggcatagaaa

SEQ ID NO: 22613 - DNA, 20 bp, Artificial Sequence
  Description of Artificial Sequence: Synthetic oligonucleotide
  Target: FXN; (-) strand; PAM type: YTN; PAM sequence: CTA
gcatgcttagcaagttctgg

SEQ ID NO: 22614 - DNA, 20 bp, Artificial Sequence
  Description of Artificial Sequence: Synthetic oligonucleotide
  Target: FXN; (-) strand; PAM type: YTN; PAM sequence: TTA
gctagcatgcttagcaagtt

SEQ ID NO: 22615 - DNA, 20 bp, Artificial Sequence
  Description of Artificial Sequence: Synthetic oligonucleotide
  Target: FXN; (-) strand; PAM type: YTN; PAM sequence: TTA
ttagctagcatgcttagcaa

SEQ ID NO: 22616 - DNA, 20 bp, Artificial Sequence
  Description of Artificial Sequence: Synthetic oligonucleotide
  Target: FXN; (-) strand; PAM type: YTN; PAM sequence: CTA
catcattattagctagcatg

SEQ ID NO: 22617 - DNA, 20 bp, Artificial Sequence
  Description of Artificial Sequence: Synthetic oligonucleotide
  Target: FXN; (-) strand; PAM type: YTN; PAM sequence: CTG
tgctacatcattattagcta

SEQ ID NO: 22618 - DNA, 20 bp, Artificial Sequence
  Description of Artificial Sequence: Synthetic oligonucleotide
  Target: FXN; (-) strand; PAM type: YTN; PAM sequence: TTA
caggcgtgagccaccgcacc

SEQ ID NO: 22619 - DNA, 20 bp, Artificial Sequence
  Description of Artificial Sequence: Synthetic oligonucleotide
  Target: FXN; (-) strand; PAM type: YTN; PAM sequence: CTG
agattacaggcgtgagccac

SEQ ID NO: 22620 - DNA, 20 bp, Artificial Sequence
  Description of Artificial Sequence: Synthetic oligonucleotide
  Target: FXN; (-) strand; PAM type: YTN; PAM sequence: CTC
ggccgcccaaagtgctgaga

SEQ ID NO: 22621 - DNA, 20 bp, Artificial Sequence
  Description of Artificial Sequence: Synthetic oligonucleotide
  Target: FXN; (-) strand; PAM type: YTN; PAM sequence: CTC
aggtgatccgcccgcctcgg

SEQ ID NO: 22622 - DNA, 20 bp, Artificial Sequence
  Description of Artificial Sequence: Synthetic oligonucleotide
  Target: FXN; (-) strand; PAM type: YTN; PAM sequence: CTG
acctcaggtgatccgcccgc

SEQ ID NO: 22623 - DNA, 20 bp, Artificial Sequence
  Description of Artificial Sequence: Synthetic oligonucleotide
  Target: FXN; (-) strand; PAM type: YTN; PAM sequence: CTC
ctgacctcaggtgatccgcc

SEQ ID NO: 22624 - DNA, 20 bp, Artificial Sequence
  Description of Artificial Sequence: Synthetic oligonucleotide
  Target: FXN; (-) strand; PAM type: YTN; PAM sequence: CTC
gaactcctgacctcaggtga

SEQ ID NO: 22625 - DNA, 20 bp, Artificial Sequence
  Description of Artificial Sequence: Synthetic oligonucleotide
  Target: FXN; (-) strand; PAM type: YTN; PAM sequence: CTG
gtctcgaactcctgacctca

SEQ ID NO: 22626 - DNA, 20 bp, Artificial Sequence
  Description of Artificial Sequence: Synthetic oligonucleotide
  Target: FXN; (-) strand; PAM type: YTN; PAM sequence: TTG
gccaggctggtctcgaactc

SEQ ID NO: 22627 - DNA, 20 bp, Artificial Sequence
  Description of Artificial Sequence: Synthetic oligonucleotide
  Target: FXN; (-) strand; PAM type: YTN; PAM sequence: TTC
atcatgttggccaggctggt

SEQ ID NO: 22628 - DNA, 20 bp, Artificial Sequence
  Description of Artificial Sequence: Synthetic oligonucleotide
  Target: FXN; (-) strand; PAM type: YTN; PAM sequence: TTT
catcatgttggccaggctgg

SEQ ID NO: 22629 - DNA, 20 bp, Artificial Sequence
  Description of Artificial Sequence: Synthetic oligonucleotide
  Target: FXN; (-) strand; PAM type: YTN; PAM sequence: TTA
gtagagatggggtttcatca

SEQ ID NO: 22630 - DNA, 20 bp, Artificial Sequence
  Description of Artificial Sequence: Synthetic oligonucleotide
  Target: FXN; (-) strand; PAM type: YTN; PAM sequence: TTT
agtagagatggggtttcatc

SEQ ID NO: 22631 - DNA, 20 bp, Artificial Sequence
  Description of Artificial Sequence: Synthetic oligonucleotide
  Target: FXN; (-) strand; PAM type: YTN; PAM sequence: TTT
tagtagagatggggtttcat

SEQ ID NO: 22632 - DNA, 20 bp, Artificial Sequence
  Description of Artificial Sequence: Synthetic oligonucleotide
  Target: FXN; (-) strand; PAM type: YTN; PAM sequence: TTT
ttagtagagatggggtttca

SEQ ID NO: 22633 - DNA, 20 bp, Artificial Sequence
  Description of Artificial Sequence: Synthetic oligonucleotide
  Target: FXN; (-) strand; PAM type: YTN; PAM sequence: TTG
tatttttagtagagatgggg

SEQ ID NO: 22634 - DNA, 20 bp, Artificial Sequence
  Description of Artificial Sequence: Synthetic oligonucleotide
  Target: FXN; (-) strand; PAM type: YTN; PAM sequence: TTT
gtatttttagtagagatggg

SEQ ID NO: 22635 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagagatgg

SEQ ID NO: 22636 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagagatg

SEQ ID NO: 22637 - DNA, 20 bp, Artificial Sequence
  Description of Artificial Sequence: Synthetic oligonucleotide
  Target: FXN; (-) strand; PAM type: YTN; PAM sequence: CTA
atttttgtatttttagtaga

SEQ ID NO: 22638 - DNA, 20 bp, Artificial Sequence
  Description of Artificial Sequence: Synthetic oligonucleotide
  Target: FXN; (-) strand; PAM type: YTN; PAM sequence: CTG
gctaatttttgtatttttag

SEQ ID NO: 22639 - DNA, 20 bp, Artificial Sequence
  Description of Artificial Sequence: Synthetic oligonucleotide
  Target: FXN; (-) strand; PAM type: YTN; PAM sequence: TTG
caggtgcccaccaccacgcc

SEQ ID NO: 22640 - DNA, 20 bp, Artificial Sequence
  Description of Artificial Sequence: Synthetic oligonucleotide
  Target: FXN; (-) strand; PAM type: YTN; PAM sequence: CTG
ggattgcaggtgcccaccac

SEQ ID NO: 22641 - DNA, 20 bp, Artificial Sequence
  Description of Artificial Sequence: Synthetic oligonucleotide
  Target: FXN; (-) strand; PAM type: YTN; PAM sequence: CTC
cagagtagctgggattgcag

SEQ ID NO: 22642 - DNA, 20 bp, Artificial Sequence
  Description of Artificial Sequence: Synthetic oligonucleotide
  Target: FXN; (-) strand; PAM type: YTN; PAM sequence: CTC
agcctccagagtagctggga

SEQ ID NO: 22643 - DNA, 20 bp, Artificial Sequence
  Description of Artificial Sequence: Synthetic oligonucleotide
  Target: FXN; (-) strand; PAM type: YTN; PAM sequence: CTG
tctcagcctccagagtagct

SEQ ID NO: 22644 - DNA, 20 bp, Artificial Sequence
  Description of Artificial Sequence: Synthetic oligonucleotide
  Target: FXN; (-) strand; PAM type: YTN; PAM sequence: TTC
tgtctcagcctccagagtag

SEQ ID NO: 22645 - DNA, 20 bp, Artificial Sequence
  Description of Artificial Sequence: Synthetic oligonucleotide
  Target: FXN; (-) strand; PAM type: YTN; PAM sequence: TTC
aagagattctgtctcagcct

SEQ ID NO: 22646 - DNA, 20 bp, Artificial Sequence
  Description of Artificial Sequence: Synthetic oligonucleotide
  Target: FXN; (-) strand; PAM type: YTN; PAM sequence: CTG
ggttcaagagattctgtctc

SEQ ID NO: 22647 - DNA, 20 bp, Artificial Sequence
  Description of Artificial Sequence: Synthetic oligonucleotide
  Target: FXN; (-) strand; PAM type: YTN; PAM sequence: CTC
ctgggttcaagagattctgt

SEQ ID NO: 22648 - DNA, 20 bp, Artificial Sequence
  Description of Artificial Sequence: Synthetic oligonucleotide
  Target: FXN; (-) strand; PAM type: YTN; PAM sequence: CTC
cacctcctgggttcaagaga

SEQ ID NO: 22649 - DNA, 20 bp, Artificial Sequence
  Description of Artificial Sequence: Synthetic oligonucleotide
  Target: FXN; (-) strand; PAM type: YTN; PAM sequence: CTG
caatctccacctcctgggtt

SEQ ID NO: 22650 - DNA, 20 bp, Artificial Sequence
  Description of Artificial Sequence: Synthetic oligonucleotide
  Target: FXN; (-) strand; PAM type: YTN; PAM sequence: CTC
actgcaatctccacctcctg

SEQ ID NO: 22651 - DNA, 20 bp, Artificial Sequence
  Description of Artificial Sequence: Synthetic oligonucleotide
  Target: FXN; (-) strand; PAM type: YTN; PAM sequence: CTG
ctcactgcaatctccacctc

SEQ ID NO: 22652 - DNA, 20 bp, Artificial Sequence
  Description of Artificial Sequence: Synthetic oligonucleotide
  Target: FXN; (-) strand; PAM type: YTN; PAM sequence: CTC
tgctcactgcaatctccacc

SEQ ID NO: 22653 - DNA, 20 bp, Artificial Sequence
  Description of Artificial Sequence: Synthetic oligonucleotide
  Target: FXN; (-) strand; PAM type: YTN; PAM sequence: CTG
gaatgcagtggtgccatctc

SEQ ID NO: 22654 - DNA, 20 bp, Artificial Sequence
  Description of Artificial Sequence: Synthetic oligonucleotide
  Target: FXN; (-) strand; PAM type: YTN; PAM sequence: TTG
cccaggctggaatgcagtgg

SEQ ID NO: 22655 - DNA, 20 bp, Artificial Sequence
  Description of Artificial Sequence: Synthetic oligonucleotide
  Target: FXN; (-) strand; PAM type: YTN; PAM sequence: TTG
ttgcccaggctggaatgcag

SEQ ID NO: 22656 - DNA, 20 bp, Artificial Sequence
  Description of Artificial Sequence: Synthetic oligonucleotide
  Target: FXN; (-) strand; PAM type: YTN; PAM sequence: TTT
gttgcccaggctggaatgca

SEQ ID NO: 22657 - DNA, 20 bp, Artificial Sequence
  Description of Artificial Sequence: Synthetic oligonucleotide
  Target: FXN; (-) strand; PAM type: YTN; PAM sequence: CTT
tgttgcccaggctggaatgc

SEQ ID NO: 22658 - DNA, 20 bp, Artificial Sequence
  Description of Artificial Sequence: Synthetic oligonucleotide
  Target: FXN; (-) strand; PAM type: YTN; PAM sequence: TTG
ctttgttgcccaggctggaa

SEQ ID NO: 22659 - DNA, 20 bp, Artificial Sequence
  Description of Artificial Sequence: Synthetic oligonucleotide
  Target: FXN; (-) strand; PAM type: YTN; PAM sequence: CTT
gctttgttgcccaggctgga

SEQ ID NO: 22660 - DNA, 20 bp, Artificial Sequence
  Description of Artificial Sequence: Synthetic oligonucleotide
  Target: FXN; (-) strand; PAM type: YTN; PAM sequence: TTG
agacagagtcttgctttgtt

SEQ ID NO: 22661 - DNA, 20 bp, Artificial Sequence
  Description of Artificial Sequence: Synthetic oligonucleotide
  Target: FXN; (-) strand; PAM type: YTN; PAM sequence: TTT
gagacagagtcttgctttgt

SEQ ID NO: 22662 - DNA, 20 bp, Artificial Sequence
  Description of Artificial Sequence: Synthetic oligonucleotide
  Target: FXN; (-) strand; PAM type: YTN; PAM sequence: TTA
tttgagacagagtcttgctt

SEQ ID NO: 22663 - DNA, 20 bp, Artificial Sequence
  Description of Artificial Sequence: Synthetic oligonucleotide
  Target: FXN; (-) strand; PAM type: YTN; PAM sequence: TTA
ttatttgagacagagtcttg

SEQ ID NO: 22664 - DNA, 20 bp, Artificial Sequence
  Description of Artificial Sequence: Synthetic oligonucleotide
  Target: FXN; (-) strand; PAM type: YTN; PAM sequence: TTA
ttattatttgagacagagtc

SEQ ID NO: 22665 - DNA, 20 bp, Artificial Sequence
  Description of Artificial Sequence: Synthetic oligonucleotide
  Target: FXN; (-) strand; PAM type: YTN; PAM sequence: TTA
ttattattatttgagacaga

SEQ ID NO: 22666 - DNA, 20 bp, Artificial Sequence
  Description of Artificial Sequence: Synthetic oligonucleotide
  Target: FXN; (-) strand; PAM type: YTN; PAM sequence: TTA
ttattattattatttgagac

SEQ ID NO: 22667 - DNA, 20 bp, Artificial Sequence
  Description of Artificial Sequence: Synthetic oligonucleotide
  Target: FXN; (-) strand; PAM type: YTN; PAM sequence: TTA
ttattattattattatttga

SEQ ID NO: 22668 - DNA, 20 bp, Artificial Sequence
  Description of Artificial Sequence: Synthetic oligonucleotide
  Target: FXN; (-) strand; PAM type: YTN; PAM sequence: TTA
gttattattattattattat

SEQ ID NO: 22669 - DNA, 20 bp, Artificial Sequence
  Description of Artificial Sequence: Synthetic oligonucleotide
  Target: FXN; (-) strand; PAM type: YTN; PAM sequence: CTG
catcattagttattattatt

SEQ ID NO: 22670 - DNA, 20 bp, Artificial Sequence
  Description of Artificial Sequence: Synthetic oligonucleotide
  Target: FXN; (-) strand; PAM type: YTN; PAM sequence: CTC
agagagagaaagctgcatca

SEQ ID NO: 22671 - DNA, 20 bp, Artificial Sequence
  Description of Artificial Sequence: Synthetic oligonucleotide
  Target: FXN; (-) strand; PAM type: YTN; PAM sequence: TTA
tatactcagagagagaaagc

SEQ ID NO: 22672 - DNA, 20 bp, Artificial Sequence
  Description of Artificial Sequence: Synthetic oligonucleotide
  Target: FXN; (-) strand; PAM type: YTN; PAM sequence: CTG
cattatatactcagagagag

SEQ ID NO: 22673 - DNA, 20 bp, Artificial Sequence
  Description of Artificial Sequence: Synthetic oligonucleotide
  Target: FXN; (-) strand; PAM type: YTN; PAM sequence: CTC
acatcatcagaactgcatta

SEQ ID NO: 22674 - DNA, 20 bp, Artificial Sequence
  Description of Artificial Sequence: Synthetic oligonucleotide
  Target: FXN; (-) strand; PAM type: YTN; PAM sequence: TTC
ctcacatcatcagaactgca

SEQ ID NO: 22675 - DNA, 20 bp, Artificial Sequence
  Description of Artificial Sequence: Synthetic oligonucleotide
  Target: FXN; (-) strand; PAM type: YTN; PAM sequence: CTT
cctcacatcatcagaactgc

SEQ ID NO: 22676 - DNA, 20 bp, Artificial Sequence
  Description of Artificial Sequence: Synthetic oligonucleotide
  Target: FXN; (-) strand; PAM type: YTN; PAM sequence: CTG
ccacaccaacagtgaggccc

SEQ ID NO: 22677 - DNA, 20 bp, Artificial Sequence
  Description of Artificial Sequence: Synthetic oligonucleotide
  Target: FXN; (-) strand; PAM type: YTN; PAM sequence: CTC
tgccacaccaacagtgaggc

SEQ ID NO: 22678 - DNA, 20 bp, Artificial Sequence
  Description of Artificial Sequence: Synthetic oligonucleotide
  Target: FXN; (-) strand; PAM type: YTN; PAM sequence: CTC
agactctgccacaccaacag

SEQ ID NO: 22679 - DNA, 20 bp, Artificial Sequence
  Description of Artificial Sequence: Synthetic oligonucleotide
  Target: FXN; (-) strand; PAM type: YTN; PAM sequence: TTG
ccagccatggtctcagactc

SEQ ID NO: 22680 - DNA, 20 bp, Artificial Sequence
  Description of Artificial Sequence: Synthetic oligonucleotide
  Target: FXN; (-) strand; PAM type: YTN; PAM sequence: TTC
attgccagccatggtctcag

SEQ ID NO: 22681 - DNA, 20 bp, Artificial Sequence
  Description of Artificial Sequence: Synthetic oligonucleotide
  Target: FXN; (-) strand; PAM type: YTN; PAM sequence: TTT
cattgccagccatggtctca

SEQ ID NO: 22682 - DNA, 20 bp, Artificial Sequence
  Description of Artificial Sequence: Synthetic oligonucleotide
  Target: FXN; (-) strand; PAM type: YTN; PAM sequence: TTT
tcattgccagccatggtctc

SEQ ID NO: 22683 - DNA, 20 bp, Artificial Sequence
  Description of Artificial Sequence: Synthetic oligonucleotide
  Target: FXN; (-) strand; PAM type: YTN; PAM sequence: TTG
aaaccataaagggagagccc

SEQ ID NO: 22684 - DNA, 20 bp, Artificial Sequence
  Description of Artificial Sequence: Synthetic oligonucleotide
  Target: FXN; (-) strand; PAM type: YTN; PAM sequence: CTT
gaaaccataaagggagagcc

SEQ ID NO: 22685 - DNA, 20 bp, Artificial Sequence
  Description of Artificial Sequence: Synthetic oligonucleotide
  Target: FXN; (-) strand; PAM type: YTN; PAM sequence: CTC
cttgaaaccataaagggaga

SEQ ID NO: 22686 - DNA, 20 bp, Artificial Sequence
  Description of Artificial Sequence: Synthetic oligonucleotide
  Target: FXN; (-) strand; PAM type: YTN; PAM sequence: TTG
agaagccctccttgaaacca

SEQ ID NO: 22687 - DNA, 20 bp, Artificial Sequence
  Description of Artificial Sequence: Synthetic oligonucleotide
  Target: FXN; (-) strand; PAM type: YTN; PAM sequence: CTG
ccaagattgagaagccctcc

SEQ ID NO: 22688 - DNA, 20 bp, Artificial Sequence
  Description of Artificial Sequence: Synthetic oligonucleotide
  Target: FXN; (-) strand; PAM type: YTN; PAM sequence: TTC
tgccaagattgagaagccct

SEQ ID NO: 22689 - DNA, 20 bp, Artificial Sequence
  Description of Artificial Sequence: Synthetic oligonucleotide
  Target: FXN; (-) strand; PAM type: YTN; PAM sequence: CTA
tccagtccaaaattctgcca

SEQ ID NO: 22690 - DNA, 20 bp, Artificial Sequence
  Description of Artificial Sequence: Synthetic oligonucleotide
  Target: FXN; (-) strand; PAM type: YTN; PAM sequence: CTG
tgcaacaaagaactatccag

SEQ ID NO: 22691 - DNA, 20 bp, Artificial Sequence
  Description of Artificial Sequence: Synthetic oligonucleotide
  Target: FXN; (-) strand; PAM type: YTN; PAM sequence: CTG
tgatgtgcaggacagccccc

SEQ ID NO: 22692 - DNA, 20 bp, Artificial Sequence
  Description of Artificial Sequence: Synthetic oligonucleotide
  Target: FXN; (-) strand; PAM type: YTN; PAM sequence: CTA
gtaggtagaggccagggatg

SEQ ID NO: 22693 - DNA, 20 bp, Artificial Sequence
  Description of Artificial Sequence: Synthetic oligonucleotide
  Target: FXN; (-) strand; PAM type: YTN; PAM sequence: CTG
gcatctagtaggtagaggcc

SEQ ID NO: 22694 - DNA, 20 bp, Artificial Sequence
  Description of Artificial Sequence: Synthetic oligonucleotide
  Target: FXN; (-) strand; PAM type: YTN; PAM sequence: CTA
ctggcatctagtaggtagag

SEQ ID NO: 22695 - DNA, 20 bp, Artificial Sequence
  Description of Artificial Sequence: Synthetic oligonucleotide
  Target: FXN; (-) strand; PAM type: YTN; PAM sequence: TTC
tactggcatctagtaggtag

SEQ ID NO: 22696 - DNA, 20 bp, Artificial Sequence
  Description of Artificial Sequence: Synthetic oligonucleotide
  Target: FXN; (-) strand; PAM type: YTN; PAM sequence: CTG
tggggtgggtatgttctact

SEQ ID NO: 22697 - DNA, 20 bp, Artificial Sequence
  Description of Artificial Sequence: Synthetic oligonucleotide
  Target: FXN; (-) strand; PAM type: YTN; PAM sequence: TTG
tcacaacaggcagctgtggg

SEQ ID NO: 22698 - DNA, 20 bp, Artificial Sequence
  Description of Artificial Sequence: Synthetic oligonucleotide
  Target: FXN; (-) strand; PAM type: YTN; PAM sequence: TTG
attgtcacaacaggcagctg

SEQ ID NO: 22699 - DNA, 20 bp, Artificial Sequence
  Description of Artificial Sequence: Synthetic oligonucleotide
  Target: FXN; (-) strand; PAM type: YTN; PAM sequence: TTT
gattgtcacaacaggcagct

SEQ ID NO: 22700 - DNA, 20 bp, Artificial Sequence
  Description of Artificial Sequence: Synthetic oligonucleotide
  Target: FXN; (-) strand; PAM type: YTN; PAM sequence: TTT
tgattgtcacaacaggcagc

SEQ ID NO: 22701 - DNA, 20 bp, Artificial Sequence
  Description of Artificial Sequence: Synthetic oligonucleotide
  Target: FXN; (-) strand; PAM type: YTN; PAM sequence: CTT
ttgattgtcacaacaggcag

SEQ ID NO: 22702 - DNA, 20 bp, Artificial Sequence
  Description of Artificial Sequence: Synthetic oligonucleotide
  Target: FXN; (-) strand; PAM type: YTN; PAM sequence: CTG
gagatgcttttgattgtcac

SEQ ID NO: 22703 - DNA, 20 bp, Artificial Sequence
  Description of Artificial Sequence: Synthetic oligonucleotide
  Target: FXN; (-) strand; PAM type: YTN; PAM sequence: CTG
caaagtatctggagatgctt

SEQ ID NO: 22704 - DNA, 20 bp, Artificial Sequence
  Description of Artificial Sequence: Synthetic oligonucleotide
  Target: FXN; (-) strand; PAM type: YTN; PAM sequence: TTC
cccctgcaaagtatctggag

SEQ ID NO: 22705 - DNA, 20 bp, Artificial Sequence
  Description of Artificial Sequence: Synthetic oligonucleotide
  Target: FXN; (-) strand; PAM type: YTN; PAM sequence: TTT
ccccctgcaaagtatctgga

SEQ ID NO: 22706 - DNA, 20 bp, Artificial Sequence
  Description of Artificial Sequence: Synthetic oligonucleotide
  Target: FXN; (-) strand; PAM type: YTN; PAM sequence: TTT
tccccctgcaaagtatctgg

SEQ ID NO: 22707 - DNA, 20 bp, Artificial Sequence
  Description of Artificial Sequence: Synthetic oligonucleotide
  Target: FXN; (-) strand; PAM type: YTN; PAM sequence: CTG
gagaaatcattttccccctg

SEQ ID NO: 22708 - DNA, 20 bp, Artificial Sequence
  Description of Artificial Sequence: Synthetic oligonucleotide
  Target: FXN; (-) strand; PAM type: YTN; PAM sequence: TTA
tgtatatgccaggcctggag

SEQ ID NO: 22709 - DNA, 20 bp, Artificial Sequence
  Description of Artificial Sequence: Synthetic oligonucleotide
  Target: FXN; (-) strand; PAM type: YTN; PAM sequence: CTG
ttatgtatatgccaggcctg

SEQ ID NO: 22710 - DNA, 20 bp, Artificial Sequence
  Description of Artificial Sequence: Synthetic oligonucleotide
  Target: FXN; (-) strand; PAM type: YTN; PAM sequence: TTA
aatactgttatgtatatgcc

SEQ ID NO: 22711 - DNA, 20 bp, Artificial Sequence
  Description of Artificial Sequence: Synthetic oligonucleotide
  Target: FXN; (-) strand; PAM type: YTN; PAM sequence: CTT
aaatactgttatgtatatgc

SEQ ID NO: 22712 - DNA, 20 bp, Artificial Sequence
  Description of Artificial Sequence: Synthetic oligonucleotide
  Target: FXN; (-) strand; PAM type: YTN; PAM sequence: CTG
cttaaatactgttatgtata

SEQ ID NO: 22713 - DNA, 20 bp, Artificial Sequence
  Description of Artificial Sequence: Synthetic oligonucleotide
  Target: FXN; (-) strand; PAM type: YTN; PAM sequence: CTA
ggcagctgcttaaatactgt

SEQ ID NO: 22714 - DNA, 20 bp, Artificial Sequence
  Description of Artificial Sequence: Synthetic oligonucleotide
  Target: FXN; (-) strand; PAM type: YTN; PAM sequence: TTC
taggcagctgcttaaatact

SEQ ID NO: 22715 - DNA, 20 bp, Artificial Sequence
  Description of Artificial Sequence: Synthetic oligonucleotide
  Target: FXN; (-) strand; PAM type: YTN; PAM sequence: TTA
attctaggcagctgcttaaa

SEQ ID NO: 22716 - DNA, 20 bp, Artificial Sequence
  Description of Artificial Sequence: Synthetic oligonucleotide
  Target: FXN; (-) strand; PAM type: YTN; PAM sequence: TTA
attaattctaggcagctgct

SEQ ID NO: 22717 - DNA, 20 bp, Artificial Sequence
  Description of Artificial Sequence: Synthetic oligonucleotide
  Target: FXN; (-) strand; PAM type: YTN; PAM sequence: TTT
aattaattctaggcagctgc

SEQ ID NO: 22718 - DNA, 20 bp, Artificial Sequence
  Description of Artificial Sequence: Synthetic oligonucleotide
  Target: FXN; (-) strand; PAM type: YTN; PAM sequence: CTG
tgtttaattaattctaggca

SEQ ID NO: 22719 - DNA, 20 bp, Artificial Sequence
  Description of Artificial Sequence: Synthetic oligonucleotide
  Target: FXN; (-) strand; PAM type: YTN; PAM sequence: TTC
tgtgtttaattaattctagg

SEQ ID NO: 22720 - DNA, 20 bp, Artificial Sequence
  Description of Artificial Sequence: Synthetic oligonucleotide
  Target: FXN; (-) strand; PAM type: YTN; PAM sequence: CTT
ctgtgtttaattaattctag

SEQ ID NO: 22721 - DNA, 20 bp, Artificial Sequence
  Description of Artificial Sequence: Synthetic oligonucleotide
  Target: FXN; (-) strand; PAM type: YTN; PAM sequence: CTG
gatgagagacatccttctgt

SEQ ID NO: 22722 - DNA, 20 bp, Artificial Sequence
  Description of Artificial Sequence: Synthetic oligonucleotide
  Target: FXN; (-) strand; PAM type: YTN; PAM sequence: TTC
tggatgagagacatccttct

SEQ ID NO: 22723 - DNA, 20 bp, Artificial Sequence
  Description of Artificial Sequence: Synthetic oligonucleotide
  Target: FXN; (-) strand; PAM type: YTN; PAM sequence: CTA
tcaaagaggtggtccagggc

SEQ ID NO: 22724 - DNA, 20 bp, Artificial Sequence
  Description of Artificial Sequence: Synthetic oligonucleotide
  Target: FXN; (-) strand; PAM type: YTN; PAM sequence: TTG
cctatcaaagaggtggtcca

SEQ ID NO: 22725 - DNA, 20 bp, Artificial Sequence
  Description of Artificial Sequence: Synthetic oligonucleotide
  Target: FXN; (-) strand; PAM type: YTN; PAM sequence: CTG
attgcctatcaaagaggtgg

SEQ ID NO: 22726 - DNA, 20 bp, Artificial Sequence
  Description of Artificial Sequence: Synthetic oligonucleotide
  Target: FXN; (-) strand; PAM type: YTN; PAM sequence: TTC
aaaaatagggtggaggaggt

SEQ ID NO: 22727 - DNA, 20 bp, Artificial Sequence
  Description of Artificial Sequence: Synthetic oligonucleotide
  Target: FXN; (-) strand; PAM type: YTN; PAM sequence: CTT
caaaaatagggtggaggagg

SEQ ID NO: 22728 - DNA, 20 bp, Artificial Sequence
  Description of Artificial Sequence: Synthetic oligonucleotide
  Target: FXN; (-) strand; PAM type: YTN; PAM sequence: TTG
gcacagggccttcaaaaata

SEQ ID NO: 22729 - DNA, 20 bp, Artificial Sequence
  Description of Artificial Sequence: Synthetic oligonucleotide
  Target: FXN; (-) strand; PAM type: YTN; PAM sequence: TTC
atggaagaagtggtgttggc

SEQ ID NO: 22730 - DNA, 20 bp, Artificial Sequence
  Description of Artificial Sequence: Synthetic oligonucleotide
  Target: FXN; (-) strand; PAM type: YTN; PAM sequence: CTA
gggatgggggaatcaaggaa

SEQ ID NO: 22731 - DNA, 20 bp, Artificial Sequence
  Description of Artificial Sequence: Synthetic oligonucleotide
  Target: FXN; (-) strand; PAM type: YTN; PAM sequence: TTA
tatagagctagggatggggg

SEQ ID NO: 22732 - DNA, 20 bp, Artificial Sequence
  Description of Artificial Sequence: Synthetic oligonucleotide
  Target: FXN; (-) strand; PAM type: YTN; PAM sequence: TTT
atatagagctagggatgggg

SEQ ID NO: 22733 - DNA, 20 bp, Artificial Sequence
  Description of Artificial Sequence: Synthetic oligonucleotide
  Target: FXN; (-) strand; PAM type: YTN; PAM sequence: TTG
agtgggagatttatatagag

SEQ ID NO: 22734 - DNA, 20 bp, Artificial Sequence
  Description of Artificial Sequence: Synthetic oligonucleotide
  Target: FXN; (-) strand; PAM type: YTN; PAM sequence: CTA
acaggtgtgagtgttgagtg

SEQ ID NO: 22735 - DNA, 20 bp, Artificial Sequence
  Description of Artificial Sequence: Synthetic oligonucleotide
  Target: FXN; (-) strand; PAM type: YTN; PAM sequence: CTA
aatgacaagtgtcaagagga

SEQ ID NO: 22736 - DNA, 20 bp, Artificial Sequence
  Description of Artificial Sequence: Synthetic oligonucleotide
  Target: FXN; (-) strand; PAM type: YTN; PAM sequence: TTA
ggatgctaaatgacaagtgt

SEQ ID NO: 22737 - DNA, 20 bp, Artificial Sequence
  Description of Artificial Sequence: Synthetic oligonucleotide
  Target: FXN; (-) strand; PAM type: YTN; PAM sequence: CTT
aggatgctaaatgacaagtg

SEQ ID NO: 22738 - DNA, 20 bp, Artificial Sequence
  Description of Artificial Sequence: Synthetic oligonucleotide
  Target: FXN; (-) strand; PAM type: YTN; PAM sequence: TTA
catacttaggatgctaaatg

SEQ ID NO: 22739 - DNA, 20 bp, Artificial Sequence
  Description of Artificial Sequence: Synthetic oligonucleotide
  Target: FXN; (-) strand; PAM type: YTN; PAM sequence: TTT
acatacttaggatgctaaat

SEQ ID NO: 22740 - DNA, 20 bp, Artificial Sequence
  Description of Artificial Sequence: Synthetic oligonucleotide
  Target: FXN; (-) strand; PAM type: YTN; PAM sequence: TTG
tgaatcgtgaagagagacat

SEQ ID NO: 22741 - DNA, 20 bp, Artificial Sequence
  Description of Artificial Sequence: Synthetic oligonucleotide
  Target: FXN; (-) strand; PAM type: YTN; PAM sequence: TTT
gtgaatcgtgaagagagaca

SEQ ID NO: 22742 - DNA, 20 bp, Artificial Sequence
  Description of Artificial Sequence: Synthetic oligonucleotide
  Target: FXN; (-) strand; PAM type: YTN; PAM sequence: CTT
tgtgaatcgtgaagagagac

SEQ ID NO: 22743 - DNA, 20 bp, Artificial Sequence
  Description of Artificial Sequence: Synthetic oligonucleotide
  Target: FXN; (-) strand; PAM type: YTN; PAM sequence: TTC
caaagccactttgtgaatcg

SEQ ID NO: 22744 - DNA, 20 bp, Artificial Sequence
  Description of Artificial Sequence: Synthetic oligonucleotide
  Target: FXN; (-) strand; PAM type: YTN; PAM sequence: CTT
ccaaagccactttgtgaatc

SEQ ID NO: 22745 - DNA, 20 bp, Artificial Sequence
  Description of Artificial Sequence: Synthetic oligonucleotide
  Target: FXN; (-) strand; PAM type: YTN; PAM sequence: TTC
ttccaaagccactttgtgaa

SEQ ID NO: 22746 - DNA, 20 bp, Artificial Sequence
  Description of Artificial Sequence: Synthetic oligonucleotide
  Target: FXN; (-) strand; PAM type: YTN; PAM sequence: CTA
aagttcttccaaagccactt

SEQ ID NO: 22747 - DNA, 20 bp, Artificial Sequence
  Description of Artificial Sequence: Synthetic oligonucleotide
  Target: FXN; (-) strand; PAM type: YTN; PAM sequence: TTC
catggcagagaagatgggaa

SEQ ID NO: 22748 - DNA, 20 bp, Artificial Sequence
  Description of Artificial Sequence: Synthetic oligonucleotide
  Target: FXN; (-) strand; PAM type: YTN; PAM sequence: TTT
ccatggcagagaagatggga

SEQ ID NO: 22749 - DNA, 20 bp, Artificial Sequence
  Description of Artificial Sequence: Synthetic oligonucleotide
  Target: FXN; (-) strand; PAM type: YTN; PAM sequence: CTT
tccatggcagagaagatggg

SEQ ID NO: 22750 - DNA, 20 bp, Artificial Sequence
  Description of Artificial Sequence: Synthetic oligonucleotide
  Target: FXN; (-) strand; PAM type: YTN; PAM sequence: TTG
tgtacactttccatggcaga

SEQ ID NO: 22751 - DNA, 20 bp, Artificial Sequence
  Description of Artificial Sequence: Synthetic oligonucleotide
  Target: FXN; (-) strand; PAM type: YTN; PAM sequence: TTA
aaaaaaaagaaaatgtcagt

SEQ ID NO: 22752 - DNA, 20 bp, Artificial Sequence
  Description of Artificial Sequence: Synthetic oligonucleotide
  Target: FXN; (-) strand; PAM type: YTN; PAM sequence: CTT
aaaaaaaaagaaaatgtcag

SEQ ID NO: 22753 - DNA, 20 bp, Artificial Sequence
  Description of Artificial Sequence: Synthetic oligonucleotide
  Target: FXN; (-) strand; PAM type: YTN; PAM sequence: CTG
tcttaaaaaaaaagaaaatg

SEQ ID NO: 22754 - DNA, 20 bp, Artificial Sequence
  Description of Artificial Sequence: Synthetic oligonucleotide
  Target: FXN; (-) strand; PAM type: YTN; PAM sequence: TTC
cagcccggccatcatagcaa

SEQ ID NO: 22755 - DNA, 20 bp, Artificial Sequence
  Description of Artificial Sequence: Synthetic oligonucleotide
  Target: FXN; (-) strand; PAM type: YTN; PAM sequence: CTG
tgaatagccacagcattcca

SEQ ID NO: 22756 - DNA, 20 bp, Artificial Sequence
  Description of Artificial Sequence: Synthetic oligonucleotide
  Target: FXN; (-) strand; PAM type: YTN; PAM sequence: TTG
tgcctgtgaatagccacagc

SEQ ID NO: 22757 - DNA, 20 bp, Artificial Sequence
  Description of Artificial Sequence: Synthetic oligonucleotide
  Target: FXN; (-) strand; PAM type: YTN; PAM sequence: CTA
tgattgtgcctgtgaatagc

SEQ ID NO: 22758 - DNA, 20 bp, Artificial Sequence
  Description of Artificial Sequence: Synthetic oligonucleotide
  Target: FXN; (-) strand; PAM type: YTN; PAM sequence: CTG
cagtgagctatgattgtgcc

SEQ ID NO: 22759 - DNA, 20 bp, Artificial Sequence
  Description of Artificial Sequence: Synthetic oligonucleotide
  Target: FXN; (-) strand; PAM type: YTN; PAM sequence: CTC
aaggctgcagtgagctatga

SEQ ID NO: 22760 - DNA, 20 bp, Artificial Sequence
  Description of Artificial Sequence: Synthetic oligonucleotide
  Target: FXN; (-) strand; PAM type: YTN; PAM sequence: CTG
ggagctcaaggctgcagtga

SEQ ID NO: 22761 - DNA, 20 bp, Artificial Sequence
  Description of Artificial Sequence: Synthetic oligonucleotide
  Target: FXN; (-) strand; PAM type: YTN; PAM sequence: TTG
agcctgggagctcaaggctg

SEQ ID NO: 22762 - DNA, 20 bp, Artificial Sequence
  Description of Artificial Sequence: Synthetic oligonucleotide
  Target: FXN; (-) strand; PAM type: YTN; PAM sequence: CTT
gagcctgggagctcaaggct

SEQ ID NO: 22763 - DNA, 20 bp, Artificial Sequence
  Description of Artificial Sequence: Synthetic oligonucleotide
  Target: FXN; (-) strand; PAM type: YTN; PAM sequence: CTG
aggcgggaggatcacttgag

SEQ ID NO: 22764 - DNA, 20 bp, Artificial Sequence
  Description of Artificial Sequence: Synthetic oligonucleotide
  Target: FXN; (-) strand; PAM type: YTN; PAM sequence: CTC
aggaggctgaggcgggagga

SEQ ID NO: 22765 - DNA, 20 bp, Artificial Sequence
  Description of Artificial Sequence: Synthetic oligonucleotide
  Target: FXN; (-) strand; PAM type: YTN; PAM sequence: CTA
ctcaggaggctgaggcggga

SEQ ID NO: 22766 - DNA, 20 bp, Artificial Sequence
  Description of Artificial Sequence: Synthetic oligonucleotide
  Target: FXN; (-) strand; PAM type: YTN; PAM sequence: CTC
agctactcaggaggctgagg

SEQ ID NO: 22767 - DNA, 20 bp, Artificial Sequence
  Description of Artificial Sequence: Synthetic oligonucleotide
  Target: FXN; (-) strand; PAM type: YTN; PAM sequence: CTG
tgatctcagctactcaggag

SEQ ID NO: 22768 - DNA, 20 bp, Artificial Sequence
  Description of Artificial Sequence: Synthetic oligonucleotide
  Target: FXN; (-) strand; PAM type: YTN; PAM sequence: TTA
gaggatgtcaaatgtgagcc

SEQ ID NO: 22769 - DNA, 20 bp, Artificial Sequence
  Description of Artificial Sequence: Synthetic oligonucleotide
  Target: FXN; (-) strand; PAM type: YTN; PAM sequence: TTT
agaggatgtcaaatgtgagc

SEQ ID NO: 22770 - DNA, 20 bp, Artificial Sequence
  Description of Artificial Sequence: Synthetic oligonucleotide
  Target: FXN; (-) strand; PAM type: YTN; PAM sequence: CTT
tagaggatgtcaaatgtgag

SEQ ID NO: 22771 - DNA, 20 bp, Artificial Sequence
  Description of Artificial Sequence: Synthetic oligonucleotide
  Target: FXN; (-) strand; PAM type: YTN; PAM sequence: TTA
tatatgctttagaggatgtc

SEQ ID NO: 22772 - DNA, 20 bp, Artificial Sequence
  Description of Artificial Sequence: Synthetic oligonucleotide
  Target: FXN; (-) strand; PAM type: YTN; PAM sequence: TTT
atatatgctttagaggatgt

SEQ ID NO: 22773 - DNA, 20 bp, Artificial Sequence
  Description of Artificial Sequence: Synthetic oligonucleotide
  Target: FXN; (-) strand; PAM type: YTN; PAM sequence: TTT
tatatatgctttagaggatg

SEQ ID NO: 22774 - DNA, 20 bp, Artificial Sequence
  Description of Artificial Sequence: Synthetic oligonucleotide
  Target: FXN; (-) strand; PAM type: YTN; PAM sequence: TTC
acattttatatatgctttag

SEQ ID NO: 22775 - DNA, 20 bp, Artificial Sequence
  Description of Artificial Sequence: Synthetic oligonucleotide
  Target: FXN; (-) strand; PAM type: YTN; PAM sequence: CTT
cacattttatatatgcttta

SEQ ID NO: 22776 - DNA, 20 bp, Artificial Sequence
  Description of Artificial Sequence: Synthetic oligonucleotide
  Target: FXN; (-) strand; PAM type: YTN; PAM sequence: TTC
ttcacattttatatatgctt

SEQ ID NO: 22777 - DNA, 20 bp, Artificial Sequence
  Description of Artificial Sequence: Synthetic oligonucleotide
  Target: FXN; (-) strand; PAM type: YTN; PAM sequence: TTT
cttcacattttatatatgct

SEQ ID NO: 22778 - DNA, 20 bp, Artificial Sequence
  Description of Artificial Sequence: Synthetic oligonucleotide
  Target: FXN; (-) strand; PAM type: YTN; PAM sequence: TTT
tcttcacattttatatatgc

SEQ ID NO: 22779 - DNA, 20 bp, Artificial Sequence
  Description of Artificial Sequence: Synthetic oligonucleotide
  Target: FXN; (-) strand; PAM type: YTN; PAM sequence: TTG
tgaaagttttcttcacattt

SEQ ID NO: 22780 - DNA, 20 bp, Artificial Sequence
  Description of Artificial Sequence: Synthetic oligonucleotide
  Target: FXN; (-) strand; PAM type: YTN; PAM sequence: TTA
caaagggatgcaaattgtga

SEQ ID NO: 22781 - DNA, 20 bp, Artificial Sequence
  Description of Artificial Sequence: Synthetic oligonucleotide
  Target: FXN; (-) strand; PAM type: YTN; PAM sequence: TTA
catattacaaagggatgcaa

SEQ ID NO: 22782 - DNA, 20 bp, Artificial Sequence
  Description of Artificial Sequence: Synthetic oligonucleotide
  Target: FXN; (-) strand; PAM type: YTN; PAM sequence: CTG
ttacatattacaaagggatg

SEQ ID NO: 22783 - DNA, 20 bp, Artificial Sequence
  Description of Artificial Sequence: Synthetic oligonucleotide
  Target: FXN; (-) strand; PAM type: YTN; PAM sequence: TTC
tgttacatattacaaaggga

SEQ ID NO: 22784 - DNA, 20 bp, Artificial Sequence
  Description of Artificial Sequence: Synthetic oligonucleotide
  Target: FXN; (-) strand; PAM type: YTN; PAM sequence: TTT
ctgttacatattacaaaggg

SEQ ID NO: 22785 - DNA, 20 bp, Artificial Sequence
  Description of Artificial Sequence: Synthetic oligonucleotide
  Target: FXN; (-) strand; PAM type: YTN; PAM sequence: TTA
tttctgttacatattacaaa

SEQ ID NO: 22786 - DNA, 20 bp, Artificial Sequence
  Description of Artificial Sequence: Synthetic oligonucleotide
  Target: FXN; (-) strand; PAM type: YTN; PAM sequence: TTT
atttctgttacatattacaa

SEQ ID NO: 22787 - DNA, 20 bp, Artificial Sequence
  Description of Artificial Sequence: Synthetic oligonucleotide
  Target: FXN; (-) strand; PAM type: YTN; PAM sequence: TTT
tatttctgttacatattaca

SEQ ID NO: 22788 - DNA, 20 bp, Artificial Sequence
  Description of Artificial Sequence: Synthetic oligonucleotide
  Target: FXN; (-) strand; PAM type: YTN; PAM sequence: TTA
aaagagaattttatttctgt

SEQ ID NO: 22789 - DNA, 20 bp, Artificial Sequence
  Description of Artificial Sequence: Synthetic oligonucleotide
  Target: FXN; (-) strand; PAM type: YTN; PAM sequence: TTT
aaaagagaattttatttctg

SEQ ID NO: 22790 - DNA, 20 bp, Artificial Sequence
  Description of Artificial Sequence: Synthetic oligonucleotide
  Target: FXN; (-) strand; PAM type: YTN; PAM sequence: TTT
taaaagagaattttatttct

SEQ ID NO: 22791 - DNA, 20 bp, Artificial Sequence
  Description of Artificial Sequence: Synthetic oligonucleotide
  Target: FXN; (-) strand; PAM type: YTN; PAM sequence: TTG
atagattttaaaagagaatt

SEQ ID NO: 22792 - DNA, 20 bp, Artificial Sequence
  Description of Artificial Sequence: Synthetic oligonucleotide
  Target: FXN; (-) strand; PAM type: YTN; PAM sequence: TTG
ttgatagattttaaaagaga

SEQ ID NO: 22793 - DNA, 20 bp, Artificial Sequence
  Description of Artificial Sequence: Synthetic oligonucleotide
  Target: FXN; (-) strand; PAM type: YTN; PAM sequence: CTA
ttgttgatagattttaaaag

SEQ ID NO: 22794 - DNA, 20 bp, Artificial Sequence
  Description of Artificial Sequence: Synthetic oligonucleotide
  Target: FXN; (-) strand; PAM type: YTN; PAM sequence: TTG
cctattgttgatagatttta

SEQ ID NO: 22795 - DNA, 20 bp, Artificial Sequence
  Description of Artificial Sequence: Synthetic oligonucleotide
  Target: FXN; (-) strand; PAM type: YTN; PAM sequence: CTT
gcctattgttgatagatttt

SEQ ID NO: 22796 - DNA, 20 bp, Artificial Sequence
  Description of Artificial Sequence: Synthetic oligonucleotide
  Target: FXN; (-) strand; PAM type: YTN; PAM sequence: CTG
agacgacaggcgtgagccac

SEQ ID NO: 22797 - DNA, 20 bp, Artificial Sequence
  Description of Artificial Sequence: Synthetic oligonucleotide
  Target: FXN; (-) strand; PAM type: YTN; PAM sequence: CTC
acaaagtgctgagacgacag

SEQ ID NO: 22798 - DNA, 20 bp, Artificial Sequence
  Description of Artificial Sequence: Synthetic oligonucleotide
  Target: FXN; (-) strand; PAM type: YTN; PAM sequence: CTG
ggcctcacaaagtgctgaga

SEQ ID NO: 22799 - DNA, 20 bp, Artificial Sequence
  Description of Artificial Sequence: Synthetic oligonucleotide
  Target: FXN; (-) strand; PAM type: YTN; PAM sequence: CTG
cccgcctgggcctcacaaag

SEQ ID NO: 22800 - DNA, 20 bp, Artificial Sequence
  Description of Artificial Sequence: Synthetic oligonucleotide
  Target: FXN; (-) strand; PAM type: YTN; PAM sequence: CTC
aaacgatctgcccgcctggg

SEQ ID NO: 22801 - DNA, 20 bp, Artificial Sequence
  Description of Artificial Sequence: Synthetic oligonucleotide
  Target: FXN; (-) strand; PAM type: YTN; PAM sequence: CTA
ggctcaaacgatctgcccgc

SEQ ID NO: 22802 - DNA, 20 bp, Artificial Sequence
  Description of Artificial Sequence: Synthetic oligonucleotide
  Target: FXN; (-) strand; PAM type: YTN; PAM sequence: TTC
taggctcaaacgatctgccc

SEQ ID NO: 22803 - DNA, 20 bp, Artificial Sequence
  Description of Artificial Sequence: Synthetic oligonucleotide
  Target: FXN; (-) strand; PAM type: YTN; PAM sequence: CTT
ctaggctcaaacgatctgcc

SEQ ID NO: 22804 - DNA, 20 bp, Artificial Sequence
  Description of Artificial Sequence: Synthetic oligonucleotide
  Target: FXN; (-) strand; PAM type: YTN; PAM sequence: TTG
aacttctaggctcaaacgat

SEQ ID NO: 22805 - DNA, 20 bp, Artificial Sequence
  Description of Artificial Sequence: Synthetic oligonucleotide
  Target: FXN; (-) strand; PAM type: YTN; PAM sequence: CTT
gaacttctaggctcaaacga

SEQ ID NO: 22806 - DNA, 20 bp, Artificial Sequence
  Description of Artificial Sequence: Synthetic oligonucleotide
  Target: FXN; (-) strand; PAM type: YTN; PAM sequence: TTG
cccagggtggtcttgaactt

SEQ ID NO: 22807 - DNA, 20 bp, Artificial Sequence
  Description of Artificial Sequence: Synthetic oligonucleotide
  Target: FXN; (-) strand; PAM type: YTN; PAM sequence: CTA
tgttgcccagggtggtcttg

SEQ ID NO: 22808 - DNA, 20 bp, Artificial Sequence
  Description of Artificial Sequence: Synthetic oligonucleotide
  Target: FXN; (-) strand; PAM type: YTN; PAM sequence: TTC
gctatgttgcccagggtggt

SEQ ID NO: 22809 - DNA, 20 bp, Artificial Sequence
  Description of Artificial Sequence: Synthetic oligonucleotide
  Target: FXN; (-) strand; PAM type: YTN; PAM sequence: TTT
cgctatgttgcccagggtgg

SEQ ID NO: 22810 - DNA, 20 bp, Artificial Sequence
  Description of Artificial Sequence: Synthetic oligonucleotide
  Target: FXN; (-) strand; PAM type: YTN; PAM sequence: TTG
tagaaagggggtttcgctat

SEQ ID NO: 22811 - DNA, 20 bp, Artificial Sequence
  Description of Artificial Sequence: Synthetic oligonucleotide
  Target: FXN; (-) strand; PAM type: YTN; PAM sequence: TTT
gtagaaagggggtttcgcta

SEQ ID NO: 22812 - DNA, 20 bp, Artificial Sequence
  Description of Artificial Sequence: Synthetic oligonucleotide
  Target: FXN; (-) strand; PAM type: YTN; PAM sequence: TTT
tgtagaaagggggtttcgct

SEQ ID NO: 22813 - DNA, 20 bp, Artificial Sequence
  Description of Artificial Sequence: Synthetic oligonucleotide
  Target: FXN; (-) strand; PAM type: YTN; PAM sequence: TTT
ttgtagaaagggggtttcgc

SEQ ID NO: 22814 - DNA, 20 bp, Artificial Sequence
  Description of Artificial Sequence: Synthetic oligonucleotide
  Target: FXN; (-) strand; PAM type: YTN; PAM sequence: TTT
tttgtagaaagggggtttcg

SEQ ID NO: 22815 - DNA, 20 bp, Artificial Sequence
  Description of Artificial Sequence: Synthetic oligonucleotide
  Target: FXN; (-) strand; PAM type: YTN; PAM sequence: TTG
tattttttgtagaaaggggg

SEQ ID NO: 22816 - DNA, 20 bp, Artificial Sequence
  Description of Artificial Sequence: Synthetic oligonucleotide
  Target: FXN; (-) strand; PAM type: YTN; PAM sequence: TTT
gtattttttgtagaaagggg

SEQ ID NO: 22817 - DNA, 20 bp, Artificial Sequence
  Description of Artificial Sequence: Synthetic oligonucleotide
  Target: FXN; (-) strand; PAM type: YTN; PAM sequence: TTT
tgtattttttgtagaaaggg

SEQ ID NO: 22818 - DNA, 20 bp, Artificial Sequence
  Description of Artificial Sequence: Synthetic oligonucleotide
  Target: FXN; (-) strand; PAM type: YTN; PAM sequence: TTT
ttgtattttttgtagaaagg

SEQ ID NO: 22819 - DNA, 20 bp, Artificial Sequence
  Description of Artificial Sequence: Synthetic oligonucleotide
  Target: FXN; (-) strand; PAM type: YTN; PAM sequence: CTA
gtttttgtattttttgtaga

SEQ ID NO: 22820 - DNA, 20 bp, Artificial Sequence
  Description of Artificial Sequence: Synthetic oligonucleotide
  Target: FXN; (-) strand; PAM type: YTN; PAM sequence: CTA
caggtgtgcaccaccacacc

SEQ ID NO: 22821 - DNA, 20 bp, Artificial Sequence
  Description of Artificial Sequence: Synthetic oligonucleotide
  Target: FXN; (-) strand; PAM type: YTN; PAM sequence: CTG
ggactacaggtgtgcaccac

SEQ ID NO: 22822 - DNA, 20 bp, Artificial Sequence
  Description of Artificial Sequence: Synthetic oligonucleotide
  Target: FXN; (-) strand; PAM type: YTN; PAM sequence: TTC
caagtagctgggactacagg

SEQ ID NO: 22823 - DNA, 20 bp, Artificial Sequence
  Description of Artificial Sequence: Synthetic oligonucleotide
  Target: FXN; (-) strand; PAM type: YTN; PAM sequence: CTT
ccaagtagctgggactacag

SEQ ID NO: 22824 - DNA, 20 bp, Artificial Sequence
  Description of Artificial Sequence: Synthetic oligonucleotide
  Target: FXN; (-) strand; PAM type: YTN; PAM sequence: TTC
agccttccaagtagctggga

SEQ ID NO: 22825 - DNA, 20 bp, Artificial Sequence
  Description of Artificial Sequence: Synthetic oligonucleotide
  Target: FXN; (-) strand; PAM type: YTN; PAM sequence: TTT
cagccttccaagtagctggg

SEQ ID NO: 22826 - DNA, 20 bp, Artificial Sequence
  Description of Artificial Sequence: Synthetic oligonucleotide
  Target: FXN; (-) strand; PAM type: YTN; PAM sequence: TTC
ccatttcagccttccaagta

SEQ ID NO: 22827 - DNA, 20 bp, Artificial Sequence
  Description of Artificial Sequence: Synthetic oligonucleotide
  Target: FXN; (-) strand; PAM type: YTN; PAM sequence: CTT
cccatttcagccttccaagt

SEQ ID NO: 22828 - DNA, 20 bp, Artificial Sequence
  Description of Artificial Sequence: Synthetic oligonucleotide
  Target: FXN; (-) strand; PAM type: YTN; PAM sequence: CTC
aagcagtcttcccatttcag

SEQ ID NO: 22829 - DNA, 20 bp, Artificial Sequence
  Description of Artificial Sequence: Synthetic oligonucleotide
  Target: FXN; (-) strand; PAM type: YTN; PAM sequence: CTC
ccgggctcaagcagtcttcc

SEQ ID NO: 22830 - DNA, 20 bp, Artificial Sequence
  Description of Artificial Sequence: Synthetic oligonucleotide
  Target: FXN; (-) strand; PAM type: YTN; PAM sequence: CTC
cctcccgggctcaagcagtc

SEQ ID NO: 22831 - DNA, 20 bp, Artificial Sequence
  Description of Artificial Sequence: Synthetic oligonucleotide
  Target: FXN; (-) strand; PAM type: YTN; PAM sequence: TTC
tccctcccgggctcaagcag

SEQ ID NO: 22832 - DNA, 20 bp, Artificial Sequence
  Description of Artificial Sequence: Synthetic oligonucleotide
  Target: FXN; (-) strand; PAM type: YTN; PAM sequence: CTT
ctccctcccgggctcaagca

SEQ ID NO: 22833 - DNA, 20 bp, Artificial Sequence
  Description of Artificial Sequence: Synthetic oligonucleotide
  Target: FXN; (-) strand; PAM type: YTN; PAM sequence: CTG
caacttctccctcccgggct

SEQ ID NO: 22834 - DNA, 20 bp, Artificial Sequence
  Description of Artificial Sequence: Synthetic oligonucleotide
  Target: FXN; (-) strand; PAM type: YTN; PAM sequence: TTA
ctgcaacttctccctcccgg

SEQ ID NO: 22835 - DNA, 20 bp, Artificial Sequence
  Description of Artificial Sequence: Synthetic oligonucleotide
  Target: FXN; (-) strand; PAM type: YTN; PAM sequence: CTT
actgcaacttctccctcccg

SEQ ID NO: 22836 - DNA, 20 bp, Artificial Sequence
  Description of Artificial Sequence: Synthetic oligonucleotide
  Target: FXN; (-) strand; PAM type: YTN; PAM sequence: CTG
gcttactgcaacttctccct

SEQ ID NO: 22837 - DNA, 20 bp, Artificial Sequence
  Description of Artificial Sequence: Synthetic oligonucleotide
  Target: FXN; (-) strand; PAM type: YTN; PAM sequence: CTG
gagtgcagtggtgtggtcct

SEQ ID NO: 22838 - DNA, 20 bp, Artificial Sequence
  Description of Artificial Sequence: Synthetic oligonucleotide
  Target: FXN; (-) strand; PAM type: YTN; PAM sequence: TTG
cccaggctggagtgcagtgg

SEQ ID NO: 22839 - DNA, 20 bp, Artificial Sequence
  Description of Artificial Sequence: Synthetic oligonucleotide
  Target: FXN; (-) strand; PAM type: YTN; PAM sequence: CTG
ttgcccaggctggagtgcag

SEQ ID NO: 22840 - DNA, 20 bp, Artificial Sequence
  Description of Artificial Sequence: Synthetic oligonucleotide
  Target: FXN; (-) strand; PAM type: YTN; PAM sequence: CTC
tgttgcccaggctggagtgc

SEQ ID NO: 22841 - DNA, 20 bp, Artificial Sequence
  Description of Artificial Sequence: Synthetic oligonucleotide
  Target: FXN; (-) strand; PAM type: YTN; PAM sequence: CTC
actctgttgcccaggctgga

SEQ ID NO: 22842 - DNA, 20 bp, Artificial Sequence
  Description of Artificial Sequence: Synthetic oligonucleotide
  Target: FXN; (-) strand; PAM type: YTN; PAM sequence: TTG
agacagagtctcactctgtt

SEQ ID NO: 22843 - DNA, 20 bp, Artificial Sequence
  Description of Artificial Sequence: Synthetic oligonucleotide
  Target: FXN; (-) strand; PAM type: YTN; PAM sequence: TTT
gagacagagtctcactctgt

SEQ ID NO: 22844 - DNA, 20 bp, Artificial Sequence
  Description of Artificial Sequence: Synthetic oligonucleotide
  Target: FXN; (-) strand; PAM type: YTN; PAM sequence: TTG
tttgagacagagtctcactc

SEQ ID NO: 22845 - DNA, 20 bp, Artificial Sequence
  Description of Artificial Sequence: Synthetic oligonucleotide
  Target: FXN; (-) strand; PAM type: YTN; PAM sequence: TTT
gtttgagacagagtctcact

SEQ ID NO: 22846 - DNA, 20 bp, Artificial Sequence
  Description of Artificial Sequence: Synthetic oligonucleotide
  Target: FXN; (-) strand; PAM type: YTN; PAM sequence: TTG
tttgtttgagacagagtctc

SEQ ID NO: 22847 - DNA, 20 bp, Artificial Sequence
  Description of Artificial Sequence: Synthetic oligonucleotide
  Target: FXN; (-) strand; PAM type: YTN; PAM sequence: TTT
gtttgtttgagacagagtct

SEQ ID NO: 22848 - DNA, 20 bp, Artificial Sequence
  Description of Artificial Sequence: Synthetic oligonucleotide
  Target: FXN; (-) strand; PAM type: YTN; PAM sequence: TTA
tttgtttgtttgagacagag

SEQ ID NO: 22849 - DNA, 20 bp, Artificial Sequence
  Description of Artificial Sequence: Synthetic oligonucleotide
  Target: FXN; (-) strand; PAM type: YTN; PAM sequence: TTT
atttgtttgtttgagacaga

SEQ ID NO: 22850 - DNA, 20 bp, Artificial Sequence
  Description of Artificial Sequence: Synthetic oligonucleotide
  Target: FXN; (-) strand; PAM type: YTN; PAM sequence: CTC
atttatttgtttgtttgaga

SEQ ID NO: 22851 - DNA, 20 bp, Artificial Sequence
  Description of Artificial Sequence: Synthetic oligonucleotide
  Target: FXN; (-) strand; PAM type: YTN; PAM sequence: CTC
gtgatccacccgcctcattt

SEQ ID NO: 22852 - DNA, 20 bp, Artificial Sequence
  Description of Artificial Sequence: Synthetic oligonucleotide
  Target: FXN; (-) strand; PAM type: YTN; PAM sequence: CTG
acctcgtgatccacccgcct

SEQ ID NO: 22853 - DNA, 20 bp, Artificial Sequence
  Description of Artificial Sequence: Synthetic oligonucleotide
  Target: FXN; (-) strand; PAM type: YTN; PAM sequence: CTA
ctgacctcgtgatccacccg

SEQ ID NO: 22854 - DNA, 20 bp, Artificial Sequence
  Description of Artificial Sequence: Synthetic oligonucleotide
  Target: FXN; (-) strand; PAM type: YTN; PAM sequence: CTC
gatctactgacctcgtgatc

SEQ ID NO: 22855 - DNA, 20 bp, Artificial Sequence
  Description of Artificial Sequence: Synthetic oligonucleotide
  Target: FXN; (-) strand; PAM type: YTN; PAM sequence: TTA
gccaggatggtctcgatcta

SEQ ID NO: 22856 - DNA, 20 bp, Artificial Sequence
  Description of Artificial Sequence: Synthetic oligonucleotide
  Target: FXN; (-) strand; PAM type: YTN; PAM sequence: TTC
accgtgttagccaggatggt

SEQ ID NO: 22857 - DNA, 20 bp, Artificial Sequence
  Description of Artificial Sequence: Synthetic oligonucleotide
  Target: FXN; (-) strand; PAM type: YTN; PAM sequence: TTT
caccgtgttagccaggatgg

SEQ ID NO: 22858 - DNA, 20 bp, Artificial Sequence
  Description of Artificial Sequence: Synthetic oligonucleotide
  Target: FXN; (-) strand; PAM type: YTN; PAM sequence: TTA
gtagagacgggtttcaccgt

SEQ ID NO: 22859 - DNA, 20 bp, Artificial Sequence
  Description of Artificial Sequence: Synthetic oligonucleotide
  Target: FXN; (-) strand; PAM type: YTN; PAM sequence: TTT
agtagagacgggtttcaccg

SEQ ID NO: 22860 - DNA, 20 bp, Artificial Sequence
  Description of Artificial Sequence: Synthetic oligonucleotide
  Target: FXN; (-) strand; PAM type: YTN; PAM sequence: TTT
tagtagagacgggtttcacc

SEQ ID NO: 22861 - DNA, 20 bp, Artificial Sequence
  Description of Artificial Sequence: Synthetic oligonucleotide
  Target: FXN; (-) strand; PAM type: YTN; PAM sequence: TTT
ttagtagagacgggtttcac

SEQ ID NO: 22862 - DNA, 20 bp, Artificial Sequence
  Description of Artificial Sequence: Synthetic oligonucleotide
  Target: FXN; (-) strand; PAM type: YTN; PAM sequence: TTT
tttagtagagacgggtttca

SEQ ID NO: 22863 - DNA, 20 bp, Artificial Sequence
  Description of Artificial Sequence: Synthetic oligonucleotide
  Target: FXN; (-) strand; PAM type: YTN; PAM sequence: TTT
ttttagtagagacgggtttc

SEQ ID NO: 22864 - DNA, 20 bp, Artificial Sequence
  Description of Artificial Sequence: Synthetic oligonucleotide
  Target: FXN; (-) strand; PAM type: YTN; PAM sequence: TTT
tttttagtagagacgggttt

SEQ ID NO: 22865 - DNA, 20 bp, Artificial Sequence
  Description of Artificial Sequence: Synthetic oligonucleotide
  Target: FXN; (-) strand; PAM type: YTN; PAM sequence: TTT
ttttttagtagagacgggtt

SEQ ID NO: 22866 - DNA, 20 bp, Artificial Sequence
  Description of Artificial Sequence: Synthetic oligonucleotide
  Target: FXN; (-) strand; PAM type: YTN; PAM sequence: TTT
tttttttagtagagacgggt

SEQ ID NO: 22867 - DNA, 20 bp, Artificial Sequence
  Description of Artificial Sequence: Synthetic oligonucleotide
  Target: FXN; (-) strand; PAM type: YTN; PAM sequence: TTT
ttttttttagtagagacggg

SEQ ID NO: 22868 - DNA, 20 bp, Artificial Sequence
  Description of Artificial Sequence: Synthetic oligonucleotide
  Target: FXN; (-) strand; PAM type: YTN; PAM sequence: TTT
tttttttttagtagagacgg

SEQ ID NO: 22869 - DNA, 20 bp, Artificial Sequence
  Description of Artificial Sequence: Synthetic oligonucleotide
  Target: FXN; (-) strand; PAM type: YTN; PAM sequence: TTT
ttttttttttagtagagacg

SEQ ID NO: 22870 - DNA, 20 bp, Artificial Sequence
  Description of Artificial Sequence: Synthetic oligonucleotide
  Target: FXN; (-) strand; PAM type: YTN; PAM sequence: TTT
tttttttttttagtagagac

SEQ ID NO: 22871 - DNA, 20 bp, Artificial Sequence
  Description of Artificial Sequence: Synthetic oligonucleotide
  Target: FXN; (-) strand; PAM type: YTN; PAM sequence: TTT
ttttttttttttagtagaga

SEQ ID NO: 22872 - DNA, 20 bp, Artificial Sequence
  Description of Artificial Sequence: Synthetic oligonucleotide
  Target: FXN; (-) strand; PAM type: YTN; PAM sequence: TTG
tatttttttttttttttagt

SEQ ID NO: 22873 - DNA, 20 bp, Artificial Sequence
  Description of Artificial Sequence: Synthetic oligonucleotide
  Target: FXN; (-) strand; PAM type: YTN; PAM sequence: TTT
gtatttttttttttttttag

SEQ ID NO: 22874 - DNA, 20 bp, Artificial Sequence
  Description of Artificial Sequence: Synthetic oligonucleotide
  Target: FXN; (-) strand; PAM type: YTN; PAM sequence: TTT
tgtattttttttttttttta

SEQ ID NO: 22875 - DNA, 20 bp, Artificial Sequence
  Description of Artificial Sequence: Synthetic oligonucleotide
  Target: FXN; (-) strand; PAM type: YTN; PAM sequence: TTT
ttgtattttttttttttttt

SEQ ID NO: 22876 - DNA, 20 bp, Artificial Sequence
  Description of Artificial Sequence: Synthetic oligonucleotide
  Target: FXN; (-) strand; PAM type: YTN; PAM sequence: TTT
tttgtatttttttttttttt

SEQ ID NO: 22877 - DNA, 20 bp, Artificial Sequence
  Description of Artificial Sequence: Synthetic oligonucleotide
  Target: FXN; (-) strand; PAM type: YTN; PAM sequence: CTA
attttttgtatttttttttt

SEQ ID NO: 22878 - DNA, 20 bp, Artificial Sequence
  Description of Artificial Sequence: Synthetic oligonucleotide
  Target: FXN; (-) strand; PAM type: YTN; PAM sequence: CTG
gctaattttttgtatttttt

SEQ ID NO: 22879 - DNA, 20 bp, Artificial Sequence
  Description of Artificial Sequence: Synthetic oligonucleotide
  Target: FXN; (-) strand; PAM type: YTN; PAM sequence: CTA
caggcgcccgccaccatgcc

SEQ ID NO: 22880 - DNA, 20 bp, Artificial Sequence
  Description of Artificial Sequence: Synthetic oligonucleotide
  Target: FXN; (-) strand; PAM type: YTN; PAM sequence: CTG
ggactacaggcgcccgccac

SEQ ID NO: 22881 - DNA, 20 bp, Artificial Sequence
  Description of Artificial Sequence: Synthetic oligonucleotide
  Target: FXN; (-) strand; PAM type: YTN; PAM sequence: CTC
ccgagtaactgggactacag

SEQ ID NO: 22882 - DNA, 20 bp, Artificial Sequence
  Description of Artificial Sequence: Synthetic oligonucleotide
  Target: FXN; (-) strand; PAM type: YTN; PAM sequence: CTC
agcctcccgagtaactggga

SEQ ID NO: 22883 - DNA, 20 bp, Artificial Sequence
  Description of Artificial Sequence: Synthetic oligonucleotide
  Target: FXN; (-) strand; PAM type: YTN; PAM sequence: CTG
cctcagcctcccgagtaact

SEQ ID NO: 22884 - DNA, 20 bp, Artificial Sequence
  Description of Artificial Sequence: Synthetic oligonucleotide
  Target: FXN; (-) strand; PAM type: YTN; PAM sequence: CTC
ctgcctcagcctcccgagta

SEQ ID NO: 22885 - DNA, 20 bp, Artificial Sequence
  Description of Artificial Sequence: Synthetic oligonucleotide
  Target: FXN; (-) strand; PAM type: YTN; PAM sequence: TTC
tcctgcctcagcctcccgag

SEQ ID NO: 22886 - DNA, 20 bp, Artificial Sequence
  Description of Artificial Sequence: Synthetic oligonucleotide
  Target: FXN; (-) strand; PAM type: YTN; PAM sequence: TTC
acgccattctcctgcctcag

SEQ ID NO: 22887 - DNA, 20 bp, Artificial Sequence
  Description of Artificial Sequence: Synthetic oligonucleotide
  Target: FXN; (-) strand; PAM type: YTN; PAM sequence: TTT
cacgccattctcctgcctca

SEQ ID NO: 22888 - DNA, 20 bp, Artificial Sequence
  Description of Artificial Sequence: Synthetic oligonucleotide
  Target: FXN; (-) strand; PAM type: YTN; PAM sequence: CTC
ccggtttcacgccattctcc

SEQ ID NO: 22889 - DNA, 20 bp, Artificial Sequence
  Description of Artificial Sequence: Synthetic oligonucleotide
  Target: FXN; (-) strand; PAM type: YTN; PAM sequence: CTG
cctcccggtttcacgccatt

SEQ ID NO: 22890 - DNA, 20 bp, Artificial Sequence
  Description of Artificial Sequence: Synthetic oligonucleotide
  Target: FXN; (-) strand; PAM type: YTN; PAM sequence: CTC
tgcctcccggtttcacgcca

SEQ ID NO: 22891 - DNA, 20 bp, Artificial Sequence
  Description of Artificial Sequence: Synthetic oligonucleotide
  Target: FXN; (-) strand; PAM type: YTN; PAM sequence: CTG
caagctctgcctcccggttt

SEQ ID NO: 22892 - DNA, 20 bp, Artificial Sequence
  Description of Artificial Sequence: Synthetic oligonucleotide
  Target: FXN; (-) strand; PAM type: YTN; PAM sequence: CTC
actgcaagctctgcctcccg

SEQ ID NO: 22893 - DNA, 20 bp, Artificial Sequence
  Description of Artificial Sequence: Synthetic oligonucleotide
  Target: FXN; (-) strand; PAM type: YTN; PAM sequence: CTC
ggctcactgcaagctctgcc

SEQ ID NO: 22894 - DNA, 20 bp, Artificial Sequence
  Description of Artificial Sequence: Synthetic oligonucleotide
  Target: FXN; (-) strand; PAM type: YTN; PAM sequence: CTG
gagggcagtggtgcgatctc

SEQ ID NO: 22895 - DNA, 20 bp, Artificial Sequence
  Description of Artificial Sequence: Synthetic oligonucleotide
  Target: FXN; (-) strand; PAM type: YTN; PAM sequence: CTG
tcgcccaggctggagggcag

SEQ ID NO: 22896 - DNA, 20 bp, Artificial Sequence
  Description of Artificial Sequence: Synthetic oligonucleotide
  Target: FXN; (-) strand; PAM type: YTN; PAM sequence: CTC
tgtcgcccaggctggagggc

SEQ ID NO: 22897 - DNA, 20 bp, Artificial Sequence
  Description of Artificial Sequence: Synthetic oligonucleotide
  Target: FXN; (-) strand; PAM type: YTN; PAM sequence: CTC
gctctgtcgcccaggctgga

SEQ ID NO: 22898 - DNA, 20 bp, Artificial Sequence
  Description of Artificial Sequence: Synthetic oligonucleotide
  Target: FXN; (-) strand; PAM type: YTN; PAM sequence: TTG
agacggagtctcgctctgtc

SEQ ID NO: 22899 - DNA, 20 bp, Artificial Sequence
  Description of Artificial Sequence: Synthetic oligonucleotide
  Target: FXN; (-) strand; PAM type: YTN; PAM sequence: TTG
attgagacggagtctcgctc

SEQ ID NO: 22900 - DNA, 20 bp, Artificial Sequence
  Description of Artificial Sequence: Synthetic oligonucleotide
  Target: FXN; (-) strand; PAM type: YTN; PAM sequence: TTG
attgattgagacggagtctc

SEQ ID NO: 22901 - DNA, 20 bp, Artificial Sequence
  Description of Artificial Sequence: Synthetic oligonucleotide
  Target: FXN; (-) strand; PAM type: YTN; PAM sequence: TTG
attgattgattgagacggag

SEQ ID NO: 22902 - DNA, 20 bp, Artificial Sequence
  Description of Artificial Sequence: Synthetic oligonucleotide
  Target: FXN; (-) strand; PAM type: YTN; PAM sequence: TTG
attgattgattgattgagac

SEQ ID NO: 22903 - DNA, 20 bp, Artificial Sequence
  Description of Artificial Sequence: Synthetic oligonucleotide
  Target: FXN; (-) strand; PAM type: YTN; PAM sequence: TTA
ttgattgattgattgattga

SEQ ID NO: 22904 - DNA, 20 bp, Artificial Sequence
  Description of Artificial Sequence: Synthetic oligonucleotide
  Target: FXN; (-) strand; PAM type: YTN; PAM sequence: TTT
attgattgattgattgattg

SEQ ID NO: 22905 - DNA, 20 bp, Artificial Sequence
  Description of Artificial Sequence: Synthetic oligonucleotide
  Target: FXN; (-) strand; PAM type: YTN; PAM sequence: TTT
tattgattgattgattgatt

SEQ ID NO: 22906 - DNA, 20 bp, Artificial Sequence
  Description of Artificial Sequence: Synthetic oligonucleotide
  Target: FXN; (-) strand; PAM type: YTN; PAM sequence: TTA
atagattttattgattgatt

SEQ ID NO: 22907 - DNA, 20 bp, Artificial Sequence
  Description of Artificial Sequence: Synthetic oligonucleotide
  Target: FXN; (-) strand; PAM type: YTN; PAM sequence: TTG
ttaatagattttattgattg

SEQ ID NO: 22908 - DNA, 20 bp, Artificial Sequence
  Description of Artificial Sequence: Synthetic oligonucleotide
  Target: FXN; (-) strand; PAM type: YTN; PAM sequence: TTA
agtgcacaataaatattgtt

SEQ ID NO: 22909 - DNA, 20 bp, Artificial Sequence
  Description of Artificial Sequence: Synthetic oligonucleotide
  Target: FXN; (-) strand; PAM type: YTN; PAM sequence: CTG
ttaagtgcacaataaatatt

SEQ ID NO: 22910 - DNA, 20 bp, Artificial Sequence
  Description of Artificial Sequence: Synthetic oligonucleotide
  Target: FXN; (-) strand; PAM type: YTN; PAM sequence: TTC
ctgttaagtgcacaataaat

SEQ ID NO: 22911 - DNA, 20 bp, Artificial Sequence
  Description of Artificial Sequence: Synthetic oligonucleotide
  Target: FXN; (-) strand; PAM type: YTN; PAM sequence: TTG
gacagggcatgttcctgtta

SEQ ID NO: 22912 - DNA, 20 bp, Artificial Sequence
  Description of Artificial Sequence: Synthetic oligonucleotide
  Target: FXN; (-) strand; PAM type: YTN; PAM sequence: TTT
ggacagggcatgttcctgtt

SEQ ID NO: 22913 - DNA, 20 bp, Artificial Sequence
  Description of Artificial Sequence: Synthetic oligonucleotide
  Target: FXN; (-) strand; PAM type: YTN; PAM sequence: TTT
tggacagggcatgttcctgt

SEQ ID NO: 22914 - DNA, 20 bp, Artificial Sequence
  Description of Artificial Sequence: Synthetic oligonucleotide
  Target: FXN; (-) strand; PAM type: YTN; PAM sequence: TTT
ttggacagggcatgttcctg

SEQ ID NO: 22915 - DNA, 20 bp, Artificial Sequence
  Description of Artificial Sequence: Synthetic oligonucleotide
  Target: FXN; (-) strand; PAM type: YTN; PAM sequence: TTT
tttggacagggcatgttcct

SEQ ID NO: 22916 - DNA, 20 bp, Artificial Sequence
  Description of Artificial Sequence: Synthetic oligonucleotide
  Target: FXN; (-) strand; PAM type: YTN; PAM sequence: TTT
ttttggacagggcatgttcc

SEQ ID NO: 22917 - DNA, 20 bp, Artificial Sequence
  Description of Artificial Sequence: Synthetic oligonucleotide
  Target: FXN; (-) strand; PAM type: YTN; PAM sequence: TTT
tttttggacagggcatgttc

SEQ ID NO: 22918 - DNA, 20 bp, Artificial Sequence
  Description of Artificial Sequence: Synthetic oligonucleotide
  Target: FXN; (-) strand; PAM type: YTN; PAM sequence: CTG
taaagttttttttggacagg

SEQ ID NO: 22919 - DNA, 20 bp, Artificial Sequence
  Description of Artificial Sequence: Synthetic oligonucleotide
  Target: FXN; (-) strand; PAM type: YTN; PAM sequence: TTA
agccctgtaaagtttttttt

SEQ ID NO: 22920 - DNA, 20 bp, Artificial Sequence
  Description of Artificial Sequence: Synthetic oligonucleotide
  Target: FXN; (-) strand; PAM type: YTN; PAM sequence: TTG
tggtaaggataaaatgagtt

SEQ ID NO: 22921 - DNA, 20 bp, Artificial Sequence
  Description of Artificial Sequence: Synthetic oligonucleotide
  Target: FXN; (-) strand; PAM type: YTN; PAM sequence: TTC
ataggattgtggtaaggata

SEQ ID NO: 22922 - DNA, 20 bp, Artificial Sequence
  Description of Artificial Sequence: Synthetic oligonucleotide
  Target: FXN; (-) strand; PAM type: YTN; PAM sequence: CTT
cataggattgtggtaaggat

SEQ ID NO: 22923 - DNA, 20 bp, Artificial Sequence
  Description of Artificial Sequence: Synthetic oligonucleotide
  Target: FXN; (-) strand; PAM type: YTN; PAM sequence: CTA
cttcataggattgtggtaag

SEQ ID NO: 22924 - DNA, 20 bp, Artificial Sequence
  Description of Artificial Sequence: Synthetic oligonucleotide
  Target: FXN; (-) strand; PAM type: YTN; PAM sequence: TTC
ctacttcataggattgtggt

SEQ ID NO: 22925 - DNA, 20 bp, Artificial Sequence
  Description of Artificial Sequence: Synthetic oligonucleotide
  Target: FXN; (-) strand; PAM type: YTN; PAM sequence: TTA
taaaagttcctacttcatag

SEQ ID NO: 22926 - DNA, 20 bp, Artificial Sequence
  Description of Artificial Sequence: Synthetic oligonucleotide
  Target: FXN; (-) strand; PAM type: YTN; PAM sequence: TTT
ataaaagttcctacttcata

SEQ ID NO: 22927 - DNA, 20 bp, Artificial Sequence
  Description of Artificial Sequence: Synthetic oligonucleotide
  Target: FXN; (-) strand; PAM type: YTN; PAM sequence: TTT
tataaaagttcctacttcat

SEQ ID NO: 22928 - DNA, 20 bp, Artificial Sequence
  Description of Artificial Sequence: Synthetic oligonucleotide
  Target: FXN; (-) strand; PAM type: YTN; PAM sequence: TTA
taaaatgcgttttataaaag

SEQ ID NO: 22929 - DNA, 20 bp, Artificial Sequence
  Description of Artificial Sequence: Synthetic oligonucleotide
  Target: FXN; (-) strand; PAM type: YTN; PAM sequence: TTT
ataaaatgcgttttataaaa

SEQ ID NO: 22930 - DNA, 20 bp, Artificial Sequence
  Description of Artificial Sequence: Synthetic oligonucleotide
  Target: FXN; (-) strand; PAM type: YTN; PAM sequence: TTG
tttataaaatgcgttttata

SEQ ID NO: 22931 - DNA, 20 bp, Artificial Sequence
  Description of Artificial Sequence: Synthetic oligonucleotide
  Target: FXN; (-) strand; PAM type: YTN; PAM sequence: CTT
gtttataaaatgcgttttat

SEQ ID NO: 22932 - DNA, 20 bp, Artificial Sequence
  Description of Artificial Sequence: Synthetic oligonucleotide
  Target: FXN; (-) strand; PAM type: YTN; PAM sequence: CTG
tgccttgtttataaaatgcg

SEQ ID NO: 22933 - DNA, 20 bp, Artificial Sequence
  Description of Artificial Sequence: Synthetic oligonucleotide
  Target: FXN; (-) strand; PAM type: YTN; PAM sequence: CTC
tgtgccttgtttataaaatg

SEQ ID NO: 22934 - DNA, 20 bp, Artificial Sequence
  Description of Artificial Sequence: Synthetic oligonucleotide
  Target: FXN; (-) strand; PAM type: YTN; PAM sequence: CTC
tctgtgccttgtttataaaa

SEQ ID NO: 22935 - DNA, 20 bp, Artificial Sequence
  Description of Artificial Sequence: Synthetic oligonucleotide
  Target: FXN; (-) strand; PAM type: YTN; PAM sequence: TTA
acctctctgtgccttgttta

SEQ ID NO: 22936 - DNA, 20 bp, Artificial Sequence
  Description of Artificial Sequence: Synthetic oligonucleotide
  Target: FXN; (-) strand; PAM type: YTN; PAM sequence: TTA
attaacctctctgtgccttg

SEQ ID NO: 22937 - DNA, 20 bp, Artificial Sequence
  Description of Artificial Sequence: Synthetic oligonucleotide
  Target: FXN; (-) strand; PAM type: YTN; PAM sequence: CTG
tgtgaccagagggcaagtta

SEQ ID NO: 22938 - DNA, 20 bp, Artificial Sequence
  Description of Artificial Sequence: Synthetic oligonucleotide
  Target: FXN; (-) strand; PAM type: YTN; PAM sequence: CTA
gctgtgtgaccagagggcaa

SEQ ID NO: 22939 - DNA, 20 bp, Artificial Sequence
  Description of Artificial Sequence: Synthetic oligonucleotide
  Target: FXN; (-) strand; PAM type: YTN; PAM sequence: TTC
ctagctgtgtgaccagaggg

SEQ ID NO: 22940 - DNA, 20 bp, Artificial Sequence
  Description of Artificial Sequence: Synthetic oligonucleotide
  Target: FXN; (-) strand; PAM type: YTN; PAM sequence: CTT
cctagctgtgtgaccagagg

SEQ ID NO: 22941 - DNA, 20 bp, Artificial Sequence
  Description of Artificial Sequence: Synthetic oligonucleotide
  Target: FXN; (-) strand; PAM type: YTN; PAM sequence: CTG
cccacttcctagctgtgtga

SEQ ID NO: 22942 - DNA, 20 bp, Artificial Sequence
  Description of Artificial Sequence: Synthetic oligonucleotide
  Target: FXN; (-) strand; PAM type: YTN; PAM sequence: CTC
tgcccacttcctagctgtgt

SEQ ID NO: 22943 - DNA, 20 bp, Artificial Sequence
  Description of Artificial Sequence: Synthetic oligonucleotide
  Target: FXN; (-) strand; PAM type: YTN; PAM sequence: CTG
tactctgcccacttcctagc

SEQ ID NO: 22944 - DNA, 20 bp, Artificial Sequence
  Description of Artificial Sequence: Synthetic oligonucleotide
  Target: FXN; (-) strand; PAM type: YTN; PAM sequence: TTG
tgtaaatctgtactctgccc

SEQ ID NO: 22945 - DNA, 20 bp, Artificial Sequence
  Description of Artificial Sequence: Synthetic oligonucleotide
  Target: FXN; (-) strand; PAM type: YTN; PAM sequence: CTT
gtgtaaatctgtactctgcc

SEQ ID NO: 22946 - DNA, 20 bp, Artificial Sequence
  Description of Artificial Sequence: Synthetic oligonucleotide
  Target: FXN; (-) strand; PAM type: YTN; PAM sequence: TTG
ggtatgtggggccaggagac

SEQ ID NO: 22947 - DNA, 20 bp, Artificial Sequence
  Description of Artificial Sequence: Synthetic oligonucleotide
  Target: FXN; (-) strand; PAM type: YTN; PAM sequence: TTA
cagcagttgggtatgtgggg

SEQ ID NO: 22948 - DNA, 20 bp, Artificial Sequence
  Description of Artificial Sequence: Synthetic oligonucleotide
  Target: FXN; (-) strand; PAM type: YTN; PAM sequence: TTT
acagcagttgggtatgtggg

SEQ ID NO: 22949 - DNA, 20 bp, Artificial Sequence
  Description of Artificial Sequence: Synthetic oligonucleotide
  Target: FXN; (-) strand; PAM type: YTN; PAM sequence: TTG
gccgccggtatgggtttaca

SEQ ID NO: 22950 - DNA, 20 bp, Artificial Sequence
  Description of Artificial Sequence: Synthetic oligonucleotide
  Target: FXN; (-) strand; PAM type: YTN; PAM sequence: CTT
ggccgccggtatgggtttac

SEQ ID NO: 22951 - DNA, 20 bp, Artificial Sequence
  Description of Artificial Sequence: Synthetic oligonucleotide
  Target: FXN; (-) strand; PAM type: YTN; PAM sequence: CTG
cttggccgccggtatgggtt

SEQ ID NO: 22952 - DNA, 20 bp, Artificial Sequence
  Description of Artificial Sequence: Synthetic oligonucleotide
  Target: FXN; (-) strand; PAM type: YTN; PAM sequence: TTG
aggctgcttggccgccggta

SEQ ID NO: 22953 - DNA, 20 bp, Artificial Sequence
  Description of Artificial Sequence: Synthetic oligonucleotide
  Target: FXN; (-) strand; PAM type: YTN; PAM sequence: CTG
ggaagtgggtgcatgcacaa

SEQ ID NO: 22954 - DNA, 20 bp, Artificial Sequence
  Description of Artificial Sequence: Synthetic oligonucleotide
  Target: FXN; (-) strand; PAM type: YTN; PAM sequence: TTG
ctgggaagtgggtgcatgca

SEQ ID NO: 22955 - DNA, 20 bp, Artificial Sequence
  Description of Artificial Sequence: Synthetic oligonucleotide
  Target: FXN; (-) strand; PAM type: YTN; PAM sequence: CTT
gctgggaagtgggtgcatgc

SEQ ID NO: 22956 - DNA, 20 bp, Artificial Sequence
  Description of Artificial Sequence: Synthetic oligonucleotide
  Target: FXN; (-) strand; PAM type: YTN; PAM sequence: CTG
tcttgctgggaagtgggtgc

SEQ ID NO: 22957 - DNA, 20 bp, Artificial Sequence
  Description of Artificial Sequence: Synthetic oligonucleotide
  Target: FXN; (-) strand; PAM type: YTN; PAM sequence: CTG
ctgtcttgctgggaagtggg

SEQ ID NO: 22958 - DNA, 20 bp, Artificial Sequence
  Description of Artificial Sequence: Synthetic oligonucleotide
  Target: FXN; (-) strand; PAM type: YTN; PAM sequence: TTG
ggagctgctgtcttgctggg

SEQ ID NO: 22959 - DNA, 20 bp, Artificial Sequence
  Description of Artificial Sequence: Synthetic oligonucleotide
  Target: FXN; (-) strand; PAM type: YTN; PAM sequence: CTT
gggagctgctgtcttgctgg

SEQ ID NO: 22960 - DNA, 20 bp, Artificial Sequence
  Description of Artificial Sequence: Synthetic oligonucleotide
  Target: FXN; (-) strand; PAM type: YTN; PAM sequence: CTA
aacaggaggaacttgggagc

SEQ ID NO: 22961 - DNA, 20 bp, Artificial Sequence
  Description of Artificial Sequence: Synthetic oligonucleotide
  Target: FXN; (-) strand; PAM type: YTN; PAM sequence: TTC
taaacaggaggaacttggga

SEQ ID NO: 22962 - DNA, 20 bp, Artificial Sequence
  Description of Artificial Sequence: Synthetic oligonucleotide
  Target: FXN; (-) strand; PAM type: YTN; PAM sequence: CTA
aaattctaaacaggaggaac

SEQ ID NO: 22963 - DNA, 20 bp, Artificial Sequence
  Description of Artificial Sequence: Synthetic oligonucleotide
  Target: FXN; (-) strand; PAM type: YTN; PAM sequence: TTC
taaaattctaaacaggagga

SEQ ID NO: 22964 - DNA, 20 bp, Artificial Sequence
  Description of Artificial Sequence: Synthetic oligonucleotide
  Target: FXN; (-) strand; PAM type: YTN; PAM sequence: CTT
ctaaaattctaaacaggagg

SEQ ID NO: 22965 - DNA, 20 bp, Artificial Sequence
  Description of Artificial Sequence: Synthetic oligonucleotide
  Target: FXN; (-) strand; PAM type: YTN; PAM sequence: CTG
gtggcccgccgcttctaaaa

SEQ ID NO: 22966 - DNA, 20 bp, Artificial Sequence
  Description of Artificial Sequence: Synthetic oligonucleotide
  Target: FXN; (-) strand; PAM type: YTN; PAM sequence: CTG
cagcctggtggcccgccgct

SEQ ID NO: 22967 - DNA, 20 bp, Artificial Sequence
  Description of Artificial Sequence: Synthetic oligonucleotide
  Target: FXN; (-) strand; PAM type: YTN; PAM sequence: CTG
acccaagggagactgcagcc

SEQ ID NO: 22968 - DNA, 20 bp, Artificial Sequence
  Description of Artificial Sequence: Synthetic oligonucleotide
  Target: FXN; (-) strand; PAM type: YTN; PAM sequence: TTG
tgcaaagcacggagtgcaac

SEQ ID NO: 22969 - DNA, 20 bp, Artificial Sequence
  Description of Artificial Sequence: Synthetic oligonucleotide
  Target: FXN; (-) strand; PAM type: YTN; PAM sequence: TTT
gtgcaaagcacggagtgcaa

SEQ ID NO: 22970 - DNA, 20 bp, Artificial Sequence
  Description of Artificial Sequence: Synthetic oligonucleotide
  Target: FXN; (-) strand; PAM type: YTN; PAM sequence: CTT
tgtgcaaagcacggagtgca

SEQ ID NO: 22971 - DNA, 20 bp, Artificial Sequence
  Description of Artificial Sequence: Synthetic oligonucleotide
  Target: FXN; (-) strand; PAM type: YTN; PAM sequence: CTG
ctttgtgcaaagcacggagt

SEQ ID NO: 22972 - DNA, 20 bp, Artificial Sequence
  Description of Artificial Sequence: Synthetic oligonucleotide
  Target: FXN; (-) strand; PAM type: YTN; PAM sequence: TTA
acaaaaatggagagcctgct

SEQ ID NO: 22973 - DNA, 20 bp, Artificial Sequence
  Description of Artificial Sequence: Synthetic oligonucleotide
  Target: FXN; (-) strand; PAM type: YTN; PAM sequence: TTT
aacaaaaatggagagcctgc

SEQ ID NO: 22974 - DNA, 20 bp, Artificial Sequence
  Description of Artificial Sequence: Synthetic oligonucleotide
  Target: FXN; (-) strand; PAM type: YTN; PAM sequence: TTC
gtgcatttaacaaaaatgga

SEQ ID NO: 22975 - DNA, 20 bp, Artificial Sequence
  Description of Artificial Sequence: Synthetic oligonucleotide
  Target: FXN; (-) strand; PAM type: YTN; PAM sequence: CTA
ttcgtgcatttaacaaaaat

SEQ ID NO: 22976 - DNA, 20 bp, Artificial Sequence
  Description of Artificial Sequence: Synthetic oligonucleotide
  Target: FXN; (-) strand; PAM type: YTN; PAM sequence: TTA
gcactattcgtgcatttaac

SEQ ID NO: 22977 - DNA, 20 bp, Artificial Sequence
  Description of Artificial Sequence: Synthetic oligonucleotide
  Target: FXN; (-) strand; PAM type: YTN; PAM sequence: CTT
agcactattcgtgcatttaa

SEQ ID NO: 22978 - DNA, 20 bp, Artificial Sequence
  Description of Artificial Sequence: Synthetic oligonucleotide
  Target: FXN; (-) strand; PAM type: YTN; PAM sequence: TTC
ccagcttagcactattcgtg

SEQ ID NO: 22979 - DNA, 20 bp, Artificial Sequence
  Description of Artificial Sequence: Synthetic oligonucleotide
  Target: FXN; (-) strand; PAM type: YTN; PAM sequence: CTT
cccagcttagcactattcgt

SEQ ID NO: 22980 - DNA, 20 bp, Artificial Sequence
  Description of Artificial Sequence: Synthetic oligonucleotide
  Target: FXN; (-) strand; PAM type: YTN; PAM sequence: CTC
aggaagaacttcccagctta

SEQ ID NO: 22981 - DNA, 20 bp, Artificial Sequence
  Description of Artificial Sequence: Synthetic oligonucleotide
  Target: FXN; (-) strand; PAM type: YTN; PAM sequence: TTA
gacctcaggaagaacttccc

SEQ ID NO: 22982 - DNA, 20 bp, Artificial Sequence
  Description of Artificial Sequence: Synthetic oligonucleotide
  Target: FXN; (-) strand; PAM type: YTN; PAM sequence: CTA
gaggttagacctcaggaaga

SEQ ID NO: 22983 - DNA, 20 bp, Artificial Sequence
  Description of Artificial Sequence: Synthetic oligonucleotide
  Target: FXN; (-) strand; PAM type: YTN; PAM sequence: CTG
tgggggagcagctagaggtt

SEQ ID NO: 22984 - DNA, 20 bp, Artificial Sequence
  Description of Artificial Sequence: Synthetic oligonucleotide
  Target: FXN; (-) strand; PAM type: YTN; PAM sequence: TTC
tgtgggggagcagctagagg

SEQ ID NO: 22985 - DNA, 20 bp, Artificial Sequence
  Description of Artificial Sequence: Synthetic oligonucleotide
  Target: FXN; (-) strand; PAM type: YTN; PAM sequence: CTT
ctgtgggggagcagctagag

SEQ ID NO: 22986 - DNA, 20 bp, Artificial Sequence
  Description of Artificial Sequence: Synthetic oligonucleotide
  Target: FXN; (-) strand; PAM type: YTN; PAM sequence: CTC
ttctgtgggggagcagctag

SEQ ID NO: 22987 - DNA, 20 bp, Artificial Sequence
  Description of Artificial Sequence: Synthetic oligonucleotide
  Target: FXN; (-) strand; PAM type: YTN; PAM sequence: CTG
gccgcaggcactcttctgtg

SEQ ID NO: 22988 - DNA, 20 bp, Artificial Sequence
  Description of Artificial Sequence: Synthetic oligonucleotide
  Target: FXN; (-) strand; PAM type: YTN; PAM sequence: CTG
gtggccactggccgcaggca

SEQ ID NO: 22989 - DNA, 20 bp, Artificial Sequence
  Description of Artificial Sequence: Synthetic oligonucleotide
  Target: FXN; (-) strand; PAM type: YTN; PAM sequence: CTG
cggcgacccctggtggccac

SEQ ID NO: 22990 - DNA, 20 bp, Artificial Sequence
  Description of Artificial Sequence: Synthetic oligonucleotide
  Target: FXN; (-) strand; PAM type: YTN; PAM sequence: CTG
ggtgctgcggcgacccctgg

SEQ ID NO: 22991 - DNA, 20 bp, Artificial Sequence
  Description of Artificial Sequence: Synthetic oligonucleotide
  Target: FXN; (-) strand; PAM type: YTN; PAM sequence: CTC
cagcgctgggtgctgcggcg

SEQ ID NO: 22992 - DNA, 20 bp, Artificial Sequence
  Description of Artificial Sequence: Synthetic oligonucleotide
  Target: FXN; (-) strand; PAM type: YTN; PAM sequence: CTC
cgccctccagcgctgggtgc

SEQ ID NO: 22993 - DNA, 20 bp, Artificial Sequence
  Description of Artificial Sequence: Synthetic oligonucleotide
  Target: FXN; (-) strand; PAM type: YTN; PAM sequence: CTG
ccgcccgctccgccctccag

SEQ ID NO: 22994 - DNA, 20 bp, Artificial Sequence
  Description of Artificial Sequence: Synthetic oligonucleotide
  Target: FXN; (-) strand; PAM type: YTN; PAM sequence: CTC
cgggtctgccgcccgctccg

SEQ ID NO: 22995 - DNA, 20 bp, Artificial Sequence
  Description of Artificial Sequence: Synthetic oligonucleotide
  Target: FXN; (-) strand; PAM type: YTN; PAM sequence: CTG
ctccgggtctgccgcccgct

SEQ ID NO: 22996 - DNA, 20 bp, Artificial Sequence
  Description of Artificial Sequence: Synthetic oligonucleotide
  Target: FXN; (-) strand; PAM type: YTN; PAM sequence: CTG
cgcggcgcccgagagtccac

SEQ ID NO: 22997 - DNA, 20 bp, Artificial Sequence
  Description of Artificial Sequence: Synthetic oligonucleotide
  Target: FXN; (-) strand; PAM type: YTN; PAM sequence: CTA
ctgcgcggcgcccgagagtc

SEQ ID NO: 22998 - DNA, 20 bp, Artificial Sequence
  Description of Artificial Sequence: Synthetic oligonucleotide
  Target: FXN; (-) strand; PAM type: YTN; PAM sequence: CTG
ggtgacgccaggaggccggc

SEQ ID NO: 22999 - DNA, 20 bp, Artificial Sequence
  Description of Artificial Sequence: Synthetic oligonucleotide
  Target: FXN; (-) strand; PAM type: YTN; PAM sequence: CTG
ggctgggtgacgccaggagg

SEQ ID NO: 23000 - DNA, 20 bp, Artificial Sequence
  Description of Artificial Sequence: Synthetic oligonucleotide
  Target: FXN; (-) strand; PAM type: YTN; PAM sequence: CTG
ggctgggctgggtgacgcca

SEQ ID NO: 23001 - DNA, 20 bp, Artificial Sequence
  Description of Artificial Sequence: Synthetic oligonucleotide
  Target: FXN; (-) strand; PAM type: YTN; PAM sequence: CTG
ggcctgggctgggctgggtg

SEQ ID NO: 23002 - DNA, 20 bp, Artificial Sequence
  Description of Artificial Sequence: Synthetic oligonucleotide
  Target: FXN; (-) strand; PAM type: YTN; PAM sequence: CTG
ccggccgcgggacccgggtg

SEQ ID NO: 23003 - DNA, 20 bp, Artificial Sequence
  Description of Artificial Sequence: Synthetic oligonucleotide
  Target: FXN; (-) strand; PAM type: YTN; PAM sequence: CTC
tgccggccgcgggacccggg

SEQ ID NO: 23004 - DNA, 20 bp, Artificial Sequence
  Description of Artificial Sequence: Synthetic oligonucleotide
  Target: FXN; (-) strand; PAM type: YTN; PAM sequence: CTG
cgcggcggggcgtgcaggtc

SEQ ID NO: 23005 - DNA, 20 bp, Artificial Sequence
  Description of Artificial Sequence: Synthetic oligonucleotide
  Target: FXN; (-) strand; PAM type: YTN; PAM sequence: TTA
ctgcgcggcggggcgtgcag

SEQ ID NO: 23006 - DNA, 20 bp, Artificial Sequence
  Description of Artificial Sequence: Synthetic oligonucleotide
  Target: FXN; (-) strand; PAM type: YTN; PAM sequence: CTT
actgcgcggcggggcgtgca

SEQ ID NO: 23007 - DNA, 20 bp, Artificial Sequence
  Description of Artificial Sequence: Synthetic oligonucleotide
  Target: FXN; (-) strand; PAM type: YTN; PAM sequence: TTC
ccggcgcggatacttactgc

SEQ ID NO: 23008 - DNA, 20 bp, Artificial Sequence
  Description of Artificial Sequence: Synthetic oligonucleotide
  Target: FXN; (-) strand; PAM type: YTN; PAM sequence: CTG
ttcccggcgcggatacttac

SEQ ID NO: 23009 - DNA, 20 bp, Artificial Sequence
  Description of Artificial Sequence: Synthetic oligonucleotide
  Target: FXN; (-) strand; PAM type: YTN; PAM sequence: CTG
cgcaggcgtgcggcgtgcgg

SEQ ID NO: 23010 - DNA, 20 bp, Artificial Sequence
  Description of Artificial Sequence: Synthetic oligonucleotide
  Target: FXN; (-) strand; PAM type: YTN; PAM sequence: CTC
cctgcgcaggcgtgcggcgt

SEQ ID NO: 23011 - DNA, 20 bp, Artificial Sequence
  Description of Artificial Sequence: Synthetic oligonucleotide
  Target: FXN; (-) strand; PAM type: YTN; PAM sequence: CTA
gtccagcgcgcgtacccgga

SEQ ID NO: 23012 - DNA, 20 bp, Artificial Sequence
  Description of Artificial Sequence: Synthetic oligonucleotide
  Target: FXN; (-) strand; PAM type: YTN; PAM sequence: CTG
agaaggagcggggtgagcta

SEQ ID NO: 23013 - DNA, 20 bp, Artificial Sequence
  Description of Artificial Sequence: Synthetic oligonucleotide
  Target: FXN; (-) strand; PAM type: YTN; PAM sequence: TTC
cgccgggccgccctgagaag

SEQ ID NO: 23014 - DNA, 20 bp, Artificial Sequence
  Description of Artificial Sequence: Synthetic oligonucleotide
  Target: FXN; (-) strand; PAM type: YTN; PAM sequence: CTT
ccgccgggccgccctgagaa

SEQ ID NO: 23015 - DNA, 20 bp, Artificial Sequence
  Description of Artificial Sequence: Synthetic oligonucleotide
  Target: FXN; (-) strand; PAM type: YTN; PAM sequence: TTG
caaggccgcttccgccgggc

SEQ ID NO: 23016 - DNA, 20 bp, Artificial Sequence
  Description of Artificial Sequence: Synthetic oligonucleotide
  Target: FXN; (-) strand; PAM type: YTN; PAM sequence: TTC
ggaaagcagaagccagtgta

SEQ ID NO: 23017 - DNA, 20 bp, Artificial Sequence
  Description of Artificial Sequence: Synthetic oligonucleotide
  Target: FXN; (-) strand; PAM type: YTN; PAM sequence: CTT
cggaaagcagaagccagtgt

SEQ ID NO: 23018 - DNA, 20 bp, Artificial Sequence
  Description of Artificial Sequence: Synthetic oligonucleotide
  Target: FXN; (-) strand; PAM type: YTN; PAM sequence: TTC
cttcggaaagcagaagccag

SEQ ID NO: 23019 - DNA, 20 bp, Artificial Sequence
  Description of Artificial Sequence: Synthetic oligonucleotide
  Target: FXN; (-) strand; PAM type: YTN; PAM sequence: TTT
ccttcggaaagcagaagcca

SEQ ID NO: 23020 - DNA, 20 bp, Artificial Sequence
  Description of Artificial Sequence: Synthetic oligonucleotide
  Target: FXN; (-) strand; PAM type: YTN; PAM sequence: TTT
tccttcggaaagcagaagcc

SEQ ID NO: 23021 - DNA, 20 bp, Artificial Sequence
  Description of Artificial Sequence: Synthetic oligonucleotide
  Target: FXN; (-) strand; PAM type: YTN; PAM sequence: CTT
ttccttcggaaagcagaagc

SEQ ID NO: 23022 - DNA, 20 bp, Artificial Sequence
  Description of Artificial Sequence: Synthetic oligonucleotide
  Target: FXN; (-) strand; PAM type: YTN; PAM sequence: TTG
acccgcagtcgcaccgcagg

SEQ ID NO: 23023 - DNA, 20 bp, Artificial Sequence
  Description of Artificial Sequence: Synthetic oligonucleotide
  Target: FXN; (-) strand; PAM type: YTN; PAM sequence: CTT
gacccgcagtcgcaccgcag

SEQ ID NO: 23024 - DNA, 20 bp, Artificial Sequence
  Description of Artificial Sequence: Synthetic oligonucleotide
  Target: FXN; (-) strand; PAM type: YTN; PAM sequence: TTC
gcccgtgccttgacccgcag

SEQ ID NO: 23025 - DNA, 20 bp, Artificial Sequence
  Description of Artificial Sequence: Synthetic oligonucleotide
  Target: FXN; (-) strand; PAM type: YTN; PAM sequence: CTT
cgcccgtgccttgacccgca

SEQ ID NO: 23026 - DNA, 20 bp, Artificial Sequence
  Description of Artificial Sequence: Synthetic oligonucleotide
  Target: FXN; (-) strand; PAM type: YTN; PAM sequence: CTG
ccttcgcccgtgccttgacc

SEQ ID NO: 23027 - DNA, 20 bp, Artificial Sequence
  Description of Artificial Sequence: Synthetic oligonucleotide
  Target: FXN; (-) strand; PAM type: YTN; PAM sequence: CTG
ccctgccttcgcccgtgcct

SEQ ID NO: 23028 - DNA, 20 bp, Artificial Sequence
  Description of Artificial Sequence: Synthetic oligonucleotide
  Target: FXN; (-) strand; PAM type: YTN; PAM sequence: CTC
caccagcctgccctgccttc

SEQ ID NO: 23029 - DNA, 20 bp, Artificial Sequence
  Description of Artificial Sequence: Synthetic oligonucleotide
  Target: FXN; (-) strand; PAM type: YTN; PAM sequence: CTC
ggaaccggtcccctccacca

SEQ ID NO: 23030 - DNA, 20 bp, Artificial Sequence
  Description of Artificial Sequence: Synthetic oligonucleotide
  Target: FXN; (-) strand; PAM type: YTN; PAM sequence: TTA
tcgcagagaagtgacaagca

SEQ ID NO: 23031 - DNA, 20 bp, Artificial Sequence
  Description of Artificial Sequence: Synthetic oligonucleotide
  Target: FXN; (-) strand; PAM type: YTN; PAM sequence: CTG
aaacaagttatcgcagagaa

SEQ ID NO: 23032 - DNA, 20 bp, Artificial Sequence
  Description of Artificial Sequence: Synthetic oligonucleotide
  Target: FXN; (-) strand; PAM type: YTN; PAM sequence: TTA
ctgaaacaagttatcgcaga

SEQ ID NO: 23033 - DNA, 20 bp, Artificial Sequence
  Description of Artificial Sequence: Synthetic oligonucleotide
  Target: FXN; (-) strand; PAM type: YTN; PAM sequence: TTA
atattactgaaacaagttat

SEQ ID NO: 23034 - DNA, 20 bp, Artificial Sequence
  Description of Artificial Sequence: Synthetic oligonucleotide
  Target: FXN; (-) strand; PAM type: YTN; PAM sequence: CTA
ttaatattactgaaacaagt

SEQ ID NO: 23035 - DNA, 20 bp, Artificial Sequence
  Description of Artificial Sequence: Synthetic oligonucleotide
  Target: FXN; (-) strand; PAM type: YTN; PAM sequence: CTA
gcagataccatctattaata

SEQ ID NO: 23036 - DNA, 20 bp, Artificial Sequence
  Description of Artificial Sequence: Synthetic oligonucleotide
  Target: FXN; (-) strand; PAM type: YTN; PAM sequence: TTA
tgtgtatgtatatactagca

SEQ ID NO: 23037 - DNA, 20 bp, Artificial Sequence
  Description of Artificial Sequence: Synthetic oligonucleotide
  Target: FXN; (-) strand; PAM type: YTN; PAM sequence: CTA
tatacagatacacacagaca

SEQ ID NO: 23038 - DNA, 20 bp, Artificial Sequence
  Description of Artificial Sequence: Synthetic oligonucleotide
  Target: FXN; (-) strand; PAM type: YTN; PAM sequence: TTA
ggtgtgcgcgcgcccgtgcg

SEQ ID NO: 23039 - DNA, 20 bp, Artificial Sequence
  Description of Artificial Sequence: Synthetic oligonucleotide
  Target: FXN; (-) strand; PAM type: YTN; PAM sequence: TTG
aaaatattaggtgtgcgcgc

SEQ ID NO: 23040 - DNA, 20 bp, Artificial Sequence
  Description of Artificial Sequence: Synthetic oligonucleotide
  Target: FXN; (-) strand; PAM type: YTN; PAM sequence: CTT
gaaaatattaggtgtgcgcg

SEQ ID NO: 23041 - DNA, 20 bp, Artificial Sequence
  Description of Artificial Sequence: Synthetic oligonucleotide
  Target: FXN; (-) strand; PAM type: YTN; PAM sequence: TTC
aaaaaaatccagccttgaaa

SEQ ID NO: 23042 - DNA, 20 bp, Artificial Sequence
  Description of Artificial Sequence: Synthetic oligonucleotide
  Target: FXN; (-) strand; PAM type: YTN; PAM sequence: TTC
gttcaaaaaaatccagcctt

SEQ ID NO: 23043 - DNA, 20 bp, Artificial Sequence
  Description of Artificial Sequence: Synthetic oligonucleotide
  Target: FXN; (-) strand; PAM type: YTN; PAM sequence: TTT
cgttcaaaaaaatccagcct

SEQ ID NO: 23044 - DNA, 20 bp, Artificial Sequence
  Description of Artificial Sequence: Synthetic oligonucleotide
  Target: FXN; (-) strand; PAM type: YTN; PAM sequence: TTC
caggaaagcatttcgttcaa

SEQ ID NO: 23045 - DNA, 20 bp, Artificial Sequence
  Description of Artificial Sequence: Synthetic oligonucleotide
  Target: FXN; (-) strand; PAM type: YTN; PAM sequence: CTC
gttccaggaaagcatttcgt

SEQ ID NO: 23046 - DNA, 20 bp, Artificial Sequence
  Description of Artificial Sequence: Synthetic oligonucleotide
  Target: FXN; (-) strand; PAM type: YTN; PAM sequence: TTC
acctcgttccaggaaagcat

SEQ ID NO: 23047 - DNA, 20 bp, Artificial Sequence
  Description of Artificial Sequence: Synthetic oligonucleotide
  Target: FXN; (-) strand; PAM type: YTN; PAM sequence: TTT
cacctcgttccaggaaagca

SEQ ID NO: 23048 - DNA, 20 bp, Artificial Sequence
  Description of Artificial Sequence: Synthetic oligonucleotide
  Target: FXN; (-) strand; PAM type: YTN; PAM sequence: CTG
aaagtttcacctcgttccag

SEQ ID NO: 23049 - DNA, 20 bp, Artificial Sequence
  Description of Artificial Sequence: Synthetic oligonucleotide
  Target: FXN; (-) strand; PAM type: YTN; PAM sequence: CTC
tgaaagtttcacctcgttcc

SEQ ID NO: 23050 - DNA, 20 bp, Artificial Sequence
  Description of Artificial Sequence: Synthetic oligonucleotide
  Target: FXN; (-) strand; PAM type: YTN; PAM sequence: CTG
cagctctgaaagtttcacct

SEQ ID NO: 23051 - DNA, 20 bp, Artificial Sequence
  Description of Artificial Sequence: Synthetic oligonucleotide
  Target: FXN; (-) strand; PAM type: YTN; PAM sequence: TTC
tgcagctctgaaagtttcac

SEQ ID NO: 23052 - DNA, 20 bp, Artificial Sequence
  Description of Artificial Sequence: Synthetic oligonucleotide
  Target: FXN; (-) strand; PAM type: YTN; PAM sequence: CTA
ttctgcagctctgaaagttt

SEQ ID NO: 23053 - DNA, 20 bp, Artificial Sequence
  Description of Artificial Sequence: Synthetic oligonucleotide
  Target: FXN; (-) strand; PAM type: YTN; PAM sequence: CTA
gctattctgcagctctgaaa

SEQ ID NO: 23054 - DNA, 20 bp, Artificial Sequence
  Description of Artificial Sequence: Synthetic oligonucleotide
  Target: FXN; (-) strand; PAM type: YTN; PAM sequence: CTC
tagctattctgcagctctga

SEQ ID NO: 23055 - DNA, 20 bp, Artificial Sequence
  Description of Artificial Sequence: Synthetic oligonucleotide
  Target: FXN; (-) strand; PAM type: YTN; PAM sequence: CTG
ctctagctattctgcagctc

SEQ ID NO: 23056 - DNA, 20 bp, Artificial Sequence
  Description of Artificial Sequence: Synthetic oligonucleotide
  Target: FXN; (-) strand; PAM type: YTN; PAM sequence: CTG
ctgctctagctattctgcag

SEQ ID NO: 23057 - DNA, 20 bp, Artificial Sequence
  Description of Artificial Sequence: Synthetic oligonucleotide
  Target: FXN; (-) strand; PAM type: YTN; PAM sequence: TTC
caaaagccagggcccctgct

SEQ ID NO: 23058 - DNA, 20 bp, Artificial Sequence
  Description of Artificial Sequence: Synthetic oligonucleotide
  Target: FXN; (-) strand; PAM type: YTN; PAM sequence: TTT
ccaaaagccagggcccctgc

SEQ ID NO: 23059 - DNA, 20 bp, Artificial Sequence
  Description of Artificial Sequence: Synthetic oligonucleotide
  Target: FXN; (-) strand; PAM type: YTN; PAM sequence: CTG
gaataaaggtcgggtcagtt

SEQ ID NO: 23060 - DNA, 20 bp, Artificial Sequence
  Description of Artificial Sequence: Synthetic oligonucleotide
  Target: FXN; (-) strand; PAM type: YTN; PAM sequence: CTG
cggagtggggcagaatctgg

SEQ ID NO: 23061 - DNA, 20 bp, Artificial Sequence
  Description of Artificial Sequence: Synthetic oligonucleotide
  Target: FXN; (-) strand; PAM type: YTN; PAM sequence: CTC
tgcggagtggggcagaatct

SEQ ID NO: 23062 - DNA, 20 bp, Artificial Sequence
  Description of Artificial Sequence: Synthetic oligonucleotide
  Target: FXN; (-) strand; PAM type: YTN; PAM sequence: TTA
ggggaatcccccaaggtcac

SEQ ID NO: 23063 - DNA, 20 bp, Artificial Sequence
  Description of Artificial Sequence: Synthetic oligonucleotide
  Target: FXN; (-) strand; PAM type: YTN; PAM sequence: CTC
agagaggttaggggaatccc

SEQ ID NO: 23064 - DNA, 20 bp, Artificial Sequence
  Description of Artificial Sequence: Synthetic oligonucleotide
  Target: FXN; (-) strand; PAM type: YTN; PAM sequence: CTA
cagaaaacaaagccacgtct

SEQ ID NO: 23065 - DNA, 20 bp, Artificial Sequence
  Description of Artificial Sequence: Synthetic oligonucleotide
  Target: FXN; (-) strand; PAM type: YTN; PAM sequence: CTC
cctacagaaaacaaagccac

SEQ ID NO: 23066 - DNA, 20 bp, Artificial Sequence
  Description of Artificial Sequence: Synthetic oligonucleotide
  Target: FXN; (-) strand; PAM type: YTN; PAM sequence: TTC
tccctacagaaaacaaagcc

SEQ ID NO: 23067 - DNA, 20 bp, Artificial Sequence
  Description of Artificial Sequence: Synthetic oligonucleotide
  Target: FXN; (-) strand; PAM type: YTN; PAM sequence: CTT
ctccctacagaaaacaaagc

SEQ ID NO: 23068 - DNA, 20 bp, Artificial Sequence
  Description of Artificial Sequence: Synthetic oligonucleotide
  Target: FXN; (-) strand; PAM type: YTN; PAM sequence: TTA
tcttctccctacagaaaaca

SEQ ID NO: 23069 - DNA, 20 bp, Artificial Sequence
  Description of Artificial Sequence: Synthetic oligonucleotide
  Target: FXN; (-) strand; PAM type: YTN; PAM sequence: TTT
atcttctccctacagaaaac

SEQ ID NO: 23070 - DNA, 20 bp, Artificial Sequence
  Description of Artificial Sequence: Synthetic oligonucleotide
  Target: FXN; (-) strand; PAM type: YTN; PAM sequence: CTT
tatcttctccctacagaaaa

SEQ ID NO: 23071 - DNA, 20 bp, Artificial Sequence
  Description of Artificial Sequence: Synthetic oligonucleotide
  Target: FXN; (-) strand; PAM type: YTN; PAM sequence: CTC
acaccaggtccgcaaaatgg

SEQ ID NO: 23072 - DNA, 20 bp, Artificial Sequence
  Description of Artificial Sequence: Synthetic oligonucleotide
  Target: FXN; (-) strand; PAM type: YTN; PAM sequence: TTA
atcctcacaccaggtccgca

SEQ ID NO: 23073 - DNA, 20 bp, Artificial Sequence
  Description of Artificial Sequence: Synthetic oligonucleotide
  Target: FXN; (-) strand; PAM type: YTN; PAM sequence: TTT
aatcctcacaccaggtccgc

SEQ ID NO: 23074 - DNA, 20 bp, Artificial Sequence
  Description of Artificial Sequence: Synthetic oligonucleotide
  Target: FXN; (-) strand; PAM type: YTN; PAM sequence: TTC
ccatttaatcctcacaccag

SEQ ID NO: 23075 - DNA, 20 bp, Artificial Sequence
  Description of Artificial Sequence: Synthetic oligonucleotide
  Target: FXN; (-) strand; PAM type: YTN; PAM sequence: TTA
ttcccatttaatcctcacac

SEQ ID NO: 23076 - DNA, 20 bp, Artificial Sequence
  Description of Artificial Sequence: Synthetic oligonucleotide
  Target: FXN; (-) strand; PAM type: YTN; PAM sequence: CTA
tgttattcccatttaatcct

SEQ ID NO: 23077 - DNA, 20 bp, Artificial Sequence
  Description of Artificial Sequence: Synthetic oligonucleotide
  Target: FXN; (-) strand; PAM type: YTN; PAM sequence: TTA
tctatgttattcccatttaa

SEQ ID NO: 23078 - DNA, 20 bp, Artificial Sequence
  Description of Artificial Sequence: Synthetic oligonucleotide
  Target: FXN; (-) strand; PAM type: YTN; PAM sequence: TTT
atctatgttattcccattta

SEQ ID NO: 23079 - DNA, 20 bp, Artificial Sequence
  Description of Artificial Sequence: Synthetic oligonucleotide
  Target: FXN; (-) strand; PAM type: YTN; PAM sequence: CTT
tatctatgttattcccattt

SEQ ID NO: 23080 - DNA, 20 bp, Artificial Sequence
  Description of Artificial Sequence: Synthetic oligonucleotide
  Target: FXN; (-) strand; PAM type: YTN; PAM sequence: CTG
aagactttatctatgttatt

SEQ ID NO: 23081 - DNA, 20 bp, Artificial Sequence
  Description of Artificial Sequence: Synthetic oligonucleotide
  Target: FXN; (-) strand; PAM type: YTN; PAM sequence: TTC
tgaagactttatctatgtta

SEQ ID NO: 23082 - DNA, 20 bp, Artificial Sequence
  Description of Artificial Sequence: Synthetic oligonucleotide
  Target: FXN; (-) strand; PAM type: YTN; PAM sequence: TTG
aagttctgaagactttatct

SEQ ID NO: 23083 - DNA, 20 bp, Artificial Sequence
  Description of Artificial Sequence: Synthetic oligonucleotide
  Target: FXN; (-) strand; PAM type: YTN; PAM sequence: TTT
gaagttctgaagactttatc

SEQ ID NO: 23084 - DNA, 20 bp, Artificial Sequence
  Description of Artificial Sequence: Synthetic oligonucleotide
  Target: FXN; (-) strand; PAM type: YTN; PAM sequence: CTA
atttgaagttctgaagactt

SEQ ID NO: 23085 - DNA, 20 bp, Artificial Sequence
  Description of Artificial Sequence: Synthetic oligonucleotide
  Target: FXN; (-) strand; PAM type: YTN; PAM sequence: TTG
taccccccaaaggaagaaag

SEQ ID NO: 23086 - DNA, 20 bp, Artificial Sequence
  Description of Artificial Sequence: Synthetic oligonucleotide
  Target: FXN; (-) strand; PAM type: YTN; PAM sequence: TTT
gtaccccccaaaggaagaaa

SEQ ID NO: 23087 - DNA, 20 bp, Artificial Sequence
  Description of Artificial Sequence: Synthetic oligonucleotide
  Target: FXN; (-) strand; PAM type: YTN; PAM sequence: CTT
tgtaccccccaaaggaagaa

SEQ ID NO: 23088 - DNA, 20 bp, Artificial Sequence
  Description of Artificial Sequence: Synthetic oligonucleotide
  Target: FXN; (-) strand; PAM type: YTN; PAM sequence: TTC
tttgtaccccccaaaggaag

SEQ ID NO: 23089 - DNA, 20 bp, Artificial Sequence
  Description of Artificial Sequence: Synthetic oligonucleotide
  Target: FXN; (-) strand; PAM type: YTN; PAM sequence: TTT
ctttgtaccccccaaaggaa

SEQ ID NO: 23090 - DNA, 20 bp, Artificial Sequence
  Description of Artificial Sequence: Synthetic oligonucleotide
  Target: FXN; (-) strand; PAM type: YTN; PAM sequence: CTG
ggtcagatatttctttgtac

SEQ ID NO: 23091 - DNA, 20 bp, Artificial Sequence
  Description of Artificial Sequence: Synthetic oligonucleotide
  Target: FXN; (-) strand; PAM type: YTN; PAM sequence: TTC
aagccgtggcgtaactgggt

SEQ ID NO: 23092 - DNA, 20 bp, Artificial Sequence
  Description of Artificial Sequence: Synthetic oligonucleotide
  Target: FXN; (-) strand; PAM type: YTN; PAM sequence: TTT
caagccgtggcgtaactggg

SEQ ID NO: 23093 - DNA, 20 bp, Artificial Sequence
  Description of Artificial Sequence: Synthetic oligonucleotide
  Target: FXN; (-) strand; PAM type: YTN; PAM sequence: CTT
tcaagccgtggcgtaactgg

SEQ ID NO: 23094 - DNA, 20 bp, Artificial Sequence
  Description of Artificial Sequence: Synthetic oligonucleotide
  Target: FXN; (-) strand; PAM type: YTN; PAM sequence: CTC
ctttcaagccgtggcgtaac

SEQ ID NO: 23095 - DNA, 20 bp, Artificial Sequence
  Description of Artificial Sequence: Synthetic oligonucleotide
  Target: FXN; (-) strand; PAM type: YTN; PAM sequence: TTC
ctcctttcaagccgtggcgt

SEQ ID NO: 23096 - DNA, 20 bp, Artificial Sequence
  Description of Artificial Sequence: Synthetic oligonucleotide
  Target: FXN; (-) strand; PAM type: YTN; PAM sequence: TTT
cctcctttcaagccgtggcg

SEQ ID NO: 23097 - DNA, 20 bp, Artificial Sequence
  Description of Artificial Sequence: Synthetic oligonucleotide
  Target: FXN; (-) strand; PAM type: YTN; PAM sequence: TTG
ggtttcctcctttcaagccg

SEQ ID NO: 23098 - DNA, 20 bp, Artificial Sequence
  Description of Artificial Sequence: Synthetic oligonucleotide
  Target: FXN; (-) strand; PAM type: YTN; PAM sequence: TTT
gggtttcctcctttcaagcc

SEQ ID NO: 23099 - DNA, 20 bp, Artificial Sequence
  Description of Artificial Sequence: Synthetic oligonucleotide
  Target: FXN; (-) strand; PAM type: YTN; PAM sequence: CTT
tgggtttcctcctttcaagc

SEQ ID NO: 23100 - DNA, 20 bp, Artificial Sequence
  Description of Artificial Sequence: Synthetic oligonucleotide
  Target: FXN; (-) strand; PAM type: YTN; PAM sequence: TTC
tttgggtttcctcctttcaa

SEQ ID NO: 23101 - DNA, 20 bp, Artificial Sequence
  Description of Artificial Sequence: Synthetic oligonucleotide
  Target: FXN; (-) strand; PAM type: YTN; PAM sequence: CTC
atccccacagccattctttg

SEQ ID NO: 23102 - DNA, 20 bp, Artificial Sequence
  Description of Artificial Sequence: Synthetic oligonucleotide
  Target: FXN; (-) strand; PAM type: YTN; PAM sequence: TTC
ctcatccccacagccattct

SEQ ID NO: 23103 - DNA, 20 bp, Artificial Sequence
  Description of Artificial Sequence: Synthetic oligonucleotide
  Target: FXN; (-) strand; PAM type: YTN; PAM sequence: CTT
cctcatccccacagccattc

SEQ ID NO: 23104 - DNA, 20 bp, Artificial Sequence
  Description of Artificial Sequence: Synthetic oligonucleotide
  Target: FXN; (-) strand; PAM type: YTN; PAM sequence: TTG
aggaatcttcctcatcccca

SEQ ID NO: 23105 - DNA, 20 bp, Artificial Sequence
  Description of Artificial Sequence: Synthetic oligonucleotide
  Target: FXN; (-) strand; PAM type: YTN; PAM sequence: CTT
gaggaatcttcctcatcccc

SEQ ID NO: 23106 - DNA, 20 bp, Artificial Sequence
  Description of Artificial Sequence: Synthetic oligonucleotide
  Target: FXN; (-) strand; PAM type: YTN; PAM sequence: CTC
cccttgaggaatcttcctca

SEQ ID NO: 23107 - DNA, 20 bp, Artificial Sequence
  Description of Artificial Sequence: Synthetic oligonucleotide
  Target: FXN; (-) strand; PAM type: YTN; PAM sequence: TTA
aataccatgtcctccccttg

SEQ ID NO: 23108 - DNA, 20 bp, Artificial Sequence
  Description of Artificial Sequence: Synthetic oligonucleotide
  Target: FXN; (-) strand; PAM type: YTN; PAM sequence: CTC
attaaataccatgtcctccc

SEQ ID NO: 23109 - DNA, 20 bp, Artificial Sequence
  Description of Artificial Sequence: Synthetic oligonucleotide
  Target: FXN; (-) strand; PAM type: YTN; PAM sequence: TTC
aagaccctcattaaatacca

SEQ ID NO: 23110 - DNA, 20 bp, Artificial Sequence
  Description of Artificial Sequence: Synthetic oligonucleotide
  Target: FXN; (-) strand; PAM type: YTN; PAM sequence: CTT
caagaccctcattaaatacc

SEQ ID NO: 23111 - DNA, 20 bp, Artificial Sequence
  Description of Artificial Sequence: Synthetic oligonucleotide
  Target: FXN; (-) strand; PAM type: YTN; PAM sequence: TTG
gcatcttcaagaccctcatt

SEQ ID NO: 23112 - DNA, 20 bp, Artificial Sequence
  Description of Artificial Sequence: Synthetic oligonucleotide
  Target: FXN; (-) strand; PAM type: YTN; PAM sequence: CTT
ggcatcttcaagaccctcat

SEQ ID NO: 23113 - DNA, 20 bp, Artificial Sequence
  Description of Artificial Sequence: Synthetic oligonucleotide
  Target: FXN; (-) strand; PAM type: YTN; PAM sequence: TTC
cttggcatcttcaagaccct

SEQ ID NO: 23114 - DNA, 20 bp, Artificial Sequence
  Description of Artificial Sequence: Synthetic oligonucleotide
  Target: FXN; (-) strand; PAM type: YTN; PAM sequence: CTT
ccttggcatcttcaagaccc

SEQ ID NO: 23115 - DNA, 20 bp, Artificial Sequence
  Description of Artificial Sequence: Synthetic oligonucleotide
  Target: FXN; (-) strand; PAM type: YTN; PAM sequence: CTA
ccacttccttggcatcttca

SEQ ID NO: 23116 - DNA, 20 bp, Artificial Sequence
  Description of Artificial Sequence: Synthetic oligonucleotide
  Target: FXN; (-) strand; PAM type: YTN; PAM sequence: CTC
taccacttccttggcatctt

SEQ ID NO: 23117 - DNA, 20 bp, Artificial Sequence
  Description of Artificial Sequence: Synthetic oligonucleotide
  Target: FXN; (-) strand; PAM type: YTN; PAM sequence: CTC
gtgaaacaccctctaccact

SEQ ID NO: 23118 - DNA, 20 bp, Artificial Sequence
  Description of Artificial Sequence: Synthetic oligonucleotide
  Target: FXN; (-) strand; PAM type: YTN; PAM sequence: CTC
ctcgtgaaacaccctctacc

SEQ ID NO: 23119 - DNA, 20 bp, Artificial Sequence
  Description of Artificial Sequence: Synthetic oligonucleotide
  Target: FXN; (-) strand; PAM type: YTN; PAM sequence: TTC
cctcctcgtgaaacaccctc

SEQ ID NO: 23120 - DNA, 20 bp, Artificial Sequence
  Description of Artificial Sequence: Synthetic oligonucleotide
  Target: FXN; (-) strand; PAM type: YTN; PAM sequence: TTG
cccagacggttccctcctcg

SEQ ID NO: 23121 - DNA, 20 bp, Artificial Sequence
  Description of Artificial Sequence: Synthetic oligonucleotide
  Target: FXN; (-) strand; PAM type: YTN; PAM sequence: TTT
gcccagacggttccctcctc

SEQ ID NO: 23122 - DNA, 20 bp, Artificial Sequence
  Description of Artificial Sequence: Synthetic oligonucleotide
  Target: FXN; (-) strand; PAM type: YTN; PAM sequence: CTT
tgcccagacggttccctcct

SEQ ID NO: 23123 - DNA, 20 bp, Artificial Sequence
  Description of Artificial Sequence: Synthetic oligonucleotide
  Target: FXN; (-) strand; PAM type: YTN; PAM sequence: CTG
gcctttgcccagacggttcc

SEQ ID NO: 23124 - DNA, 20 bp, Artificial Sequence
  Description of Artificial Sequence: Synthetic oligonucleotide
  Target: FXN; (-) strand; PAM type: YTN; PAM sequence: TTC
ctggcctttgcccagacggt

SEQ ID NO: 23125 - DNA, 20 bp, Artificial Sequence
  Description of Artificial Sequence: Synthetic oligonucleotide
  Target: FXN; (-) strand; PAM type: YTN; PAM sequence: CTT
cctggcctttgcccagacgg

SEQ ID NO: 23126 - DNA, 20 bp, Artificial Sequence
  Description of Artificial Sequence: Synthetic oligonucleotide
  Target: FXN; (-) strand; PAM type: YTN; PAM sequence: TTC
cgccttcctggcctttgccc

SEQ ID NO: 23127 - DNA, 20 bp, Artificial Sequence
  Description of Artificial Sequence: Synthetic oligonucleotide
  Target: FXN; (-) strand; PAM type: YTN; PAM sequence: CTT
ccgccttcctggcctttgcc

SEQ ID NO: 23128 - DNA, 20 bp, Artificial Sequence
  Description of Artificial Sequence: Synthetic oligonucleotide
  Target: FXN; (-) strand; PAM type: YTN; PAM sequence: CTG
aagggatccccttccgcctt

SEQ ID NO: 23129 - DNA, 20 bp, Artificial Sequence
  Description of Artificial Sequence: Synthetic oligonucleotide
  Target: FXN; (-) strand; PAM type: YTN; PAM sequence: CTC
tgaagggatccccttccgcc

SEQ ID NO: 23130 - DNA, 20 bp, Artificial Sequence
  Description of Artificial Sequence: Synthetic oligonucleotide
  Target: FXN; (-) strand; PAM type: YTN; PAM sequence: CTA
atacatgcggcgtaccagcc

SEQ ID NO: 23131 - DNA, 20 bp, Artificial Sequence
  Description of Artificial Sequence: Synthetic oligonucleotide
  Target: FXN; (-) strand; PAM type: YTN; PAM sequence: CTC
ccctaatacatgcggcgtac

SEQ ID NO: 23132 - DNA, 20 bp, Artificial Sequence
  Description of Artificial Sequence: Synthetic oligonucleotide
  Target: FXN; (-) strand; PAM type: YTN; PAM sequence: TTC
atctcccctaatacatgcgg

SEQ ID NO: 23133 - DNA, 20 bp, Artificial Sequence
  Description of Artificial Sequence: Synthetic oligonucleotide
  Target: FXN; (-) strand; PAM type: YTN; PAM sequence: TTT
catctcccctaatacatgcg

SEQ ID NO: 23134 - DNA, 20 bp, Artificial Sequence
  Description of Artificial Sequence: Synthetic oligonucleotide
  Target: FXN; (-) strand; PAM type: YTN; PAM sequence: CTT
tcatctcccctaatacatgc

SEQ ID NO: 23135 - DNA, 20 bp, Artificial Sequence
  Description of Artificial Sequence: Synthetic oligonucleotide
  Target: FXN; (-) strand; PAM type: YTN; PAM sequence: CTC
tttcatctcccctaatacat

SEQ ID NO: 23136 - DNA, 20 bp, Artificial Sequence
  Description of Artificial Sequence: Synthetic oligonucleotide
  Target: FXN; (-) strand; PAM type: YTN; PAM sequence: CTG
cctctttcatctcccctaat

SEQ ID NO: 23137 - DNA, 20 bp, Artificial Sequence
  Description of Artificial Sequence: Synthetic oligonucleotide
  Target: FXN; (-) strand; PAM type: YTN; PAM sequence: TTG
gacgtggcctgcctctttca

SEQ ID NO: 23138 - DNA, 20 bp, Artificial Sequence
  Description of Artificial Sequence: Synthetic oligonucleotide
  Target: FXN; (-) strand; PAM type: YTN; PAM sequence: CTT
ggacgtggcctgcctctttc

SEQ ID NO: 23139 - DNA, 20 bp, Artificial Sequence
  Description of Artificial Sequence: Synthetic oligonucleotide
  Target: FXN; (-) strand; PAM type: YTN; PAM sequence: CTC
cggagagcaacacaaatatg

SEQ ID NO: 23140 - DNA, 20 bp, Artificial Sequence
  Description of Artificial Sequence: Synthetic oligonucleotide
  Target: FXN; (-) strand; PAM type: YTN; PAM sequence: CTA
aagtacaaactccggagagc

SEQ ID NO: 23141 - DNA, 20 bp, Artificial Sequence
  Description of Artificial Sequence: Synthetic oligonucleotide
  Target: FXN; (-) strand; PAM type: YTN; PAM sequence: TTC
aagcctaaagtacaaactcc

SEQ ID NO: 23142 - DNA, 20 bp, Artificial Sequence
  Description of Artificial Sequence: Synthetic oligonucleotide
  Target: FXN; (-) strand; PAM type: YTN; PAM sequence: TTC
aaacacaatgtgggccaaat

SEQ ID NO: 23143 - DNA, 20 bp, Artificial Sequence
  Description of Artificial Sequence: Synthetic oligonucleotide
  Target: FXN; (-) strand; PAM type: YTN; PAM sequence: CTT
caaacacaatgtgggccaaa

SEQ ID NO: 23144 - DNA, 20 bp, Artificial Sequence
  Description of Artificial Sequence: Synthetic oligonucleotide
  Target: FXN; (-) strand; PAM type: YTN; PAM sequence: TTC
ttcaaacacaatgtgggcca

SEQ ID NO: 23145 - DNA, 20 bp, Artificial Sequence
  Description of Artificial Sequence: Synthetic oligonucleotide
  Target: FXN; (-) strand; PAM type: YTN; PAM sequence: TTT
cttcaaacacaatgtgggcc

SEQ ID NO: 23146 - DNA, 20 bp, Artificial Sequence
  Description of Artificial Sequence: Synthetic oligonucleotide
  Target: FXN; (-) strand; PAM type: YTN; PAM sequence: CTG
gcaaccaatcccaaagtttc

SEQ ID NO: 23147 - DNA, 20 bp, Artificial Sequence
  Description of Artificial Sequence: Synthetic oligonucleotide
  Target: FXN; (-) strand; PAM type: YTN; PAM sequence: TTA
agcactggcaaccaatccca

SEQ ID NO: 23148 - DNA, 20 bp, Artificial Sequence
  Description of Artificial Sequence: Synthetic oligonucleotide
  Target: FXN; (-) strand; PAM type: YTN; PAM sequence: TTT
aagcactggcaaccaatccc

SEQ ID NO: 23149 - DNA, 20 bp, Artificial Sequence
  Description of Artificial Sequence: Synthetic oligonucleotide
  Target: FXN; (-) strand; PAM type: YTN; PAM sequence: TTT
taagcactggcaaccaatcc

SEQ ID NO: 23150 - DNA, 20 bp, Artificial Sequence
  Description of Artificial Sequence: Synthetic oligonucleotide
  Target: FXN; (-) strand; PAM type: YTN; PAM sequence: CTT
ttaagcactggcaaccaatc

SEQ ID NO: 23151 - DNA, 20 bp, Artificial Sequence
  Description of Artificial Sequence: Synthetic oligonucleotide
  Target: FXN; (-) strand; PAM type: YTN; PAM sequence: CTA
acttttaagcactggcaacc

SEQ ID NO: 23152 - DNA, 20 bp, Artificial Sequence
  Description of Artificial Sequence: Synthetic oligonucleotide
  Target: FXN; (-) strand; PAM type: YTN; PAM sequence: CTA
agtcctaacttttaagcact

SEQ ID NO: 23153 - DNA, 20 bp, Artificial Sequence
  Description of Artificial Sequence: Synthetic oligonucleotide
  Target: FXN; (-) strand; PAM type: YTN; PAM sequence: TTC
taagtcctaacttttaagca

SEQ ID NO: 23154 - DNA, 20 bp, Artificial Sequence
  Description of Artificial Sequence: Synthetic oligonucleotide
  Target: FXN; (-) strand; PAM type: YTN; PAM sequence: TTT
ctaagtcctaacttttaagc

SEQ ID NO: 23155 - DNA, 20 bp, Artificial Sequence
  Description of Artificial Sequence: Synthetic oligonucleotide
  Target: FXN; (-) strand; PAM type: YTN; PAM sequence: TTT
tctaagtcctaacttttaag

SEQ ID NO: 23156 - DNA, 20 bp, Artificial Sequence
  Description of Artificial Sequence: Synthetic oligonucleotide
  Target: FXN; (-) strand; PAM type: YTN; PAM sequence: CTG
ccaggaaatccattttctaa

SEQ ID NO: 23157 - DNA, 20 bp, Artificial Sequence
  Description of Artificial Sequence: Synthetic oligonucleotide
  Target: FXN; (-) strand; PAM type: YTN; PAM sequence: TTA
tgggcatgagccaccgcgtc

SEQ ID NO: 23158 - DNA, 20 bp, Artificial Sequence
  Description of Artificial Sequence: Synthetic oligonucleotide
  Target: FXN; (-) strand; PAM type: YTN; PAM sequence: CTG
agattatgggcatgagccac

SEQ ID NO: 23159 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgagattatgg

SEQ ID NO: 23160 - DNA, 20 bp, Artificial Sequence
  Description of Artificial Sequence: Synthetic oligonucleotide
  Target: FXN; (-) strand; PAM type: YTN; PAM sequence: CTA
ggcctcccaaagtgctgaga

SEQ ID NO: 23161 - DNA, 20 bp, Artificial Sequence
  Description of Artificial Sequence: Synthetic oligonucleotide
  Target: FXN; (-) strand; PAM type: YTN; PAM sequence: TTC
ctaggcctcccaaagtgctg

SEQ ID NO: 23162 - DNA, 20 bp, Artificial Sequence
  Description of Artificial Sequence: Synthetic oligonucleotide
  Target: FXN; (-) strand; PAM type: YTN; PAM sequence: CTT
cctaggcctcccaaagtgct

SEQ ID NO: 23163 - DNA, 20 bp, Artificial Sequence
  Description of Artificial Sequence: Synthetic oligonucleotide
  Target: FXN; (-) strand; PAM type: YTN; PAM sequence: CTC
aggtgatccaccttcctagg

SEQ ID NO: 23164 - DNA, 20 bp, Artificial Sequence
  Description of Artificial Sequence: Synthetic oligonucleotide
  Target: FXN; (-) strand; PAM type: YTN; PAM sequence: CTC
cggacctcaggtgatccacc

SEQ ID NO: 23165 - DNA, 20 bp, Artificial Sequence
  Description of Artificial Sequence: Synthetic oligonucleotide
  Target: FXN; (-) strand; PAM type: YTN; PAM sequence: TTG
aactccggacctcaggtgat

SEQ ID NO: 23166 - DNA, 20 bp, Artificial Sequence
  Description of Artificial Sequence: Synthetic oligonucleotide
  Target: FXN; (-) strand; PAM type: YTN; PAM sequence: CTT
gaactccggacctcaggtga

SEQ ID NO: 23167 - DNA, 20 bp, Artificial Sequence
  Description of Artificial Sequence: Synthetic oligonucleotide
  Target: FXN; (-) strand; PAM type: YTN; PAM sequence: TTA
gtcttgaactccggacctca

SEQ ID NO: 23168 - DNA, 20 bp, Artificial Sequence
  Description of Artificial Sequence: Synthetic oligonucleotide
  Target: FXN; (-) strand; PAM type: YTN; PAM sequence: TTG
gccaggttagtcttgaactc

SEQ ID NO: 23169 - DNA, 20 bp, Artificial Sequence
  Description of Artificial Sequence: Synthetic oligonucleotide
  Target: FXN; (-) strand; PAM type: YTN; PAM sequence: TTC
accatgttggccaggttagt

SEQ ID NO: 23170 - DNA, 20 bp, Artificial Sequence
  Description of Artificial Sequence: Synthetic oligonucleotide
  Target: FXN; (-) strand; PAM type: YTN; PAM sequence: TTT
caccatgttggccaggttag

SEQ ID NO: 23171 - DNA, 20 bp, Artificial Sequence
  Description of Artificial Sequence: Synthetic oligonucleotide
  Target: FXN; (-) strand; PAM type: YTN; PAM sequence: CTG
ggtttcaccatgttggccag

SEQ ID NO: 23172 - DNA, 20 bp, Artificial Sequence
  Description of Artificial Sequence: Synthetic oligonucleotide
  Target: FXN; (-) strand; PAM type: YTN; PAM sequence: TTA
gtagatactgggtttcacca

SEQ ID NO: 23173 - DNA, 20 bp, Artificial Sequence
  Description of Artificial Sequence: Synthetic oligonucleotide
  Target: FXN; (-) strand; PAM type: YTN; PAM sequence: TTT
agtagatactgggtttcacc

SEQ ID NO: 23174 - DNA, 20 bp, Artificial Sequence
  Description of Artificial Sequence: Synthetic oligonucleotide
  Target: FXN; (-) strand; PAM type: YTN; PAM sequence: TTT
tagtagatactgggtttcac

SEQ ID NO: 23175 - DNA, 20 bp, Artificial Sequence
  Description of Artificial Sequence: Synthetic oligonucleotide
  Target: FXN; (-) strand; PAM type: YTN; PAM sequence: TTT
ttagtagatactgggtttca

SEQ ID NO: 23176 - DNA, 20 bp, Artificial Sequence
  Description of Artificial Sequence: Synthetic oligonucleotide
  Target: FXN; (-) strand; PAM type: YTN; PAM sequence: TTT
tttagtagatactgggtttc

SEQ ID NO: 23177 - DNA, 20 bp, Artificial Sequence
  Description of Artificial Sequence: Synthetic oligonucleotide
  Target: FXN; (-) strand; PAM type: YTN; PAM sequence: TTG
tattttttagtagatactgg

SEQ ID NO: 23178 - DNA, 20 bp, Artificial Sequence
  Description of Artificial Sequence: Synthetic oligonucleotide
  Target: FXN; (-) strand; PAM type: YTN; PAM sequence: TTT
gtattttttagtagatactg

SEQ ID NO: 23179 - DNA, 20 bp, Artificial Sequence
  Description of Artificial Sequence: Synthetic oligonucleotide
  Target: FXN; (-) strand; PAM type: YTN; PAM sequence: TTT
tgtattttttagtagatact

SEQ ID NO: 23180 - DNA, 20 bp, Artificial Sequence
  Description of Artificial Sequence: Synthetic oligonucleotide
  Target: FXN; (-) strand; PAM type: YTN; PAM sequence: TTT
ttgtattttttagtagatac

SEQ ID NO: 23181 - DNA, 20 bp, Artificial Sequence
  Description of Artificial Sequence: Synthetic oligonucleotide
  Target: FXN; (-) strand; PAM type: YTN; PAM sequence: TTT
tttgtattttttagtagata

SEQ ID NO: 23182 - DNA, 20 bp, Artificial Sequence
  Description of Artificial Sequence: Synthetic oligonucleotide
  Target: FXN; (-) strand; PAM type: YTN; PAM sequence: TTT
ttttgtattttttagtagat

SEQ ID NO: 23183 - DNA, 20 bp, Artificial Sequence
  Description of Artificial Sequence: Synthetic oligonucleotide
  Target: FXN; (-) strand; PAM type: YTN; PAM sequence: TTT
tttttgtattttttagtaga

SEQ ID NO: 23184 - DNA, 20 bp, Artificial Sequence
  Description of Artificial Sequence: Synthetic oligonucleotide
  Target: FXN; (-) strand; PAM type: YTN; PAM sequence: TTT
ttttttgtattttttagtag

SEQ ID NO: 23185 - DNA, 20 bp, Artificial Sequence
  Description of Artificial Sequence: Synthetic oligonucleotide
  Target: FXN; (-) strand; PAM type: YTN; PAM sequence: TTT
tttttttgtattttttagta

SEQ ID NO: 23186 - DNA, 20 bp, Artificial Sequence
  Description of Artificial Sequence: Synthetic oligonucleotide
  Target: FXN; (-) strand; PAM type: YTN; PAM sequence: TTT
ttttttttgtattttttagt

SEQ ID NO: 23187 - DNA, 20 bp, Artificial Sequence
  Description of Artificial Sequence: Synthetic oligonucleotide
  Target: FXN; (-) strand; PAM type: YTN; PAM sequence: TTT
tttttttttgtattttttag

SEQ ID NO: 23188 - DNA, 20 bp, Artificial Sequence
  Description of Artificial Sequence: Synthetic oligonucleotide
  Target: FXN; (-) strand; PAM type: YTN; PAM sequence: TTT
ttttttttttgtatttttta

SEQ ID NO: 23189 - DNA, 20 bp, Artificial Sequence
  Description of Artificial Sequence: Synthetic oligonucleotide
  Target: FXN; (-) strand; PAM type: YTN; PAM sequence: TTT
tttttttttttgtatttttt

SEQ ID NO: 23190 - DNA, 20 bp, Artificial Sequence
  Description of Artificial Sequence: Synthetic oligonucleotide
  Target: FXN; (-) strand; PAM type: YTN; PAM sequence: TTT
ttttttttttttgtattttt

SEQ ID NO: 23191 - DNA, 20 bp, Artificial Sequence
  Description of Artificial Sequence: Synthetic oligonucleotide
  Target: FXN; (-) strand; PAM type: YTN; PAM sequence: TTT
tttttttttttttgtatttt

SEQ ID NO: 23192 - DNA, 20 bp, Artificial Sequence
  Description of Artificial Sequence: Synthetic oligonucleotide
  Target: FXN; (-) strand; PAM type: YTN; PAM sequence: CTT
ttttttttttttttgtattt

SEQ ID NO: 23193 - DNA, 20 bp, Artificial Sequence
  Description of Artificial Sequence: Synthetic oligonucleotide
  Target: FXN; (-) strand; PAM type: YTN; PAM sequence: TTC
ttttttttttttttttgtat

SEQ ID NO: 23194 - DNA, 20 bp, Artificial Sequence
  Description of Artificial Sequence: Synthetic oligonucleotide
  Target: FXN; (-) strand; PAM type: YTN; PAM sequence: CTT
cttttttttttttttttgta

SEQ ID NO: 23195 - DNA, 20 bp, Artificial Sequence
  Description of Artificial Sequence: Synthetic oligonucleotide
  Target: FXN; (-) strand; PAM type: YTN; PAM sequence: TTC
ttcttttttttttttttttg

SEQ ID NO: 23196 - DNA, 20 bp, Artificial Sequence
  Description of Artificial Sequence: Synthetic oligonucleotide
  Target: FXN; (-) strand; PAM type: YTN; PAM sequence: CTT
cttctttttttttttttttt

SEQ ID NO: 23197 - DNA, 20 bp, Artificial Sequence
  Description of Artificial Sequence: Synthetic oligonucleotide
  Target: FXN; (-) strand; PAM type: YTN; PAM sequence: TTC
ttcttctttttttttttttt

SEQ ID NO: 23198 - DNA, 20 bp, Artificial Sequence
  Description of Artificial Sequence: Synthetic oligonucleotide
  Target: FXN; (-) strand; PAM type: YTN; PAM sequence: CTT
cttcttcttttttttttttt

SEQ ID NO: 23199 - DNA, 20 bp, Artificial Sequence
  Description of Artificial Sequence: Synthetic oligonucleotide
  Target: FXN; (-) strand; PAM type: YTN; PAM sequence: TTC
ttcttcttcttttttttttt

SEQ ID NO: 23200 - DNA, 20 bp, Artificial Sequence
  Description of Artificial Sequence: Synthetic oligonucleotide
  Target: FXN; (-) strand; PAM type: YTN; PAM sequence: CTT
cttcttcttctttttttttt

SEQ ID NO: 23201 - DNA, 20 bp, Artificial Sequence
  Description of Artificial Sequence: Synthetic oligonucleotide
  Target: FXN; (-) strand; PAM type: YTN; PAM sequence: TTC
ttcttcttcttctttttttt

SEQ ID NO: 23202 - DNA, 20 bp, Artificial Sequence
  Description of Artificial Sequence: Synthetic oligonucleotide
  Target: FXN; (-) strand; PAM type: YTN; PAM sequence: CTT
cttcttcttcttcttttttt

SEQ ID NO: 23203 - DNA, 20 bp, Artificial Sequence
  Description of Artificial Sequence: Synthetic oligonucleotide
  Target: FXN; (-) strand; PAM type: YTN; PAM sequence: TTC
ttcttcttcttcttcttttt

SEQ ID NO: 23204 - DNA, 20 bp, Artificial Sequence
  Description of Artificial Sequence: Synthetic oligonucleotide
  Target: FXN; (-) strand; PAM type: YTN; PAM sequence: TTT
cttcttcttcttcttctttt

SEQ ID NO: 23205 - DNA, 20 bp, Artificial Sequence
  Description of Artificial Sequence: Synthetic oligonucleotide
  Target: FXN; (-) strand; PAM type: YTN; PAM sequence: TTT
tcttcttcttcttcttcttt

SEQ ID NO: 23206 - DNA, 20 bp, Artificial Sequence
  Description of Artificial Sequence: Synthetic oligonucleotide
  Target: FXN; (-) strand; PAM type: YTN; PAM sequence: TTA
ttttcttcttcttcttcttc

SEQ ID NO: 23207 - DNA, 20 bp, Artificial Sequence
  Description of Artificial Sequence: Synthetic oligonucleotide
  Target: FXN; (-) strand; PAM type: YTN; PAM sequence: TTT
attttcttcttcttcttctt

SEQ ID NO: 23208 - DNA, 20 bp, Artificial Sequence
  Description of Artificial Sequence: Synthetic oligonucleotide
  Target: FXN; (-) strand; PAM type: YTN; PAM sequence: CTT
tattttcttcttcttcttct

SEQ ID NO: 23209 - DNA, 20 bp, Artificial Sequence
  Description of Artificial Sequence: Synthetic oligonucleotide
  Target: FXN; (-) strand; PAM type: YTN; PAM sequence: TTC
tttattttcttcttcttctt

SEQ ID NO: 23210 - DNA, 20 bp, Artificial Sequence
  Description of Artificial Sequence: Synthetic oligonucleotide
  Target: FXN; (-) strand; PAM type: YTN; PAM sequence: TTT
ctttattttcttcttcttct

SEQ ID NO: 23211 - DNA, 20 bp, Artificial Sequence
  Description of Artificial Sequence: Synthetic oligonucleotide
  Target: FXN; (-) strand; PAM type: YTN; PAM sequence: TTT
tctttattttcttcttcttc

SEQ ID NO: 23212 - DNA, 20 bp, Artificial Sequence
  Description of Artificial Sequence: Synthetic oligonucleotide
  Target: FXN; (-) strand; PAM type: YTN; PAM sequence: CTT
ttctttattttcttcttctt

SEQ ID NO: 23213 - DNA, 20 bp, Artificial Sequence
  Description of Artificial Sequence: Synthetic oligonucleotide
  Target: FXN; (-) strand; PAM type: YTN; PAM sequence: CTA
acttttctttattttcttct

SEQ ID NO: 23214 - DNA, 20 bp, Artificial Sequence
  Description of Artificial Sequence: Synthetic oligonucleotide
  Target: FXN; (-) strand; PAM type: YTN; PAM sequence: TTA
caggcgcgcgacaccacgcc

SEQ ID NO: 23215 - DNA, 20 bp, Artificial Sequence
  Description of Artificial Sequence: Synthetic oligonucleotide
  Target: FXN; (-) strand; PAM type: YTN; PAM sequence: CTG
ggattacaggcgcgcgacac

SEQ ID NO: 23216 - DNA, 20 bp, Artificial Sequence
  Description of Artificial Sequence: Synthetic oligonucleotide
  Target: FXN; (-) strand; PAM type: YTN; PAM sequence: CTG
gagtagctgggattacaggc

SEQ ID NO: 23217 - DNA, 20 bp, Artificial Sequence
  Description of Artificial Sequence: Synthetic oligonucleotide
  Target: FXN; (-) strand; PAM type: YTN; PAM sequence: CTC
tggagtagctgggattacag

SEQ ID NO: 23218 - DNA, 20 bp, Artificial Sequence
  Description of Artificial Sequence: Synthetic oligonucleotide
  Target: FXN; (-) strand; PAM type: YTN; PAM sequence: CTG
ccgcagcctctggagtagct

SEQ ID NO: 23219 - DNA, 20 bp, Artificial Sequence
  Description of Artificial Sequence: Synthetic oligonucleotide
  Target: FXN; (-) strand; PAM type: YTN; PAM sequence: CTC
ctgccgcagcctctggagta

SEQ ID NO: 23220 - DNA, 20 bp, Artificial Sequence
  Description of Artificial Sequence: Synthetic oligonucleotide
  Target: FXN; (-) strand; PAM type: YTN; PAM sequence: TTC
tcctgccgcagcctctggag

SEQ ID NO: 23221 - DNA, 20 bp, Artificial Sequence
  Description of Artificial Sequence: Synthetic oligonucleotide
  Target: FXN; (-) strand; PAM type: YTN; PAM sequence: CTC
aagcgattctcctgccgcag

SEQ ID NO: 23222 - DNA, 20 bp, Artificial Sequence
  Description of Artificial Sequence: Synthetic oligonucleotide
  Target: FXN; (-) strand; PAM type: YTN; PAM sequence: CTC
ccgggctcaagcgattctcc

SEQ ID NO: 23223 - DNA, 20 bp, Artificial Sequence
  Description of Artificial Sequence: Synthetic oligonucleotide
  Target: FXN; (-) strand; PAM type: YTN; PAM sequence: CTG
cctcccgggctcaagcgatt

SEQ ID NO: 23224 - DNA, 20 bp, Artificial Sequence
  Description of Artificial Sequence: Synthetic oligonucleotide
  Target: FXN; (-) strand; PAM type: YTN; PAM sequence: CTC
tgcctcccgggctcaagcga

SEQ ID NO: 23225 - DNA, 20 bp, Artificial Sequence
  Description of Artificial Sequence: Synthetic oligonucleotide
  Target: FXN; (-) strand; PAM type: YTN; PAM sequence: TTA
atgcaacctctgcctcccgg

SEQ ID NO: 23226 - DNA, 20 bp, Artificial Sequence
  Description of Artificial Sequence: Synthetic oligonucleotide
  Target: FXN; (-) strand; PAM type: YTN; PAM sequence: CTT
aatgcaacctctgcctcccg

SEQ ID NO: 23227 - DNA, 20 bp, Artificial Sequence
  Description of Artificial Sequence: Synthetic oligonucleotide
  Target: FXN; (-) strand; PAM type: YTN; PAM sequence: TTG
gcttaatgcaacctctgcct

SEQ ID NO: 23228 - DNA, 20 bp, Artificial Sequence
  Description of Artificial Sequence: Synthetic oligonucleotide
  Target: FXN; (-) strand; PAM type: YTN; PAM sequence: CTT
ggcttaatgcaacctctgcc

SEQ ID NO: 23229 - DNA, 20 bp, Artificial Sequence
  Description of Artificial Sequence: Synthetic oligonucleotide
  Target: FXN; (-) strand; PAM type: YTN; PAM sequence: TTG
ggcgatcttggcttaatgca

SEQ ID NO: 23230 - DNA, 20 bp, Artificial Sequence
  Description of Artificial Sequence: Synthetic oligonucleotide
  Target: FXN; (-) strand; PAM type: YTN; PAM sequence: CTG
tcgcccaggccggagtgcat

SEQ ID NO: 23231 - DNA, 20 bp, Artificial Sequence
  Description of Artificial Sequence: Synthetic oligonucleotide
  Target: FXN; (-) strand; PAM type: YTN; PAM sequence: CTC
tgtcgcccaggccggagtgc

SEQ ID NO: 23232 - DNA, 20 bp, Artificial Sequence
  Description of Artificial Sequence: Synthetic oligonucleotide
  Target: FXN; (-) strand; PAM type: YTN; PAM sequence: TTG
ctctgtcgcccaggccggag

SEQ ID NO: 23233 - DNA, 20 bp, Artificial Sequence
  Description of Artificial Sequence: Synthetic oligonucleotide
  Target: FXN; (-) strand; PAM type: YTN; PAM sequence: CTT
gctctgtcgcccaggccgga

SEQ ID NO: 23234 - DNA, 20 bp, Artificial Sequence
  Description of Artificial Sequence: Synthetic oligonucleotide
  Target: FXN; (-) strand; PAM type: YTN; PAM sequence: TTG
agacggagtcttgctctgtc

SEQ ID NO: 23235 - DNA, 20 bp, Artificial Sequence
  Description of Artificial Sequence: Synthetic oligonucleotide
  Target: FXN; (-) strand; PAM type: YTN; PAM sequence: TTT
gagacggagtcttgctctgt

SEQ ID NO: 23236 - DNA, 20 bp, Artificial Sequence
  Description of Artificial Sequence: Synthetic oligonucleotide
  Target: FXN; (-) strand; PAM type: YTN; PAM sequence: TTT
tgagacggagtcttgctctg

SEQ ID NO: 23237 - DNA, 20 bp, Artificial Sequence
  Description of Artificial Sequence: Synthetic oligonucleotide
  Target: FXN; (-) strand; PAM type: YTN; PAM sequence: TTT
ttgagacggagtcttgctct

SEQ ID NO: 23238 - DNA, 20 bp, Artificial Sequence
  Description of Artificial Sequence: Synthetic oligonucleotide
  Target: FXN; (-) strand; PAM type: YTN; PAM sequence: TTT
tttgagacggagtcttgctc

SEQ ID NO: 23239 - DNA, 20 bp, Artificial Sequence
  Description of Artificial Sequence: Synthetic oligonucleotide
  Target: FXN; (-) strand; PAM type: YTN; PAM sequence: TTA
ttttttgagacggagtcttg

SEQ ID NO: 23240 - DNA, 20 bp, Artificial Sequence
  Description of Artificial Sequence: Synthetic oligonucleotide
  Target: FXN; (-) strand; PAM type: YTN; PAM sequence: TTA
ttattttttgagacggagtc

SEQ ID NO: 23241 - DNA, 20 bp, Artificial Sequence
  Description of Artificial Sequence: Synthetic oligonucleotide
  Target: FXN; (-) strand; PAM type: YTN; PAM sequence: TTA
ttattattttttgagacgga

SEQ ID NO: 23242 - DNA, 20 bp, Artificial Sequence
  Description of Artificial Sequence: Synthetic oligonucleotide
  Target: FXN; (-) strand; PAM type: YTN; PAM sequence: TTA
ttattattattttttgagac

SEQ ID NO: 23243 - DNA, 20 bp, Artificial Sequence
  Description of Artificial Sequence: Synthetic oligonucleotide
  Target: FXN; (-) strand; PAM type: YTN; PAM sequence: TTT
attattattattttttgaga

SEQ ID NO: 23244 - DNA, 20 bp, Artificial Sequence
  Description of Artificial Sequence: Synthetic oligonucleotide
  Target: FXN; (-) strand; PAM type: YTN; PAM sequence: TTA
tttattattattattttttg

SEQ ID NO: 23245 - DNA, 20 bp, Artificial Sequence
  Description of Artificial Sequence: Synthetic oligonucleotide
  Target: FXN; (-) strand; PAM type: YTN; PAM sequence: TTT
atttattattattatttttt

SEQ ID NO: 23246 - DNA, 20 bp, Artificial Sequence
  Description of Artificial Sequence: Synthetic oligonucleotide
  Target: FXN; (-) strand; PAM type: YTN; PAM sequence: TTT
tatttattattattattttt

SEQ ID NO: 23247 - DNA, 20 bp, Artificial Sequence
  Description of Artificial Sequence: Synthetic oligonucleotide
  Target: FXN; (-) strand; PAM type: YTN; PAM sequence: TTT
ttatttattattattatttt

SEQ ID NO: 23248 - DNA, 20 bp, Artificial Sequence
  Description of Artificial Sequence: Synthetic oligonucleotide
  Target: FXN; (-) strand; PAM type: YTN; PAM sequence: TTA
tttttatttattattattat

SEQ ID NO: 23249 - DNA, 20 bp, Artificial Sequence
  Description of Artificial Sequence: Synthetic oligonucleotide
  Target: FXN; (-) strand; PAM type: YTN; PAM sequence: TTT
atttttatttattattatta

SEQ ID NO: 23250 - DNA, 20 bp, Artificial Sequence
  Description of Artificial Sequence: Synthetic oligonucleotide
  Target: FXN; (-) strand; PAM type: YTN; PAM sequence: TTT
tatttttatttattattatt

SEQ ID NO: 23251 - DNA, 20 bp, Artificial Sequence
  Description of Artificial Sequence: Synthetic oligonucleotide
  Target: FXN; (-) strand; PAM type: YTN; PAM sequence: TTT
ttatttttatttattattat

SEQ ID NO: 23252 - DNA, 20 bp, Artificial Sequence
  Description of Artificial Sequence: Synthetic oligonucleotide
  Target: FXN; (-) strand; PAM type: YTN; PAM sequence: TTT
tttatttttatttattatta

SEQ ID NO: 23253 - DNA, 20 bp, Artificial Sequence
  Description of Artificial Sequence: Synthetic oligonucleotide
  Target: FXN; (-) strand; PAM type: YTN; PAM sequence: TTA
ttttttatttttatttatta

SEQ ID NO: 23254 - DNA, 20 bp, Artificial Sequence
  Description of Artificial Sequence: Synthetic oligonucleotide
  Target: FXN; (-) strand; PAM type: YTN; PAM sequence: TTT
attttttatttttatttatt

SEQ ID NO: 23255 - DNA, 20 bp, Artificial Sequence
  Description of Artificial Sequence: Synthetic oligonucleotide
  Target: FXN; (-) strand; PAM type: YTN; PAM sequence: TTT
tattttttatttttatttat

SEQ ID NO: 23256 - DNA, 20 bp, Artificial Sequence
  Description of Artificial Sequence: Synthetic oligonucleotide
  Target: FXN; (-) strand; PAM type: YTN; PAM sequence: CTG
ggaaatccattttatttttt

SEQ ID NO: 23257 - DNA, 20 bp, Artificial Sequence
  Description of Artificial Sequence: Synthetic oligonucleotide
  Target: FXN; (-) strand; PAM type: YTN; PAM sequence: TTC
cagagatgctgggaaatcca

SEQ ID NO: 23258 - DNA, 20 bp, Artificial Sequence
  Description of Artificial Sequence: Synthetic oligonucleotide
  Target: FXN; (-) strand; PAM type: YTN; PAM sequence: TTT
ccagagatgctgggaaatcc

SEQ ID NO: 23259 - DNA, 20 bp, Artificial Sequence
  Description of Artificial Sequence: Synthetic oligonucleotide
  Target: FXN; (-) strand; PAM type: YTN; PAM sequence: TTT
tccagagatgctgggaaatc

SEQ ID NO: 23260 - DNA, 20 bp, Artificial Sequence
  Description of Artificial Sequence: Synthetic oligonucleotide
  Target: FXN; (-) strand; PAM type: YTN; PAM sequence: TTT
ttccagagatgctgggaaat

SEQ ID NO: 23261 - DNA, 20 bp, Artificial Sequence
  Description of Artificial Sequence: Synthetic oligonucleotide
  Target: FXN; (-) strand; PAM type: YTN; PAM sequence: CTA
tttttccagagatgctggga

SEQ ID NO: 23262 - DNA, 20 bp, Artificial Sequence
  Description of Artificial Sequence: Synthetic oligonucleotide
  Target: FXN; (-) strand; PAM type: YTN; PAM sequence: TTG
cctatttttccagagatgct

SEQ ID NO: 23263 - DNA, 20 bp, Artificial Sequence
  Description of Artificial Sequence: Synthetic oligonucleotide
  Target: FXN; (-) strand; PAM type: YTN; PAM sequence: CTT
gcctatttttccagagatgc

SEQ ID NO: 23264 - DNA, 20 bp, Artificial Sequence
  Description of Artificial Sequence: Synthetic oligonucleotide
  Target: FXN; (-) strand; PAM type: YTN; PAM sequence: CTA
aggaccatcatggccacact

SEQ ID NO: 23265 - DNA, 20 bp, Artificial Sequence
  Description of Artificial Sequence: Synthetic oligonucleotide
  Target: FXN; (-) strand; PAM type: YTN; PAM sequence: CTA
gaggagatctaaggaccatc

SEQ ID NO: 23266 - DNA, 20 bp, Artificial Sequence
  Description of Artificial Sequence: Synthetic oligonucleotide
  Target: FXN; (-) strand; PAM type: YTN; PAM sequence: TTC
ctagaggagatctaaggacc

SEQ ID NO: 23267 - DNA, 20 bp, Artificial Sequence
  Description of Artificial Sequence: Synthetic oligonucleotide
  Target: FXN; (-) strand; PAM type: YTN; PAM sequence: TTT
cctagaggagatctaaggac

SEQ ID NO: 23268 - DNA, 20 bp, Artificial Sequence
  Description of Artificial Sequence: Synthetic oligonucleotide
  Target: FXN; (-) strand; PAM type: YTN; PAM sequence: CTT
tcctagaggagatctaagga

SEQ ID NO: 23269 - DNA, 20 bp, Artificial Sequence
  Description of Artificial Sequence: Synthetic oligonucleotide
  Target: FXN; (-) strand; PAM type: YTN; PAM sequence: CTG
ctttcctagaggagatctaa

SEQ ID NO: 23270 - DNA, 20 bp, Artificial Sequence
  Description of Artificial Sequence: Synthetic oligonucleotide
  Target: FXN; (-) strand; PAM type: YTN; PAM sequence: CTC
agatagtgcacagaagccaa

SEQ ID NO: 23271 - DNA, 20 bp, Artificial Sequence
  Description of Artificial Sequence: Synthetic oligonucleotide
  Target: FXN; (-) strand; PAM type: YTN; PAM sequence: CTG
tccacacaggcaggggtgga

SEQ ID NO: 23272 - DNA, 20 bp, Artificial Sequence
  Description of Artificial Sequence: Synthetic oligonucleotide
  Target: FXN; (-) strand; PAM type: YTN; PAM sequence: CTG
acaacccatgctgtccacac

SEQ ID NO: 23273 - DNA, 20 bp, Artificial Sequence
  Description of Artificial Sequence: Synthetic oligonucleotide
  Target: FXN; (-) strand; PAM type: YTN; PAM sequence: CTG
ctgacaacccatgctgtcca

SEQ ID NO: 23274 - DNA, 20 bp, Artificial Sequence
  Description of Artificial Sequence: Synthetic oligonucleotide
  Target: FXN; (-) strand; PAM type: YTN; PAM sequence: CTC
tgctgacaacccatgctgtc

SEQ ID NO: 23275 - DNA, 20 bp, Artificial Sequence
  Description of Artificial Sequence: Synthetic oligonucleotide
  Target: FXN; (-) strand; PAM type: YTN; PAM sequence: CTC
aaaaaaacaaaacaaaacac

SEQ ID NO: 23276 - DNA, 20 bp, Artificial Sequence
  Description of Artificial Sequence: Synthetic oligonucleotide
  Target: FXN; (-) strand; PAM type: YTN; PAM sequence: CTG
tctcaaaaaaacaaaacaaa

SEQ ID NO: 23277 - DNA, 20 bp, Artificial Sequence
  Description of Artificial Sequence: Synthetic oligonucleotide
  Target: FXN; (-) strand; PAM type: YTN; PAM sequence: CTC
tgtctcaaaaaaacaaaaca

SEQ ID NO: 23278 - DNA, 20 bp, Artificial Sequence
  Description of Artificial Sequence: Synthetic oligonucleotide
  Target: FXN; (-) strand; PAM type: YTN; PAM sequence: CTG
ggcaacaagagggaaactct

SEQ ID NO: 23279 - DNA, 20 bp, Artificial Sequence
  Description of Artificial Sequence: Synthetic oligonucleotide
  Target: FXN; (-) strand; PAM type: YTN; PAM sequence: CTC
cagcctgggcaacaagaggg

SEQ ID NO: 23280 - DNA, 20 bp, Artificial Sequence
  Description of Artificial Sequence: Synthetic oligonucleotide
  Target: FXN; (-) strand; PAM type: YTN; PAM sequence: CTG
cactccagcctgggcaacaa

SEQ ID NO: 23281 - DNA, 20 bp, Artificial Sequence
  Description of Artificial Sequence: Synthetic oligonucleotide
  Target: FXN; (-) strand; PAM type: YTN; PAM sequence: CTG
agccactgcactccagcctg

SEQ ID NO: 23282 - DNA, 20 bp, Artificial Sequence
  Description of Artificial Sequence: Synthetic oligonucleotide
  Target: FXN; (-) strand; PAM type: YTN; PAM sequence: CTG
agactgagccactgcactcc

SEQ ID NO: 23283 - DNA, 20 bp, Artificial Sequence
  Description of Artificial Sequence: Synthetic oligonucleotide
  Target: FXN; (-) strand; PAM type: YTN; PAM sequence: TTG
cagtgagctgagactgagcc

SEQ ID NO: 23284 - DNA, 20 bp, Artificial Sequence
  Description of Artificial Sequence: Synthetic oligonucleotide
  Target: FXN; (-) strand; PAM type: YTN; PAM sequence: TTG
aacccaggaggcagaggttg

SEQ ID NO: 23285 - DNA, 20 bp, Artificial Sequence
  Description of Artificial Sequence: Synthetic oligonucleotide
  Target: FXN; (-) strand; PAM type: YTN; PAM sequence: CTT
gaacccaggaggcagaggtt

SEQ ID NO: 23286 - DNA, 20 bp, Artificial Sequence
  Description of Artificial Sequence: Synthetic oligonucleotide
  Target: FXN; (-) strand; PAM type: YTN; PAM sequence: CTG
aggcaggagaatcacttgaa

SEQ ID NO: 23287 - DNA, 20 bp, Artificial Sequence
  Description of Artificial Sequence: Synthetic oligonucleotide
  Target: FXN; (-) strand; PAM type: YTN; PAM sequence: CTC
gggaggctgaggcaggagaa

SEQ ID NO: 23288 - DNA, 20 bp, Artificial Sequence
  Description of Artificial Sequence: Synthetic oligonucleotide
  Target: FXN; (-) strand; PAM type: YTN; PAM sequence: CTA
ctcgggaggctgaggcagga

SEQ ID NO: 23289 - DNA, 20 bp, Artificial Sequence
  Description of Artificial Sequence: Synthetic oligonucleotide
  Target: FXN; (-) strand; PAM type: YTN; PAM sequence: TTA
gccgataatcccagctactc

SEQ ID NO: 23290 - DNA, 20 bp, Artificial Sequence
  Description of Artificial Sequence: Synthetic oligonucleotide
  Target: FXN; (-) strand; PAM type: YTN; PAM sequence: CTA
aaaatacaaaattagccgat

SEQ ID NO: 23291 - DNA, 20 bp, Artificial Sequence
  Description of Artificial Sequence: Synthetic oligonucleotide
  Target: FXN; (-) strand; PAM type: YTN; PAM sequence: CTA
ctaaaaatacaaaattagcc

SEQ ID NO: 23292 - DNA, 20 bp, Artificial Sequence
  Description of Artificial Sequence: Synthetic oligonucleotide
  Target: FXN; (-) strand; PAM type: YTN; PAM sequence: CTC
tactaaaaatacaaaattag

SEQ ID NO: 23293 - DNA, 20 bp, Artificial Sequence
  Description of Artificial Sequence: Synthetic oligonucleotide
  Target: FXN; (-) strand; PAM type: YTN; PAM sequence: CTG
tctctactaaaaatacaaaa

SEQ ID NO: 23294 - DNA, 20 bp, Artificial Sequence
  Description of Artificial Sequence: Synthetic oligonucleotide
  Target: FXN; (-) strand; PAM type: YTN; PAM sequence: CTG
accaacatggagaaatctgt

SEQ ID NO: 23295 - DNA, 20 bp, Artificial Sequence
  Description of Artificial Sequence: Synthetic oligonucleotide
  Target: FXN; (-) strand; PAM type: YTN; PAM sequence: TTC
gagaccagcctgaccaacat

SEQ ID NO: 23296 - DNA, 20 bp, Artificial Sequence
  Description of Artificial Sequence: Synthetic oligonucleotide
  Target: FXN; (-) strand; PAM type: YTN; PAM sequence: TTG
ggagttcgagaccagcctga

SEQ ID NO: 23297 - DNA, 20 bp, Artificial Sequence
  Description of Artificial Sequence: Synthetic oligonucleotide
  Target: FXN; (-) strand; PAM type: YTN; PAM sequence: CTG
aggttgggagttcgagacca

SEQ ID NO: 23298 - DNA, 20 bp, Artificial Sequence
  Description of Artificial Sequence: Synthetic oligonucleotide
  Target: FXN; (-) strand; PAM type: YTN; PAM sequence: TTG
ggagggcgaggtgggcggat

SEQ ID NO: 23299 - DNA, 20 bp, Artificial Sequence
  Description of Artificial Sequence: Synthetic oligonucleotide
  Target: FXN; (-) strand; PAM type: YTN; PAM sequence: TTT
gggagggcgaggtgggcgga

SEQ ID NO: 23300 - DNA, 20 bp, Artificial Sequence
  Description of Artificial Sequence: Synthetic oligonucleotide
  Target: FXN; (-) strand; PAM type: YTN; PAM sequence: CTT
tgggagggcgaggtgggcgg

SEQ ID NO: 23301 - DNA, 20 bp, Artificial Sequence
  Description of Artificial Sequence: Synthetic oligonucleotide
  Target: FXN; (-) strand; PAM type: YTN; PAM sequence: TTC
cagcactttgggagggcgag

SEQ ID NO: 23302 - DNA, 20 bp, Artificial Sequence
  Description of Artificial Sequence: Synthetic oligonucleotide
  Target: FXN; (-) strand; PAM type: YTN; PAM sequence: CTG
taattccagcactttgggag

SEQ ID NO: 23303 - DNA, 20 bp, Artificial Sequence
  Description of Artificial Sequence: Synthetic oligonucleotide
  Target: FXN; (-) strand; PAM type: YTN; PAM sequence: CTC
acgcctgtaattccagcact

SEQ ID NO: 23304 - DNA, 20 bp, Artificial Sequence
  Description of Artificial Sequence: Synthetic oligonucleotide
  Target: FXN; (-) strand; PAM type: YTN; PAM sequence: CTG
atggccagacgcggtggctc

SEQ ID NO: 23305 - DNA, 20 bp, Artificial Sequence
  Description of Artificial Sequence: Synthetic oligonucleotide
  Target: FXN; (-) strand; PAM type: YTN; PAM sequence: CTG
ctgatggccagacgcggtgg

SEQ ID NO: 23306 - DNA, 20 bp, Artificial Sequence
  Description of Artificial Sequence: Synthetic oligonucleotide
  Target: FXN; (-) strand; PAM type: YTN; PAM sequence: CTC
tgctgatggccagacgcggt

SEQ ID NO: 23307 - DNA, 20 bp, Artificial Sequence
  Description of Artificial Sequence: Synthetic oligonucleotide
  Target: FXN; (-) strand; PAM type: YTN; PAM sequence: TTA
aaaactctgctgatggccag

SEQ ID NO: 23308 - DNA, 20 bp, Artificial Sequence
  Description of Artificial Sequence: Synthetic oligonucleotide
  Target: FXN; (-) strand; PAM type: YTN; PAM sequence: CTA
aattaaaaactctgctgatg

SEQ ID NO: 23309 - DNA, 20 bp, Artificial Sequence
  Description of Artificial Sequence: Synthetic oligonucleotide
  Target: FXN; (-) strand; PAM type: YTN; PAM sequence: CTC
ctaaattaaaaactctgctg

SEQ ID NO: 23310 - DNA, 20 bp, Artificial Sequence
  Description of Artificial Sequence: Synthetic oligonucleotide
  Target: FXN; (-) strand; PAM type: YTN; PAM sequence: TTC
tcctaaattaaaaactctgc

SEQ ID NO: 23311 - DNA, 20 bp, Artificial Sequence
  Description of Artificial Sequence: Synthetic oligonucleotide
  Target: FXN; (-) strand; PAM type: YTN; PAM sequence: TTG
tcattctcctaaattaaaaa

SEQ ID NO: 23312 - DNA, 20 bp, Artificial Sequence
  Description of Artificial Sequence: Synthetic oligonucleotide
  Target: FXN; (-) strand; PAM type: YTN; PAM sequence: CTT
gtcattctcctaaattaaaa

SEQ ID NO: 23313 - DNA, 20 bp, Artificial Sequence
  Description of Artificial Sequence: Synthetic oligonucleotide
  Target: FXN; (-) strand; PAM type: YTN; PAM sequence: CTC
ttgtcattctcctaaattaa

SEQ ID NO: 23314 - DNA, 20 bp, Artificial Sequence
  Description of Artificial Sequence: Synthetic oligonucleotide
  Target: FXN; (-) strand; PAM type: YTN; PAM sequence: CTG
taccacctcttgtcattctc

SEQ ID NO: 23315 - DNA, 20 bp, Artificial Sequence
  Description of Artificial Sequence: Synthetic oligonucleotide
  Target: FXN; (-) strand; PAM type: YTN; PAM sequence: CTA
aaaaactgtaccacctcttg

SEQ ID NO: 23316 - DNA, 20 bp, Artificial Sequence
  Description of Artificial Sequence: Synthetic oligonucleotide
  Target: FXN; (-) strand; PAM type: YTN; PAM sequence: TTA
acagccaccaggtaccatct

SEQ ID NO: 23317 - DNA, 20 bp, Artificial Sequence
  Description of Artificial Sequence: Synthetic oligonucleotide
  Target: FXN; (-) strand; PAM type: YTN; PAM sequence: CTT
aacagccaccaggtaccatc

SEQ ID NO: 23318 - DNA, 20 bp, Artificial Sequence
  Description of Artificial Sequence: Synthetic oligonucleotide
  Target: FXN; (-) strand; PAM type: YTN; PAM sequence: TTG
tcagtcaatagcccttaaca

SEQ ID NO: 23319 - DNA, 20 bp, Artificial Sequence
  Description of Artificial Sequence: Synthetic oligonucleotide
  Target: FXN; (-) strand; PAM type: YTN; PAM sequence: TTT
gtcagtcaatagcccttaac

SEQ ID NO: 23320 - DNA, 20 bp, Artificial Sequence
  Description of Artificial Sequence: Synthetic oligonucleotide
  Target: FXN; (-) strand; PAM type: YTN; PAM sequence: TTG
ggtgtgtttgtcagtcaata

SEQ ID NO: 23321 - DNA, 20 bp, Artificial Sequence
  Description of Artificial Sequence: Synthetic oligonucleotide
  Target: FXN; (-) strand; PAM type: YTN; PAM sequence: CTG
ggcggcagcgccaagttggg

SEQ ID NO: 23322 - DNA, 20 bp, Artificial Sequence
  Description of Artificial Sequence: Synthetic oligonucleotide
  Target: FXN; (-) strand; PAM type: YTN; PAM sequence: CTC
ctgggcggcagcgccaagtt

SEQ ID NO: 23323 - DNA, 20 bp, Artificial Sequence
  Description of Artificial Sequence: Synthetic oligonucleotide
  Target: FXN; (-) strand; PAM type: YTN; PAM sequence: CTA
tccagaaacccagtgtccac

SEQ ID NO: 23324 - DNA, 20 bp, Artificial Sequence
  Description of Artificial Sequence: Synthetic oligonucleotide
  Target: FXN; (-) strand; PAM type: YTN; PAM sequence: CTA
accatctatccagaaaccca

SEQ ID NO: 23325 - DNA, 20 bp, Artificial Sequence
  Description of Artificial Sequence: Synthetic oligonucleotide
  Target: FXN; (-) strand; PAM type: YTN; PAM sequence: TTG
ctaaccatctatccagaaac

SEQ ID NO: 23326 - DNA, 20 bp, Artificial Sequence
  Description of Artificial Sequence: Synthetic oligonucleotide
  Target: FXN; (-) strand; PAM type: YTN; PAM sequence: CTG
gtgacagaggttgctaacca

SEQ ID NO: 23327 - DNA, 20 bp, Artificial Sequence
  Description of Artificial Sequence: Synthetic oligonucleotide
  Target: FXN; (-) strand; PAM type: YTN; PAM sequence: TTC
agtatagaaaaaaagaggcc

SEQ ID NO: 23328 - DNA, 20 bp, Artificial Sequence
  Description of Artificial Sequence: Synthetic oligonucleotide
  Target: FXN; (-) strand; PAM type: YTN; PAM sequence: TTA
attcagtatagaaaaaaaga

SEQ ID NO: 23329 - DNA, 20 bp, Artificial Sequence
  Description of Artificial Sequence: Synthetic oligonucleotide
  Target: FXN; (-) strand; PAM type: YTN; PAM sequence: TTA
aacaaatgtgattaattcag

SEQ ID NO: 23330 - DNA, 20 bp, Artificial Sequence
  Description of Artificial Sequence: Synthetic oligonucleotide
  Target: FXN; (-) strand; PAM type: YTN; PAM sequence: CTA
tggaacagacaggttaaaca

SEQ ID NO: 23331 - DNA, 20 bp, Artificial Sequence
  Description of Artificial Sequence: Synthetic oligonucleotide
  Target: FXN; (-) strand; PAM type: YTN; PAM sequence: CTC
aaatacccaagatgtgcaag

SEQ ID NO: 23332 - DNA, 20 bp, Artificial Sequence
  Description of Artificial Sequence: Synthetic oligonucleotide
  Target: FXN; (-) strand; PAM type: YTN; PAM sequence: CTC
ctcaaatacccaagatgtgc

SEQ ID NO: 23333 - DNA, 20 bp, Artificial Sequence
  Description of Artificial Sequence: Synthetic oligonucleotide
  Target: FXN; (-) strand; PAM type: YTN; PAM sequence: CTG
ccacccacccaactcctcaa

SEQ ID NO: 23334 - DNA, 20 bp, Artificial Sequence
  Description of Artificial Sequence: Synthetic oligonucleotide
  Target: FXN; (-) strand; PAM type: YTN; PAM sequence: TTG
ccactgccacccacccaact

SEQ ID NO: 23335 - DNA, 20 bp, Artificial Sequence
  Description of Artificial Sequence: Synthetic oligonucleotide
  Target: FXN; (-) strand; PAM type: YTN; PAM sequence: TTA
aacaggatggtggccccagt

SEQ ID NO: 23336 - DNA, 20 bp, Artificial Sequence
  Description of Artificial Sequence: Synthetic oligonucleotide
  Target: FXN; (-) strand; PAM type: YTN; PAM sequence: TTA
aaataattaaacaggatggt

SEQ ID NO: 23337 - DNA, 20 bp, Artificial Sequence
  Description of Artificial Sequence: Synthetic oligonucleotide
  Target: FXN; (-) strand; PAM type: YTN; PAM sequence: TTT
aaaataattaaacaggatgg

SEQ ID NO: 23338 - DNA, 20 bp, Artificial Sequence
  Description of Artificial Sequence: Synthetic oligonucleotide
  Target: FXN; (-) strand; PAM type: YTN; PAM sequence: CTT
taaaataattaaacaggatg

SEQ ID NO: 23339 - DNA, 20 bp, Artificial Sequence
  Description of Artificial Sequence: Synthetic oligonucleotide
  Target: FXN; (-) strand; PAM type: YTN; PAM sequence: TTA
gggtcaatccaggacagtca

SEQ ID NO: 23340 - DNA, 20 bp, Artificial Sequence
  Description of Artificial Sequence: Synthetic oligonucleotide
  Target: FXN; (-) strand; PAM type: YTN; PAM sequence: CTT
agggtcaatccaggacagtc

SEQ ID NO: 23341 - DNA, 20 bp, Artificial Sequence
  Description of Artificial Sequence: Synthetic oligonucleotide
  Target: FXN; (-) strand; PAM type: YTN; PAM sequence: TTG
gagaccagggggagcttagg

SEQ ID NO: 23342 - DNA, 20 bp, Artificial Sequence
  Description of Artificial Sequence: Synthetic oligonucleotide
  Target: FXN; (-) strand; PAM type: YTN; PAM sequence: TTT
ggagaccagggggagcttag

SEQ ID NO: 23343 - DNA, 20 bp, Artificial Sequence
  Description of Artificial Sequence: Synthetic oligonucleotide
  Target: FXN; (-) strand; PAM type: YTN; PAM sequence: TTT
tggagaccagggggagctta

SEQ ID NO: 23344 - DNA, 20 bp, Artificial Sequence
  Description of Artificial Sequence: Synthetic oligonucleotide
  Target: FXN; (-) strand; PAM type: YTN; PAM sequence: CTG
atgaattttggagaccaggg

SEQ ID NO: 23345 - DNA, 20 bp, Artificial Sequence
  Description of Artificial Sequence: Synthetic oligonucleotide
  Target: FXN; (-) strand; PAM type: YTN; PAM sequence: TTC
tgatgaattttggagaccag

SEQ ID NO: 23346 - DNA, 20 bp, Artificial Sequence
  Description of Artificial Sequence: Synthetic oligonucleotide
  Target: FXN; (-) strand; PAM type: YTN; PAM sequence: TTT
ctgatgaattttggagacca

SEQ ID NO: 23347 - DNA, 20 bp, Artificial Sequence
  Description of Artificial Sequence: Synthetic oligonucleotide
  Target: FXN; (-) strand; PAM type: YTN; PAM sequence: CTC
agtttctgatgaattttgga

SEQ ID NO: 23348 - DNA, 20 bp, Artificial Sequence
  Description of Artificial Sequence: Synthetic oligonucleotide
  Target: FXN; (-) strand; PAM type: YTN; PAM sequence: TTC
aagtgaactcagtttctgat

SEQ ID NO: 23349 - DNA, 20 bp, Artificial Sequence
  Description of Artificial Sequence: Synthetic oligonucleotide
  Target: FXN; (-) strand; PAM type: YTN; PAM sequence: CTT
caagtgaactcagtttctga

SEQ ID NO: 23350 - DNA, 20 bp, Artificial Sequence
  Description of Artificial Sequence: Synthetic oligonucleotide
  Target: FXN; (-) strand; PAM type: YTN; PAM sequence: TTA
gaagtagatgcaaggggtgg

SEQ ID NO: 23351 - DNA, 20 bp, Artificial Sequence
  Description of Artificial Sequence: Synthetic oligonucleotide
  Target: FXN; (-) strand; PAM type: YTN; PAM sequence: TTT
agaagtagatgcaaggggtg

SEQ ID NO: 23352 - DNA, 20 bp, Artificial Sequence
  Description of Artificial Sequence: Synthetic oligonucleotide
  Target: FXN; (-) strand; PAM type: YTN; PAM sequence: CTT
tagaagtagatgcaaggggt

SEQ ID NO: 23353 - DNA, 20 bp, Artificial Sequence
  Description of Artificial Sequence: Synthetic oligonucleotide
  Target: FXN; (-) strand; PAM type: YTN; PAM sequence: CTG
ctttagaagtagatgcaagg

SEQ ID NO: 23354 - DNA, 20 bp, Artificial Sequence
  Description of Artificial Sequence: Synthetic oligonucleotide
  Target: FXN; (-) strand; PAM type: YTN; PAM sequence: TTG
aacagctgctttagaagtag

SEQ ID NO: 23355 - DNA, 20 bp, Artificial Sequence
  Description of Artificial Sequence: Synthetic oligonucleotide
  Target: FXN; (-) strand; PAM type: YTN; PAM sequence: CTG
ttgaacagctgctttagaag

SEQ ID NO: 23356 - DNA, 20 bp, Artificial Sequence
  Description of Artificial Sequence: Synthetic oligonucleotide
  Target: FXN; (-) strand; PAM type: YTN; PAM sequence: TTC
tgttgaacagctgctttaga

SEQ ID NO: 23357 - DNA, 20 bp, Artificial Sequence
  Description of Artificial Sequence: Synthetic oligonucleotide
  Target: FXN; (-) strand; PAM type: YTN; PAM sequence: TTT
ctgttgaacagctgctttag

SEQ ID NO: 23358 - DNA, 20 bp, Artificial Sequence
  Description of Artificial Sequence: Synthetic oligonucleotide
  Target: FXN; (-) strand; PAM type: YTN; PAM sequence: CTG
tttctgttgaacagctgctt

SEQ ID NO: 23359 - DNA, 20 bp, Artificial Sequence
  Description of Artificial Sequence: Synthetic oligonucleotide
  Target: FXN; (-) strand; PAM type: YTN; PAM sequence: TTC
tgtttctgttgaacagctgc

SEQ ID NO: 23360 - DNA, 20 bp, Artificial Sequence
  Description of Artificial Sequence: Synthetic oligonucleotide
  Target: FXN; (-) strand; PAM type: YTN; PAM sequence: CTC
ccattctgtttctgttgaac

SEQ ID NO: 23361 - DNA, 20 bp, Artificial Sequence
  Description of Artificial Sequence: Synthetic oligonucleotide
  Target: FXN; (-) strand; PAM type: YTN; PAM sequence: TTA
tgtgtgtggctcccattctg

SEQ ID NO: 23362 - DNA, 20 bp, Artificial Sequence
  Description of Artificial Sequence: Synthetic oligonucleotide
  Target: FXN; (-) strand; PAM type: YTN; PAM sequence: CTA
gaaaatgtagaattatgtgt

SEQ ID NO: 23363 - DNA, 20 bp, Artificial Sequence
  Description of Artificial Sequence: Synthetic oligonucleotide
  Target: FXN; (-) strand; PAM type: YTN; PAM sequence: TTA
actagaaaatgtagaattat

SEQ ID NO: 23364 - DNA, 20 bp, Artificial Sequence
  Description of Artificial Sequence: Synthetic oligonucleotide
  Target: FXN; (-) strand; PAM type: YTN; PAM sequence: TTT
aactagaaaatgtagaatta

SEQ ID NO: 23365 - DNA, 20 bp, Artificial Sequence
  Description of Artificial Sequence: Synthetic oligonucleotide
  Target: FXN; (-) strand; PAM type: YTN; PAM sequence: TTT
taactagaaaatgtagaatt

SEQ ID NO: 23366 - DNA, 20 bp, Artificial Sequence
  Description of Artificial Sequence: Synthetic oligonucleotide
  Target: FXN; (-) strand; PAM type: YTN; PAM sequence: TTT
ttaactagaaaatgtagaat

SEQ ID NO: 23367 - DNA, 20 bp, Artificial Sequence
  Description of Artificial Sequence: Synthetic oligonucleotide
  Target: FXN; (-) strand; PAM type: YTN; PAM sequence: CTT
tttaactagaaaatgtagaa

SEQ ID NO: 23368 - DNA, 20 bp, Artificial Sequence
  Description of Artificial Sequence: Synthetic oligonucleotide
  Target: FXN; (-) strand; PAM type: YTN; PAM sequence: TTC
tttttaactagaaaatgtag

SEQ ID NO: 23369 - DNA, 20 bp, Artificial Sequence
  Description of Artificial Sequence: Synthetic oligonucleotide
  Target: FXN; (-) strand; PAM type: YTN; PAM sequence: TTT
ctttttaactagaaaatgta

SEQ ID NO: 23370 - DNA, 20 bp, Artificial Sequence
  Description of Artificial Sequence: Synthetic oligonucleotide
  Target: FXN; (-) strand; PAM type: YTN; PAM sequence: TTT
tctttttaactagaaaatgt

SEQ ID NO: 23371 - DNA, 20 bp, Artificial Sequence
  Description of Artificial Sequence: Synthetic oligonucleotide
  Target: FXN; (-) strand; PAM type: YTN; PAM sequence: TTT
ttctttttaactagaaaatg

SEQ ID NO: 23372 - DNA, 20 bp, Artificial Sequence
  Description of Artificial Sequence: Synthetic oligonucleotide
  Target: FXN; (-) strand; PAM type: YTN; PAM sequence: TTT
tttctttttaactagaaaat

SEQ ID NO: 23373 - DNA, 20 bp, Artificial Sequence
  Description of Artificial Sequence: Synthetic oligonucleotide
  Target: FXN; (-) strand; PAM type: YTN; PAM sequence: TTT
ttttctttttaactagaaaa

SEQ ID NO: 23374 - DNA, 20 bp, Artificial Sequence
  Description of Artificial Sequence: Synthetic oligonucleotide
  Target: FXN; (-) strand; PAM type: YTN; PAM sequence: TTT
tttttctttttaactagaaa

SEQ ID NO: 23375 - DNA, 20 bp, Artificial Sequence
  Description of Artificial Sequence: Synthetic oligonucleotide
  Target: FXN; (-) strand; PAM type: YTN; PAM sequence: TTT
ttttttctttttaactagaa

SEQ ID NO: 23376 - DNA, 20 bp, Artificial Sequence
  Description of Artificial Sequence: Synthetic oligonucleotide
  Target: FXN; (-) strand; PAM type: YTN; PAM sequence: TTG
aaaatgatttttttttcttt

SEQ ID NO: 23377 - DNA, 20 bp, Artificial Sequence
  Description of Artificial Sequence: Synthetic oligonucleotide
  Target: FXN; (-) strand; PAM type: YTN; PAM sequence: TTG
ttgaaaatgatttttttttc

SEQ ID NO: 23378 - DNA, 20 bp, Artificial Sequence
  Description of Artificial Sequence: Synthetic oligonucleotide
  Target: FXN; (-) strand; PAM type: YTN; PAM sequence: TTG
aataaatatattgttgaaaa

SEQ ID NO: 23379 - DNA, 20 bp, Artificial Sequence
  Description of Artificial Sequence: Synthetic oligonucleotide
  Target: FXN; (-) strand; PAM type: YTN; PAM sequence: CTA
ggttgaataaatatattgtt

SEQ ID NO: 23380 - DNA, 20 bp, Artificial Sequence
  Description of Artificial Sequence: Synthetic oligonucleotide
  Target: FXN; (-) strand; PAM type: YTN; PAM sequence: TTG
tatgtactaggttgaataaa

SEQ ID NO: 23381 - DNA, 20 bp, Artificial Sequence
  Description of Artificial Sequence: Synthetic oligonucleotide
  Target: FXN; (-) strand; PAM type: YTN; PAM sequence: TTT
gtatgtactaggttgaataa

SEQ ID NO: 23382 - DNA, 20 bp, Artificial Sequence
  Description of Artificial Sequence: Synthetic oligonucleotide
  Target: FXN; (-) strand; PAM type: YTN; PAM sequence: TTT
tgtatgtactaggttgaata

SEQ ID NO: 23383 - DNA, 20 bp, Artificial Sequence
  Description of Artificial Sequence: Synthetic oligonucleotide
  Target: FXN; (-) strand; PAM type: YTN; PAM sequence: TTG
gaatgataatattttgtatg

SEQ ID NO: 23384 - DNA, 20 bp, Artificial Sequence
  Description of Artificial Sequence: Synthetic oligonucleotide
  Target: FXN; (-) strand; PAM type: YTN; PAM sequence: TTA
catgttggaatgataatatt

SEQ ID NO: 23385 - DNA, 20 bp, Artificial Sequence
  Description of Artificial Sequence: Synthetic oligonucleotide
  Target: FXN; (-) strand; PAM type: YTN; PAM sequence: CTG
attacatgttggaatgataa

SEQ ID NO: 23386 - DNA, 20 bp, Artificial Sequence
  Description of Artificial Sequence: Synthetic oligonucleotide
  Target: FXN; (-) strand; PAM type: YTN; PAM sequence: TTA
aaatactgattacatgttgg

SEQ ID NO: 23387 - DNA, 20 bp, Artificial Sequence
  Description of Artificial Sequence: Synthetic oligonucleotide
  Target: FXN; (-) strand; PAM type: YTN; PAM sequence: TTT
aaaatactgattacatgttg

SEQ ID NO: 23388 - DNA, 20 bp, Artificial Sequence
  Description of Artificial Sequence: Synthetic oligonucleotide
  Target: FXN; (-) strand; PAM type: YTN; PAM sequence: TTT
taaaatactgattacatgtt

SEQ ID NO: 23389 - DNA, 20 bp, Artificial Sequence
  Description of Artificial Sequence: Synthetic oligonucleotide
  Target: FXN; (-) strand; PAM type: YTN; PAM sequence: TTT
ttaaaatactgattacatgt

SEQ ID NO: 23390 - DNA, 20 bp, Artificial Sequence
  Description of Artificial Sequence: Synthetic oligonucleotide
  Target: FXN; (-) strand; PAM type: YTN; PAM sequence: CTG
atttttaaaatactgattac

SEQ ID NO: 23391 - DNA, 20 bp, Artificial Sequence
  Description of Artificial Sequence: Synthetic oligonucleotide
  Target: FXN; (-) strand; PAM type: YTN; PAM sequence: TTA
ctgatttttaaaatactgat

SEQ ID NO: 23392 - DNA, 20 bp, Artificial Sequence
  Description of Artificial Sequence: Synthetic oligonucleotide
  Target: FXN; (-) strand; PAM type: YTN; PAM sequence: CTC
attactgatttttaaaatac

SEQ ID NO: 23393 - DNA, 20 bp, Artificial Sequence
  Description of Artificial Sequence: Synthetic oligonucleotide
  Target: FXN; (-) strand; PAM type: YTN; PAM sequence: CTG
gtctcattactgatttttaa

SEQ ID NO: 23394 - DNA, 20 bp, Artificial Sequence
  Description of Artificial Sequence: Synthetic oligonucleotide
  Target: FXN; (-) strand; PAM type: YTN; PAM sequence: TTA
cagtcgtgagccaccgtgcc

SEQ ID NO: 23395 - DNA, 20 bp, Artificial Sequence
  Description of Artificial Sequence: Synthetic oligonucleotide
  Target: FXN; (-) strand; PAM type: YTN; PAM sequence: CTG
ggattacagtcgtgagccac

SEQ ID NO: 23396 - DNA, 20 bp, Artificial Sequence
  Description of Artificial Sequence: Synthetic oligonucleotide
  Target: FXN; (-) strand; PAM type: YTN; PAM sequence: CTC
ccaaagtcctgggattacag

SEQ ID NO: 23397 - DNA, 20 bp, Artificial Sequence
  Description of Artificial Sequence: Synthetic oligonucleotide
  Target: FXN; (-) strand; PAM type: YTN; PAM sequence: CTC
ggcctcccaaagtcctggga

SEQ ID NO: 23398 - DNA, 20 bp, Artificial Sequence
  Description of Artificial Sequence: Synthetic oligonucleotide
  Target: FXN; (-) strand; PAM type: YTN; PAM sequence: CTC
gcctcggcctcccaaagtcc

SEQ ID NO: 23399 - DNA, 20 bp, Artificial Sequence
  Description of Artificial Sequence: Synthetic oligonucleotide
  Target: FXN; (-) strand; PAM type: YTN; PAM sequence: CTC
agatgatccactcgcctcgg

SEQ ID NO: 23400 - DNA, 20 bp, Artificial Sequence
  Description of Artificial Sequence: Synthetic oligonucleotide
  Target: FXN; (-) strand; PAM type: YTN; PAM sequence: CTG
atctcagatgatccactcgc

SEQ ID NO: 23401 - DNA, 20 bp, Artificial Sequence
  Description of Artificial Sequence: Synthetic oligonucleotide
  Target: FXN; (-) strand; PAM type: YTN; PAM sequence: CTC
ctgatctcagatgatccact

SEQ ID NO: 23402 - DNA, 20 bp, Artificial Sequence
  Description of Artificial Sequence: Synthetic oligonucleotide
  Target: FXN; (-) strand; PAM type: YTN; PAM sequence: TTG
aactcctgatctcagatgat

SEQ ID NO: 23403 - DNA, 20 bp, Artificial Sequence
  Description of Artificial Sequence: Synthetic oligonucleotide
  Target: FXN; (-) strand; PAM type: YTN; PAM sequence: CTT
gaactcctgatctcagatga

SEQ ID NO: 23404 - DNA, 20 bp, Artificial Sequence
  Description of Artificial Sequence: Synthetic oligonucleotide
  Target: FXN; (-) strand; PAM type: YTN; PAM sequence: CTG
gtcttgaactcctgatctca

SEQ ID NO: 23405 - DNA, 20 bp, Artificial Sequence
  Description of Artificial Sequence: Synthetic oligonucleotide
  Target: FXN; (-) strand; PAM type: YTN; PAM sequence: TTG
gccaggctggtcttgaactc

SEQ ID NO: 23406 - DNA, 20 bp, Artificial Sequence
  Description of Artificial Sequence: Synthetic oligonucleotide
  Target: FXN; (-) strand; PAM type: YTN; PAM sequence: TTC
accatgttggccaggctggt

SEQ ID NO: 23407 - DNA, 20 bp, Artificial Sequence
  Description of Artificial Sequence: Synthetic oligonucleotide
  Target: FXN; (-) strand; PAM type: YTN; PAM sequence: TTT
caccatgttggccaggctgg

SEQ ID NO: 23408 - DNA, 20 bp, Artificial Sequence
  Description of Artificial Sequence: Synthetic oligonucleotide
  Target: FXN; (-) strand; PAM type: YTN; PAM sequence: TTA
gtagagatggggtttcacca

SEQ ID NO: 23409 - DNA, 20 bp, Artificial Sequence
  Description of Artificial Sequence: Synthetic oligonucleotide
  Target: FXN; (-) strand; PAM type: YTN; PAM sequence: TTT
agtagagatggggtttcacc

SEQ ID NO: 23410 - DNA, 20 bp, Artificial Sequence
  Description of Artificial Sequence: Synthetic oligonucleotide
  Target: FXN; (-) strand; PAM type: YTN; PAM sequence: TTT
tagtagagatggggtttcac

SEQ ID NO: 23411 - DNA, 20 bp, Artificial Sequence
  Description of Artificial Sequence: Synthetic oligonucleotide
  Target: FXN; (-) strand; PAM type: YTN; PAM sequence: TTT
ttagtagagatggggtttca

SEQ ID NO: 23412 - DNA, 20 bp, Artificial Sequence
  Description of Artificial Sequence: Synthetic oligonucleotide
  Target: FXN; (-) strand; PAM type: YTN; PAM sequence: CTA
gtttttagtagagatggggt

SEQ ID NO: 23413 - DNA, 20 bp, Artificial Sequence
  Description of Artificial Sequence: Synthetic oligonucleotide
  Target: FXN; (-) strand; PAM type: YTN; PAM sequence: CTG
agctagtttttagtagagat

SEQ ID NO: 23414 - DNA, 20 bp, Artificial Sequence
  Description of Artificial Sequence: Synthetic oligonucleotide
  Target: FXN; (-) strand; PAM type: YTN; PAM sequence: CTA
caggcacccaccaccatgct

SEQ ID NO: 23415 - DNA, 20 bp, Artificial Sequence
  Description of Artificial Sequence: Synthetic oligonucleotide
  Target: FXN; (-) strand; PAM type: YTN; PAM sequence: CTG
ggactacaggcacccaccac

SEQ ID NO: 23416 - DNA, 20 bp, Artificial Sequence
  Description of Artificial Sequence: Synthetic oligonucleotide
  Target: FXN; (-) strand; PAM type: YTN; PAM sequence: CTC
ccgagtagctgggactacag

SEQ ID NO: 23417 - DNA, 20 bp, Artificial Sequence
  Description of Artificial Sequence: Synthetic oligonucleotide
  Target: FXN; (-) strand; PAM type: YTN; PAM sequence: CTC
agcctcccgagtagctggga

SEQ ID NO: 23418 - DNA, 20 bp, Artificial Sequence
  Description of Artificial Sequence: Synthetic oligonucleotide
  Target: FXN; (-) strand; PAM type: YTN; PAM sequence: CTC
atgcctcagcctcccgagta

SEQ ID NO: 23419 - DNA, 20 bp, Artificial Sequence
  Description of Artificial Sequence: Synthetic oligonucleotide
  Target: FXN; (-) strand; PAM type: YTN; PAM sequence: TTC
tcatgcctcagcctcccgag

SEQ ID NO: 23420 - DNA, 20 bp, Artificial Sequence
  Description of Artificial Sequence: Synthetic oligonucleotide
  Target: FXN; (-) strand; PAM type: YTN; PAM sequence: CTC
aagtgattctcatgcctcag

SEQ ID NO: 23421 - DNA, 20 bp, Artificial Sequence
  Description of Artificial Sequence: Synthetic oligonucleotide
  Target: FXN; (-) strand; PAM type: YTN; PAM sequence: CTG
ggctcaagtgattctcatgc

SEQ ID NO: 23422 - DNA, 20 bp, Artificial Sequence
  Description of Artificial Sequence: Synthetic oligonucleotide
  Target: FXN; (-) strand; PAM type: YTN; PAM sequence: CTC
ctgggctcaagtgattctca

SEQ ID NO: 23423 - DNA, 20 bp, Artificial Sequence
  Description of Artificial Sequence: Synthetic oligonucleotide
  Target: FXN; (-) strand; PAM type: YTN; PAM sequence: CTG
cctcctgggctcaagtgatt

SEQ ID NO: 23424 - DNA, 20 bp, Artificial Sequence
  Description of Artificial Sequence: Synthetic oligonucleotide
  Target: FXN; (-) strand; PAM type: YTN; PAM sequence: CTC
tgcctcctgggctcaagtga

SEQ ID NO: 23425 - DNA, 20 bp, Artificial Sequence
  Description of Artificial Sequence: Synthetic oligonucleotide
  Target: FXN; (-) strand; PAM type: YTN; PAM sequence: CTG
caacctctgcctcctgggct

SEQ ID NO: 23426 - DNA, 20 bp, Artificial Sequence
  Description of Artificial Sequence: Synthetic oligonucleotide
  Target: FXN; (-) strand; PAM type: YTN; PAM sequence: CTC
actgcaacctctgcctcctg

SEQ ID NO: 23427 - DNA, 20 bp, Artificial Sequence
  Description of Artificial Sequence: Synthetic oligonucleotide
  Target: FXN; (-) strand; PAM type: YTN; PAM sequence: TTG
gctcactgcaacctctgcct

SEQ ID NO: 23428 - DNA, 20 bp, Artificial Sequence
  Description of Artificial Sequence: Synthetic oligonucleotide
  Target: FXN; (-) strand; PAM type: YTN; PAM sequence: CTT
ggctcactgcaacctctgcc

SEQ ID NO: 23429 - DNA, 20 bp, Artificial Sequence
  Description of Artificial Sequence: Synthetic oligonucleotide
  Target: FXN; (-) strand; PAM type: YTN; PAM sequence: TTG
tatgtcacagaatcccccaa

SEQ ID NO: 23430 - DNA, 20 bp, Artificial Sequence
  Description of Artificial Sequence: Synthetic oligonucleotide
  Target: FXN; (-) strand; PAM type: YTN; PAM sequence: TTT
gtatgtcacagaatccccca

SEQ ID NO: 23431 - DNA, 20 bp, Artificial Sequence
  Description of Artificial Sequence: Synthetic oligonucleotide
  Target: FXN; (-) strand; PAM type: YTN; PAM sequence: TTT
tgtatgtcacagaatccccc

SEQ ID NO: 23432 - DNA, 20 bp, Artificial Sequence
  Description of Artificial Sequence: Synthetic oligonucleotide
  Target: FXN; (-) strand; PAM type: YTN; PAM sequence: TTT
ttgtatgtcacagaatcccc

SEQ ID NO: 23433 - DNA, 20 bp, Artificial Sequence
  Description of Artificial Sequence: Synthetic oligonucleotide
  Target: FXN; (-) strand; PAM type: YTN; PAM sequence: TTT
tttgtatgtcacagaatccc

SEQ ID NO: 23434 - DNA, 20 bp, Artificial Sequence
  Description of Artificial Sequence: Synthetic oligonucleotide
  Target: FXN; (-) strand; PAM type: YTN; PAM sequence: TTT
ttttgtatgtcacagaatcc

SEQ ID NO: 23435 - DNA, 20 bp, Artificial Sequence
  Description of Artificial Sequence: Synthetic oligonucleotide
  Target: FXN; (-) strand; PAM type: YTN; PAM sequence: TTT
tttttgtatgtcacagaatc

SEQ ID NO: 23436 - DNA, 20 bp, Artificial Sequence
  Description of Artificial Sequence: Synthetic oligonucleotide
  Target: FXN; (-) strand; PAM type: YTN; PAM sequence: CTG
attttttttgtatgtcacag

SEQ ID NO: 23437 - DNA, 20 bp, Artificial Sequence
  Description of Artificial Sequence: Synthetic oligonucleotide
  Target: FXN; (-) strand; PAM type: YTN; PAM sequence: TTA
ctgattttttttgtatgtca

SEQ ID NO: 23438 - DNA, 20 bp, Artificial Sequence
  Description of Artificial Sequence: Synthetic oligonucleotide
  Target: FXN; (-) strand; PAM type: YTN; PAM sequence: TTA
ttactgattttttttgtatg

SEQ ID NO: 23439 - DNA, 20 bp, Artificial Sequence
  Description of Artificial Sequence: Synthetic oligonucleotide
  Target: FXN; (-) strand; PAM type: YTN; PAM sequence: CTT
attactgattttttttgtat

SEQ ID NO: 23440 - DNA, 20 bp, Artificial Sequence
  Description of Artificial Sequence: Synthetic oligonucleotide
  Target: FXN; (-) strand; PAM type: YTN; PAM sequence: CTG
gaagtatatgagtacgaaaa

SEQ ID NO: 23441 - DNA, 20 bp, Artificial Sequence
  Description of Artificial Sequence: Synthetic oligonucleotide
  Target: FXN; (-) strand; PAM type: YTN; PAM sequence: TTG
agatatgctggaagtatatg

SEQ ID NO: 23442 - DNA, 20 bp, Artificial Sequence
  Description of Artificial Sequence: Synthetic oligonucleotide
  Target: FXN; (-) strand; PAM type: YTN; PAM sequence: TTG
tgaattgagatatgctggaa

SEQ ID NO: 23443 - DNA, 20 bp, Artificial Sequence
  Description of Artificial Sequence: Synthetic oligonucleotide
  Target: FXN; (-) strand; PAM type: YTN; PAM sequence: TTA
gaaattgtgaattgagatat

SEQ ID NO: 23444 - DNA, 20 bp, Artificial Sequence
  Description of Artificial Sequence: Synthetic oligonucleotide
  Target: FXN; (-) strand; PAM type: YTN; PAM sequence: CTT
agaaattgtgaattgagata

SEQ ID NO: 23445 - DNA, 20 bp, Artificial Sequence
  Description of Artificial Sequence: Synthetic oligonucleotide
  Target: FXN; (-) strand; PAM type: YTN; PAM sequence: TTA
cttagaaattgtgaattgag

SEQ ID NO: 23446 - DNA, 20 bp, Artificial Sequence
  Description of Artificial Sequence: Synthetic oligonucleotide
  Target: FXN; (-) strand; PAM type: YTN; PAM sequence: TTT
acttagaaattgtgaattga

SEQ ID NO: 23447 - DNA, 20 bp, Artificial Sequence
  Description of Artificial Sequence: Synthetic oligonucleotide
  Target: FXN; (-) strand; PAM type: YTN; PAM sequence: TTA
taaaagtaaatacagataga

SEQ ID NO: 23448 - DNA, 20 bp, Artificial Sequence
  Description of Artificial Sequence: Synthetic oligonucleotide
  Target: FXN; (-) strand; PAM type: YTN; PAM sequence: TTT
ataaaagtaaatacagatag

SEQ ID NO: 23449 - DNA, 20 bp, Artificial Sequence
  Description of Artificial Sequence: Synthetic oligonucleotide
  Target: FXN; (-) strand; PAM type: YTN; PAM sequence: TTT
tataaaagtaaatacagata

SEQ ID NO: 23450 - DNA, 20 bp, Artificial Sequence
  Description of Artificial Sequence: Synthetic oligonucleotide
  Target: FXN; (-) strand; PAM type: YTN; PAM sequence: TTG
tgaattttataaaagtaaat

SEQ ID NO: 23451 - DNA, 20 bp, Artificial Sequence
  Description of Artificial Sequence: Synthetic oligonucleotide
  Target: FXN; (-) strand; PAM type: YTN; PAM sequence: TTA
attgtgaattttataaaagt

SEQ ID NO: 23452 - DNA, 20 bp, Artificial Sequence
  Description of Artificial Sequence: Synthetic oligonucleotide
  Target: FXN; (-) strand; PAM type: YTN; PAM sequence: TTT
aattgtgaattttataaaag

SEQ ID NO: 23453 - DNA, 20 bp, Artificial Sequence
  Description of Artificial Sequence: Synthetic oligonucleotide
  Target: FXN; (-) strand; PAM type: YTN; PAM sequence: TTT
taattgtgaattttataaaa

SEQ ID NO: 23454 - DNA, 20 bp, Artificial Sequence
  Description of Artificial Sequence: Synthetic oligonucleotide
  Target: FXN; (-) strand; PAM type: YTN; PAM sequence: TTT
ttaattgtgaattttataaa

SEQ ID NO: 23455 - DNA, 20 bp, Artificial Sequence
  Description of Artificial Sequence: Synthetic oligonucleotide
  Target: FXN; (-) strand; PAM type: YTN; PAM sequence: TTC
atttttaattgtgaatttta

SEQ ID NO: 23456 - DNA, 20 bp, Artificial Sequence
  Description of Artificial Sequence: Synthetic oligonucleotide
  Target: FXN; (-) strand; PAM type: YTN; PAM sequence: CTT
catttttaattgtgaatttt

SEQ ID NO: 23457 - DNA, 20 bp, Artificial Sequence
  Description of Artificial Sequence: Synthetic oligonucleotide
  Target: FXN; (-) strand; PAM type: YTN; PAM sequence: CTA
tgtgaaccttcatttttaat

SEQ ID NO: 23458 - DNA, 20 bp, Artificial Sequence
  Description of Artificial Sequence: Synthetic oligonucleotide
  Target: FXN; (-) strand; PAM type: YTN; PAM sequence: TTG
actatgtgaaccttcatttt

SEQ ID NO: 23459 - DNA, 20 bp, Artificial Sequence
  Description of Artificial Sequence: Synthetic oligonucleotide
  Target: FXN; (-) strand; PAM type: YTN; PAM sequence: CTT
gactatgtgaaccttcattt

SEQ ID NO: 23460 - DNA, 20 bp, Artificial Sequence
  Description of Artificial Sequence: Synthetic oligonucleotide
  Target: FXN; (-) strand; PAM type: YTN; PAM sequence: TTG
gaacaacttgactatgtgaa

SEQ ID NO: 23461 - DNA, 20 bp, Artificial Sequence
  Description of Artificial Sequence: Synthetic oligonucleotide
  Target: FXN; (-) strand; PAM type: YTN; PAM sequence: TTT
ggaacaacttgactatgtga

SEQ ID NO: 23462 - DNA, 20 bp, Artificial Sequence
  Description of Artificial Sequence: Synthetic oligonucleotide
  Target: FXN; (-) strand; PAM type: YTN; PAM sequence: TTA
agtgtgtttggaacaacttg

SEQ ID NO: 23463 - DNA, 20 bp, Artificial Sequence
  Description of Artificial Sequence: Synthetic oligonucleotide
  Target: FXN; (-) strand; PAM type: YTN; PAM sequence: TTT
aagtgtgtttggaacaactt

SEQ ID NO: 23464 - DNA, 20 bp, Artificial Sequence
  Description of Artificial Sequence: Synthetic oligonucleotide
  Target: FXN; (-) strand; PAM type: YTN; PAM sequence: CTA
ggagacatttaagtgtgttt

SEQ ID NO: 23465 - DNA, 20 bp, Artificial Sequence
  Description of Artificial Sequence: Synthetic oligonucleotide
  Target: FXN; (-) strand; PAM type: YTN; PAM sequence: TTA
caggtgtgagcaaccacacc

SEQ ID NO: 23466 - DNA, 20 bp, Artificial Sequence
  Description of Artificial Sequence: Synthetic oligonucleotide
  Target: FXN; (-) strand; PAM type: YTN; PAM sequence: CTG
ggattacaggtgtgagcaac

SEQ ID NO: 23467 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattacag

SEQ ID NO: 23468 - DNA, 20 bp, Artificial Sequence
  Description of Artificial Sequence: Synthetic oligonucleotide
  Target: FXN; (-) strand; PAM type: YTN; PAM sequence: CTC
agcctcccaaagtgctggga

SEQ ID NO: 23469 - DNA, 20 bp, Artificial Sequence
  Description of Artificial Sequence: Synthetic oligonucleotide
  Target: FXN; (-) strand; PAM type: YTN; PAM sequence: CTC
aggtgatccgcccatctcag

SEQ ID NO: 23470 - DNA, 20 bp, Artificial Sequence
  Description of Artificial Sequence: Synthetic oligonucleotide
  Target: FXN; (-) strand; PAM type: YTN; PAM sequence: CTG
acctcaggtgatccgcccat

SEQ ID NO: 23471 - DNA, 20 bp, Artificial Sequence
  Description of Artificial Sequence: Synthetic oligonucleotide
  Target: FXN; (-) strand; PAM type: YTN; PAM sequence: CTC
ctgacctcaggtgatccgcc

SEQ ID NO: 23472 - DNA, 20 bp, Artificial Sequence
  Description of Artificial Sequence: Synthetic oligonucleotide
  Target: FXN; (-) strand; PAM type: YTN; PAM sequence: CTC
aaactcctgacctcaggtga

SEQ ID NO: 23473 - DNA, 20 bp, Artificial Sequence
  Description of Artificial Sequence: Synthetic oligonucleotide
  Target: FXN; (-) strand; PAM type: YTN; PAM sequence: CTG
gtctcaaactcctgacctca

SEQ ID NO: 23474 - DNA, 20 bp, Artificial Sequence
  Description of Artificial Sequence: Synthetic oligonucleotide
  Target: FXN; (-) strand; PAM type: YTN; PAM sequence: TTG
gccaggctggtctcaaactc

SEQ ID NO: 23475 - DNA, 20 bp, Artificial Sequence
  Description of Artificial Sequence: Synthetic oligonucleotide
  Target: FXN; (-) strand; PAM type: YTN; PAM sequence: TTC
accatgttggccaggctggt

SEQ ID NO: 23476 - DNA, 20 bp, Artificial Sequence
  Description of Artificial Sequence: Synthetic oligonucleotide
  Target: FXN; (-) strand; PAM type: YTN; PAM sequence: TTT
caccatgttggccaggctgg

SEQ ID NO: 23477 - DNA, 20 bp, Artificial Sequence
  Description of Artificial Sequence: Synthetic oligonucleotide
  Target: FXN; (-) strand; PAM type: YTN; PAM sequence: TTA
gtagagacggggtttcacca

SEQ ID NO: 23478 - DNA, 20 bp, Artificial Sequence
  Description of Artificial Sequence: Synthetic oligonucleotide
  Target: FXN; (-) strand; PAM type: YTN; PAM sequence: TTT
agtagagacggggtttcacc

SEQ ID NO: 23479 - DNA, 20 bp, Artificial Sequence
  Description of Artificial Sequence: Synthetic oligonucleotide
  Target: FXN; (-) strand; PAM type: YTN; PAM sequence: TTT
tagtagagacggggtttcac

SEQ ID NO: 23480 - DNA, 20 bp, Artificial Sequence
  Description of Artificial Sequence: Synthetic oligonucleotide
  Target: FXN; (-) strand; PAM type: YTN; PAM sequence: TTT
ttagtagagacggggtttca

SEQ ID NO: 23481 - DNA, 20 bp, Artificial Sequence
  Description of Artificial Sequence: Synthetic oligonucleotide
  Target: FXN; (-) strand; PAM type: YTN; PAM sequence: TTG
tatttttagtagagacgggg

SEQ ID NO: 23482 - DNA, 20 bp, Artificial Sequence
  Description of Artificial Sequence: Synthetic oligonucleotide
  Target: FXN; (-) strand; PAM type: YTN; PAM sequence: TTT
gtatttttagtagagacggg

SEQ ID NO: 23483 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagagacgg

SEQ ID NO: 23484 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagagacg

SEQ ID NO: 23485 - DNA, 20 bp, Artificial Sequence
  Description of Artificial Sequence: Synthetic oligonucleotide
  Target: FXN; (-) strand; PAM type: YTN; PAM sequence: CTA
atttttgtatttttagtaga

SEQ ID NO: 23486 - DNA, 20 bp, Artificial Sequence
  Description of Artificial Sequence: Synthetic oligonucleotide
  Target: FXN; (-) strand; PAM type: YTN; PAM sequence: TTA
caggtgagtgccaccacatc

SEQ ID NO: 23487 - DNA, 20 bp, Artificial Sequence
  Description of Artificial Sequence: Synthetic oligonucleotide
  Target: FXN; (-) strand; PAM type: YTN; PAM sequence: CTG
ggattacaggtgagtgccac

SEQ ID NO: 23488 - DNA, 20 bp, Artificial Sequence
  Description of Artificial Sequence: Synthetic oligonucleotide
  Target: FXN; (-) strand; PAM type: YTN; PAM sequence: CTG
agtagctgggattacaggtg

SEQ ID NO: 23489 - DNA, 20 bp, Artificial Sequence
  Description of Artificial Sequence: Synthetic oligonucleotide
  Target: FXN; (-) strand; PAM type: YTN; PAM sequence: CTC
ctgagtagctgggattacag

SEQ ID NO: 23490 - DNA, 20 bp, Artificial Sequence
  Description of Artificial Sequence: Synthetic oligonucleotide
  Target: FXN; (-) strand; PAM type: YTN; PAM sequence: CTC
agcctcctgagtagctggga

SEQ ID NO: 23491 - DNA, 20 bp, Artificial Sequence
  Description of Artificial Sequence: Synthetic oligonucleotide
  Target: FXN; (-) strand; PAM type: YTN; PAM sequence: CTG
cctcagcctcctgagtagct

SEQ ID NO: 23492 - DNA, 20 bp, Artificial Sequence
  Description of Artificial Sequence: Synthetic oligonucleotide
  Target: FXN; (-) strand; PAM type: YTN; PAM sequence: TTA
tcctgcctcagcctcctgag

SEQ ID NO: 23493 - DNA, 20 bp, Artificial Sequence
  Description of Artificial Sequence: Synthetic oligonucleotide
  Target: FXN; (-) strand; PAM type: YTN; PAM sequence: TTC
aagcaattatcctgcctcag

SEQ ID NO: 23494 - DNA, 20 bp, Artificial Sequence
  Description of Artificial Sequence: Synthetic oligonucleotide
  Target: FXN; (-) strand; PAM type: YTN; PAM sequence: CTC
ccgggttcaagcaattatcc

SEQ ID NO: 23495 - DNA, 20 bp, Artificial Sequence
  Description of Artificial Sequence: Synthetic oligonucleotide
  Target: FXN; (-) strand; PAM type: YTN; PAM sequence: CTC
caccacctcccgggttcaag

SEQ ID NO: 23496 - DNA, 20 bp, Artificial Sequence
  Description of Artificial Sequence: Synthetic oligonucleotide
  Target: FXN; (-) strand; PAM type: YTN; PAM sequence: CTG
caacctccaccacctcccgg

SEQ ID NO: 23497 - DNA, 20 bp, Artificial Sequence
  Description of Artificial Sequence: Synthetic oligonucleotide
  Target: FXN; (-) strand; PAM type: YTN; PAM sequence: CTC
actgcaacctccaccacctc

SEQ ID NO: 23498 - DNA, 20 bp, Artificial Sequence
  Description of Artificial Sequence: Synthetic oligonucleotide
  Target: FXN; (-) strand; PAM type: YTN; PAM sequence: CTC
ggctcactgcaacctccacc

SEQ ID NO: 23499 - DNA, 20 bp, Artificial Sequence
  Description of Artificial Sequence: Synthetic oligonucleotide
  Target: FXN; (-) strand; PAM type: YTN; PAM sequence: TTG
gaaggcagtggtgcgatctc

SEQ ID NO: 23500 - DNA, 20 bp, Artificial Sequence
  Description of Artificial Sequence: Synthetic oligonucleotide
  Target: FXN; (-) strand; PAM type: YTN; PAM sequence: CTG
tcgcccaggttggaaggcag

SEQ ID NO: 23501 - DNA, 20 bp, Artificial Sequence
  Description of Artificial Sequence: Synthetic oligonucleotide
  Target: FXN; (-) strand; PAM type: YTN; PAM sequence: CTC
tgtcgcccaggttggaaggc

SEQ ID NO: 23502 - DNA, 20 bp, Artificial Sequence
  Description of Artificial Sequence: Synthetic oligonucleotide
  Target: FXN; (-) strand; PAM type: YTN; PAM sequence: CTC
gctctgtcgcccaggttgga

SEQ ID NO: 23503 - DNA, 20 bp, Artificial Sequence
  Description of Artificial Sequence: Synthetic oligonucleotide
  Target: FXN; (-) strand; PAM type: YTN; PAM sequence: TTG
agacggagtctcgctctgtc

SEQ ID NO: 23504 - DNA, 20 bp, Artificial Sequence
  Description of Artificial Sequence: Synthetic oligonucleotide
  Target: FXN; (-) strand; PAM type: YTN; PAM sequence: TTT
gagacggagtctcgctctgt

SEQ ID NO: 23505 - DNA, 20 bp, Artificial Sequence
  Description of Artificial Sequence: Synthetic oligonucleotide
  Target: FXN; (-) strand; PAM type: YTN; PAM sequence: TTT
tgagacggagtctcgctctg

SEQ ID NO: 23506 - DNA, 20 bp, Artificial Sequence
  Description of Artificial Sequence: Synthetic oligonucleotide
  Target: FXN; (-) strand; PAM type: YTN; PAM sequence: TTT
ttgagacggagtctcgctct

SEQ ID NO: 23507 - DNA, 20 bp, Artificial Sequence
  Description of Artificial Sequence: Synthetic oligonucleotide
  Target: FXN; (-) strand; PAM type: YTN; PAM sequence: TTT
tttgagacggagtctcgctc

SEQ ID NO: 23508 - DNA, 20 bp, Artificial Sequence
  Description of Artificial Sequence: Synthetic oligonucleotide
  Target: FXN; (-) strand; PAM type: YTN; PAM sequence: TTT
ttttgagacggagtctcgct

SEQ ID NO: 23509 - DNA, 20 bp, Artificial Sequence
  Description of Artificial Sequence: Synthetic oligonucleotide
  Target: FXN; (-) strand; PAM type: YTN; PAM sequence: TTT
tttttgagacggagtctcgc

SEQ ID NO: 23510 - DNA, 20 bp, Artificial Sequence
  Description of Artificial Sequence: Synthetic oligonucleotide
  Target: FXN; (-) strand; PAM type: YTN; PAM sequence: TTT
ttttttgagacggagtctcg

SEQ ID NO: 23511 - DNA, 20 bp, Artificial Sequence
  Description of Artificial Sequence: Synthetic oligonucleotide
  Target: FXN; (-) strand; PAM type: YTN; PAM sequence: TTT
tttttttgagacggagtctc

SEQ ID NO: 23512 - DNA, 20 bp, Artificial Sequence
  Description of Artificial Sequence: Synthetic oligonucleotide
  Target: FXN; (-) strand; PAM type: YTN; PAM sequence: TTT
ttttttttgagacggagtct

SEQ ID NO: 23513 - DNA, 20 bp, Artificial Sequence
  Description of Artificial Sequence: Synthetic oligonucleotide
  Target: FXN; (-) strand; PAM type: YTN; PAM sequence: TTT
tttttttttgagacggagtc

SEQ ID NO: 23514 - DNA, 20 bp, Artificial Sequence
  Description of Artificial Sequence: Synthetic oligonucleotide
  Target: FXN; (-) strand; PAM type: YTN; PAM sequence: TTT
ttttttttttgagacggagt

SEQ ID NO: 23515 - DNA, 20 bp, Artificial Sequence
  Description of Artificial Sequence: Synthetic oligonucleotide
  Target: FXN; (-) strand; PAM type: YTN; PAM sequence: TTT
tttttttttttgagacggag

SEQ ID NO: 23516 - DNA, 20 bp, Artificial Sequence
  Description of Artificial Sequence: Synthetic oligonucleotide
  Target: FXN; (-) strand; PAM type: YTN; PAM sequence: CTT
ttttttttttttgagacgga

SEQ ID NO: 23517 - DNA, 20 bp, Artificial Sequence
  Description of Artificial Sequence: Synthetic oligonucleotide
  Target: FXN; (-) strand; PAM type: YTN; PAM sequence: TTA
ggagcctttttttttttttt

SEQ ID NO: 23518 - DNA, 20 bp, Artificial Sequence
  Description of Artificial Sequence: Synthetic oligonucleotide
  Target: FXN; (-) strand; PAM type: YTN; PAM sequence: TTA
ttaggagccttttttttttt

SEQ ID NO: 23519 - DNA, 20 bp, Artificial Sequence
  Description of Artificial Sequence: Synthetic oligonucleotide
  Target: FXN; (-) strand; PAM type: YTN; PAM sequence: TTG
aggtgataataaagtaataa

SEQ ID NO: 23520 - DNA, 20 bp, Artificial Sequence
  Description of Artificial Sequence: Synthetic oligonucleotide
  Target: FXN; (-) strand; PAM type: YTN; PAM sequence: TTT
gaggtgataataaagtaata

SEQ ID NO: 23521 - DNA, 20 bp, Artificial Sequence
  Description of Artificial Sequence: Synthetic oligonucleotide
  Target: FXN; (-) strand; PAM type: YTN; PAM sequence: TTA
tttgaggtgataataaagta

SEQ ID NO: 23522 - DNA, 20 bp, Artificial Sequence
  Description of Artificial Sequence: Synthetic oligonucleotide
  Target: FXN; (-) strand; PAM type: YTN; PAM sequence: TTA
attatttgaggtgataataa

SEQ ID NO: 23523 - DNA, 20 bp, Artificial Sequence
  Description of Artificial Sequence: Synthetic oligonucleotide
  Target: FXN; (-) strand; PAM type: YTN; PAM sequence: TTT
aattatttgaggtgataata

SEQ ID NO: 23524 - DNA, 20 bp, Artificial Sequence
  Description of Artificial Sequence: Synthetic oligonucleotide
  Target: FXN; (-) strand; PAM type: YTN; PAM sequence: TTT
taattatttgaggtgataat

SEQ ID NO: 23525 - DNA, 20 bp, Artificial Sequence
  Description of Artificial Sequence: Synthetic oligonucleotide
  Target: FXN; (-) strand; PAM type: YTN; PAM sequence: TTA
attttaattatttgaggtga

SEQ ID NO: 23526 - DNA, 20 bp, Artificial Sequence
  Description of Artificial Sequence: Synthetic oligonucleotide
  Target: FXN; (-) strand; PAM type: YTN; PAM sequence: TTT
aattttaattatttgaggtg

SEQ ID NO: 23527 - DNA, 20 bp, Artificial Sequence
  Description of Artificial Sequence: Synthetic oligonucleotide
  Target: FXN; (-) strand; PAM type: YTN; PAM sequence: TTC
atttaattttaattatttga

SEQ ID NO: 23528 - DNA, 20 bp, Artificial Sequence
  Description of Artificial Sequence: Synthetic oligonucleotide
  Target: FXN; (-) strand; PAM type: YTN; PAM sequence: CTT
catttaattttaattatttg

SEQ ID NO: 23529 - DNA, 20 bp, Artificial Sequence
  Description of Artificial Sequence: Synthetic oligonucleotide
  Target: FXN; (-) strand; PAM type: YTN; PAM sequence: TTC
aacttcatttaattttaatt

SEQ ID NO: 23530 - DNA, 20 bp, Artificial Sequence
  Description of Artificial Sequence: Synthetic oligonucleotide
  Target: FXN; (-) strand; PAM type: YTN; PAM sequence: TTT
caacttcatttaattttaat

SEQ ID NO: 23531 - DNA, 20 bp, Artificial Sequence
  Description of Artificial Sequence: Synthetic oligonucleotide
  Target: FXN; (-) strand; PAM type: YTN; PAM sequence: TTT
tcaacttcatttaattttaa

SEQ ID NO: 23532 - DNA, 20 bp, Artificial Sequence
  Description of Artificial Sequence: Synthetic oligonucleotide
  Target: FXN; (-) strand; PAM type: YTN; PAM sequence: CTG
gattttcaacttcatttaat

SEQ ID NO: 23533 - DNA, 20 bp, Artificial Sequence
  Description of Artificial Sequence: Synthetic oligonucleotide
  Target: FXN; (-) strand; PAM type: YTN; PAM sequence: CTG
aggacctggattttcaactt

SEQ ID NO: 23534 - DNA, 20 bp, Artificial Sequence
  Description of Artificial Sequence: Synthetic oligonucleotide
  Target: FXN; (-) strand; PAM type: YTN; PAM sequence: CTA
atgggactgaggacctggat

SEQ ID NO: 23535 - DNA, 20 bp, Artificial Sequence
  Description of Artificial Sequence: Synthetic oligonucleotide
  Target: FXN; (-) strand; PAM type: YTN; PAM sequence: CTA
gaaatgtggctaatgggact

SEQ ID NO: 23536 - DNA, 20 bp, Artificial Sequence
  Description of Artificial Sequence: Synthetic oligonucleotide
  Target: FXN; (-) strand; PAM type: YTN; PAM sequence: CTG
agcactagaaatgtggctaa

SEQ ID NO: 23537 - DNA, 20 bp, Artificial Sequence
  Description of Artificial Sequence: Synthetic oligonucleotide
  Target: FXN; (-) strand; PAM type: YTN; PAM sequence: CTA
ctgagcactagaaatgtggc

SEQ ID NO: 23538 - DNA, 20 bp, Artificial Sequence
  Description of Artificial Sequence: Synthetic oligonucleotide
  Target: FXN; (-) strand; PAM type: YTN; PAM sequence: CTG
tcccatgtggtggtcaccag

SEQ ID NO: 23539 - DNA, 20 bp, Artificial Sequence
  Description of Artificial Sequence: Synthetic oligonucleotide
  Target: FXN; (-) strand; PAM type: YTN; PAM sequence: CTA
aatatgctgtcccatgtggt

SEQ ID NO: 23540 - DNA, 20 bp, Artificial Sequence
  Description of Artificial Sequence: Synthetic oligonucleotide
  Target: FXN; (-) strand; PAM type: YTN; PAM sequence: CTG
agaaccaatgatcaggtact

SEQ ID NO: 23541 - DNA, 20 bp, Artificial Sequence
  Description of Artificial Sequence: Synthetic oligonucleotide
  Target: FXN; (-) strand; PAM type: YTN; PAM sequence: CTG
agtagccagatctgagaacc

SEQ ID NO: 23542 - DNA, 20 bp, Artificial Sequence
  Description of Artificial Sequence: Synthetic oligonucleotide
  Target: FXN; (-) strand; PAM type: YTN; PAM sequence: CTG
ctgagtagccagatctgaga

SEQ ID NO: 23543 - DNA, 20 bp, Artificial Sequence
  Description of Artificial Sequence: Synthetic oligonucleotide
  Target: FXN; (-) strand; PAM type: YTN; PAM sequence: TTC
tgctgagtagccagatctga

SEQ ID NO: 23544 - DNA, 20 bp, Artificial Sequence
  Description of Artificial Sequence: Synthetic oligonucleotide
  Target: FXN; (-) strand; PAM type: YTN; PAM sequence: TTG
gttctgctgagtagccagat

SEQ ID NO: 23545 - DNA, 20 bp, Artificial Sequence
  Description of Artificial Sequence: Synthetic oligonucleotide
  Target: FXN; (-) strand; PAM type: YTN; PAM sequence: CTT
ggttctgctgagtagccaga

SEQ ID NO: 23546 - DNA, 20 bp, Artificial Sequence
  Description of Artificial Sequence: Synthetic oligonucleotide
  Target: FXN; (-) strand; PAM type: YTN; PAM sequence: TTC
ttggttctgctgagtagcca

SEQ ID NO: 23547 - DNA, 20 bp, Artificial Sequence
  Description of Artificial Sequence: Synthetic oligonucleotide
  Target: FXN; (-) strand; PAM type: YTN; PAM sequence: CTG
tggattcttggttctgctga

SEQ ID NO: 23548 - DNA, 20 bp, Artificial Sequence
  Description of Artificial Sequence: Synthetic oligonucleotide
  Target: FXN; (-) strand; PAM type: YTN; PAM sequence: TTC
tgtggattcttggttctgct

SEQ ID NO: 23549 - DNA, 20 bp, Artificial Sequence
  Description of Artificial Sequence: Synthetic oligonucleotide
  Target: FXN; (-) strand; PAM type: YTN; PAM sequence: TTT
ctgtggattcttggttctgc

SEQ ID NO: 23550 - DNA, 20 bp, Artificial Sequence
  Description of Artificial Sequence: Synthetic oligonucleotide
  Target: FXN; (-) strand; PAM type: YTN; PAM sequence: TTA
aaagccgtttctgtggattc

SEQ ID NO: 23551 - DNA, 20 bp, Artificial Sequence
  Description of Artificial Sequence: Synthetic oligonucleotide
  Target: FXN; (-) strand; PAM type: YTN; PAM sequence: TTT
aaaagccgtttctgtggatt

SEQ ID NO: 23552 - DNA, 20 bp, Artificial Sequence
  Description of Artificial Sequence: Synthetic oligonucleotide
  Target: FXN; (-) strand; PAM type: YTN; PAM sequence: TTT
taaaagccgtttctgtggat

SEQ ID NO: 23553 - DNA, 20 bp, Artificial Sequence
  Description of Artificial Sequence: Synthetic oligonucleotide
  Target: FXN; (-) strand; PAM type: YTN; PAM sequence: CTT
ttaaaagccgtttctgtgga

SEQ ID NO: 23554 - DNA, 20 bp, Artificial Sequence
  Description of Artificial Sequence: Synthetic oligonucleotide
  Target: FXN; (-) strand; PAM type: YTN; PAM sequence: CTG
tgcttttaaaagccgtttct

SEQ ID NO: 23555 - DNA, 20 bp, Artificial Sequence
  Description of Artificial Sequence: Synthetic oligonucleotide
  Target: FXN; (-) strand; PAM type: YTN; PAM sequence: CTG
tggggctgtgcttttaaaag

SEQ ID NO: 23556 - DNA, 20 bp, Artificial Sequence
  Description of Artificial Sequence: Synthetic oligonucleotide
  Target: FXN; (-) strand; PAM type: YTN; PAM sequence: CTG
ggggctgtggggctgtgctt

SEQ ID NO: 23557 - DNA, 20 bp, Artificial Sequence
  Description of Artificial Sequence: Synthetic oligonucleotide
  Target: FXN; (-) strand; PAM type: YTN; PAM sequence: CTG
gggctgggggctgtggggct

SEQ ID NO: 23558 - DNA, 20 bp, Artificial Sequence
  Description of Artificial Sequence: Synthetic oligonucleotide
  Target: FXN; (-) strand; PAM type: YTN; PAM sequence: CTC
caggtaggtaaggctggggc

SEQ ID NO: 23559 - DNA, 20 bp, Artificial Sequence
  Description of Artificial Sequence: Synthetic oligonucleotide
  Target: FXN; (-) strand; PAM type: YTN; PAM sequence: TTC
ccagcctccaggtaggtaag

SEQ ID NO: 23560 - DNA, 20 bp, Artificial Sequence
  Description of Artificial Sequence: Synthetic oligonucleotide
  Target: FXN; (-) strand; PAM type: YTN; PAM sequence: CTT
cccagcctccaggtaggtaa

SEQ ID NO: 23561 - DNA, 20 bp, Artificial Sequence
  Description of Artificial Sequence: Synthetic oligonucleotide
  Target: FXN; (-) strand; PAM type: YTN; PAM sequence: CTC
gtggaatcagagtccttccc

SEQ ID NO: 23562 - DNA, 20 bp, Artificial Sequence
  Description of Artificial Sequence: Synthetic oligonucleotide
  Target: FXN; (-) strand; PAM type: YTN; PAM sequence: CTG
cctcgtggaatcagagtcct

SEQ ID NO: 23563 - DNA, 20 bp, Artificial Sequence
  Description of Artificial Sequence: Synthetic oligonucleotide
  Target: FXN; (-) strand; PAM type: YTN; PAM sequence: CTC
catcaaaaaacataggctgc

SEQ ID NO: 23564 - DNA, 20 bp, Artificial Sequence
  Description of Artificial Sequence: Synthetic oligonucleotide
  Target: FXN; (-) strand; PAM type: YTN; PAM sequence: CTG
tcacatccctccatcaaaaa

SEQ ID NO: 23565 - DNA, 20 bp, Artificial Sequence
  Description of Artificial Sequence: Synthetic oligonucleotide
  Target: FXN; (-) strand; PAM type: YTN; PAM sequence: TTA
aagatgcagcccctgtcaca

SEQ ID NO: 23566 - DNA, 20 bp, Artificial Sequence
  Description of Artificial Sequence: Synthetic oligonucleotide
  Target: FXN; (-) strand; PAM type: YTN; PAM sequence: TTA
agaggaaacgttaaagatgc

SEQ ID NO: 23567 - DNA, 20 bp, Artificial Sequence
  Description of Artificial Sequence: Synthetic oligonucleotide
  Target: FXN; (-) strand; PAM type: YTN; PAM sequence: TTT
aagaggaaacgttaaagatg

SEQ ID NO: 23568 - DNA, 20 bp, Artificial Sequence
  Description of Artificial Sequence: Synthetic oligonucleotide
  Target: FXN; (-) strand; PAM type: YTN; PAM sequence: CTC
cagtatttaagaggaaacgt

SEQ ID NO: 23569 - DNA, 20 bp, Artificial Sequence
  Description of Artificial Sequence: Synthetic oligonucleotide
  Target: FXN; (-) strand; PAM type: YTN; PAM sequence: CTG
tctccagtatttaagaggaa

SEQ ID NO: 23570 - DNA, 20 bp, Artificial Sequence
  Description of Artificial Sequence: Synthetic oligonucleotide
  Target: FXN; (-) strand; PAM type: YTN; PAM sequence: CTC
gaagctgtctccagtattta

SEQ ID NO: 23571 - DNA, 20 bp, Artificial Sequence
  Description of Artificial Sequence: Synthetic oligonucleotide
  Target: FXN; (-) strand; PAM type: YTN; PAM sequence: CTC
ctcgaagctgtctccagtat

SEQ ID NO: 23572 - DNA, 20 bp, Artificial Sequence
  Description of Artificial Sequence: Synthetic oligonucleotide
  Target: FXN; (-) strand; PAM type: YTN; PAM sequence: CTC
ctcctcgaagctgtctccag

SEQ ID NO: 23573 - DNA, 20 bp, Artificial Sequence
  Description of Artificial Sequence: Synthetic oligonucleotide
  Target: FXN; (-) strand; PAM type: YTN; PAM sequence: TTA
tctcctcctcgaagctgtct

SEQ ID NO: 23574 - DNA, 20 bp, Artificial Sequence
  Description of Artificial Sequence: Synthetic oligonucleotide
  Target: FXN; (-) strand; PAM type: YTN; PAM sequence: CTA
agacacatccagttatctcc

SEQ ID NO: 23575 - DNA, 20 bp, Artificial Sequence
  Description of Artificial Sequence: Synthetic oligonucleotide
  Target: FXN; (-) strand; PAM type: YTN; PAM sequence: CTC
catcaaatggactaagacac

SEQ ID NO: 23576 - DNA, 20 bp, Artificial Sequence
  Description of Artificial Sequence: Synthetic oligonucleotide
  Target: FXN; (-) strand; PAM type: YTN; PAM sequence: TTA
aagacgcagccccgtcacat

SEQ ID NO: 23577 - DNA, 20 bp, Artificial Sequence
  Description of Artificial Sequence: Synthetic oligonucleotide
  Target: FXN; (-) strand; PAM type: YTN; PAM sequence: TTA
agaggaaacgttaaagacgc

SEQ ID NO: 23578 - DNA, 20 bp, Artificial Sequence
  Description of Artificial Sequence: Synthetic oligonucleotide
  Target: FXN; (-) strand; PAM type: YTN; PAM sequence: TTT
aagaggaaacgttaaagacg

SEQ ID NO: 23579 - DNA, 20 bp, Artificial Sequence
  Description of Artificial Sequence: Synthetic oligonucleotide
  Target: FXN; (-) strand; PAM type: YTN; PAM sequence: CTC
cggtatttaagaggaaacgt

SEQ ID NO: 23580 - DNA, 20 bp, Artificial Sequence
  Description of Artificial Sequence: Synthetic oligonucleotide
  Target: FXN; (-) strand; PAM type: YTN; PAM sequence: CTG
tctccggtatttaagaggaa

SEQ ID NO: 23581 - DNA, 20 bp, Artificial Sequence
  Description of Artificial Sequence: Synthetic oligonucleotide
  Target: FXN; (-) strand; PAM type: YTN; PAM sequence: CTC
gaagctgtctccggtattta

SEQ ID NO: 23582 - DNA, 20 bp, Artificial Sequence
  Description of Artificial Sequence: Synthetic oligonucleotide
  Target: FXN; (-) strand; PAM type: YTN; PAM sequence: TTC
tcgaagctgtctccggtatt

SEQ ID NO: 23583 - DNA, 20 bp, Artificial Sequence
  Description of Artificial Sequence: Synthetic oligonucleotide
  Target: FXN; (-) strand; PAM type: YTN; PAM sequence: CTT
ctcgaagctgtctccggtat

SEQ ID NO: 23584 - DNA, 20 bp, Artificial Sequence
  Description of Artificial Sequence: Synthetic oligonucleotide
  Target: FXN; (-) strand; PAM type: YTN; PAM sequence: CTC
cttctcgaagctgtctccgg

SEQ ID NO: 23585 - DNA, 20 bp, Artificial Sequence
  Description of Artificial Sequence: Synthetic oligonucleotide
  Target: FXN; (-) strand; PAM type: YTN; PAM sequence: TTA
tctccttctcgaagctgtct

SEQ ID NO: 23586 - DNA, 20 bp, Artificial Sequence
  Description of Artificial Sequence: Synthetic oligonucleotide
  Target: FXN; (-) strand; PAM type: YTN; PAM sequence: CTA
agaaacatccagttatctcc

SEQ ID NO: 23587 - DNA, 20 bp, Artificial Sequence
  Description of Artificial Sequence: Synthetic oligonucleotide
  Target: FXN; (-) strand; PAM type: YTN; PAM sequence: CTG
tcacaagcaacagaaaatgg

SEQ ID NO: 23588 - DNA, 20 bp, Artificial Sequence
  Description of Artificial Sequence: Synthetic oligonucleotide
  Target: FXN; (-) strand; PAM type: YTN; PAM sequence: TTC
tgtcacaagcaacagaaaat

SEQ ID NO: 23589 - DNA, 20 bp, Artificial Sequence
  Description of Artificial Sequence: Synthetic oligonucleotide
  Target: FXN; (-) strand; PAM type: YTN; PAM sequence: TTC
aggtattctgtcacaagcaa

SEQ ID NO: 23590 - DNA, 20 bp, Artificial Sequence
  Description of Artificial Sequence: Synthetic oligonucleotide
  Target: FXN; (-) strand; PAM type: YTN; PAM sequence: TTT
caggtattctgtcacaagca

SEQ ID NO: 23591 - DNA, 20 bp, Artificial Sequence
  Description of Artificial Sequence: Synthetic oligonucleotide
  Target: FXN; (-) strand; PAM type: YTN; PAM sequence: TTG
cccagtttcaggtattctgt

SEQ ID NO: 23592 - DNA, 20 bp, Artificial Sequence
  Description of Artificial Sequence: Synthetic oligonucleotide
  Target: FXN; (-) strand; PAM type: YTN; PAM sequence: TTA
ccatataaattgcccagttt

SEQ ID NO: 23593 - DNA, 20 bp, Artificial Sequence
  Description of Artificial Sequence: Synthetic oligonucleotide
  Target: FXN; (-) strand; PAM type: YTN; PAM sequence: TTT
accatataaattgcccagtt

SEQ ID NO: 23594 - DNA, 20 bp, Artificial Sequence
  Description of Artificial Sequence: Synthetic oligonucleotide
  Target: FXN; (-) strand; PAM type: YTN; PAM sequence: TTT
taccatataaattgcccagt

SEQ ID NO: 23595 - DNA, 20 bp, Artificial Sequence
  Description of Artificial Sequence: Synthetic oligonucleotide
  Target: FXN; (-) strand; PAM type: YTN; PAM sequence: TTT
ttaccatataaattgcccag

SEQ ID NO: 23596 - DNA, 20 bp, Artificial Sequence
  Description of Artificial Sequence: Synthetic oligonucleotide
  Target: FXN; (-) strand; PAM type: YTN; PAM sequence: TTT
tttaccatataaattgccca

SEQ ID NO: 23597 - DNA, 20 bp, Artificial Sequence
  Description of Artificial Sequence: Synthetic oligonucleotide
  Target: FXN; (-) strand; PAM type: YTN; PAM sequence: CTC
cagagcagtaagaagaaaat

SEQ ID NO: 23598 - DNA, 20 bp, Artificial Sequence
  Description of Artificial Sequence: Synthetic oligonucleotide
  Target: FXN; (-) strand; PAM type: YTN; PAM sequence: CTC
agcctccagagcagtaagaa

SEQ ID NO: 23599 - DNA, 20 bp, Artificial Sequence
  Description of Artificial Sequence: Synthetic oligonucleotide
  Target: FXN; (-) strand; PAM type: YTN; PAM sequence: TTC
tcagcctccagagcagtaag

SEQ ID NO: 23600 - DNA, 20 bp, Artificial Sequence
  Description of Artificial Sequence: Synthetic oligonucleotide
  Target: FXN; (-) strand; PAM type: YTN; PAM sequence: CTT
ctcagcctccagagcagtaa

SEQ ID NO: 23601 - DNA, 20 bp, Artificial Sequence
  Description of Artificial Sequence: Synthetic oligonucleotide
  Target: FXN; (-) strand; PAM type: YTN; PAM sequence: TTG
gacttctcagcctccagagc

SEQ ID NO: 23602 - DNA, 20 bp, Artificial Sequence
  Description of Artificial Sequence: Synthetic oligonucleotide
  Target: FXN; (-) strand; PAM type: YTN; PAM sequence: TTT
ggacttctcagcctccagag

SEQ ID NO: 23603 - DNA, 20 bp, Artificial Sequence
  Description of Artificial Sequence: Synthetic oligonucleotide
  Target: FXN; (-) strand; PAM type: YTN; PAM sequence: CTT
tggacttctcagcctccaga

SEQ ID NO: 23604 - DNA, 20 bp, Artificial Sequence
  Description of Artificial Sequence: Synthetic oligonucleotide
  Target: FXN; (-) strand; PAM type: YTN; PAM sequence: TTG
actttggacttctcagcctc

SEQ ID NO: 23605 - DNA, 20 bp, Artificial Sequence
  Description of Artificial Sequence: Synthetic oligonucleotide
  Target: FXN; (-) strand; PAM type: YTN; PAM sequence: CTT
gactttggacttctcagcct

SEQ ID NO: 23606 - DNA, 20 bp, Artificial Sequence
  Description of Artificial Sequence: Synthetic oligonucleotide
  Target: FXN; (-) strand; PAM type: YTN; PAM sequence: CTG
caaagtccccaccagcaaga

SEQ ID NO: 23607 - DNA, 20 bp, Artificial Sequence
  Description of Artificial Sequence: Synthetic oligonucleotide
  Target: FXN; (-) strand; PAM type: YTN; PAM sequence: CTC
tgcaaagtccccaccagcaa

SEQ ID NO: 23608 - DNA, 20 bp, Artificial Sequence
  Description of Artificial Sequence: Synthetic oligonucleotide
  Target: FXN; (-) strand; PAM type: YTN; PAM sequence: CTC
aatactctgcaaagtcccca

SEQ ID NO: 23609 - DNA, 20 bp, Artificial Sequence
  Description of Artificial Sequence: Synthetic oligonucleotide
  Target: FXN; (-) strand; PAM type: YTN; PAM sequence: TTA
ccatatgacgcccggtgccg

SEQ ID NO: 23610 - DNA, 20 bp, Artificial Sequence
  Description of Artificial Sequence: Synthetic oligonucleotide
  Target: FXN; (-) strand; PAM type: YTN; PAM sequence: CTT
accatatgacgcccggtgcc

SEQ ID NO: 23611 - DNA, 20 bp, Artificial Sequence
  Description of Artificial Sequence: Synthetic oligonucleotide
  Target: FXN; (-) strand; PAM type: YTN; PAM sequence: CTC
agccccttaccatatgacgc

SEQ ID NO: 23612 - DNA, 20 bp, Artificial Sequence
  Description of Artificial Sequence: Synthetic oligonucleotide
  Target: FXN; (-) strand; PAM type: YTN; PAM sequence: CTG
aggtagcacactcagcccct

SEQ ID NO: 23613 - DNA, 20 bp, Artificial Sequence
  Description of Artificial Sequence: Synthetic oligonucleotide
  Target: FXN; (-) strand; PAM type: YTN; PAM sequence: TTA
taagaaaagaaaaagacacc

SEQ ID NO: 23614 - DNA, 20 bp, Artificial Sequence
  Description of Artificial Sequence: Synthetic oligonucleotide
  Target: FXN; (-) strand; PAM type: YTN; PAM sequence: TTT
ataagaaaagaaaaagacac

SEQ ID NO: 23615 - DNA, 20 bp, Artificial Sequence
  Description of Artificial Sequence: Synthetic oligonucleotide
  Target: FXN; (-) strand; PAM type: YTN; PAM sequence: CTT
tataagaaaagaaaaagaca

SEQ ID NO: 23616 - DNA, 20 bp, Artificial Sequence
  Description of Artificial Sequence: Synthetic oligonucleotide
  Target: FXN; (-) strand; PAM type: YTN; PAM sequence: TTA
ggctttataagaaaagaaaa

SEQ ID NO: 23617 - DNA, 20 bp, Artificial Sequence
  Description of Artificial Sequence: Synthetic oligonucleotide
  Target: FXN; (-) strand; PAM type: YTN; PAM sequence: CTA
gttaggctttataagaaaag

SEQ ID NO: 23618 - DNA, 20 bp, Artificial Sequence
  Description of Artificial Sequence: Synthetic oligonucleotide
  Target: FXN; (-) strand; PAM type: YTN; PAM sequence: TTA
tcatgggagtgaaactagtt

SEQ ID NO: 23619 - DNA, 20 bp, Artificial Sequence
  Description of Artificial Sequence: Synthetic oligonucleotide
  Target: FXN; (-) strand; PAM type: YTN; PAM sequence: TTA
atgggttatcatgggagtga

SEQ ID NO: 23620 - DNA, 20 bp, Artificial Sequence
  Description of Artificial Sequence: Synthetic oligonucleotide
  Target: FXN; (-) strand; PAM type: YTN; PAM sequence: TTC
atagattaatgggttatcat

SEQ ID NO: 23621 - DNA, 20 bp, Artificial Sequence
  Description of Artificial Sequence: Synthetic oligonucleotide
  Target: FXN; (-) strand; PAM type: YTN; PAM sequence: TTA
atccattcatagattaatgg

SEQ ID NO: 23622 - DNA, 20 bp, Artificial Sequence
  Description of Artificial Sequence: Synthetic oligonucleotide
  Target: FXN; (-) strand; PAM type: YTN; PAM sequence: CTC
aataatggattaatccattc

SEQ ID NO: 23623 - DNA, 20 bp, Artificial Sequence
  Description of Artificial Sequence: Synthetic oligonucleotide
  Target: FXN; (-) strand; PAM type: YTN; PAM sequence: TTC
cctcaataatggattaatcc

SEQ ID NO: 23624 - DNA, 20 bp, Artificial Sequence
  Description of Artificial Sequence: Synthetic oligonucleotide
  Target: FXN; (-) strand; PAM type: YTN; PAM sequence: CTT
ccctcaataatggattaatc

SEQ ID NO: 23625 - DNA, 20 bp, Artificial Sequence
  Description of Artificial Sequence: Synthetic oligonucleotide
  Target: FXN; (-) strand; PAM type: YTN; PAM sequence: TTC
ttccctcaataatggattaa

SEQ ID NO: 23626 - DNA, 20 bp, Artificial Sequence
  Description of Artificial Sequence: Synthetic oligonucleotide
  Target: FXN; (-) strand; PAM type: YTN; PAM sequence: CTG
ggtcatgaaggttcttccct

SEQ ID NO: 23627 - DNA, 20 bp, Artificial Sequence
  Description of Artificial Sequence: Synthetic oligonucleotide
  Target: FXN; (-) strand; PAM type: YTN; PAM sequence: TTA
agcggtgactgggtcatgaa

SEQ ID NO: 23628 - DNA, 20 bp, Artificial Sequence
  Description of Artificial Sequence: Synthetic oligonucleotide
  Target: FXN; (-) strand; PAM type: YTN; PAM sequence: TTT
aagcggtgactgggtcatga

SEQ ID NO: 23629 - DNA, 20 bp, Artificial Sequence
  Description of Artificial Sequence: Synthetic oligonucleotide
  Target: FXN; (-) strand; PAM type: YTN; PAM sequence: CTT
taagcggtgactgggtcatg

SEQ ID NO: 23630 - DNA, 20 bp, Artificial Sequence
  Description of Artificial Sequence: Synthetic oligonucleotide
  Target: FXN; (-) strand; PAM type: YTN; PAM sequence: TTG
agaggtggggcctttaagcg

SEQ ID NO: 23631 - DNA, 20 bp, Artificial Sequence
  Description of Artificial Sequence: Synthetic oligonucleotide
  Target: FXN; (-) strand; PAM type: YTN; PAM sequence: TTC
ccgatgtggcagtattgaga

SEQ ID NO: 23632 - DNA, 20 bp, Artificial Sequence
  Description of Artificial Sequence: Synthetic oligonucleotide
  Target: FXN; (-) strand; PAM type: YTN; PAM sequence: TTA
attcccgatgtggcagtatt

SEQ ID NO: 23633 - DNA, 20 bp, Artificial Sequence
  Description of Artificial Sequence: Synthetic oligonucleotide
  Target: FXN; (-) strand; PAM type: YTN; PAM sequence: CTT
aattcccgatgtggcagtat

SEQ ID NO: 23634 - DNA, 20 bp, Artificial Sequence
  Description of Artificial Sequence: Synthetic oligonucleotide
  Target: FXN; (-) strand; PAM type: YTN; PAM sequence: TTG
aaacttaattcccgatgtgg

SEQ ID NO: 23635 - DNA, 20 bp, Artificial Sequence
  Description of Artificial Sequence: Synthetic oligonucleotide
  Target: FXN; (-) strand; PAM type: YTN; PAM sequence: CTC
atgttgaaacttaattcccg

SEQ ID NO: 23636 - DNA, 20 bp, Artificial Sequence
  Description of Artificial Sequence: Synthetic oligonucleotide
  Target: FXN; (-) strand; PAM type: YTN; PAM sequence: CTC
cgaaactcatgttgaaactt

SEQ ID NO: 23637 - DNA, 20 bp, Artificial Sequence
  Description of Artificial Sequence: Synthetic oligonucleotide
  Target: FXN; (-) strand; PAM type: YTN; PAM sequence: TTG
tcacctccgaaactcatgtt

SEQ ID NO: 23638 - DNA, 20 bp, Artificial Sequence
  Description of Artificial Sequence: Synthetic oligonucleotide
  Target: FXN; (-) strand; PAM type: YTN; PAM sequence: TTT
gtcacctccgaaactcatgt

SEQ ID NO: 23639 - DNA, 20 bp, Artificial Sequence
  Description of Artificial Sequence: Synthetic oligonucleotide
  Target: FXN; (-) strand; PAM type: YTN; PAM sequence: TTG
aatgtttgtcacctccgaaa

SEQ ID NO: 23640 - DNA, 20 bp, Artificial Sequence
  Description of Artificial Sequence: Synthetic oligonucleotide
  Target: FXN; (-) strand; PAM type: YTN; PAM sequence: TTT
gaatgtttgtcacctccgaa

SEQ ID NO: 23641 - DNA, 20 bp, Artificial Sequence
  Description of Artificial Sequence: Synthetic oligonucleotide
  Target: FXN; (-) strand; PAM type: YTN; PAM sequence: CTA
tggtttgaatgtttgtcacc

SEQ ID NO: 23642 - DNA, 20 bp, Artificial Sequence
  Description of Artificial Sequence: Synthetic oligonucleotide
  Target: FXN; (-) strand; PAM type: YTN; PAM sequence: TTA
agagacagcatgctatggtt

SEQ ID NO: 23643 - DNA, 20 bp, Artificial Sequence
  Description of Artificial Sequence: Synthetic oligonucleotide
  Target: FXN; (-) strand; PAM type: YTN; PAM sequence: TTT
aagagacagcatgctatggt

SEQ ID NO: 23644 - DNA, 20 bp, Artificial Sequence
  Description of Artificial Sequence: Synthetic oligonucleotide
  Target: FXN; (-) strand; PAM type: YTN; PAM sequence: TTG
agtcatttaagagacagcat

SEQ ID NO: 23645 - DNA, 20 bp, Artificial Sequence
  Description of Artificial Sequence: Synthetic oligonucleotide
  Target: FXN; (-) strand; PAM type: YTN; PAM sequence: TTA
ttgagtcatttaagagacag

SEQ ID NO: 23646 - DNA, 20 bp, Artificial Sequence
  Description of Artificial Sequence: Synthetic oligonucleotide
  Target: FXN; (-) strand; PAM type: YTN; PAM sequence: CTT
attgagtcatttaagagaca

SEQ ID NO: 23647 - DNA, 20 bp, Artificial Sequence
  Description of Artificial Sequence: Synthetic oligonucleotide
  Target: FXN; (-) strand; PAM type: YTN; PAM sequence: CTG
cccaaggcatgcagaagtgg

SEQ ID NO: 23648 - DNA, 20 bp, Artificial Sequence
  Description of Artificial Sequence: Synthetic oligonucleotide
  Target: FXN; (-) strand; PAM type: YTN; PAM sequence: CTA
aaagctgcccaaggcatgca

SEQ ID NO: 23649 - DNA, 20 bp, Artificial Sequence
  Description of Artificial Sequence: Synthetic oligonucleotide
  Target: FXN; (-) strand; PAM type: YTN; PAM sequence: CTA
ggaaaatggacagatgtcta

SEQ ID NO: 23650 - DNA, 20 bp, Artificial Sequence
  Description of Artificial Sequence: Synthetic oligonucleotide
  Target: FXN; (-) strand; PAM type: YTN; PAM sequence: CTC
taggaaaatggacagatgtc

SEQ ID NO: 23651 - DNA, 20 bp, Artificial Sequence
  Description of Artificial Sequence: Synthetic oligonucleotide
  Target: FXN; (-) strand; PAM type: YTN; PAM sequence: TTG
tccctctaggaaaatggaca

SEQ ID NO: 23652 - DNA, 20 bp, Artificial Sequence
  Description of Artificial Sequence: Synthetic oligonucleotide
  Target: FXN; (-) strand; PAM type: YTN; PAM sequence: CTT
gtccctctaggaaaatggac

SEQ ID NO: 23653 - DNA, 20 bp, Artificial Sequence
  Description of Artificial Sequence: Synthetic oligonucleotide
  Target: FXN; (-) strand; PAM type: YTN; PAM sequence: CTA
aagccaaaaggtcataggat

SEQ ID NO: 23654 - DNA, 20 bp, Artificial Sequence
  Description of Artificial Sequence: Synthetic oligonucleotide
  Target: FXN; (-) strand; PAM type: YTN; PAM sequence: TTA
ggcctaaagccaaaaggtca

SEQ ID NO: 23655 - DNA, 20 bp, Artificial Sequence
  Description of Artificial Sequence: Synthetic oligonucleotide
  Target: FXN; (-) strand; PAM type: YTN; PAM sequence: TTG
ttaggcctaaagccaaaagg

SEQ ID NO: 23656 - DNA, 20 bp, Artificial Sequence
  Description of Artificial Sequence: Synthetic oligonucleotide
  Target: FXN; (-) strand; PAM type: YTN; PAM sequence: CTT
gttaggcctaaagccaaaag

SEQ ID NO: 23657 - DNA, 20 bp, Artificial Sequence
  Description of Artificial Sequence: Synthetic oligonucleotide
  Target: FXN; (-) strand; PAM type: YTN; PAM sequence: CTG
cttgttaggcctaaagccaa

SEQ ID NO: 23658 - DNA, 20 bp, Artificial Sequence
  Description of Artificial Sequence: Synthetic oligonucleotide
  Target: FXN; (-) strand; PAM type: YTN; PAM sequence: TTG
aaagtgagtgagggtataac

SEQ ID NO: 23659 - DNA, 20 bp, Artificial Sequence
  Description of Artificial Sequence: Synthetic oligonucleotide
  Target: FXN; (-) strand; PAM type: YTN; PAM sequence: TTT
gaaagtgagtgagggtataa

SEQ ID NO: 23660 - DNA, 20 bp, Artificial Sequence
  Description of Artificial Sequence: Synthetic oligonucleotide
  Target: FXN; (-) strand; PAM type: YTN; PAM sequence: CTG
caagacaataaaaatgattt

SEQ ID NO: 23661 - DNA, 20 bp, Artificial Sequence
  Description of Artificial Sequence: Synthetic oligonucleotide
  Target: FXN; (-) strand; PAM type: YTN; PAM sequence: TTG
tctgcaagacaataaaaatg

SEQ ID NO: 23662 - DNA, 20 bp, Artificial Sequence
  Description of Artificial Sequence: Synthetic oligonucleotide
  Target: FXN; (-) strand; PAM type: YTN; PAM sequence: TTG
tgtaaattgtctgcaagaca

SEQ ID NO: 23663 - DNA, 20 bp, Artificial Sequence
  Description of Artificial Sequence: Synthetic oligonucleotide
  Target: FXN; (-) strand; PAM type: YTN; PAM sequence: CTT
gtgtaaattgtctgcaagac

SEQ ID NO: 23664 - DNA, 20 bp, Artificial Sequence
  Description of Artificial Sequence: Synthetic oligonucleotide
  Target: FXN; (-) strand; PAM type: YTN; PAM sequence: CTA
tgtgtaaacttgtgtaaatt

SEQ ID NO: 23665 - DNA, 20 bp, Artificial Sequence
  Description of Artificial Sequence: Synthetic oligonucleotide
  Target: FXN; (-) strand; PAM type: YTN; PAM sequence: TTC
tatgtgtaaacttgtgtaaa

SEQ ID NO: 23666 - DNA, 20 bp, Artificial Sequence
  Description of Artificial Sequence: Synthetic oligonucleotide
  Target: FXN; (-) strand; PAM type: YTN; PAM sequence: TTT
ctatgtgtaaacttgtgtaa

SEQ ID NO: 23667 - DNA, 20 bp, Artificial Sequence
  Description of Artificial Sequence: Synthetic oligonucleotide
  Target: FXN; (-) strand; PAM type: YTN; PAM sequence: TTT
tctatgtgtaaacttgtgta

SEQ ID NO: 23668 - DNA, 20 bp, Artificial Sequence
  Description of Artificial Sequence: Synthetic oligonucleotide
  Target: FXN; (-) strand; PAM type: YTN; PAM sequence: CTT
ttctatgtgtaaacttgtgt

SEQ ID NO: 23669 - DNA, 20 bp, Artificial Sequence
  Description of Artificial Sequence: Synthetic oligonucleotide
  Target: FXN; (-) strand; PAM type: YTN; PAM sequence: TTA
catatccttttctatgtgta

SEQ ID NO: 23670 - DNA, 20 bp, Artificial Sequence
  Description of Artificial Sequence: Synthetic oligonucleotide
  Target: FXN; (-) strand; PAM type: YTN; PAM sequence: TTT
acatatccttttctatgtgt

SEQ ID NO: 23671 - DNA, 20 bp, Artificial Sequence
  Description of Artificial Sequence: Synthetic oligonucleotide
  Target: FXN; (-) strand; PAM type: YTN; PAM sequence: TTA
caggcgtgagccaccgcgcc

SEQ ID NO: 23672 - DNA, 20 bp, Artificial Sequence
  Description of Artificial Sequence: Synthetic oligonucleotide
  Target: FXN; (-) strand; PAM type: YTN; PAM sequence: CTG
ggattacaggcgtgagccac

SEQ ID NO: 23673 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattacag

SEQ ID NO: 23674 - DNA, 20 bp, Artificial Sequence
  Description of Artificial Sequence: Synthetic oligonucleotide
  Target: FXN; (-) strand; PAM type: YTN; PAM sequence: CTC
ggcctcccaaagtgctggga

SEQ ID NO: 23675 - DNA, 20 bp, Artificial Sequence
  Description of Artificial Sequence: Synthetic oligonucleotide
  Target: FXN; (-) strand; PAM type: YTN; PAM sequence: CTG
cctcggcctcccaaagtgct

SEQ ID NO: 23676 - DNA, 20 bp, Artificial Sequence
  Description of Artificial Sequence: Synthetic oligonucleotide
  Target: FXN; (-) strand; PAM type: YTN; PAM sequence: CTC
gtgatccacctgcctcggcc

SEQ ID NO: 23677 - DNA, 20 bp, Artificial Sequence
  Description of Artificial Sequence: Synthetic oligonucleotide
  Target: FXN; (-) strand; PAM type: YTN; PAM sequence: CTG
aactcgtgatccacctgcct

SEQ ID NO: 23678 - DNA, 20 bp, Artificial Sequence
  Description of Artificial Sequence: Synthetic oligonucleotide
  Target: FXN; (-) strand; PAM type: YTN; PAM sequence: CTC
ctgaactcgtgatccacctg

SEQ ID NO: 23679 - DNA, 20 bp, Artificial Sequence
  Description of Artificial Sequence: Synthetic oligonucleotide
  Target: FXN; (-) strand; PAM type: YTN; PAM sequence: CTC
catctcctgaactcgtgatc

SEQ ID NO: 23680 - DNA, 20 bp, Artificial Sequence
  Description of Artificial Sequence: Synthetic oligonucleotide
  Target: FXN; (-) strand; PAM type: YTN; PAM sequence: TTA
gccaggatggtctccatctc

SEQ ID NO: 23681 - DNA, 20 bp, Artificial Sequence
  Description of Artificial Sequence: Synthetic oligonucleotide
  Target: FXN; (-) strand; PAM type: YTN; PAM sequence: TTC
atcgtattagccaggatggt

SEQ ID NO: 23682 - DNA, 20 bp, Artificial Sequence
  Description of Artificial Sequence: Synthetic oligonucleotide
  Target: FXN; (-) strand; PAM type: YTN; PAM sequence: TTT
catcgtattagccaggatgg

SEQ ID NO: 23683 - DNA, 20 bp, Artificial Sequence
  Description of Artificial Sequence: Synthetic oligonucleotide
  Target: FXN; (-) strand; PAM type: YTN; PAM sequence: TTA
gtagagatggggtttcatcg

SEQ ID NO: 23684 - DNA, 20 bp, Artificial Sequence
  Description of Artificial Sequence: Synthetic oligonucleotide
  Target: FXN; (-) strand; PAM type: YTN; PAM sequence: TTT
agtagagatggggtttcatc

SEQ ID NO: 23685 - DNA, 20 bp, Artificial Sequence
  Description of Artificial Sequence: Synthetic oligonucleotide
  Target: FXN; (-) strand; PAM type: YTN; PAM sequence: TTT
tagtagagatggggtttcat

SEQ ID NO: 23686 - DNA, 20 bp, Artificial Sequence
  Description of Artificial Sequence: Synthetic oligonucleotide
  Target: FXN; (-) strand; PAM type: YTN; PAM sequence: TTT
ttagtagagatggggtttca

SEQ ID NO: 23687 - DNA, 20 bp, Artificial Sequence
  Description of Artificial Sequence: Synthetic oligonucleotide
  Target: FXN; (-) strand; PAM type: YTN; PAM sequence: TTG
tatttttagtagagatgggg

SEQ ID NO: 23688 - DNA, 20 bp, Artificial Sequence
  Description of Artificial Sequence: Synthetic oligonucleotide
  Target: FXN; (-) strand; PAM type: YTN; PAM sequence: TTT
gtatttttagtagagatggg

SEQ ID NO: 23689 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagagatgg

SEQ ID NO: 23690 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagagatg

SEQ ID NO: 23691 - DNA, 20 bp, Artificial Sequence
  Description of Artificial Sequence: Synthetic oligonucleotide
  Target: FXN; (-) strand; PAM type: YTN; PAM sequence: TTT
tttgtatttttagtagagat

SEQ ID NO: 23692 - DNA, 20 bp, Artificial Sequence
  Description of Artificial Sequence: Synthetic oligonucleotide
  Target: FXN; (-) strand; PAM type: YTN; PAM sequence: CTA
attttttgtatttttagtag

SEQ ID NO: 23693 - DNA, 20 bp, Artificial Sequence
  Description of Artificial Sequence: Synthetic oligonucleotide
  Target: FXN; (-) strand; PAM type: YTN; PAM sequence: CTA
caggcacccgtcaccacgcc

SEQ ID NO: 23694 - DNA, 20 bp, Artificial Sequence
  Description of Artificial Sequence: Synthetic oligonucleotide
  Target: FXN; (-) strand; PAM type: YTN; PAM sequence: CTC
agcgtcccgagtagtgggga

SEQ ID NO: 23695 - DNA, 20 bp, Artificial Sequence
  Description of Artificial Sequence: Synthetic oligonucleotide
  Target: FXN; (-) strand; PAM type: YTN; PAM sequence: CTG
cctcagcgtcccgagtagtg

SEQ ID NO: 23696 - DNA, 20 bp, Artificial Sequence
  Description of Artificial Sequence: Synthetic oligonucleotide
  Target: FXN; (-) strand; PAM type: YTN; PAM sequence: CTC
ctgcctcagcgtcccgagta

SEQ ID NO: 23697 - DNA, 20 bp, Artificial Sequence
  Description of Artificial Sequence: Synthetic oligonucleotide
  Target: FXN; (-) strand; PAM type: YTN; PAM sequence: TTC
tcctgcctcagcgtcccgag

SEQ ID NO: 23698 - DNA, 20 bp, Artificial Sequence
  Description of Artificial Sequence: Synthetic oligonucleotide
  Target: FXN; (-) strand; PAM type: YTN; PAM sequence: TTC
acgccattctcctgcctcag

SEQ ID NO: 23699 - DNA, 20 bp, Artificial Sequence
  Description of Artificial Sequence: Synthetic oligonucleotide
  Target: FXN; (-) strand; PAM type: YTN; PAM sequence: CTC
ccgggttcacgccattctcc

SEQ ID NO: 23700 - DNA, 20 bp, Artificial Sequence
  Description of Artificial Sequence: Synthetic oligonucleotide
  Target: FXN; (-) strand; PAM type: YTN; PAM sequence: CTG
cctcccgggttcacgccatt

SEQ ID NO: 23701 - DNA, 20 bp, Artificial Sequence
  Description of Artificial Sequence: Synthetic oligonucleotide
  Target: FXN; (-) strand; PAM type: YTN; PAM sequence: CTC
tgcctcccgggttcacgcca

SEQ ID NO: 23702 - DNA, 20 bp, Artificial Sequence
  Description of Artificial Sequence: Synthetic oligonucleotide
  Target: FXN; (-) strand; PAM type: YTN; PAM sequence: CTG
caagctctgcctcccgggtt

SEQ ID NO: 23703 - DNA, 20 bp, Artificial Sequence
  Description of Artificial Sequence: Synthetic oligonucleotide
  Target: FXN; (-) strand; PAM type: YTN; PAM sequence: CTC
ggatcactgcaagctctgcc

SEQ ID NO: 23704 - DNA, 20 bp, Artificial Sequence
  Description of Artificial Sequence: Synthetic oligonucleotide
  Target: FXN; (-) strand; PAM type: YTN; PAM sequence: CTG
gagtgcagtggcacgatctc

SEQ ID NO: 23705 - DNA, 20 bp, Artificial Sequence
  Description of Artificial Sequence: Synthetic oligonucleotide
  Target: FXN; (-) strand; PAM type: YTN; PAM sequence: CTG
tcacccaggctggagtgcag

SEQ ID NO: 23706 - DNA, 20 bp, Artificial Sequence
  Description of Artificial Sequence: Synthetic oligonucleotide
  Target: FXN; (-) strand; PAM type: YTN; PAM sequence: CTC
tgtcacccaggctggagtgc

SEQ ID NO: 23707 - DNA, 20 bp, Artificial Sequence
  Description of Artificial Sequence: Synthetic oligonucleotide
  Target: FXN; (-) strand; PAM type: YTN; PAM sequence: CTC
gctctgtcacccaggctgga

SEQ ID NO: 23708 - DNA, 20 bp, Artificial Sequence
  Description of Artificial Sequence: Synthetic oligonucleotide
  Target: FXN; (-) strand; PAM type: YTN; PAM sequence: TTG
agatgcagtctcgctctgtc

SEQ ID NO: 23709 - DNA, 20 bp, Artificial Sequence
  Description of Artificial Sequence: Synthetic oligonucleotide
  Target: FXN; (-) strand; PAM type: YTN; PAM sequence: TTT
gagatgcagtctcgctctgt

SEQ ID NO: 23710 - DNA, 20 bp, Artificial Sequence
  Description of Artificial Sequence: Synthetic oligonucleotide
  Target: FXN; (-) strand; PAM type: YTN; PAM sequence: CTT
tgagatgcagtctcgctctg

SEQ ID NO: 23711 - DNA, 20 bp, Artificial Sequence
  Description of Artificial Sequence: Synthetic oligonucleotide
  Target: FXN; (-) strand; PAM type: YTN; PAM sequence: TTC
tttgagatgcagtctcgctc

SEQ ID NO: 23712 - DNA, 20 bp, Artificial Sequence
  Description of Artificial Sequence: Synthetic oligonucleotide
  Target: FXN; (-) strand; PAM type: YTN; PAM sequence: TTT
ctttgagatgcagtctcgct

SEQ ID NO: 23713 - DNA, 20 bp, Artificial Sequence
  Description of Artificial Sequence: Synthetic oligonucleotide
  Target: FXN; (-) strand; PAM type: YTN; PAM sequence: TTT
tctttgagatgcagtctcgc

SEQ ID NO: 23714 - DNA, 20 bp, Artificial Sequence
  Description of Artificial Sequence: Synthetic oligonucleotide
  Target: FXN; (-) strand; PAM type: YTN; PAM sequence: TTT
ttctttgagatgcagtctcg

SEQ ID NO: 23715 - DNA, 20 bp, Artificial Sequence
  Description of Artificial Sequence: Synthetic oligonucleotide
  Target: FXN; (-) strand; PAM type: YTN; PAM sequence: TTT
tttctttgagatgcagtctc

SEQ ID NO: 23716 - DNA, 20 bp, Artificial Sequence
  Description of Artificial Sequence: Synthetic oligonucleotide
  Target: FXN; (-) strand; PAM type: YTN; PAM sequence: TTT
ttttctttgagatgcagtct

SEQ ID NO: 23717 - DNA, 20 bp, Artificial Sequence
  Description of Artificial Sequence: Synthetic oligonucleotide
  Target: FXN; (-) strand; PAM type: YTN; PAM sequence: TTA
tttttttctttgagatgcag

SEQ ID NO: 23718 - DNA, 20 bp, Artificial Sequence
  Description of Artificial Sequence: Synthetic oligonucleotide
  Target: FXN; (-) strand; PAM type: YTN; PAM sequence: TTT
atttttttctttgagatgca

SEQ ID NO: 23719 - DNA, 20 bp, Artificial Sequence
  Description of Artificial Sequence: Synthetic oligonucleotide
  Target: FXN; (-) strand; PAM type: YTN; PAM sequence: TTA
tttatttttttctttgagat

SEQ ID NO: 23720 - DNA, 20 bp, Artificial Sequence
  Description of Artificial Sequence: Synthetic oligonucleotide
  Target: FXN; (-) strand; PAM type: YTN; PAM sequence: TTT
atttatttttttctttgaga

SEQ ID NO: 23721 - DNA, 20 bp, Artificial Sequence
  Description of Artificial Sequence: Synthetic oligonucleotide
  Target: FXN; (-) strand; PAM type: YTN; PAM sequence: TTA
tttatttatttttttctttg

SEQ ID NO: 23722 - DNA, 20 bp, Artificial Sequence
  Description of Artificial Sequence: Synthetic oligonucleotide
  Target: FXN; (-) strand; PAM type: YTN; PAM sequence: TTT
atttatttatttttttcttt

SEQ ID NO: 23723 - DNA, 20 bp, Artificial Sequence
  Description of Artificial Sequence: Synthetic oligonucleotide
  Target: FXN; (-) strand; PAM type: YTN; PAM sequence: TTA
tttatttatttatttttttc

SEQ ID NO: 23724 - DNA, 20 bp, Artificial Sequence
  Description of Artificial Sequence: Synthetic oligonucleotide
  Target: FXN; (-) strand; PAM type: YTN; PAM sequence: TTT
atttatttatttattttttt

SEQ ID NO: 23725 - DNA, 20 bp, Artificial Sequence
  Description of Artificial Sequence: Synthetic oligonucleotide
  Target: FXN; (-) strand; PAM type: YTN; PAM sequence: TTA
taagcagtataaatatttat

SEQ ID NO: 23726 - DNA, 20 bp, Artificial Sequence
  Description of Artificial Sequence: Synthetic oligonucleotide
  Target: FXN; (-) strand; PAM type: YTN; PAM sequence: TTT
ataagcagtataaatattta

SEQ ID NO: 23727 - DNA, 20 bp, Artificial Sequence
  Description of Artificial Sequence: Synthetic oligonucleotide
  Target: FXN; (-) strand; PAM type: YTN; PAM sequence: TTA
gtttataagcagtataaata

SEQ ID NO: 23728 - DNA, 20 bp, Artificial Sequence
  Description of Artificial Sequence: Synthetic oligonucleotide
  Target: FXN; (-) strand; PAM type: YTN; PAM sequence: TTA
ttagtttataagcagtataa

SEQ ID NO: 23729 - DNA, 20 bp, Artificial Sequence
  Description of Artificial Sequence: Synthetic oligonucleotide
  Target: FXN; (-) strand; PAM type: YTN; PAM sequence: TTA
ttattagtttataagcagta

SEQ ID NO: 23730 - DNA, 20 bp, Artificial Sequence
  Description of Artificial Sequence: Synthetic oligonucleotide
  Target: FXN; (-) strand; PAM type: YTN; PAM sequence: TTT
attattagtttataagcagt

SEQ ID NO: 23731 - DNA, 20 bp, Artificial Sequence
  Description of Artificial Sequence: Synthetic oligonucleotide
  Target: FXN; (-) strand; PAM type: YTN; PAM sequence: TTA
acatatgaatggtggggtga

SEQ ID NO: 23732 - DNA, 20 bp, Artificial Sequence
  Description of Artificial Sequence: Synthetic oligonucleotide
  Target: FXN; (-) strand; PAM type: YTN; PAM sequence: TTT
aacatatgaatggtggggtg

SEQ ID NO: 23733 - DNA, 20 bp, Artificial Sequence
  Description of Artificial Sequence: Synthetic oligonucleotide
  Target: FXN; (-) strand; PAM type: YTN; PAM sequence: TTT
taacatatgaatggtggggt

SEQ ID NO: 23734 - DNA, 20 bp, Artificial Sequence
  Description of Artificial Sequence: Synthetic oligonucleotide
  Target: FXN; (-) strand; PAM type: YTN; PAM sequence: TTA
ggttttaacatatgaatggt

SEQ ID NO: 23735 - DNA, 20 bp, Artificial Sequence
  Description of Artificial Sequence: Synthetic oligonucleotide
  Target: FXN; (-) strand; PAM type: YTN; PAM sequence: TTG
gtgattaggttttaacatat

SEQ ID NO: 23736 - DNA, 20 bp, Artificial Sequence
  Description of Artificial Sequence: Synthetic oligonucleotide
  Target: FXN; (-) strand; PAM type: YTN; PAM sequence: TTT
ggtgattaggttttaacata

SEQ ID NO: 23737 - DNA, 20 bp, Artificial Sequence
  Description of Artificial Sequence: Synthetic oligonucleotide
  Target: FXN; (-) strand; PAM type: YTN; PAM sequence: CTT
tggtgattaggttttaacat

SEQ ID NO: 23738 - DNA, 20 bp, Artificial Sequence
  Description of Artificial Sequence: Synthetic oligonucleotide
  Target: FXN; (-) strand; PAM type: YTN; PAM sequence: CTA
atatcactttggtgattagg

SEQ ID NO: 23739 - DNA, 20 bp, Artificial Sequence
  Description of Artificial Sequence: Synthetic oligonucleotide
  Target: FXN; (-) strand; PAM type: YTN; PAM sequence: CTC
ctaatatcactttggtgatt

SEQ ID NO: 23740 - DNA, 20 bp, Artificial Sequence
  Description of Artificial Sequence: Synthetic oligonucleotide
  Target: FXN; (-) strand; PAM type: YTN; PAM sequence: CTC
ccaagggccccacctcctaa

SEQ ID NO: 23741 - DNA, 20 bp, Artificial Sequence
  Description of Artificial Sequence: Synthetic oligonucleotide
  Target: FXN; (-) strand; PAM type: YTN; PAM sequence: CTC
atcacctcccaagggcccca

SEQ ID NO: 23742 - DNA, 20 bp, Artificial Sequence
  Description of Artificial Sequence: Synthetic oligonucleotide
  Target: FXN; (-) strand; PAM type: YTN; PAM sequence: CTC
atacctcatcacctcccaag

SEQ ID NO: 23743 - DNA, 20 bp, Artificial Sequence
  Description of Artificial Sequence: Synthetic oligonucleotide
  Target: FXN; (-) strand; PAM type: YTN; PAM sequence: CTC
caccctcatacctcatcacc

SEQ ID NO: 23744 - DNA, 20 bp, Artificial Sequence
  Description of Artificial Sequence: Synthetic oligonucleotide
  Target: FXN; (-) strand; PAM type: YTN; PAM sequence: CTA
atcccaatcatatgggctcc

SEQ ID NO: 23745 - DNA, 20 bp, Artificial Sequence
  Description of Artificial Sequence: Synthetic oligonucleotide
  Target: FXN; (-) strand; PAM type: YTN; PAM sequence: TTA
gaagggcactaatcccaatc

SEQ ID NO: 23746 - DNA, 20 bp, Artificial Sequence
  Description of Artificial Sequence: Synthetic oligonucleotide
  Target: FXN; (-) strand; PAM type: YTN; PAM sequence: TTT
agaagggcactaatcccaat

SEQ ID NO: 23747 - DNA, 20 bp, Artificial Sequence
  Description of Artificial Sequence: Synthetic oligonucleotide
  Target: FXN; (-) strand; PAM type: YTN; PAM sequence: TTT
tagaagggcactaatcccaa

SEQ ID NO: 23748 - DNA, 20 bp, Artificial Sequence
  Description of Artificial Sequence: Synthetic oligonucleotide
  Target: FXN; (-) strand; PAM type: YTN; PAM sequence: CTA
ttttagaagggcactaatcc

SEQ ID NO: 23749 - DNA, 20 bp, Artificial Sequence
  Description of Artificial Sequence: Synthetic oligonucleotide
  Target: FXN; (-) strand; PAM type: YTN; PAM sequence: TTG
ggctattttagaagggcact

SEQ ID NO: 23750 - DNA, 20 bp, Artificial Sequence
  Description of Artificial Sequence: Synthetic oligonucleotide
  Target: FXN; (-) strand; PAM type: YTN; PAM sequence: CTC
cgttgggctattttagaagg

SEQ ID NO: 23751 - DNA, 20 bp, Artificial Sequence
  Description of Artificial Sequence: Synthetic oligonucleotide
  Target: FXN; (-) strand; PAM type: YTN; PAM sequence: CTG
ggctccgttgggctatttta

SEQ ID NO: 23752 - DNA, 20 bp, Artificial Sequence
  Description of Artificial Sequence: Synthetic oligonucleotide
  Target: FXN; (-) strand; PAM type: YTN; PAM sequence: TTG
tcactgggctccgttgggct

SEQ ID NO: 23753 - DNA, 20 bp, Artificial Sequence
  Description of Artificial Sequence: Synthetic oligonucleotide
  Target: FXN; (-) strand; PAM type: YTN; PAM sequence: CTT
gtcactgggctccgttgggc

SEQ ID NO: 23754 - DNA, 20 bp, Artificial Sequence
  Description of Artificial Sequence: Synthetic oligonucleotide
  Target: FXN; (-) strand; PAM type: YTN; PAM sequence: TTC
atagatgatgccttgtcact

SEQ ID NO: 23755 - DNA, 20 bp, Artificial Sequence
  Description of Artificial Sequence: Synthetic oligonucleotide
  Target: FXN; (-) strand; PAM type: YTN; PAM sequence: CTG
gttcatagatgatgccttgt

SEQ ID NO: 23756 - DNA, 20 bp, Artificial Sequence
  Description of Artificial Sequence: Synthetic oligonucleotide
  Target: FXN; (-) strand; PAM type: YTN; PAM sequence: TTC
ctggttcatagatgatgcct

SEQ ID NO: 23757 - DNA, 20 bp, Artificial Sequence
  Description of Artificial Sequence: Synthetic oligonucleotide
  Target: FXN; (-) strand; PAM type: YTN; PAM sequence: TTT
cctggttcatagatgatgcc

SEQ ID NO: 23758 - DNA, 20 bp, Artificial Sequence
  Description of Artificial Sequence: Synthetic oligonucleotide
  Target: FXN; (-) strand; PAM type: YTN; PAM sequence: CTG
gtgagggccagtttcctggt

SEQ ID NO: 23759 - DNA, 20 bp, Artificial Sequence
  Description of Artificial Sequence: Synthetic oligonucleotide
  Target: FXN; (-) strand; PAM type: YTN; PAM sequence: TTG
gtgtctggtgagggccagtt

SEQ ID NO: 23760 - DNA, 20 bp, Artificial Sequence
  Description of Artificial Sequence: Synthetic oligonucleotide
  Target: FXN; (-) strand; PAM type: YTN; PAM sequence: TTT
ggtgtctggtgagggccagt

SEQ ID NO: 23761 - DNA, 20 bp, Artificial Sequence
  Description of Artificial Sequence: Synthetic oligonucleotide
  Target: FXN; (-) strand; PAM type: YTN; PAM sequence: CTT
tggtgtctggtgagggccag

SEQ ID NO: 23762 - DNA, 20 bp, Artificial Sequence
  Description of Artificial Sequence: Synthetic oligonucleotide
  Target: FXN; (-) strand; PAM type: YTN; PAM sequence: CTG
gagggtgggaaatccaagat

SEQ ID NO: 23763 - DNA, 20 bp, Artificial Sequence
  Description of Artificial Sequence: Synthetic oligonucleotide
  Target: FXN; (-) strand; PAM type: YTN; PAM sequence: TTA
gagtcctggagggtgggaaa

SEQ ID NO: 23764 - DNA, 20 bp, Artificial Sequence
  Description of Artificial Sequence: Synthetic oligonucleotide
  Target: FXN; (-) strand; PAM type: YTN; PAM sequence: CTT
agagtcctggagggtgggaa

SEQ ID NO: 23765 - DNA, 20 bp, Artificial Sequence
  Description of Artificial Sequence: Synthetic oligonucleotide
  Target: FXN; (-) strand; PAM type: YTN; PAM sequence: TTC
ttagagtcctggagggtggg

SEQ ID NO: 23766 - DNA, 20 bp, Artificial Sequence
  Description of Artificial Sequence: Synthetic oligonucleotide
  Target: FXN; (-) strand; PAM type: YTN; PAM sequence: TTT
cttagagtcctggagggtgg

SEQ ID NO: 23767 - DNA, 20 bp, Artificial Sequence
  Description of Artificial Sequence: Synthetic oligonucleotide
  Target: FXN; (-) strand; PAM type: YTN; PAM sequence: TTA
taaacaatagaaatgtgttt

SEQ ID NO: 23768 - DNA, 20 bp, Artificial Sequence
  Description of Artificial Sequence: Synthetic oligonucleotide
  Target: FXN; (-) strand; PAM type: YTN; PAM sequence: CTT
ataaacaatagaaatgtgtt

SEQ ID NO: 23769 - DNA, 20 bp, Artificial Sequence
  Description of Artificial Sequence: Synthetic oligonucleotide
  Target: FXN; (-) strand; PAM type: YTN; PAM sequence: CTG
ggtggcttataaacaataga

SEQ ID NO: 23770 - DNA, 20 bp, Artificial Sequence
  Description of Artificial Sequence: Synthetic oligonucleotide
  Target: FXN; (-) strand; PAM type: YTN; PAM sequence: TTA
taacaaaataccagccactg

SEQ ID NO: 23771 - DNA, 20 bp, Artificial Sequence
  Description of Artificial Sequence: Synthetic oligonucleotide
  Target: FXN; (-) strand; PAM type: YTN; PAM sequence: CTG
ggatgttataacaaaatacc

SEQ ID NO: 23772 - DNA, 20 bp, Artificial Sequence
  Description of Artificial Sequence: Synthetic oligonucleotide
  Target: FXN; (-) strand; PAM type: YTN; PAM sequence: TTA
gtctgggatgttataacaaa

SEQ ID NO: 23773 - DNA, 20 bp, Artificial Sequence
  Description of Artificial Sequence: Synthetic oligonucleotide
  Target: FXN; (-) strand; PAM type: YTN; PAM sequence: CTT
agtctgggatgttataacaa

SEQ ID NO: 23774 - DNA, 20 bp, Artificial Sequence
  Description of Artificial Sequence: Synthetic oligonucleotide
  Target: FXN; (-) strand; PAM type: YTN; PAM sequence: TTG
tcttagtctgggatgttata

SEQ ID NO: 23775 - DNA, 20 bp, Artificial Sequence
  Description of Artificial Sequence: Synthetic oligonucleotide
  Target: FXN; (-) strand; PAM type: YTN; PAM sequence: TTT
gtcttagtctgggatgttat

SEQ ID NO: 23776 - DNA, 20 bp, Artificial Sequence
  Description of Artificial Sequence: Synthetic oligonucleotide
  Target: FXN; (-) strand; PAM type: YTN; PAM sequence: TTA
tttgtcttagtctgggatgt

SEQ ID NO: 23777 - DNA, 20 bp, Artificial Sequence
  Description of Artificial Sequence: Synthetic oligonucleotide
  Target: FXN; (-) strand; PAM type: YTN; PAM sequence: TTG
ttatttgtcttagtctggga

SEQ ID NO: 23778 - DNA, 20 bp, Artificial Sequence
  Description of Artificial Sequence: Synthetic oligonucleotide
  Target: FXN; (-) strand; PAM type: YTN; PAM sequence: TTT
gttatttgtcttagtctggg

SEQ ID NO: 23779 - DNA, 20 bp, Artificial Sequence
  Description of Artificial Sequence: Synthetic oligonucleotide
  Target: FXN; (-) strand; PAM type: YTN; PAM sequence: CTG
gtgtcagggatacaagtatt

SEQ ID NO: 23780 - DNA, 20 bp, Artificial Sequence
  Description of Artificial Sequence: Synthetic oligonucleotide
  Target: FXN; (-) strand; PAM type: YTN; PAM sequence: TTA
acctggtgtcagggatacaa

SEQ ID NO: 23781 - DNA, 20 bp, Artificial Sequence
  Description of Artificial Sequence: Synthetic oligonucleotide
  Target: FXN; (-) strand; PAM type: YTN; PAM sequence: CTT
aacctggtgtcagggataca

SEQ ID NO: 23782 - DNA, 20 bp, Artificial Sequence
  Description of Artificial Sequence: Synthetic oligonucleotide
  Target: FXN; (-) strand; PAM type: YTN; PAM sequence: CTC
ttaacctggtgtcagggata

SEQ ID NO: 23783 - DNA, 20 bp, Artificial Sequence
  Description of Artificial Sequence: Synthetic oligonucleotide
  Target: FXN; (-) strand; PAM type: YTN; PAM sequence: CTA
tctcttaacctggtgtcagg

SEQ ID NO: 23784 - DNA, 20 bp, Artificial Sequence
  Description of Artificial Sequence: Synthetic oligonucleotide
  Target: FXN; (-) strand; PAM type: YTN; PAM sequence: TTC
tatctcttaacctggtgtca

SEQ ID NO: 23785 - DNA, 20 bp, Artificial Sequence
  Description of Artificial Sequence: Synthetic oligonucleotide
  Target: FXN; (-) strand; PAM type: YTN; PAM sequence: CTC
cagaggaacaaacaaattct

SEQ ID NO: 23786 - DNA, 20 bp, Artificial Sequence
  Description of Artificial Sequence: Synthetic oligonucleotide
  Target: FXN; (-) strand; PAM type: YTN; PAM sequence: CTC
cagggaggacagggcagtga

SEQ ID NO: 23787 - DNA, 20 bp, Artificial Sequence
  Description of Artificial Sequence: Synthetic oligonucleotide
  Target: FXN; (-) strand; PAM type: YTN; PAM sequence: TTC
ctccagggaggacagggcag

SEQ ID NO: 23788 - DNA, 20 bp, Artificial Sequence
  Description of Artificial Sequence: Synthetic oligonucleotide
  Target: FXN; (-) strand; PAM type: YTN; PAM sequence: CTG
gcagattcctccagggagga

SEQ ID NO: 23789 - DNA, 20 bp, Artificial Sequence
  Description of Artificial Sequence: Synthetic oligonucleotide
  Target: FXN; (-) strand; PAM type: YTN; PAM sequence: TTC
gggctggcagattcctccag

SEQ ID NO: 23790 - DNA, 20 bp, Artificial Sequence
  Description of Artificial Sequence: Synthetic oligonucleotide
  Target: FXN; (-) strand; PAM type: YTN; PAM sequence: CTA
agaaaaggagggtacgatga

SEQ ID NO: 23791 - DNA, 20 bp, Artificial Sequence
  Description of Artificial Sequence: Synthetic oligonucleotide
  Target: FXN; (-) strand; PAM type: YTN; PAM sequence: CTC
taagaaaaggagggtacgat

SEQ ID NO: 23792 - DNA, 20 bp, Artificial Sequence
  Description of Artificial Sequence: Synthetic oligonucleotide
  Target: FXN; (-) strand; PAM type: YTN; PAM sequence: TTG
ggggagatacagaggaggtc

SEQ ID NO: 23793 - DNA, 20 bp, Artificial Sequence
  Description of Artificial Sequence: Synthetic oligonucleotide
  Target: FXN; (-) strand; PAM type: YTN; PAM sequence: TTG
tatataagcaatacatggat

SEQ ID NO: 23794 - DNA, 20 bp, Artificial Sequence
  Description of Artificial Sequence: Synthetic oligonucleotide
  Target: FXN; (-) strand; PAM type: YTN; PAM sequence: CTT
gtatataagcaatacatgga

SEQ ID NO: 23795 - DNA, 20 bp, Artificial Sequence
  Description of Artificial Sequence: Synthetic oligonucleotide
  Target: FXN; (-) strand; PAM type: YTN; PAM sequence: TTG
aacaaaaggggcaagccata

SEQ ID NO: 23796 - DNA, 20 bp, Artificial Sequence
  Description of Artificial Sequence: Synthetic oligonucleotide
  Target: FXN; (-) strand; PAM type: YTN; PAM sequence: CTG
catgcatcaatgcagatgac

SEQ ID NO: 23797 - DNA, 20 bp, Artificial Sequence
  Description of Artificial Sequence: Synthetic oligonucleotide
  Target: FXN; (-) strand; PAM type: YTN; PAM sequence: CTA
tccagcagtgagaacaaata

SEQ ID NO: 23798 - DNA, 20 bp, Artificial Sequence
  Description of Artificial Sequence: Synthetic oligonucleotide
  Target: FXN; (-) strand; PAM type: YTN; PAM sequence: TTA
cccaaccagatactatccag

SEQ ID NO: 23799 - DNA, 20 bp, Artificial Sequence
  Description of Artificial Sequence: Synthetic oligonucleotide
  Target: FXN; (-) strand; PAM type: YTN; PAM sequence: TTT
acccaaccagatactatcca

SEQ ID NO: 23800 - DNA, 20 bp, Artificial Sequence
  Description of Artificial Sequence: Synthetic oligonucleotide
  Target: FXN; (-) strand; PAM type: YTN; PAM sequence: TTA
cagtgtgatatatttaccca

SEQ ID NO: 23801 - DNA, 20 bp, Artificial Sequence
  Description of Artificial Sequence: Synthetic oligonucleotide
  Target: FXN; (-) strand; PAM type: YTN; PAM sequence: TTT
acagtgtgatatatttaccc

SEQ ID NO: 23802 - DNA, 20 bp, Artificial Sequence
  Description of Artificial Sequence: Synthetic oligonucleotide
  Target: FXN; (-) strand; PAM type: YTN; PAM sequence: CTG
gatagtgtgatttacagtgt

SEQ ID NO: 23803 - DNA, 20 bp, Artificial Sequence
  Description of Artificial Sequence: Synthetic oligonucleotide
  Target: FXN; (-) strand; PAM type: YTN; PAM sequence: CTA
aaggaacctggatagtgtga

SEQ ID NO: 23804 - DNA, 20 bp, Artificial Sequence
  Description of Artificial Sequence: Synthetic oligonucleotide
  Target: FXN; (-) strand; PAM type: YTN; PAM sequence: CTG
caatcaaccaaatgtcacct

SEQ ID NO: 23805 - DNA, 20 bp, Artificial Sequence
  Description of Artificial Sequence: Synthetic oligonucleotide
  Target: FXN; (-) strand; PAM type: YTN; PAM sequence: CTG
tccatgcacaagaacagtca

SEQ ID NO: 23806 - DNA, 20 bp, Artificial Sequence
  Description of Artificial Sequence: Synthetic oligonucleotide
  Target: FXN; (-) strand; PAM type: YTN; PAM sequence: TTC
tgtccatgcacaagaacagt

SEQ ID NO: 23807 - DNA, 20 bp, Artificial Sequence
  Description of Artificial Sequence: Synthetic oligonucleotide
  Target: FXN; (-) strand; PAM type: YTN; PAM sequence: CTT
ctgtccatgcacaagaacag

SEQ ID NO: 23808 - DNA, 20 bp, Artificial Sequence
  Description of Artificial Sequence: Synthetic oligonucleotide
  Target: FXN; (-) strand; PAM type: YTN; PAM sequence: CTG
aaaggaacttctgtccatgc

SEQ ID NO: 23809 - DNA, 20 bp, Artificial Sequence
  Description of Artificial Sequence: Synthetic oligonucleotide
  Target: FXN; (-) strand; PAM type: YTN; PAM sequence: TTC
acctgaaaggaacttctgtc

SEQ ID NO: 23810 - DNA, 20 bp, Artificial Sequence
  Description of Artificial Sequence: Synthetic oligonucleotide
  Target: FXN; (-) strand; PAM type: YTN; PAM sequence: CTG
agaaattcacctgaaaggaa

SEQ ID NO: 23811 - DNA, 20 bp, Artificial Sequence
  Description of Artificial Sequence: Synthetic oligonucleotide
  Target: FXN; (-) strand; PAM type: YTN; PAM sequence: TTC
tgagaaattcacctgaaagg

SEQ ID NO: 23812 - DNA, 20 bp, Artificial Sequence
  Description of Artificial Sequence: Synthetic oligonucleotide
  Target: FXN; (-) strand; PAM type: YTN; PAM sequence: TTC
cattctgagaaattcacctg

SEQ ID NO: 23813 - DNA, 20 bp, Artificial Sequence
  Description of Artificial Sequence: Synthetic oligonucleotide
  Target: FXN; (-) strand; PAM type: YTN; PAM sequence: TTG
cccagcaattccattctgag

SEQ ID NO: 23814 - DNA, 20 bp, Artificial Sequence
  Description of Artificial Sequence: Synthetic oligonucleotide
  Target: FXN; (-) strand; PAM type: YTN; PAM sequence: TTT
gcccagcaattccattctga

SEQ ID NO: 23815 - DNA, 20 bp, Artificial Sequence
  Description of Artificial Sequence: Synthetic oligonucleotide
  Target: FXN; (-) strand; PAM type: YTN; PAM sequence: CTT
tgcccagcaattccattctg

SEQ ID NO: 23816 - DNA, 20 bp, Artificial Sequence
  Description of Artificial Sequence: Synthetic oligonucleotide
  Target: FXN; (-) strand; PAM type: YTN; PAM sequence: CTG
cccctttgcccagcaattcc

SEQ ID NO: 23817 - DNA, 20 bp, Artificial Sequence
  Description of Artificial Sequence: Synthetic oligonucleotide
  Target: FXN; (-) strand; PAM type: YTN; PAM sequence: TTG
gctgcccctttgcccagcaa

SEQ ID NO: 23818 - DNA, 20 bp, Artificial Sequence
  Description of Artificial Sequence: Synthetic oligonucleotide
  Target: FXN; (-) strand; PAM type: YTN; PAM sequence: TTA
ttggctgcccctttgcccag

SEQ ID NO: 23819 - DNA, 20 bp, Artificial Sequence
  Description of Artificial Sequence: Synthetic oligonucleotide
  Target: FXN; (-) strand; PAM type: YTN; PAM sequence: TTG
attattggctgcccctttgc

SEQ ID NO: 23820 - DNA, 20 bp, Artificial Sequence
  Description of Artificial Sequence: Synthetic oligonucleotide
  Target: FXN; (-) strand; PAM type: YTN; PAM sequence: TTG
gcatcaaatgagttgattat

SEQ ID NO: 23821 - DNA, 20 bp, Artificial Sequence
  Description of Artificial Sequence: Synthetic oligonucleotide
  Target: FXN; (-) strand; PAM type: YTN; PAM sequence: TTT
ggcatcaaatgagttgatta

SEQ ID NO: 23822 - DNA, 20 bp, Artificial Sequence
  Description of Artificial Sequence: Synthetic oligonucleotide
  Target: FXN; (-) strand; PAM type: YTN; PAM sequence: TTT
tggcatcaaatgagttgatt

SEQ ID NO: 23823 - DNA, 20 bp, Artificial Sequence
  Description of Artificial Sequence: Synthetic oligonucleotide
  Target: FXN; (-) strand; PAM type: YTN; PAM sequence: CTT
ttggcatcaaatgagttgat

SEQ ID NO: 23824 - DNA, 20 bp, Artificial Sequence
  Description of Artificial Sequence: Synthetic oligonucleotide
  Target: FXN; (-) strand; PAM type: YTN; PAM sequence: CTG
gcaccaccacttttggcatc

SEQ ID NO: 23825 - DNA, 20 bp, Artificial Sequence
  Description of Artificial Sequence: Synthetic oligonucleotide
  Target: FXN; (-) strand; PAM type: YTN; PAM sequence: CTC
gcaggggaggatgaactggc

SEQ ID NO: 23826 - DNA, 20 bp, Artificial Sequence
  Description of Artificial Sequence: Synthetic oligonucleotide
  Target: FXN; (-) strand; PAM type: YTN; PAM sequence: TTG
aagagtgaatcaggacccat

SEQ ID NO: 23827 - DNA, 20 bp, Artificial Sequence
  Description of Artificial Sequence: Synthetic oligonucleotide
  Target: FXN; (-) strand; PAM type: YTN; PAM sequence: CTT
gaagagtgaatcaggaccca

SEQ ID NO: 23828 - DNA, 20 bp, Artificial Sequence
  Description of Artificial Sequence: Synthetic oligonucleotide
  Target: FXN; (-) strand; PAM type: YTN; PAM sequence: CTG
tcaaaccacagcacttgaag

SEQ ID NO: 23829 - DNA, 20 bp, Artificial Sequence
  Description of Artificial Sequence: Synthetic oligonucleotide
  Target: FXN; (-) strand; PAM type: YTN; PAM sequence: TTG
tcacccccggccctgtcaaa

SEQ ID NO: 23830 - DNA, 20 bp, Artificial Sequence
  Description of Artificial Sequence: Synthetic oligonucleotide
  Target: FXN; (-) strand; PAM type: YTN; PAM sequence: CTT
gtcacccccggccctgtcaa

SEQ ID NO: 23831 - DNA, 20 bp, Artificial Sequence
  Description of Artificial Sequence: Synthetic oligonucleotide
  Target: FXN; (-) strand; PAM type: YTN; PAM sequence: TTC
ccaggtgtccccttgtcacc

SEQ ID NO: 23832 - DNA, 20 bp, Artificial Sequence
  Description of Artificial Sequence: Synthetic oligonucleotide
  Target: FXN; (-) strand; PAM type: YTN; PAM sequence: CTT
cccaggtgtccccttgtcac

SEQ ID NO: 23833 - DNA, 20 bp, Artificial Sequence
  Description of Artificial Sequence: Synthetic oligonucleotide
  Target: FXN; (-) strand; PAM type: YTN; PAM sequence: TTC
cttcccaggtgtccccttgt

SEQ ID NO: 23834 - DNA, 20 bp, Artificial Sequence
  Description of Artificial Sequence: Synthetic oligonucleotide
  Target: FXN; (-) strand; PAM type: YTN; PAM sequence: TTT
ccttcccaggtgtccccttg

SEQ ID NO: 23835 - DNA, 20 bp, Artificial Sequence
  Description of Artificial Sequence: Synthetic oligonucleotide
  Target: FXN; (-) strand; PAM type: YTN; PAM sequence: CTT
tccttcccaggtgtcccctt

SEQ ID NO: 23836 - DNA, 20 bp, Artificial Sequence
  Description of Artificial Sequence: Synthetic oligonucleotide
  Target: FXN; (-) strand; PAM type: YTN; PAM sequence: CTG
gatggccagcagggagccca

SEQ ID NO: 23837 - DNA, 20 bp, Artificial Sequence
  Description of Artificial Sequence: Synthetic oligonucleotide
  Target: FXN; (-) strand; PAM type: YTN; PAM sequence: CTG
gcctggatggccagcaggga

SEQ ID NO: 23838 - DNA, 20 bp, Artificial Sequence
  Description of Artificial Sequence: Synthetic oligonucleotide
  Target: FXN; (-) strand; PAM type: YTN; PAM sequence: CTG
gtaaggactggcctggatgg

SEQ ID NO: 23839 - DNA, 20 bp, Artificial Sequence
  Description of Artificial Sequence: Synthetic oligonucleotide
  Target: FXN; (-) strand; PAM type: YTN; PAM sequence: CTA
ccccctggtaaggactggcc

SEQ ID NO: 23840 - DNA, 20 bp, Artificial Sequence
  Description of Artificial Sequence: Synthetic oligonucleotide
  Target: FXN; (-) strand; PAM type: YTN; PAM sequence: TTG
cctaccccctggtaaggact

SEQ ID NO: 23841 - DNA, 20 bp, Artificial Sequence
  Description of Artificial Sequence: Synthetic oligonucleotide
  Target: FXN; (-) strand; PAM type: YTN; PAM sequence: TTG
acccaatcattgcctacccc

SEQ ID NO: 23842 - DNA, 20 bp, Artificial Sequence
  Description of Artificial Sequence: Synthetic oligonucleotide
  Target: FXN; (-) strand; PAM type: YTN; PAM sequence: CTT
gacccaatcattgcctaccc

SEQ ID NO: 23843 - DNA, 20 bp, Artificial Sequence
  Description of Artificial Sequence: Synthetic oligonucleotide
  Target: FXN; (-) strand; PAM type: YTN; PAM sequence: CTC
aggcccagtggtcaggaacc

SEQ ID NO: 23844 - DNA, 20 bp, Artificial Sequence
  Description of Artificial Sequence: Synthetic oligonucleotide
  Target: FXN; (-) strand; PAM type: YTN; PAM sequence: CTG
aagtctcaggcccagtggtc

SEQ ID NO: 23845 - DNA, 20 bp, Artificial Sequence
  Description of Artificial Sequence: Synthetic oligonucleotide
  Target: FXN; (-) strand; PAM type: YTN; PAM sequence: CTG
ggcctgaagtctcaggccca

SEQ ID NO: 23846 - DNA, 20 bp, Artificial Sequence
  Description of Artificial Sequence: Synthetic oligonucleotide
  Target: FXN; (-) strand; PAM type: YTN; PAM sequence: TTC
tgggcctgaagtctcaggcc

SEQ ID NO: 23847 - DNA, 20 bp, Artificial Sequence
  Description of Artificial Sequence: Synthetic oligonucleotide
  Target: FXN; (-) strand; PAM type: YTN; PAM sequence: TTT
ctgggcctgaagtctcaggc

SEQ ID NO: 23848 - DNA, 20 bp, Artificial Sequence
  Description of Artificial Sequence: Synthetic oligonucleotide
  Target: FXN; (-) strand; PAM type: YTN; PAM sequence: TTA
gatagtttctgggcctgaag

SEQ ID NO: 23849 - DNA, 20 bp, Artificial Sequence
  Description of Artificial Sequence: Synthetic oligonucleotide
  Target: FXN; (-) strand; PAM type: YTN; PAM sequence: TTG
aggaaatattagatagtttc

SEQ ID NO: 23850 - DNA, 20 bp, Artificial Sequence
  Description of Artificial Sequence: Synthetic oligonucleotide
  Target: FXN; (-) strand; PAM type: YTN; PAM sequence: TTT
gaggaaatattagatagttt

SEQ ID NO: 23851 - DNA, 20 bp, Artificial Sequence
  Description of Artificial Sequence: Synthetic oligonucleotide
  Target: FXN; (-) strand; PAM type: YTN; PAM sequence: CTC
atgggatgcatttgaggaaa

SEQ ID NO: 23852 - DNA, 20 bp, Artificial Sequence
  Description of Artificial Sequence: Synthetic oligonucleotide
  Target: FXN; (-) strand; PAM type: YTN; PAM sequence: CTG
ctcatgggatgcatttgagg

SEQ ID NO: 23853 - DNA, 20 bp, Artificial Sequence
  Description of Artificial Sequence: Synthetic oligonucleotide
  Target: FXN; (-) strand; PAM type: YTN; PAM sequence: CTC
acacagtgcctgctcatggg

SEQ ID NO: 23854 - DNA, 20 bp, Artificial Sequence
  Description of Artificial Sequence: Synthetic oligonucleotide
  Target: FXN; (-) strand; PAM type: YTN; PAM sequence: CTC
actcacacagtgcctgctca

SEQ ID NO: 23855 - DNA, 20 bp, Artificial Sequence
  Description of Artificial Sequence: Synthetic oligonucleotide
  Target: FXN; (-) strand; PAM type: YTN; PAM sequence: TTC
agatgtgtgtgctcactcac

SEQ ID NO: 23856 - DNA, 20 bp, Artificial Sequence
  Description of Artificial Sequence: Synthetic oligonucleotide
  Target: FXN; (-) strand; PAM type: YTN; PAM sequence: CTT
cagatgtgtgtgctcactca

SEQ ID NO: 23857 - DNA, 20 bp, Artificial Sequence
  Description of Artificial Sequence: Synthetic oligonucleotide
  Target: FXN; (-) strand; PAM type: YTN; PAM sequence: TTG
aggcttcagatgtgtgtgct

SEQ ID NO: 23858 - DNA, 20 bp, Artificial Sequence
  Description of Artificial Sequence: Synthetic oligonucleotide
  Target: FXN; (-) strand; PAM type: YTN; PAM sequence: CTT
gaggcttcagatgtgtgtgc

SEQ ID NO: 23859 - DNA, 20 bp, Artificial Sequence
  Description of Artificial Sequence: Synthetic oligonucleotide
  Target: FXN; (-) strand; PAM type: YTN; PAM sequence: CTA
gcttgaggcttcagatgtgt

SEQ ID NO: 23860 - DNA, 20 bp, Artificial Sequence
  Description of Artificial Sequence: Synthetic oligonucleotide
  Target: FXN; (-) strand; PAM type: YTN; PAM sequence: TTG
cctagcttgaggcttcagat

SEQ ID NO: 23861 - DNA, 20 bp, Artificial Sequence
  Description of Artificial Sequence: Synthetic oligonucleotide
  Target: FXN; (-) strand; PAM type: YTN; PAM sequence: CTT
gcctagcttgaggcttcaga

SEQ ID NO: 23862 - DNA, 20 bp, Artificial Sequence
  Description of Artificial Sequence: Synthetic oligonucleotide
  Target: FXN; (-) strand; PAM type: YTN; PAM sequence: TTG
gaccacaagtcatggtaggc

SEQ ID NO: 23863 - DNA, 20 bp, Artificial Sequence
  Description of Artificial Sequence: Synthetic oligonucleotide
  Target: FXN; (-) strand; PAM type: YTN; PAM sequence: CTT
ggaccacaagtcatggtagg

SEQ ID NO: 23864 - DNA, 20 bp, Artificial Sequence
  Description of Artificial Sequence: Synthetic oligonucleotide
  Target: FXN; (-) strand; PAM type: YTN; PAM sequence: CTC
caggtcacccgtgagccctt

SEQ ID NO: 23865 - DNA, 20 bp, Artificial Sequence
  Description of Artificial Sequence: Synthetic oligonucleotide
  Target: FXN; (-) strand; PAM type: YTN; PAM sequence: CTA
actccaggtcacccgtgagc

SEQ ID NO: 23866 - DNA, 20 bp, Artificial Sequence
  Description of Artificial Sequence: Synthetic oligonucleotide
  Target: FXN; (-) strand; PAM type: YTN; PAM sequence: CTC
taactccaggtcacccgtga

SEQ ID NO: 23867 - DNA, 20 bp, Artificial Sequence
  Description of Artificial Sequence: Synthetic oligonucleotide
  Target: FXN; (-) strand; PAM type: YTN; PAM sequence: CTC
cctctaactccaggtcaccc

SEQ ID NO: 23868 - DNA, 20 bp, Artificial Sequence
  Description of Artificial Sequence: Synthetic oligonucleotide
  Target: FXN; (-) strand; PAM type: YTN; PAM sequence: CTG
gcagccatgtctccctctaa

SEQ ID NO: 23869 - DNA, 20 bp, Artificial Sequence
  Description of Artificial Sequence: Synthetic oligonucleotide
  Target: FXN; (-) strand; PAM type: YTN; PAM sequence: CTA
aagccacctggcagccatgt

SEQ ID NO: 23870 - DNA, 20 bp, Artificial Sequence
  Description of Artificial Sequence: Synthetic oligonucleotide
  Target: FXN; (-) strand; PAM type: YTN; PAM sequence: TTC
taaagccacctggcagccat

SEQ ID NO: 23871 - DNA, 20 bp, Artificial Sequence
  Description of Artificial Sequence: Synthetic oligonucleotide
  Target: FXN; (-) strand; PAM type: YTN; PAM sequence: TTT
ctaaagccacctggcagcca

SEQ ID NO: 23872 - DNA, 20 bp, Artificial Sequence
  Description of Artificial Sequence: Synthetic oligonucleotide
  Target: FXN; (-) strand; PAM type: YTN; PAM sequence: CTT
tctaaagccacctggcagcc

SEQ ID NO: 23873 - DNA, 20 bp, Artificial Sequence
  Description of Artificial Sequence: Synthetic oligonucleotide
  Target: FXN; (-) strand; PAM type: YTN; PAM sequence: TTC
tttctaaagccacctggcag

SEQ ID NO: 23874 - DNA, 20 bp, Artificial Sequence
  Description of Artificial Sequence: Synthetic oligonucleotide
  Target: FXN; (-) strand; PAM type: YTN; PAM sequence: CTG
gccatgatgagtgttctttc

SEQ ID NO: 23875 - DNA, 20 bp, Artificial Sequence
  Description of Artificial Sequence: Synthetic oligonucleotide
  Target: FXN; (-) strand; PAM type: YTN; PAM sequence: TTA
caggcgtaagccaccgcacc

SEQ ID NO: 23876 - DNA, 20 bp, Artificial Sequence
  Description of Artificial Sequence: Synthetic oligonucleotide
  Target: FXN; (-) strand; PAM type: YTN; PAM sequence: CTG
ggattacaggcgtaagccac

SEQ ID NO: 23877 - DNA, 20 bp, Artificial Sequence
  Description of Artificial Sequence: Synthetic oligonucleotide
  Target: FXN; (-) strand; PAM type: YTN; PAM sequence: CTC
ccaaagtgctgggattacag

SEQ ID NO: 23878 - DNA, 20 bp, Artificial Sequence
  Description of Artificial Sequence: Synthetic oligonucleotide
  Target: FXN; (-) strand; PAM type: YTN; PAM sequence: TTG
gcctcccaaagtgctgggat

SEQ ID NO: 23879 - DNA, 20 bp, Artificial Sequence
  Description of Artificial Sequence: Synthetic oligonucleotide
  Target: FXN; (-) strand; PAM type: YTN; PAM sequence: CTT
ggcctcccaaagtgctggga

SEQ ID NO: 23880 - DNA, 20 bp, Artificial Sequence
  Description of Artificial Sequence: Synthetic oligonucleotide
  Target: FXN; (-) strand; PAM type: YTN; PAM sequence: CTC
atgatccacccaccttggcc

SEQ ID NO: 23881 - DNA, 20 bp, Artificial Sequence
  Description of Artificial Sequence: Synthetic oligonucleotide
  Target: FXN; (-) strand; PAM type: YTN; PAM sequence: CTG
acctcatgatccacccacct

SEQ ID NO: 23882 - DNA, 20 bp, Artificial Sequence
  Description of Artificial Sequence: Synthetic oligonucleotide
  Target: FXN; (-) strand; PAM type: YTN; PAM sequence: CTC
ctgacctcatgatccaccca

SEQ ID NO: 23883 - DNA, 20 bp, Artificial Sequence
  Description of Artificial Sequence: Synthetic oligonucleotide
  Target: FXN; (-) strand; PAM type: YTN; PAM sequence: CTC
actcctgacctcatgatcca

SEQ ID NO: 23884 - DNA, 20 bp, Artificial Sequence
  Description of Artificial Sequence: Synthetic oligonucleotide
  Target: FXN; (-) strand; PAM type: YTN; PAM sequence: CTG
gtctcactcctgacctcatg

SEQ ID NO: 23885 - DNA, 20 bp, Artificial Sequence
  Description of Artificial Sequence: Synthetic oligonucleotide
  Target: FXN; (-) strand; PAM type: YTN; PAM sequence: TTG
gtcaggctggtctcactcct

SEQ ID NO: 23886 - DNA, 20 bp, Artificial Sequence
  Description of Artificial Sequence: Synthetic oligonucleotide
  Target: FXN; (-) strand; PAM type: YTN; PAM sequence: TTC
agcatgttggtcaggctggt

SEQ ID NO: 23887 - DNA, 20 bp, Artificial Sequence
  Description of Artificial Sequence: Synthetic oligonucleotide
  Target: FXN; (-) strand; PAM type: YTN; PAM sequence: TTT
cagcatgttggtcaggctgg

SEQ ID NO: 23888 - DNA, 20 bp, Artificial Sequence
  Description of Artificial Sequence: Synthetic oligonucleotide
  Target: FXN; (-) strand; PAM type: YTN; PAM sequence: TTA
ggagagacaggtttcagcat

SEQ ID NO: 23889 - DNA, 20 bp, Artificial Sequence
  Description of Artificial Sequence: Synthetic oligonucleotide
  Target: FXN; (-) strand; PAM type: YTN; PAM sequence: TTT
aggagagacaggtttcagca

SEQ ID NO: 23890 - DNA, 20 bp, Artificial Sequence
  Description of Artificial Sequence: Synthetic oligonucleotide
  Target: FXN; (-) strand; PAM type: YTN; PAM sequence: TTT
taggagagacaggtttcagc

SEQ ID NO: 23891 - DNA, 20 bp, Artificial Sequence
  Description of Artificial Sequence: Synthetic oligonucleotide
  Target: FXN; (-) strand; PAM type: YTN; PAM sequence: TTT
ttaggagagacaggtttcag

SEQ ID NO: 23892 - DNA, 20 bp, Artificial Sequence
  Description of Artificial Sequence: Synthetic oligonucleotide
  Target: FXN; (-) strand; PAM type: YTN; PAM sequence: TTG
tgtttttaggagagacaggt

SEQ ID NO: 23893 - DNA, 20 bp, Artificial Sequence
  Description of Artificial Sequence: Synthetic oligonucleotide
  Target: FXN; (-) strand; PAM type: YTN; PAM sequence: TTT
gtgtttttaggagagacagg

SEQ ID NO: 23894 - DNA, 20 bp, Artificial Sequence
  Description of Artificial Sequence: Synthetic oligonucleotide
  Target: FXN; (-) strand; PAM type: YTN; PAM sequence: TTT
tgtgtttttaggagagacag

SEQ ID NO: 23895 - DNA, 20 bp, Artificial Sequence
  Description of Artificial Sequence: Synthetic oligonucleotide
  Target: FXN; (-) strand; PAM type: YTN; PAM sequence: TTT
ttgtgtttttaggagagaca

SEQ ID NO: 23896 - DNA, 20 bp, Artificial Sequence
  Description of Artificial Sequence: Synthetic oligonucleotide
  Target: FXN; (-) strand; PAM type: YTN; PAM sequence: CTA
atttttgtgtttttaggaga

SEQ ID NO: 23897 - DNA, 20 bp, Artificial Sequence
  Description of Artificial Sequence: Synthetic oligonucleotide
  Target: FXN; (-) strand; PAM type: YTN; PAM sequence: CTC
catgcccagctaatttttgt

SEQ ID NO: 23898 - DNA, 20 bp, Artificial Sequence
  Description of Artificial Sequence: Synthetic oligonucleotide
  Target: FXN; (-) strand; PAM type: YTN; PAM sequence: TTA
caggcgtgcacctccatgcc

SEQ ID NO: 23899 - DNA, 20 bp, Artificial Sequence
  Description of Artificial Sequence: Synthetic oligonucleotide
  Target: FXN; (-) strand; PAM type: YTN; PAM sequence: CTG
ggattacaggcgtgcacctc

SEQ ID NO: 23900 - DNA, 20 bp, Artificial Sequence
  Description of Artificial Sequence: Synthetic oligonucleotide
  Target: FXN; (-) strand; PAM type: YTN; PAM sequence: CTG
agtagctgggattacaggcg

SEQ ID NO: 23901 - DNA, 20 bp, Artificial Sequence
  Description of Artificial Sequence: Synthetic oligonucleotide
  Target: FXN; (-) strand; PAM type: YTN; PAM sequence: CTC
ctgagtagctgggattacag

SEQ ID NO: 23902 - DNA, 20 bp, Artificial Sequence
  Description of Artificial Sequence: Synthetic oligonucleotide
  Target: FXN; (-) strand; PAM type: YTN; PAM sequence: CTC
agcctcctgagtagctggga

SEQ ID NO: 23903 - DNA, 20 bp, Artificial Sequence
  Description of Artificial Sequence: Synthetic oligonucleotide
  Target: FXN; (-) strand; PAM type: YTN; PAM sequence: CTG
cctcagcctcctgagtagct

SEQ ID NO: 23904 - DNA, 20 bp, Artificial Sequence
  Description of Artificial Sequence: Synthetic oligonucleotide
  Target: FXN; (-) strand; PAM type: YTN; PAM sequence: CTC
ctgcctcagcctcctgagta

SEQ ID NO: 23905 - DNA, 20 bp, Artificial Sequence
  Description of Artificial Sequence: Synthetic oligonucleotide
  Target: FXN; (-) strand; PAM type: YTN; PAM sequence: TTC
tcctgcctcagcctcctgag

SEQ ID NO: 23906 - DNA, 20 bp, Artificial Sequence
  Description of Artificial Sequence: Synthetic oligonucleotide
  Target: FXN; (-) strand; PAM type: YTN; PAM sequence: TTC
aagtgattctcctgcctcag

SEQ ID NO: 23907 - DNA, 20 bp, Artificial Sequence
  Description of Artificial Sequence: Synthetic oligonucleotide
  Target: FXN; (-) strand; PAM type: YTN; PAM sequence: CTC
ccgggttcaagtgattctcc

SEQ ID NO: 23908 - DNA, 20 bp, Artificial Sequence
  Description of Artificial Sequence: Synthetic oligonucleotide
  Target: FXN; (-) strand; PAM type: YTN; PAM sequence: CTC
cgcctcccgggttcaagtga

SEQ ID NO: 23909 - DNA, 20 bp, Artificial Sequence
  Description of Artificial Sequence: Synthetic oligonucleotide
  Target: FXN; (-) strand; PAM type: YTN; PAM sequence: TTG
caacctccgcctcccgggtt

SEQ ID NO: 23910 - DNA, 20 bp, Artificial Sequence
  Description of Artificial Sequence: Synthetic oligonucleotide
  Target: FXN; (-) strand; PAM type: YTN; PAM sequence: TTA
ttgcaacctccgcctcccgg

SEQ ID NO: 23911 - DNA, 20 bp, Artificial Sequence
  Description of Artificial Sequence: Synthetic oligonucleotide
  Target: FXN; (-) strand; PAM type: YTN; PAM sequence: CTT
attgcaacctccgcctcccg

SEQ ID NO: 23912 - DNA, 20 bp, Artificial Sequence
  Description of Artificial Sequence: Synthetic oligonucleotide
  Target: FXN; (-) strand; PAM type: YTN; PAM sequence: CTA
ggcttattgcaacctccgcc

SEQ ID NO: 23913 - DNA, 20 bp, Artificial Sequence
  Description of Artificial Sequence: Synthetic oligonucleotide
  Target: FXN; (-) strand; PAM type: YTN; PAM sequence: CTG
gaatgcagtggcacaatcta

SEQ ID NO: 23914 - DNA, 20 bp, Artificial Sequence
  Description of Artificial Sequence: Synthetic oligonucleotide
  Target: FXN; (-) strand; PAM type: YTN; PAM sequence: TTG
cccaggctggaatgcagtgg

SEQ ID NO: 23915 - DNA, 20 bp, Artificial Sequence
  Description of Artificial Sequence: Synthetic oligonucleotide
  Target: FXN; (-) strand; PAM type: YTN; PAM sequence: CTG
ttgcccaggctggaatgcag

SEQ ID NO: 23916 - DNA, 20 bp, Artificial Sequence
  Description of Artificial Sequence: Synthetic oligonucleotide
  Target: FXN; (-) strand; PAM type: YTN; PAM sequence: CTC
tgttgcccaggctggaatgc

SEQ ID NO: 23917 - DNA, 20 bp, Artificial Sequence
  Description of Artificial Sequence: Synthetic oligonucleotide
  Target: FXN; (-) strand; PAM type: YTN; PAM sequence: TTG
ctctgttgcccaggctggaa

SEQ ID NO: 23918 - DNA, 20 bp, Artificial Sequence
  Description of Artificial Sequence: Synthetic oligonucleotide
  Target: FXN; (-) strand; PAM type: YTN; PAM sequence: CTT
gctctgttgcccaggctgga

SEQ ID NO: 23919 - DNA, 20 bp, Artificial Sequence
  Description of Artificial Sequence: Synthetic oligonucleotide
  Target: FXN; (-) strand; PAM type: YTN; PAM sequence: CTG
agacggagtcttgctctgtt

SEQ ID NO: 23920 - DNA, 20 bp, Artificial Sequence
  Description of Artificial Sequence: Synthetic oligonucleotide
  Target: FXN; (-) strand; PAM type: YTN; PAM sequence: TTC
tgagacggagtcttgctctg

SEQ ID NO: 23921 - DNA, 20 bp, Artificial Sequence
  Description of Artificial Sequence: Synthetic oligonucleotide
  Target: FXN; (-) strand; PAM type: YTN; PAM sequence: TTT
ctgagacggagtcttgctct

SEQ ID NO: 23922 - DNA, 20 bp, Artificial Sequence
  Description of Artificial Sequence: Synthetic oligonucleotide
  Target: FXN; (-) strand; PAM type: YTN; PAM sequence: TTT
tctgagacggagtcttgctc

SEQ ID NO: 23923 - DNA, 20 bp, Artificial Sequence
  Description of Artificial Sequence: Synthetic oligonucleotide
  Target: FXN; (-) strand; PAM type: YTN; PAM sequence: TTT
ttctgagacggagtcttgct

SEQ ID NO: 23924 - DNA, 20 bp, Artificial Sequence
  Description of Artificial Sequence: Synthetic oligonucleotide
  Target: FXN; (-) strand; PAM type: YTN; PAM sequence: TTT
tttctgagacggagtcttgc

SEQ ID NO: 23925 - DNA, 20 bp, Artificial Sequence
  Description of Artificial Sequence: Synthetic oligonucleotide
  Target: FXN; (-) strand; PAM type: YTN; PAM sequence: TTT
ttttctgagacggagtcttg

SEQ ID NO: 23926 - DNA, 20 bp, Artificial Sequence
  Description of Artificial Sequence: Synthetic oligonucleotide
  Target: FXN; (-) strand; PAM type: YTN; PAM sequence: TTT
tttttctgagacggagtctt

SEQ ID NO: 23927 - DNA, 20 bp, Artificial Sequence
  Description of Artificial Sequence: Synthetic oligonucleotide
  Target: FXN; (-) strand; PAM type: YTN; PAM sequence: TTT
ttttttctgagacggagtct

SEQ ID NO: 23928 - DNA, 20 bp, Artificial Sequence
  Description of Artificial Sequence: Synthetic oligonucleotide
  Target: FXN; (-) strand; PAM type: YTN; PAM sequence: TTT
tttttttctgagacggagtc

SEQ ID NO: 23929 - DNA, 20 bp, Artificial Sequence
  Description of Artificial Sequence: Synthetic oligonucleotide
  Target: FXN; (-) strand; PAM type: YTN; PAM sequence: TTT
ttttttttctgagacggagt

SEQ ID NO: 23930 - DNA, 20 bp, Artificial Sequence
  Description of Artificial Sequence: Synthetic oligonucleotide
  Target: FXN; (-) strand; PAM type: YTN; PAM sequence: TTT
tttttttttctgagacggag

SEQ ID NO: 23931 - DNA, 20 bp, Artificial Sequence
  Description of Artificial Sequence: Synthetic oligonucleotide
  Target: FXN; (-) strand; PAM type: YTN; PAM sequence: TTT
ttttttttttctgagacgga

SEQ ID NO: 23932 - DNA, 20 bp, Artificial Sequence
  Description of Artificial Sequence: Synthetic oligonucleotide
  Target: FXN; (-) strand; PAM type: YTN; PAM sequence: TTT
tttttttttttctgagacgg

SEQ ID NO: 23933 - DNA, 20 bp, Artificial Sequence
  Description of Artificial Sequence: Synthetic oligonucleotide
  Target: FXN; (-) strand; PAM type: YTN; PAM sequence: TTT
ttttttttttttctgagacg

SEQ ID NO: 23934 - DNA, 20 bp, Artificial Sequence
  Description of Artificial Sequence: Synthetic oligonucleotide
  Target: FXN; (-) strand; PAM type: YTN; PAM sequence: CTT
tttttttttttttctgagac

SEQ ID NO: 23935 - DNA, 20 bp, Artificial Sequence
  Description of Artificial Sequence: Synthetic oligonucleotide
  Target: FXN; (-) strand; PAM type: YTN; PAM sequence: TTC
ctttttttttttttttctga

SEQ ID NO: 23936 - DNA, 20 bp, Artificial Sequence
  Description of Artificial Sequence: Synthetic oligonucleotide
  Target: FXN; (-) strand; PAM type: YTN; PAM sequence: CTT
cctttttttttttttttctg

SEQ ID NO: 23937 - DNA, 20 bp, Artificial Sequence
  Description of Artificial Sequence: Synthetic oligonucleotide
  Target: FXN; (-) strand; PAM type: YTN; PAM sequence: TTC
ttcctttttttttttttttc

SEQ ID NO: 23938 - DNA, 20 bp, Artificial Sequence
  Description of Artificial Sequence: Synthetic oligonucleotide
  Target: FXN; (-) strand; PAM type: YTN; PAM sequence: TTG
gaggtcaaggtcataggatg

SEQ ID NO: 23939 - DNA, 20 bp, Artificial Sequence
  Description of Artificial Sequence: Synthetic oligonucleotide
  Target: FXN; (-) strand; PAM type: YTN; PAM sequence: CTT
ggaggtcaaggtcataggat

SEQ ID NO: 23940 - DNA, 20 bp, Artificial Sequence
  Description of Artificial Sequence: Synthetic oligonucleotide
  Target: FXN; (-) strand; PAM type: YTN; PAM sequence: TTG
agggaggcaaagcttggagg

SEQ ID NO: 23941 - DNA, 20 bp, Artificial Sequence
  Description of Artificial Sequence: Synthetic oligonucleotide
  Target: FXN; (-) strand; PAM type: YTN; PAM sequence: CTT
gagggaggcaaagcttggag

SEQ ID NO: 23942 - DNA, 20 bp, Artificial Sequence
  Description of Artificial Sequence: Synthetic oligonucleotide
  Target: FXN; (-) strand; PAM type: YTN; PAM sequence: CTG
cttgagggaggcaaagcttg

SEQ ID NO: 23943 - DNA, 20 bp, Artificial Sequence
  Description of Artificial Sequence: Synthetic oligonucleotide
  Target: FXN; (-) strand; PAM type: YTN; PAM sequence: TTC
tgcttgagggaggcaaagct

SEQ ID NO: 23944 - DNA, 20 bp, Artificial Sequence
  Description of Artificial Sequence: Synthetic oligonucleotide
  Target: FXN; (-) strand; PAM type: YTN; PAM sequence: CTG
ttctgcttgagggaggcaaa

SEQ ID NO: 23945 - DNA, 20 bp, Artificial Sequence
  Description of Artificial Sequence: Synthetic oligonucleotide
  Target: FXN; (-) strand; PAM type: YTN; PAM sequence: TTC
tgttctgcttgagggaggca

SEQ ID NO: 23946 - DNA, 20 bp, Artificial Sequence
  Description of Artificial Sequence: Synthetic oligonucleotide
  Target: FXN; (-) strand; PAM type: YTN; PAM sequence: CTC
cattctgttctgcttgaggg

SEQ ID NO: 23947 - DNA, 20 bp, Artificial Sequence
  Description of Artificial Sequence: Synthetic oligonucleotide
  Target: FXN; (-) strand; PAM type: YTN; PAM sequence: CTA
agggaggctccattctgttc

SEQ ID NO: 23948 - DNA, 20 bp, Artificial Sequence
  Description of Artificial Sequence: Synthetic oligonucleotide
  Target: FXN; (-) strand; PAM type: YTN; PAM sequence: CTG
cctaagggaggctccattct

SEQ ID NO: 23949 - DNA, 20 bp, Artificial Sequence
  Description of Artificial Sequence: Synthetic oligonucleotide
  Target: FXN; (-) strand; PAM type: YTN; PAM sequence: CTC
tgcctaagggaggctccatt

SEQ ID NO: 23950 - DNA, 20 bp, Artificial Sequence
  Description of Artificial Sequence: Synthetic oligonucleotide
  Target: FXN; (-) strand; PAM type: YTN; PAM sequence: TTC
cgcctctgcctaagggaggc

SEQ ID NO: 23951 - DNA, 20 bp, Artificial Sequence
  Description of Artificial Sequence: Synthetic oligonucleotide
  Target: FXN; (-) strand; PAM type: YTN; PAM sequence: CTT
ccgcctctgcctaagggagg

SEQ ID NO: 23952 - DNA, 20 bp, Artificial Sequence
  Description of Artificial Sequence: Synthetic oligonucleotide
  Target: FXN; (-) strand; PAM type: YTN; PAM sequence: CTA
ggtgagaggcaaacttccgc

SEQ ID NO: 23953 - DNA, 20 bp, Artificial Sequence
  Description of Artificial Sequence: Synthetic oligonucleotide
  Target: FXN; (-) strand; PAM type: YTN; PAM sequence: CTG
aacaaaagaatggagaacta

SEQ ID NO: 23954 - DNA, 20 bp, Artificial Sequence
  Description of Artificial Sequence: Synthetic oligonucleotide
  Target: FXN; (-) strand; PAM type: YTN; PAM sequence: CTC
tgaacaaaagaatggagaac

SEQ ID NO: 23955 - DNA, 20 bp, Artificial Sequence
  Description of Artificial Sequence: Synthetic oligonucleotide
  Target: FXN; (-) strand; PAM type: YTN; PAM sequence: TTC
aggctctgaacaaaagaatg

SEQ ID NO: 23956 - DNA, 20 bp, Artificial Sequence
  Description of Artificial Sequence: Synthetic oligonucleotide
  Target: FXN; (-) strand; PAM type: YTN; PAM sequence: CTG
agggtattcaggctctgaac

SEQ ID NO: 23957 - DNA, 20 bp, Artificial Sequence
  Description of Artificial Sequence: Synthetic oligonucleotide
  Target: FXN; (-) strand; PAM type: YTN; PAM sequence: CTC
acaaccgtgagcataaaaca

SEQ ID NO: 23958 - DNA, 20 bp, Artificial Sequence
  Description of Artificial Sequence: Synthetic oligonucleotide
  Target: FXN; (-) strand; PAM type: YTN; PAM sequence: CTC
acaacaaacctcacaaccgt

SEQ ID NO: 23959 - DNA, 20 bp, Artificial Sequence
  Description of Artificial Sequence: Synthetic oligonucleotide
  Target: FXN; (-) strand; PAM type: YTN; PAM sequence: CTG
aaggaagggatcgtggtact

SEQ ID NO: 23960 - DNA, 20 bp, Artificial Sequence
  Description of Artificial Sequence: Synthetic oligonucleotide
  Target: FXN; (-) strand; PAM type: YTN; PAM sequence: CTC
tgaaggaagggatcgtggta

SEQ ID NO: 23961 - DNA, 20 bp, Artificial Sequence
  Description of Artificial Sequence: Synthetic oligonucleotide
  Target: FXN; (-) strand; PAM type: YTN; PAM sequence: CTC
ctctgaaggaagggatcgtg

SEQ ID NO: 23962 - DNA, 20 bp, Artificial Sequence
  Description of Artificial Sequence: Synthetic oligonucleotide
  Target: FXN; (-) strand; PAM type: YTN; PAM sequence: TTA
ctcctctgaaggaagggatc

SEQ ID NO: 23963 - DNA, 20 bp, Artificial Sequence
  Description of Artificial Sequence: Synthetic oligonucleotide
  Target: FXN; (-) strand; PAM type: YTN; PAM sequence: TTT
actcctctgaaggaagggat

SEQ ID NO: 23964 - DNA, 20 bp, Artificial Sequence
  Description of Artificial Sequence: Synthetic oligonucleotide
  Target: FXN; (-) strand; PAM type: YTN; PAM sequence: CTC
agtttactcctctgaaggaa

SEQ ID NO: 23965 - DNA, 20 bp, Artificial Sequence
  Description of Artificial Sequence: Synthetic oligonucleotide
  Target: FXN; (-) strand; PAM type: YTN; PAM sequence: TTG
gaacctcagtttactcctct

SEQ ID NO: 23966 - DNA, 20 bp, Artificial Sequence
  Description of Artificial Sequence: Synthetic oligonucleotide
  Target: FXN; (-) strand; PAM type: YTN; PAM sequence: TTT
ggaacctcagtttactcctc

SEQ ID NO: 23967 - DNA, 20 bp, Artificial Sequence
  Description of Artificial Sequence: Synthetic oligonucleotide
  Target: FXN; (-) strand; PAM type: YTN; PAM sequence: TTT
tggaacctcagtttactcct

SEQ ID NO: 23968 - DNA, 20 bp, Artificial Sequence
  Description of Artificial Sequence: Synthetic oligonucleotide
  Target: FXN; (-) strand; PAM type: YTN; PAM sequence: CTT
ttggaacctcagtttactcc

SEQ ID NO: 23969 - DNA, 20 bp, Artificial Sequence
  Description of Artificial Sequence: Synthetic oligonucleotide
  Target: FXN; (-) strand; PAM type: YTN; PAM sequence: CTA
aaccttttggaacctcagtt

SEQ ID NO: 23970 - DNA, 20 bp, Artificial Sequence
  Description of Artificial Sequence: Synthetic oligonucleotide
  Target: FXN; (-) strand; PAM type: YTN; PAM sequence: CTG
ctaaaccttttggaacctca

SEQ ID NO: 23971 - DNA, 20 bp, Artificial Sequence
  Description of Artificial Sequence: Synthetic oligonucleotide
  Target: FXN; (-) strand; PAM type: YTN; PAM sequence: CTC
gggcaactgctaaacctttt

SEQ ID NO: 23972 - DNA, 20 bp, Artificial Sequence
  Description of Artificial Sequence: Synthetic oligonucleotide
  Target: FXN; (-) strand; PAM type: YTN; PAM sequence: TTC
ctcgggcaactgctaaacct

SEQ ID NO: 23973 - DNA, 20 bp, Artificial Sequence
  Description of Artificial Sequence: Synthetic oligonucleotide
  Target: FXN; (-) strand; PAM type: YTN; PAM sequence: TTA
atattcctcgggcaactgct

SEQ ID NO: 23974 - DNA, 20 bp, Artificial Sequence
  Description of Artificial Sequence: Synthetic oligonucleotide
  Target: FXN; (-) strand; PAM type: YTN; PAM sequence: TTT
aatattcctcgggcaactgc

SEQ ID NO: 23975 - DNA, 20 bp, Artificial Sequence
  Description of Artificial Sequence: Synthetic oligonucleotide
  Target: FXN; (-) strand; PAM type: YTN; PAM sequence: TTG
ccaatttaatattcctcggg

SEQ ID NO: 23976 - DNA, 20 bp, Artificial Sequence
  Description of Artificial Sequence: Synthetic oligonucleotide
  Target: FXN; (-) strand; PAM type: YTN; PAM sequence: TTT
gccaatttaatattcctcgg

SEQ ID NO: 23977 - DNA, 20 bp, Artificial Sequence
  Description of Artificial Sequence: Synthetic oligonucleotide
  Target: FXN; (-) strand; PAM type: YTN; PAM sequence: TTT
tgccaatttaatattcctcg

SEQ ID NO: 23978 - DNA, 20 bp, Artificial Sequence
  Description of Artificial Sequence: Synthetic oligonucleotide
  Target: FXN; (-) strand; PAM type: YTN; PAM sequence: CTT
ttgccaatttaatattcctc

SEQ ID NO: 23979 - DNA, 20 bp, Artificial Sequence
  Description of Artificial Sequence: Synthetic oligonucleotide
  Target: FXN; (-) strand; PAM type: YTN; PAM sequence: CTG
cttttgccaatttaatattc

SEQ ID NO: 23980 - DNA, 20 bp, Artificial Sequence
  Description of Artificial Sequence: Synthetic oligonucleotide
  Target: FXN; (-) strand; PAM type: YTN; PAM sequence: CTA
cctgcttttgccaatttaat

SEQ ID NO: 23981 - DNA, 20 bp, Artificial Sequence
  Description of Artificial Sequence: Synthetic oligonucleotide
  Target: FXN; (-) strand; PAM type: YTN; PAM sequence: TTC
tacctgcttttgccaattta

SEQ ID NO: 23982 - DNA, 20 bp, Artificial Sequence
  Description of Artificial Sequence: Synthetic oligonucleotide
  Target: FXN; (-) strand; PAM type: YTN; PAM sequence: TTA
tattctacctgcttttgcca

SEQ ID NO: 23983 - DNA, 20 bp, Artificial Sequence
  Description of Artificial Sequence: Synthetic oligonucleotide
  Target: FXN; (-) strand; PAM type: YTN; PAM sequence: TTT
atattctacctgcttttgcc

SEQ ID NO: 23984 - DNA, 20 bp, Artificial Sequence
  Description of Artificial Sequence: Synthetic oligonucleotide
  Target: FXN; (-) strand; PAM type: YTN; PAM sequence: CTT
tatattctacctgcttttgc

SEQ ID NO: 23985 - DNA, 20 bp, Artificial Sequence
  Description of Artificial Sequence: Synthetic oligonucleotide
  Target: FXN; (-) strand; PAM type: YTN; PAM sequence: TTG
ctttatattctacctgcttt

SEQ ID NO: 23986 - DNA, 20 bp, Artificial Sequence
  Description of Artificial Sequence: Synthetic oligonucleotide
  Target: FXN; (-) strand; PAM type: YTN; PAM sequence: CTT
gctttatattctacctgctt

SEQ ID NO: 23987 - DNA, 20 bp, Artificial Sequence
  Description of Artificial Sequence: Synthetic oligonucleotide
  Target: FXN; (-) strand; PAM type: YTN; PAM sequence: CTC
cttgctttatattctacctg

SEQ ID NO: 23988 - DNA, 20 bp, Artificial Sequence
  Description of Artificial Sequence: Synthetic oligonucleotide
  Target: FXN; (-) strand; PAM type: YTN; PAM sequence: TTG
ccaaatactccttgctttat

SEQ ID NO: 23989 - DNA, 20 bp, Artificial Sequence
  Description of Artificial Sequence: Synthetic oligonucleotide
  Target: FXN; (-) strand; PAM type: YTN; PAM sequence: TTA
atcataaaaaagaaccgttg

SEQ ID NO: 23990 - DNA, 20 bp, Artificial Sequence
  Description of Artificial Sequence: Synthetic oligonucleotide
  Target: FXN; (-) strand; PAM type: YTN; PAM sequence: TTT
aatcataaaaaagaaccgtt

SEQ ID NO: 23991 - DNA, 20 bp, Artificial Sequence
  Description of Artificial Sequence: Synthetic oligonucleotide
  Target: FXN; (-) strand; PAM type: YTN; PAM sequence: TTT
taatcataaaaaagaaccgt

SEQ ID NO: 23992 - DNA, 20 bp, Artificial Sequence
  Description of Artificial Sequence: Synthetic oligonucleotide
  Target: FXN; (-) strand; PAM type: YTN; PAM sequence: TTT
ttaatcataaaaaagaaccg

SEQ ID NO: 23993 - DNA, 20 bp, Artificial Sequence
  Description of Artificial Sequence: Synthetic oligonucleotide
  Target: FXN; (-) strand; PAM type: YTN; PAM sequence: CTG
tttttaatcataaaaaagaa

SEQ ID NO: 23994 - DNA, 20 bp, Artificial Sequence
  Description of Artificial Sequence: Synthetic oligonucleotide
  Target: FXN; (-) strand; PAM type: YTN; PAM sequence: TTC
ggctgtttttaatcataaaa

SEQ ID NO: 23995 - DNA, 20 bp, Artificial Sequence
  Description of Artificial Sequence: Synthetic oligonucleotide
  Target: FXN; (-) strand; PAM type: YTN; PAM sequence: CTT
cggctgtttttaatcataaa

SEQ ID NO: 23996 - DNA, 20 bp, Artificial Sequence
  Description of Artificial Sequence: Synthetic oligonucleotide
  Target: FXN; (-) strand; PAM type: YTN; PAM sequence: TTC
ttcggctgtttttaatcata

SEQ ID NO: 23997 - DNA, 20 bp, Artificial Sequence
  Description of Artificial Sequence: Synthetic oligonucleotide
  Target: FXN; (-) strand; PAM type: YTN; PAM sequence: TTT
cttcggctgtttttaatcat

SEQ ID NO: 23998 - DNA, 20 bp, Artificial Sequence
  Description of Artificial Sequence: Synthetic oligonucleotide
  Target: FXN; (-) strand; PAM type: YTN; PAM sequence: CTT
tcttcggctgtttttaatca

SEQ ID NO: 23999 - DNA, 20 bp, Artificial Sequence
  Description of Artificial Sequence: Synthetic oligonucleotide
  Target: FXN; (-) strand; PAM type: YTN; PAM sequence: TTC
aaaggcacaagtagaagtct

SEQ ID NO: 24000 - DNA, 20 bp, Artificial Sequence
  Description of Artificial Sequence: Synthetic oligonucleotide
  Target: FXN; (-) strand; PAM type: YTN; PAM sequence: CTT
caaaggcacaagtagaagtc

SEQ ID NO: 24001 - DNA, 20 bp, Artificial Sequence
  Description of Artificial Sequence: Synthetic oligonucleotide
  Target: FXN; (-) strand; PAM type: YTN; PAM sequence: CTC
cttcaaaggcacaagtagaa

SEQ ID NO: 24002 - DNA, 20 bp, Artificial Sequence
  Description of Artificial Sequence: Synthetic oligonucleotide
  Target: FXN; (-) strand; PAM type: YTN; PAM sequence: TTA
ctccttcaaaggcacaagta

SEQ ID NO: 24003 - DNA, 20 bp, Artificial Sequence
  Description of Artificial Sequence: Synthetic oligonucleotide
  Target: FXN; (-) strand; PAM type: YTN; PAM sequence: CTG
gtgggaaggtcaaatgcagt

SEQ ID NO: 24004 - DNA, 20 bp, Artificial Sequence
  Description of Artificial Sequence: Synthetic oligonucleotide
  Target: FXN; (-) strand; PAM type: YTN; PAM sequence: TTA
ctggtgggaaggtcaaatgc

SEQ ID NO: 24005 - DNA, 20 bp, Artificial Sequence
  Description of Artificial Sequence: Synthetic oligonucleotide
  Target: FXN; (-) strand; PAM type: YTN; PAM sequence: TTG
ttactggtgggaaggtcaaa

SEQ ID NO: 24006 - DNA, 20 bp, Artificial Sequence
  Description of Artificial Sequence: Synthetic oligonucleotide
  Target: FXN; (-) strand; PAM type: YTN; PAM sequence: TTG
atggttgttactggtgggaa

SEQ ID NO: 24007 - DNA, 20 bp, Artificial Sequence
  Description of Artificial Sequence: Synthetic oligonucleotide
  Target: FXN; (-) strand; PAM type: YTN; PAM sequence: TTT
gatggttgttactggtggga

SEQ ID NO: 24008 - DNA, 20 bp, Artificial Sequence
  Description of Artificial Sequence: Synthetic oligonucleotide
  Target: FXN; (-) strand; PAM type: YTN; PAM sequence: TTA
atagagatttgatggttgtt

SEQ ID NO: 24009 - DNA, 20 bp, Artificial Sequence
  Description of Artificial Sequence: Synthetic oligonucleotide
  Target: FXN; (-) strand; PAM type: YTN; PAM sequence: TTT
aatagagatttgatggttgt

SEQ ID NO: 24010 - DNA, 20 bp, Artificial Sequence
  Description of Artificial Sequence: Synthetic oligonucleotide
  Target: FXN; (-) strand; PAM type: YTN; PAM sequence: TTA
atttaatagagatttgatgg

SEQ ID NO: 24011 - DNA, 20 bp, Artificial Sequence
  Description of Artificial Sequence: Synthetic oligonucleotide
  Target: FXN; (-) strand; PAM type: YTN; PAM sequence: TTT
aatttaatagagatttgatg

SEQ ID NO: 24012 - DNA, 20 bp, Artificial Sequence
  Description of Artificial Sequence: Synthetic oligonucleotide
  Target: FXN; (-) strand; PAM type: YTN; PAM sequence: TTG
tgtgtgtgtgtgtttaattt

SEQ ID NO: 24013 - DNA, 20 bp, Artificial Sequence
  Description of Artificial Sequence: Synthetic oligonucleotide
  Target: FXN; (-) strand; PAM type: YTN; PAM sequence: TTT
gtgtgtgtgtgtgtttaatt

SEQ ID NO: 24014 - DNA, 20 bp, Artificial Sequence
  Description of Artificial Sequence: Synthetic oligonucleotide
  Target: FXN; (-) strand; PAM type: YTN; PAM sequence: TTG
tttgtgtgtgtgtgtgttta

SEQ ID NO: 24015 - DNA, 20 bp, Artificial Sequence
  Description of Artificial Sequence: Synthetic oligonucleotide
  Target: FXN; (-) strand; PAM type: YTN; PAM sequence: TTT
gtttgtgtgtgtgtgtgttt

SEQ ID NO: 24016 - DNA, 20 bp, Artificial Sequence
  Description of Artificial Sequence: Synthetic oligonucleotide
  Target: FXN; (-) strand; PAM type: YTN; PAM sequence: TTT
tgtttgtgtgtgtgtgtgtt

SEQ ID NO: 24017 - DNA, 20 bp, Artificial Sequence
  Description of Artificial Sequence: Synthetic oligonucleotide
  Target: FXN; (-) strand; PAM type: YTN; PAM sequence: TTT
ttgtttgtgtgtgtgtgtgt

SEQ ID NO: 24018 - DNA, 20 bp, Artificial Sequence
  Description of Artificial Sequence: Synthetic oligonucleotide
  Target: FXN; (-) strand; PAM type: YTN; PAM sequence: CTG
tttttgtttgtgtgtgtgtg

SEQ ID NO: 24019 - DNA, 20 bp, Artificial Sequence
  Description of Artificial Sequence: Synthetic oligonucleotide
  Target: FXN; (-) strand; PAM type: YTN; PAM sequence: TTC
acaatagctgtttttgtttg

SEQ ID NO: 24020 - DNA, 20 bp, Artificial Sequence
  Description of Artificial Sequence: Synthetic oligonucleotide
  Target: FXN; (-) strand; PAM type: YTN; PAM sequence: CTT
cacaatagctgtttttgttt

SEQ ID NO: 24021 - DNA, 20 bp, Artificial Sequence
  Description of Artificial Sequence: Synthetic oligonucleotide
  Target: FXN; (-) strand; PAM type: YTN; PAM sequence: CTG
ataccttcacaatagctgtt

SEQ ID NO: 24022 - DNA, 20 bp, Artificial Sequence
  Description of Artificial Sequence: Synthetic oligonucleotide
  Target: FXN; (-) strand; PAM type: YTN; PAM sequence: TTA
gtcgctgataccttcacaat

SEQ ID NO: 24023 - DNA, 20 bp, Artificial Sequence
  Description of Artificial Sequence: Synthetic oligonucleotide
  Target: FXN; (-) strand; PAM type: YTN; PAM sequence: CTT
agtcgctgataccttcacaa

SEQ ID NO: 24024 - DNA, 20 bp, Artificial Sequence
  Description of Artificial Sequence: Synthetic oligonucleotide
  Target: FXN; (-) strand; PAM type: YTN; PAM sequence: TTG
tcttagtcgctgataccttc

SEQ ID NO: 24025 - DNA, 20 bp, Artificial Sequence
  Description of Artificial Sequence: Synthetic oligonucleotide
  Target: FXN; (-) strand; PAM type: YTN; PAM sequence: TTA
gttgtcttagtcgctgatac

SEQ ID NO: 24026 - DNA, 20 bp, Artificial Sequence
  Description of Artificial Sequence: Synthetic oligonucleotide
  Target: FXN; (-) strand; PAM type: YTN; PAM sequence: CTT
agttgtcttagtcgctgata

SEQ ID NO: 24027 - DNA, 20 bp, Artificial Sequence
  Description of Artificial Sequence: Synthetic oligonucleotide
  Target: FXN; (-) strand; PAM type: YTN; PAM sequence: CTC
aaaccttagttgtcttagtc

SEQ ID NO: 24028 - DNA, 20 bp, Artificial Sequence
  Description of Artificial Sequence: Synthetic oligonucleotide
  Target: FXN; (-) strand; PAM type: YTN; PAM sequence: CTG
gcccctcaaaccttagttgt

SEQ ID NO: 24029 - DNA, 20 bp, Artificial Sequence
  Description of Artificial Sequence: Synthetic oligonucleotide
  Target: FXN; (-) strand; PAM type: YTN; PAM sequence: CTC
caggatcctggcccctcaaa

SEQ ID NO: 24030 - DNA, 20 bp, Artificial Sequence
  Description of Artificial Sequence: Synthetic oligonucleotide
  Target: FXN; (-) strand; PAM type: YTN; PAM sequence: CTC
tccaggatcctggcccctca

SEQ ID NO: 24031 - DNA, 20 bp, Artificial Sequence
  Description of Artificial Sequence: Synthetic oligonucleotide
  Target: FXN; (-) strand; PAM type: YTN; PAM sequence: TTC
catctctccaggatcctggc

SEQ ID NO: 24032 - DNA, 20 bp, Artificial Sequence
  Description of Artificial Sequence: Synthetic oligonucleotide
  Target: FXN; (-) strand; PAM type: YTN; PAM sequence: TTT
ccatctctccaggatcctgg

SEQ ID NO: 24033 - DNA, 20 bp, Artificial Sequence
  Description of Artificial Sequence: Synthetic oligonucleotide
  Target: FXN; (-) strand; PAM type: YTN; PAM sequence: CTC
agggaagtttccatctctcc

SEQ ID NO: 24034 - DNA, 20 bp, Artificial Sequence
  Description of Artificial Sequence: Synthetic oligonucleotide
  Target: FXN; (-) strand; PAM type: YTN; PAM sequence: CTC
acctcagggaagtttccatc

SEQ ID NO: 24035 - DNA, 20 bp, Artificial Sequence
  Description of Artificial Sequence: Synthetic oligonucleotide
  Target: FXN; (-) strand; PAM type: YTN; PAM sequence: CTG
agaatgtggggctcacctca

SEQ ID NO: 24036 - DNA, 20 bp, Artificial Sequence
  Description of Artificial Sequence: Synthetic oligonucleotide
  Target: FXN; (-) strand; PAM type: YTN; PAM sequence: CTC
aaaacatccaaggaaaagtg

SEQ ID NO: 24037 - DNA, 20 bp, Artificial Sequence
  Description of Artificial Sequence: Synthetic oligonucleotide
  Target: FXN; (-) strand; PAM type: YTN; PAM sequence: TTA
aagcagtgctcaaaacatcc

SEQ ID NO: 24038 - DNA, 20 bp, Artificial Sequence
  Description of Artificial Sequence: Synthetic oligonucleotide
  Target: FXN; (-) strand; PAM type: YTN; PAM sequence: TTC
ccaggaattaaagcagtgct

SEQ ID NO: 24039 - DNA, 20 bp, Artificial Sequence
  Description of Artificial Sequence: Synthetic oligonucleotide
  Target: FXN; (-) strand; PAM type: YTN; PAM sequence: TTT
cccaggaattaaagcagtgc

SEQ ID NO: 24040 - DNA, 20 bp, Artificial Sequence
  Description of Artificial Sequence: Synthetic oligonucleotide
  Target: FXN; (-) strand; PAM type: YTN; PAM sequence: TTT
tcccaggaattaaagcagtg

SEQ ID NO: 24041 - DNA, 20 bp, Artificial Sequence
  Description of Artificial Sequence: Synthetic oligonucleotide
  Target: FXN; (-) strand; PAM type: YTN; PAM sequence: TTG
ttttcccaggaattaaagca

SEQ ID NO: 24042 - DNA, 20 bp, Artificial Sequence
  Description of Artificial Sequence: Synthetic oligonucleotide
  Target: FXN; (-) strand; PAM type: YTN; PAM sequence: CTG
tgcacagtggaaggaattgt

SEQ ID NO: 24043 - DNA, 20 bp, Artificial Sequence
  Description of Artificial Sequence: Synthetic oligonucleotide
  Target: FXN; (-) strand; PAM type: YTN; PAM sequence: CTG
gccccagagtctgtgcacag

SEQ ID NO: 24044 - DNA, 20 bp, Artificial Sequence
  Description of Artificial Sequence: Synthetic oligonucleotide
  Target: FXN; (-) strand; PAM type: YTN; PAM sequence: CTG
tctggccccagagtctgtgc

SEQ ID NO: 24045 - DNA, 20 bp, Artificial Sequence
  Description of Artificial Sequence: Synthetic oligonucleotide
  Target: FXN; (-) strand; PAM type: YTN; PAM sequence: TTG
aacccaagctgtctggcccc

SEQ ID NO: 24046 - DNA, 20 bp, Artificial Sequence
  Description of Artificial Sequence: Synthetic oligonucleotide
  Target: FXN; (-) strand; PAM type: YTN; PAM sequence: CTG
ggattgaacccaagctgtct

SEQ ID NO: 24047 - DNA, 20 bp, Artificial Sequence
  Description of Artificial Sequence: Synthetic oligonucleotide
  Target: FXN; (-) strand; PAM type: YTN; PAM sequence: TTA
agtggcagagctgggattga

SEQ ID NO: 24048 - DNA, 20 bp, Artificial Sequence
  Description of Artificial Sequence: Synthetic oligonucleotide
  Target: FXN; (-) strand; PAM type: YTN; PAM sequence: CTA
cacagatacacagacattaa

SEQ ID NO: 24049 - DNA, 20 bp, Artificial Sequence
  Description of Artificial Sequence: Synthetic oligonucleotide
  Target: FXN; (-) strand; PAM type: YTN; PAM sequence: TTG
cctacacagatacacagaca

SEQ ID NO: 24050 - DNA, 20 bp, Artificial Sequence
  Description of Artificial Sequence: Synthetic oligonucleotide
  Target: FXN; (-) strand; PAM type: YTN; PAM sequence: CTT
gcctacacagatacacagac

SEQ ID NO: 24051 - DNA, 20 bp, Artificial Sequence
  Description of Artificial Sequence: Synthetic oligonucleotide
  Target: FXN; (-) strand; PAM type: YTN; PAM sequence: CTG
acgcaccaaagggtaacttg

SEQ ID NO: 24052 - DNA, 20 bp, Artificial Sequence
  Description of Artificial Sequence: Synthetic oligonucleotide
  Target: FXN; (-) strand; PAM type: YTN; PAM sequence: TTA
cagatgaggaaactgacgca

SEQ ID NO: 24053 - DNA, 20 bp, Artificial Sequence
  Description of Artificial Sequence: Synthetic oligonucleotide
  Target: FXN; (-) strand; PAM type: YTN; PAM sequence: TTT
acagatgaggaaactgacgc

SEQ ID NO: 24054 - DNA, 20 bp, Artificial Sequence
  Description of Artificial Sequence: Synthetic oligonucleotide
  Target: FXN; (-) strand; PAM type: YTN; PAM sequence: TTT
tacagatgaggaaactgacg

SEQ ID NO: 24055 - DNA, 20 bp, Artificial Sequence
  Description of Artificial Sequence: Synthetic oligonucleotide
  Target: FXN; (-) strand; PAM type: YTN; PAM sequence: TTG
tgttttacagatgaggaaac

SEQ ID NO: 24056 - DNA, 20 bp, Artificial Sequence
  Description of Artificial Sequence: Synthetic oligonucleotide
  Target: FXN; (-) strand; PAM type: YTN; PAM sequence: CTA
tagttgtgttttacagatga

SEQ ID NO: 24057 - DNA, 20 bp, Artificial Sequence
  Description of Artificial Sequence: Synthetic oligonucleotide
  Target: FXN; (-) strand; PAM type: YTN; PAM sequence: TTA
acgaatgaggatcaactata

SEQ ID NO: 24058 - DNA, 20 bp, Artificial Sequence
  Description of Artificial Sequence: Synthetic oligonucleotide
  Target: FXN; (-) strand; PAM type: YTN; PAM sequence: CTT
aacgaatgaggatcaactat

SEQ ID NO: 24059 - DNA, 20 bp, Artificial Sequence
  Description of Artificial Sequence: Synthetic oligonucleotide
  Target: FXN; (-) strand; PAM type: YTN; PAM sequence: CTC
ttaacgaatgaggatcaact

SEQ ID NO: 24060 - DNA, 20 bp, Artificial Sequence
  Description of Artificial Sequence: Synthetic oligonucleotide
  Target: FXN; (-) strand; PAM type: YTN; PAM sequence: TTA
acaagtacagactcttaacg

SEQ ID NO: 24061 - DNA, 20 bp, Artificial Sequence
  Description of Artificial Sequence: Synthetic oligonucleotide
  Target: FXN; (-) strand; PAM type: YTN; PAM sequence: TTA
gcaagtgagcaaattaacaa

SEQ ID NO: 24062 - DNA, 20 bp, Artificial Sequence
  Description of Artificial Sequence: Synthetic oligonucleotide
  Target: FXN; (-) strand; PAM type: YTN; PAM sequence: TTT
agcaagtgagcaaattaaca

SEQ ID NO: 24063 - DNA, 20 bp, Artificial Sequence
  Description of Artificial Sequence: Synthetic oligonucleotide
  Target: FXN; (-) strand; PAM type: YTN; PAM sequence: TTT
tagcaagtgagcaaattaac

SEQ ID NO: 24064 - DNA, 20 bp, Artificial Sequence
  Description of Artificial Sequence: Synthetic oligonucleotide
  Target: FXN; (-) strand; PAM type: YTN; PAM sequence: TTG
gggtaacaaattttagcaag

SEQ ID NO: 24065 - DNA, 20 bp, Artificial Sequence
  Description of Artificial Sequence: Synthetic oligonucleotide
  Target: FXN; (-) strand; PAM type: YTN; PAM sequence: TTT
ggggtaacaaattttagcaa

SEQ ID NO: 24066 - DNA, 20 bp, Artificial Sequence
  Description of Artificial Sequence: Synthetic oligonucleotide
  Target: FXN; (-) strand; PAM type: YTN; PAM sequence: TTT
tggggtaacaaattttagca

SEQ ID NO: 24067 - DNA, 20 bp, Artificial Sequence
  Description of Artificial Sequence: Synthetic oligonucleotide
  Target: FXN; (-) strand; PAM type: YTN; PAM sequence: CTG
attttggggtaacaaatttt

SEQ ID NO: 24068 - DNA, 20 bp, Artificial Sequence
  Description of Artificial Sequence: Synthetic oligonucleotide
  Target: FXN; (-) strand; PAM type: YTN; PAM sequence: CTA
ggggtactgattttggggta

SEQ ID NO: 24069 - DNA, 20 bp, Artificial Sequence
  Description of Artificial Sequence: Synthetic oligonucleotide
  Target: FXN; (-) strand; PAM type: YTN; PAM sequence: TTG
aaacgaccccaaaaggctag

SEQ ID NO: 24070 - DNA, 20 bp, Artificial Sequence
  Description of Artificial Sequence: Synthetic oligonucleotide
  Target: FXN; (-) strand; PAM type: YTN; PAM sequence: TTT
gaaacgaccccaaaaggcta

SEQ ID NO: 24071 - DNA, 20 bp, Artificial Sequence
  Description of Artificial Sequence: Synthetic oligonucleotide
  Target: FXN; (-) strand; PAM type: YTN; PAM sequence: CTT
tgaaacgaccccaaaaggct

SEQ ID NO: 24072 - DNA, 20 bp, Artificial Sequence
  Description of Artificial Sequence: Synthetic oligonucleotide
  Target: FXN; (-) strand; PAM type: YTN; PAM sequence: CTG
cacacatctttgaaacgacc

SEQ ID NO: 24073 - DNA, 20 bp, Artificial Sequence
  Description of Artificial Sequence: Synthetic oligonucleotide
  Target: FXN; (-) strand; PAM type: YTN; PAM sequence: CTC
tgcacacatctttgaaacga

SEQ ID NO: 24074 - DNA, 20 bp, Artificial Sequence
  Description of Artificial Sequence: Synthetic oligonucleotide
  Target: FXN; (-) strand; PAM type: YTN; PAM sequence: TTG
ccgctctgcacacatctttg

SEQ ID NO: 24075 - DNA, 20 bp, Artificial Sequence
  Description of Artificial Sequence: Synthetic oligonucleotide
  Target: FXN; (-) strand; PAM type: YTN; PAM sequence: TTT
gccgctctgcacacatcttt

SEQ ID NO: 24076 - DNA, 20 bp, Artificial Sequence
  Description of Artificial Sequence: Synthetic oligonucleotide
  Target: FXN; (-) strand; PAM type: YTN; PAM sequence: TTT
tgccgctctgcacacatctt

SEQ ID NO: 24077 - DNA, 20 bp, Artificial Sequence
  Description of Artificial Sequence: Synthetic oligonucleotide
  Target: FXN; (-) strand; PAM type: YTN; PAM sequence: TTT
ttgccgctctgcacacatct

SEQ ID NO: 24078 - DNA, 20 bp, Artificial Sequence
  Description of Artificial Sequence: Synthetic oligonucleotide
  Target: FXN; (-) strand; PAM type: YTN; PAM sequence: TTT
tttgccgctctgcacacatc

SEQ ID NO: 24079 - DNA, 20 bp, Artificial Sequence
  Description of Artificial Sequence: Synthetic oligonucleotide
  Target: FXN; (-) strand; PAM type: YTN; PAM sequence: TTT
ttttgccgctctgcacacat

SEQ ID NO: 24080 - DNA, 20 bp, Artificial Sequence
  Description of Artificial Sequence: Synthetic oligonucleotide
  Target: FXN; (-) strand; PAM type: YTN; PAM sequence: CTC
acatttttttgccgctctgc

SEQ ID NO: 24081 - DNA, 20 bp, Artificial Sequence
  Description of Artificial Sequence: Synthetic oligonucleotide
  Target: FXN; (-) strand; PAM type: YTN; PAM sequence: CTG
gaggagctcacatttttttg

SEQ ID NO: 24082 - DNA, 20 bp, Artificial Sequence
  Description of Artificial Sequence: Synthetic oligonucleotide
  Target: FXN; (-) strand; PAM type: YTN; PAM sequence: CTG
ggaacatgagcctggaggag

SEQ ID NO: 24083 - DNA, 20 bp, Artificial Sequence
  Description of Artificial Sequence: Synthetic oligonucleotide
  Target: FXN; (-) strand; PAM type: YTN; PAM sequence: TTG
gctgggaacatgagcctgga

SEQ ID NO: 24084 - DNA, 20 bp, Artificial Sequence
  Description of Artificial Sequence: Synthetic oligonucleotide
  Target: FXN; (-) strand; PAM type: YTN; PAM sequence: CTT
ggctgggaacatgagcctgg

SEQ ID NO: 24085 - DNA, 20 bp, Artificial Sequence
  Description of Artificial Sequence: Synthetic oligonucleotide
  Target: FXN; (-) strand; PAM type: YTN; PAM sequence: TTG
gaccttggctgggaacatga

SEQ ID NO: 24086 - DNA, 20 bp, Artificial Sequence
  Description of Artificial Sequence: Synthetic oligonucleotide
  Target: FXN; (-) strand; PAM type: YTN; PAM sequence: TTG
ttggaccttggctgggaaca

SEQ ID NO: 24087 - DNA, 20 bp, Artificial Sequence
  Description of Artificial Sequence: Synthetic oligonucleotide
  Target: FXN; (-) strand; PAM type: YTN; PAM sequence: TTT
gttggaccttggctgggaac

SEQ ID NO: 24088 - DNA, 20 bp, Artificial Sequence
  Description of Artificial Sequence: Synthetic oligonucleotide
  Target: FXN; (-) strand; PAM type: YTN; PAM sequence: CTT
tgttggaccttggctgggaa

SEQ ID NO: 24089 - DNA, 20 bp, Artificial Sequence
  Description of Artificial Sequence: Synthetic oligonucleotide
  Target: FXN; (-) strand; PAM type: YTN; PAM sequence: CTG
aaataagaaggcagggcagc

SEQ ID NO: 24090 - DNA, 20 bp, Artificial Sequence
  Description of Artificial Sequence: Synthetic oligonucleotide
  Target: FXN; (-) strand; PAM type: YTN; PAM sequence: CTA
tgacagctgaaataagaagg

SEQ ID NO: 24091 - DNA, 20 bp, Artificial Sequence
  Description of Artificial Sequence: Synthetic oligonucleotide
  Target: FXN; (-) strand; PAM type: YTN; PAM sequence: TTA
cactatgacagctgaaataa

SEQ ID NO: 24092 - DNA, 20 bp, Artificial Sequence
  Description of Artificial Sequence: Synthetic oligonucleotide
  Target: FXN; (-) strand; PAM type: YTN; PAM sequence: TTT
acactatgacagctgaaata

SEQ ID NO: 24093 - DNA, 20 bp, Artificial Sequence
  Description of Artificial Sequence: Synthetic oligonucleotide
  Target: FXN; (-) strand; PAM type: YTN; PAM sequence: CTG
tgaaaaggacacagtttaca

SEQ ID NO: 24094 - DNA, 20 bp, Artificial Sequence
  Description of Artificial Sequence: Synthetic oligonucleotide
  Target: FXN; (-) strand; PAM type: YTN; PAM sequence: CTA
atcagactgtgaaaaggaca

SEQ ID NO: 24095 - DNA, 20 bp, Artificial Sequence
  Description of Artificial Sequence: Synthetic oligonucleotide
  Target: FXN; (-) strand; PAM type: YTN; PAM sequence: CTG
aaaaacatggcactaatcag

SEQ ID NO: 24096 - DNA, 20 bp, Artificial Sequence
  Description of Artificial Sequence: Synthetic oligonucleotide
  Target: FXN; (-) strand; PAM type: YTN; PAM sequence: TTA
acagagaaataaccaagaaa

SEQ ID NO: 24097 - DNA, 20 bp, Artificial Sequence
  Description of Artificial Sequence: Synthetic oligonucleotide
  Target: FXN; (-) strand; PAM type: YTN; PAM sequence: TTT
aacagagaaataaccaagaa

SEQ ID NO: 24098 - DNA, 20 bp, Artificial Sequence
  Description of Artificial Sequence: Synthetic oligonucleotide
  Target: FXN; (-) strand; PAM type: YTN; PAM sequence: TTT
taacagagaaataaccaaga

SEQ ID NO: 24099 - DNA, 20 bp, Artificial Sequence
  Description of Artificial Sequence: Synthetic oligonucleotide
  Target: FXN; (-) strand; PAM type: YTN; PAM sequence: TTG
gagacaattttaacagagaa

SEQ ID NO: 24100 - DNA, 20 bp, Artificial Sequence
  Description of Artificial Sequence: Synthetic oligonucleotide
  Target: FXN; (-) strand; PAM type: YTN; PAM sequence: CTT
ggagacaattttaacagaga

SEQ ID NO: 24101 - DNA, 20 bp, Artificial Sequence
  Description of Artificial Sequence: Synthetic oligonucleotide
  Target: FXN; (-) strand; PAM type: YTN; PAM sequence: CTA
cacttggagacaattttaac

SEQ ID NO: 24102 - DNA, 20 bp, Artificial Sequence
  Description of Artificial Sequence: Synthetic oligonucleotide
  Target: FXN; (-) strand; PAM type: YTN; PAM sequence: TTG
cactacacttggagacaatt

SEQ ID NO: 24103 - DNA, 20 bp, Artificial Sequence
  Description of Artificial Sequence: Synthetic oligonucleotide
  Target: FXN; (-) strand; PAM type: YTN; PAM sequence: TTT
gcactacacttggagacaat

SEQ ID NO: 24104 - DNA, 20 bp, Artificial Sequence
  Description of Artificial Sequence: Synthetic oligonucleotide
  Target: FXN; (-) strand; PAM type: YTN; PAM sequence: CTT
tgcactacacttggagacaa

SEQ ID NO: 24105 - DNA, 20 bp, Artificial Sequence
  Description of Artificial Sequence: Synthetic oligonucleotide
  Target: FXN; (-) strand; PAM type: YTN; PAM sequence: CTA
aactttgcactacacttgga

SEQ ID NO: 24106 - DNA, 20 bp, Artificial Sequence
  Description of Artificial Sequence: Synthetic oligonucleotide
  Target: FXN; (-) strand; PAM type: YTN; PAM sequence: CTC
gtgctaaactttgcactaca

SEQ ID NO: 24107 - DNA, 20 bp, Artificial Sequence
  Description of Artificial Sequence: Synthetic oligonucleotide
  Target: FXN; (-) strand; PAM type: YTN; PAM sequence: CTC
ctcgtgctaaactttgcact

SEQ ID NO: 24108 - DNA, 20 bp, Artificial Sequence
  Description of Artificial Sequence: Synthetic oligonucleotide
  Target: FXN; (-) strand; PAM type: YTN; PAM sequence: CTG
taaggaacatcacagcctcc

SEQ ID NO: 24109 - DNA, 20 bp, Artificial Sequence
  Description of Artificial Sequence: Synthetic oligonucleotide
  Target: FXN; (-) strand; PAM type: YTN; PAM sequence: CTC
tgtaaggaacatcacagcct

SEQ ID NO: 24110 - DNA, 20 bp, Artificial Sequence
  Description of Artificial Sequence: Synthetic oligonucleotide
  Target: FXN; (-) strand; PAM type: YTN; PAM sequence: TTC
tctgtaaggaacatcacagc

SEQ ID NO: 24111 - DNA, 20 bp, Artificial Sequence
  Description of Artificial Sequence: Synthetic oligonucleotide
  Target: FXN; (-) strand; PAM type: YTN; PAM sequence: TTT
ctctgtaaggaacatcacag

SEQ ID NO: 24112 - DNA, 20 bp, Artificial Sequence
  Description of Artificial Sequence: Synthetic oligonucleotide
  Target: FXN; (-) strand; PAM type: YTN; PAM sequence: TTT
tctctgtaaggaacatcaca

SEQ ID NO: 24113 - DNA, 20 bp, Artificial Sequence
  Description of Artificial Sequence: Synthetic oligonucleotide
  Target: FXN; (-) strand; PAM type: YTN; PAM sequence: CTA
acacatgcattttctctgta

SEQ ID NO: 24114 - DNA, 20 bp, Artificial Sequence
  Description of Artificial Sequence: Synthetic oligonucleotide
  Target: FXN; (-) strand; PAM type: YTN; PAM sequence: CTC
taacacatgcattttctctg

SEQ ID NO: 24115 - DNA, 20 bp, Artificial Sequence
  Description of Artificial Sequence: Synthetic oligonucleotide
  Target: FXN; (-) strand; PAM type: YTN; PAM sequence: TTC
tctaacacatgcattttctc

SEQ ID NO: 24116 - DNA, 20 bp, Artificial Sequence
  Description of Artificial Sequence: Synthetic oligonucleotide
  Target: FXN; (-) strand; PAM type: YTN; PAM sequence: CTT
ctctaacacatgcattttct

SEQ ID NO: 24117 - DNA, 20 bp, Artificial Sequence
  Description of Artificial Sequence: Synthetic oligonucleotide
  Target: FXN; (-) strand; PAM type: YTN; PAM sequence: CTG
acaaagcttctctaacacat

SEQ ID NO: 24118 - DNA, 20 bp, Artificial Sequence
  Description of Artificial Sequence: Synthetic oligonucleotide
  Target: FXN; (-) strand; PAM type: YTN; PAM sequence: CTC
atgcctgacaaagcttctct

SEQ ID NO: 24119 - DNA, 20 bp, Artificial Sequence
  Description of Artificial Sequence: Synthetic oligonucleotide
  Target: FXN; (-) strand; PAM type: YTN; PAM sequence: TTA
actcatgcctgacaaagctt

SEQ ID NO: 24120 - DNA, 20 bp, Artificial Sequence
  Description of Artificial Sequence: Synthetic oligonucleotide
  Target: FXN; (-) strand; PAM type: YTN; PAM sequence: CTT
aactcatgcctgacaaagct

SEQ ID NO: 24121 - DNA, 20 bp, Artificial Sequence
  Description of Artificial Sequence: Synthetic oligonucleotide
  Target: FXN; (-) strand; PAM type: YTN; PAM sequence: CTC
aggacaacagcaccttaact

SEQ ID NO: 24122 - DNA, 20 bp, Artificial Sequence
  Description of Artificial Sequence: Synthetic oligonucleotide
  Target: FXN; (-) strand; PAM type: YTN; PAM sequence: TTG
atctcaggacaacagcacct

SEQ ID NO: 24123 - DNA, 20 bp, Artificial Sequence
  Description of Artificial Sequence: Synthetic oligonucleotide
  Target: FXN; (-) strand; PAM type: YTN; PAM sequence: TTA
attgatctcaggacaacagc

SEQ ID NO: 24124 - DNA, 20 bp, Artificial Sequence
  Description of Artificial Sequence: Synthetic oligonucleotide
  Target: FXN; (-) strand; PAM type: YTN; PAM sequence: CTC
aaacaacaacaacaacaaat

SEQ ID NO: 24125 - DNA, 20 bp, Artificial Sequence
  Description of Artificial Sequence: Synthetic oligonucleotide
  Target: FXN; (-) strand; PAM type: YTN; PAM sequence: CTG
tctcaaacaacaacaacaac

SEQ ID NO: 24126 - DNA, 20 bp, Artificial Sequence
  Description of Artificial Sequence: Synthetic oligonucleotide
  Target: FXN; (-) strand; PAM type: YTN; PAM sequence: CTG
ggcaacagagggagaccctg

SEQ ID NO: 24127 - DNA, 20 bp, Artificial Sequence
  Description of Artificial Sequence: Synthetic oligonucleotide
  Target: FXN; (-) strand; PAM type: YTN; PAM sequence: CTC
cagcagcctgggcaacagag

SEQ ID NO: 24128 - DNA, 20 bp, Artificial Sequence
  Description of Artificial Sequence: Synthetic oligonucleotide
  Target: FXN; (-) strand; PAM type: YTN; PAM sequence: TTG
cactccagcagcctgggcaa

SEQ ID NO: 24129 - DNA, 20 bp, Artificial Sequence
  Description of Artificial Sequence: Synthetic oligonucleotide
  Target: FXN; (-) strand; PAM type: YTN; PAM sequence: TTA
caccattgcactccagcagc

SEQ ID NO: 24130 - DNA, 20 bp, Artificial Sequence
  Description of Artificial Sequence: Synthetic oligonucleotide
  Target: FXN; (-) strand; PAM type: YTN; PAM sequence: CTA
tgattacaccattgcactcc

SEQ ID NO: 24131 - DNA, 20 bp, Artificial Sequence
  Description of Artificial Sequence: Synthetic oligonucleotide
  Target: FXN; (-) strand; PAM type: YTN; PAM sequence: CTG
cagtgagctatgattacacc

SEQ ID NO: 24132 - DNA, 20 bp, Artificial Sequence
  Description of Artificial Sequence: Synthetic oligonucleotide
  Target: FXN; (-) strand; PAM type: YTN; PAM sequence: TTG
agccagagaggtagaggctg

SEQ ID NO: 24133 - DNA, 20 bp, Artificial Sequence
  Description of Artificial Sequence: Synthetic oligonucleotide
  Target: FXN; (-) strand; PAM type: YTN; PAM sequence: CTT
gagccagagaggtagaggct

SEQ ID NO: 24134 - DNA, 20 bp, Artificial Sequence
  Description of Artificial Sequence: Synthetic oligonucleotide
  Target: FXN; (-) strand; PAM type: YTN; PAM sequence: TTG
cttgagccagagaggtagag

SEQ ID NO: 24135 - DNA, 20 bp, Artificial Sequence
  Description of Artificial Sequence: Synthetic oligonucleotide
  Target: FXN; (-) strand; PAM type: YTN; PAM sequence: CTC
aggaggccgaggtgggagga

SEQ ID NO: 24136 - DNA, 20 bp, Artificial Sequence
  Description of Artificial Sequence: Synthetic oligonucleotide
  Target: FXN; (-) strand; PAM type: YTN; PAM sequence: CTA
ctcaggaggccgaggtggga

SEQ ID NO: 24137 - DNA, 20 bp, Artificial Sequence
  Description of Artificial Sequence: Synthetic oligonucleotide
  Target: FXN; (-) strand; PAM type: YTN; PAM sequence: CTG
tagtcccagctactcaggag

SEQ ID NO: 24138 - DNA, 20 bp, Artificial Sequence
  Description of Artificial Sequence: Synthetic oligonucleotide
  Target: FXN; (-) strand; PAM type: YTN; PAM sequence: CTG
ggtgtggtggggtgtacctg

SEQ ID NO: 24139 - DNA, 20 bp, Artificial Sequence
  Description of Artificial Sequence: Synthetic oligonucleotide
  Target: FXN; (-) strand; PAM type: YTN; PAM sequence: TTA
tctgggtgtggtggggtgta

SEQ ID NO: 24140 - DNA, 20 bp, Artificial Sequence
  Description of Artificial Sequence: Synthetic oligonucleotide
  Target: FXN; (-) strand; PAM type: YTN; PAM sequence: CTA
aaaaaatatcaaaaacatta

SEQ ID NO: 24141 - DNA, 20 bp, Artificial Sequence
  Description of Artificial Sequence: Synthetic oligonucleotide
  Target: FXN; (-) strand; PAM type: YTN; PAM sequence: TTC
cacctaaaaaaatatcaaaa

SEQ ID NO: 24142 - DNA, 20 bp, Artificial Sequence
  Description of Artificial Sequence: Synthetic oligonucleotide
  Target: FXN; (-) strand; PAM type: YTN; PAM sequence: CTG
ggtgatgagcaaaattccac

SEQ ID NO: 24143 - DNA, 20 bp, Artificial Sequence
  Description of Artificial Sequence: Synthetic oligonucleotide
  Target: FXN; (-) strand; PAM type: YTN; PAM sequence: CTC
cagcctgggtgatgagcaaa

SEQ ID NO: 24144 - DNA, 20 bp, Artificial Sequence
  Description of Artificial Sequence: Synthetic oligonucleotide
  Target: FXN; (-) strand; PAM type: YTN; PAM sequence: TTG
cactccagcctgggtgatga

SEQ ID NO: 24145 - DNA, 20 bp, Artificial Sequence
  Description of Artificial Sequence: Synthetic oligonucleotide
  Target: FXN; (-) strand; PAM type: YTN; PAM sequence: TTG
cagtgagccaggatcgcacc

SEQ ID NO: 24146 - DNA, 20 bp, Artificial Sequence
  Description of Artificial Sequence: Synthetic oligonucleotide
  Target: FXN; (-) strand; PAM type: YTN; PAM sequence: TTG
aatccgggaggtggaggttg

SEQ ID NO: 24147 - DNA, 20 bp, Artificial Sequence
  Description of Artificial Sequence: Synthetic oligonucleotide
  Target: FXN; (-) strand; PAM type: YTN; PAM sequence: CTT
gaatccgggaggtggaggtt

SEQ ID NO: 24148 - DNA, 20 bp, Artificial Sequence
  Description of Artificial Sequence: Synthetic oligonucleotide
  Target: FXN; (-) strand; PAM type: YTN; PAM sequence: TTG
cttgaatccgggaggtggag

SEQ ID NO: 24149 - DNA, 20 bp, Artificial Sequence
  Description of Artificial Sequence: Synthetic oligonucleotide
  Target: FXN; (-) strand; PAM type: YTN; PAM sequence: CTG
aggcagaagaattgcttgaa

SEQ ID NO: 24150 - DNA, 20 bp, Artificial Sequence
  Description of Artificial Sequence: Synthetic oligonucleotide
  Target: FXN; (-) strand; PAM type: YTN; PAM sequence: CTC
aggaggctgaggcagaagaa

SEQ ID NO: 24151 - DNA, 20 bp, Artificial Sequence
  Description of Artificial Sequence: Synthetic oligonucleotide
  Target: FXN; (-) strand; PAM type: YTN; PAM sequence: CTA
ctcaggaggctgaggcagaa

SEQ ID NO: 24152 - DNA, 20 bp, Artificial Sequence
  Description of Artificial Sequence: Synthetic oligonucleotide
  Target: FXN; (-) strand; PAM type: YTN; PAM sequence: CTG
tgctactcaggaggctgagg

SEQ ID NO: 24153 - DNA, 20 bp, Artificial Sequence
  Description of Artificial Sequence: Synthetic oligonucleotide
  Target: FXN; (-) strand; PAM type: YTN; PAM sequence: CTG
taatctgtgctactcaggag

SEQ ID NO: 24154 - DNA, 20 bp, Artificial Sequence
  Description of Artificial Sequence: Synthetic oligonucleotide
  Target: FXN; (-) strand; PAM type: YTN; PAM sequence: TTA
gcaaggcgtgatgacatgtg

SEQ ID NO: 24155 - DNA, 20 bp, Artificial Sequence
  Description of Artificial Sequence: Synthetic oligonucleotide
  Target: FXN; (-) strand; PAM type: YTN; PAM sequence: CTA
aaaacacaaaaattagcaag

SEQ ID NO: 24156 - DNA, 20 bp, Artificial Sequence
  Description of Artificial Sequence: Synthetic oligonucleotide
  Target: FXN; (-) strand; PAM type: YTN; PAM sequence: CTA
ctaaaaacacaaaaattagc

SEQ ID NO: 24157 - DNA, 20 bp, Artificial Sequence
  Description of Artificial Sequence: Synthetic oligonucleotide
  Target: FXN; (-) strand; PAM type: YTN; PAM sequence: CTC
tactaaaaacacaaaaatta

SEQ ID NO: 24158 - DNA, 20 bp, Artificial Sequence
  Description of Artificial Sequence: Synthetic oligonucleotide
  Target: FXN; (-) strand; PAM type: YTN; PAM sequence: CTG
gccaacatggtgaaaccccg

SEQ ID NO: 24159 - DNA, 20 bp, Artificial Sequence
  Description of Artificial Sequence: Synthetic oligonucleotide
  Target: FXN; (-) strand; PAM type: YTN; PAM sequence: CTA
gcctggccaacatggtgaaa

SEQ ID NO: 24160 - DNA, 20 bp, Artificial Sequence
  Description of Artificial Sequence: Synthetic oligonucleotide
  Target: FXN; (-) strand; PAM type: YTN; PAM sequence: TTC
aagactagcctggccaacat

SEQ ID NO: 24161 - DNA, 20 bp, Artificial Sequence
  Description of Artificial Sequence: Synthetic oligonucleotide
  Target: FXN; (-) strand; PAM type: YTN; PAM sequence: CTG
aggtcaggagttcaagacta

SEQ ID NO: 24162 - DNA, 20 bp, Artificial Sequence
  Description of Artificial Sequence: Synthetic oligonucleotide
  Target: FXN; (-) strand; PAM type: YTN; PAM sequence: TTG
ggaggcggaggcgggtggat

SEQ ID NO: 24163 - DNA, 20 bp, Artificial Sequence
  Description of Artificial Sequence: Synthetic oligonucleotide
  Target: FXN; (-) strand; PAM type: YTN; PAM sequence: TTT
gggaggcggaggcgggtgga

SEQ ID NO: 24164 - DNA, 20 bp, Artificial Sequence
  Description of Artificial Sequence: Synthetic oligonucleotide
  Target: FXN; (-) strand; PAM type: YTN; PAM sequence: CTG
cagtttgggaggcggaggcg

SEQ ID NO: 24165 - DNA, 20 bp, Artificial Sequence
  Description of Artificial Sequence: Synthetic oligonucleotide
  Target: FXN; (-) strand; PAM type: YTN; PAM sequence: CTC
tgcagtttgggaggcggagg

SEQ ID NO: 24166 - DNA, 20 bp, Artificial Sequence
  Description of Artificial Sequence: Synthetic oligonucleotide
  Target: FXN; (-) strand; PAM type: YTN; PAM sequence: CTA
taatctctgcagtttgggag

SEQ ID NO: 24167 - DNA, 20 bp, Artificial Sequence
  Description of Artificial Sequence: Synthetic oligonucleotide
  Target: FXN; (-) strand; PAM type: YTN; PAM sequence: TTC
gtgcctataatctctgcagt

SEQ ID NO: 24168 - DNA, 20 bp, Artificial Sequence
  Description of Artificial Sequence: Synthetic oligonucleotide
  Target: FXN; (-) strand; PAM type: YTN; PAM sequence: TTG
tggttcgtgcctataatctc

SEQ ID NO: 24169 - DNA, 20 bp, Artificial Sequence
  Description of Artificial Sequence: Synthetic oligonucleotide
  Target: FXN; (-) strand; PAM type: YTN; PAM sequence: TTG
aaaaataaaaaacatgaggc

SEQ ID NO: 24170 - DNA, 20 bp, Artificial Sequence
  Description of Artificial Sequence: Synthetic oligonucleotide
  Target: FXN; (-) strand; PAM type: YTN; PAM sequence: CTT
gaaaaataaaaaacatgagg

SEQ ID NO: 24171 - DNA, 20 bp, Artificial Sequence
  Description of Artificial Sequence: Synthetic oligonucleotide
  Target: FXN; (-) strand; PAM type: YTN; PAM sequence: TTC
aacttgaaaaataaaaaaca

SEQ ID NO: 24172 - DNA, 20 bp, Artificial Sequence
  Description of Artificial Sequence: Synthetic oligonucleotide
  Target: FXN; (-) strand; PAM type: YTN; PAM sequence: TTT
caacttgaaaaataaaaaac

SEQ ID NO: 24173 - DNA, 20 bp, Artificial Sequence
  Description of Artificial Sequence: Synthetic oligonucleotide
  Target: FXN; (-) strand; PAM type: YTN; PAM sequence: CTC
atttcaacttgaaaaataaa

SEQ ID NO: 24174 - DNA, 20 bp, Artificial Sequence
  Description of Artificial Sequence: Synthetic oligonucleotide
  Target: FXN; (-) strand; PAM type: YTN; PAM sequence: CTG
ggcaacatagagagacctca

SEQ ID NO: 24175 - DNA, 20 bp, Artificial Sequence
  Description of Artificial Sequence: Synthetic oligonucleotide
  Target: FXN; (-) strand; PAM type: YTN; PAM sequence: TTG
agaccaacctgggcaacata

SEQ ID NO: 24176 - DNA, 20 bp, Artificial Sequence
  Description of Artificial Sequence: Synthetic oligonucleotide
  Target: FXN; (-) strand; PAM type: YTN; PAM sequence: TTT
gagaccaacctgggcaacat

SEQ ID NO: 24177 - DNA, 20 bp, Artificial Sequence
  Description of Artificial Sequence: Synthetic oligonucleotide
  Target: FXN; (-) strand; PAM type: YTN; PAM sequence: CTC
aagagtttgagaccaacctg

SEQ ID NO: 24178 - DNA, 20 bp, Artificial Sequence
  Description of Artificial Sequence: Synthetic oligonucleotide
  Target: FXN; (-) strand; PAM type: YTN; PAM sequence: TTG
agctcaagagtttgagacca

SEQ ID NO: 24179 - DNA, 20 bp, Artificial Sequence
  Description of Artificial Sequence: Synthetic oligonucleotide
  Target: FXN; (-) strand; PAM type: YTN; PAM sequence: CTT
gagctcaagagtttgagacc

SEQ ID NO: 24180 - DNA, 20 bp, Artificial Sequence
  Description of Artificial Sequence: Synthetic oligonucleotide
  Target: FXN; (-) strand; PAM type: YTN; PAM sequence: TTA
cttgagctcaagagtttgag

SEQ ID NO: 24181 - DNA, 20 bp, Artificial Sequence
  Description of Artificial Sequence: Synthetic oligonucleotide
  Target: FXN; (-) strand; PAM type: YTN; PAM sequence: TTG
ggaggccaaggtgggaggat

SEQ ID NO: 24182 - DNA, 20 bp, Artificial Sequence
  Description of Artificial Sequence: Synthetic oligonucleotide
  Target: FXN; (-) strand; PAM type: YTN; PAM sequence: TTT
gggaggccaaggtgggagga

SEQ ID NO: 24183 - DNA, 20 bp, Artificial Sequence
  Description of Artificial Sequence: Synthetic oligonucleotide
  Target: FXN; (-) strand; PAM type: YTN; PAM sequence: CTT
tgggaggccaaggtgggagg

SEQ ID NO: 24184 - DNA, 20 bp, Artificial Sequence
  Description of Artificial Sequence: Synthetic oligonucleotide
  Target: FXN; (-) strand; PAM type: YTN; PAM sequence: CTG
taatccccgcactttgggag

SEQ ID NO: 24185 - DNA, 20 bp, Artificial Sequence
  Description of Artificial Sequence: Synthetic oligonucleotide
  Target: FXN; (-) strand; PAM type: YTN; PAM sequence: CTC
acacctgtaatccccgcact

SEQ ID NO: 24186 - DNA, 20 bp, Artificial Sequence
  Description of Artificial Sequence: Synthetic oligonucleotide
  Target: FXN; (-) strand; PAM type: YTN; PAM sequence: CTG
ggcatggtagctcacacctg

SEQ ID NO: 24187 - DNA, 20 bp, Artificial Sequence
  Description of Artificial Sequence: Synthetic oligonucleotide
  Target: FXN; (-) strand; PAM type: YTN; PAM sequence: TTG
gctgggcatggtagctcaca

SEQ ID NO: 24188 - DNA, 20 bp, Artificial Sequence
  Description of Artificial Sequence: Synthetic oligonucleotide
  Target: FXN; (-) strand; PAM type: YTN; PAM sequence: CTT
ggctgggcatggtagctcac

SEQ ID NO: 24189 - DNA, 20 bp, Artificial Sequence
  Description of Artificial Sequence: Synthetic oligonucleotide
  Target: FXN; (-) strand; PAM type: YTN; PAM sequence: CTG
atcttggctgggcatggtag

SEQ ID NO: 24190 - DNA, 20 bp, Artificial Sequence
  Description of Artificial Sequence: Synthetic oligonucleotide
  Target: FXN; (-) strand; PAM type: YTN; PAM sequence: TTA
acactgatcttggctgggca

SEQ ID NO: 24191 - DNA, 20 bp, Artificial Sequence
  Description of Artificial Sequence: Synthetic oligonucleotide
  Target: FXN; (-) strand; PAM type: YTN; PAM sequence: TTC
attaacactgatcttggctg

SEQ ID NO: 24192 - DNA, 20 bp, Artificial Sequence
  Description of Artificial Sequence: Synthetic oligonucleotide
  Target: FXN; (-) strand; PAM type: YTN; PAM sequence: TTG
attcattaacactgatcttg

SEQ ID NO: 24193 - DNA, 20 bp, Artificial Sequence
  Description of Artificial Sequence: Synthetic oligonucleotide
  Target: FXN; (-) strand; PAM type: YTN; PAM sequence: TTA
tgtaatatatatagttgatt

SEQ ID NO: 24194 - DNA, 20 bp, Artificial Sequence
  Description of Artificial Sequence: Synthetic oligonucleotide
  Target: FXN; (-) strand; PAM type: YTN; PAM sequence: CTT
atgtaatatatatagttgat

SEQ ID NO: 24195 - DNA, 20 bp, Artificial Sequence
  Description of Artificial Sequence: Synthetic oligonucleotide
  Target: FXN; (-) strand; PAM type: YTN; PAM sequence: TTA
aagacaccttatgtaatata

SEQ ID NO: 24196 - DNA, 20 bp, Artificial Sequence
  Description of Artificial Sequence: Synthetic oligonucleotide
  Target: FXN; (-) strand; PAM type: YTN; PAM sequence: TTT
aaagacaccttatgtaatat

SEQ ID NO: 24197 - DNA, 20 bp, Artificial Sequence
  Description of Artificial Sequence: Synthetic oligonucleotide
  Target: FXN; (-) strand; PAM type: YTN; PAM sequence: CTG
tttaaagacaccttatgtaa

SEQ ID NO: 24198 - DNA, 20 bp, Artificial Sequence
  Description of Artificial Sequence: Synthetic oligonucleotide
  Target: FXN; (-) strand; PAM type: YTN; PAM sequence: TTC
tgtttaaagacaccttatgt

SEQ ID NO: 24199 - DNA, 20 bp, Artificial Sequence
  Description of Artificial Sequence: Synthetic oligonucleotide
  Target: FXN; (-) strand; PAM type: YTN; PAM sequence: TTT
ctgtttaaagacaccttatg

SEQ ID NO: 24200 - DNA, 20 bp, Artificial Sequence
  Description of Artificial Sequence: Synthetic oligonucleotide
  Target: FXN; (-) strand; PAM type: YTN; PAM sequence: TTA
tttctgtttaaagacacctt

SEQ ID NO: 24201 - DNA, 20 bp, Artificial Sequence
  Description of Artificial Sequence: Synthetic oligonucleotide
  Target: FXN; (-) strand; PAM type: YTN; PAM sequence: CTT
atttctgtttaaagacacct

SEQ ID NO: 24202 - DNA, 20 bp, Artificial Sequence
  Description of Artificial Sequence: Synthetic oligonucleotide
  Target: FXN; (-) strand; PAM type: YTN; PAM sequence: TTA
ccaatcgatcaatatataac

SEQ ID NO: 24203 - DNA, 20 bp, Artificial Sequence
  Description of Artificial Sequence: Synthetic oligonucleotide
  Target: FXN; (-) strand; PAM type: YTN; PAM sequence: TTG
ttaccaatcgatcaatatat

SEQ ID NO: 24204 - DNA, 20 bp, Artificial Sequence
  Description of Artificial Sequence: Synthetic oligonucleotide
  Target: FXN; (-) strand; PAM type: YTN; PAM sequence: CTG
gtcacaacattgttaccaat

SEQ ID NO: 24205 - DNA, 20 bp, Artificial Sequence
  Description of Artificial Sequence: Synthetic oligonucleotide
  Target: FXN; (-) strand; PAM type: YTN; PAM sequence: CTG
ctggtcacaacattgttacc

SEQ ID NO: 24206 - DNA, 20 bp, Artificial Sequence
  Description of Artificial Sequence: Synthetic oligonucleotide
  Target: FXN; (-) strand; PAM type: YTN; PAM sequence: CTG
taagctgctggtcacaacat

SEQ ID NO: 24207 - DNA, 20 bp, Artificial Sequence
  Description of Artificial Sequence: Synthetic oligonucleotide
  Target: FXN; (-) strand; PAM type: YTN; PAM sequence: CTA
ggtaccctgtaagctgctgg

SEQ ID NO: 24208 - DNA, 20 bp, Artificial Sequence
  Description of Artificial Sequence: Synthetic oligonucleotide
  Target: FXN; (-) strand; PAM type: YTN; PAM sequence: TTA
taggagaaatacaaggctag

SEQ ID NO: 24209 - DNA, 20 bp, Artificial Sequence
  Description of Artificial Sequence: Synthetic oligonucleotide
  Target: FXN; (-) strand; PAM type: YTN; PAM sequence: TTT
ataggagaaatacaaggcta

SEQ ID NO: 24210 - DNA, 20 bp, Artificial Sequence
  Description of Artificial Sequence: Synthetic oligonucleotide
  Target: FXN; (-) strand; PAM type: YTN; PAM sequence: TTA
tttataggagaaatacaagg

SEQ ID NO: 24211 - DNA, 20 bp, Artificial Sequence
  Description of Artificial Sequence: Synthetic oligonucleotide
  Target: FXN; (-) strand; PAM type: YTN; PAM sequence: CTC
aacgagcaaattatttatag

SEQ ID NO: 24212 - DNA, 20 bp, Artificial Sequence
  Description of Artificial Sequence: Synthetic oligonucleotide
  Target: FXN; (-) strand; PAM type: YTN; PAM sequence: TTG
ccacaaacactcaacgagca

SEQ ID NO: 24213 - DNA, 20 bp, Artificial Sequence
  Description of Artificial Sequence: Synthetic oligonucleotide
  Target: FXN; (-) strand; PAM type: YTN; PAM sequence: CTA
caaagttgccacaaacactc

SEQ ID NO: 24214 - DNA, 20 bp, Artificial Sequence
  Description of Artificial Sequence: Synthetic oligonucleotide
  Target: FXN; (-) strand; PAM type: YTN; PAM sequence: TTA
tgtgctacaaagttgccaca

SEQ ID NO: 24215 - DNA, 20 bp, Artificial Sequence
  Description of Artificial Sequence: Synthetic oligonucleotide
  Target: FXN; (-) strand; PAM type: YTN; PAM sequence: TTG
gtagttatgtgctacaaagt

SEQ ID NO: 24216 - DNA, 20 bp, Artificial Sequence
  Description of Artificial Sequence: Synthetic oligonucleotide
  Target: FXN; (-) strand; PAM type: YTN; PAM sequence: CTT
ggtagttatgtgctacaaag

SEQ ID NO: 24217 - DNA, 20 bp, Artificial Sequence
  Description of Artificial Sequence: Synthetic oligonucleotide
  Target: FXN; (-) strand; PAM type: YTN; PAM sequence: TTC
ttggtagttatgtgctacaa

SEQ ID NO: 24218 - DNA, 20 bp, Artificial Sequence
  Description of Artificial Sequence: Synthetic oligonucleotide
  Target: FXN; (-) strand; PAM type: YTN; PAM sequence: TTA
ttcttggtagttatgtgcta

SEQ ID NO: 24219 - DNA, 20 bp, Artificial Sequence
  Description of Artificial Sequence: Synthetic oligonucleotide
  Target: FXN; (-) strand; PAM type: YTN; PAM sequence: CTT
attcttggtagttatgtgct

SEQ ID NO: 24220 - DNA, 20 bp, Artificial Sequence
  Description of Artificial Sequence: Synthetic oligonucleotide
  Target: FXN; (-) strand; PAM type: YTN; PAM sequence: TTA
cagtccttattcttggtagt

SEQ ID NO: 24221 - DNA, 20 bp, Artificial Sequence
  Description of Artificial Sequence: Synthetic oligonucleotide
  Target: FXN; (-) strand; PAM type: YTN; PAM sequence: TTA
ttacagtccttattcttggt

SEQ ID NO: 24222 - DNA, 20 bp, Artificial Sequence
  Description of Artificial Sequence: Synthetic oligonucleotide
  Target: FXN; (-) strand; PAM type: YTN; PAM sequence: CTT
attacagtccttattcttgg

SEQ ID NO: 24223 - DNA, 20 bp, Artificial Sequence
  Description of Artificial Sequence: Synthetic oligonucleotide
  Target: FXN; (-) strand; PAM type: YTN; PAM sequence: CTC
ttattacagtccttattctt

SEQ ID NO: 24224 - DNA, 20 bp, Artificial Sequence
  Description of Artificial Sequence: Synthetic oligonucleotide
  Target: FXN; (-) strand; PAM type: YTN; PAM sequence: CTG
tgagggacgtactcttatta

SEQ ID NO: 24225 - DNA, 20 bp, Artificial Sequence
  Description of Artificial Sequence: Synthetic oligonucleotide
  Target: FXN; (-) strand; PAM type: YTN; PAM sequence: TTA
caatcctgtgagggacgtac

SEQ ID NO: 24226 - DNA, 20 bp, Artificial Sequence
  Description of Artificial Sequence: Synthetic oligonucleotide
  Target: FXN; (-) strand; PAM type: YTN; PAM sequence: TTC
attacaatcctgtgagggac

SEQ ID NO: 24227 - DNA, 20 bp, Artificial Sequence
  Description of Artificial Sequence: Synthetic oligonucleotide
  Target: FXN; (-) strand; PAM type: YTN; PAM sequence: CTT
cattacaatcctgtgaggga

SEQ ID NO: 24228 - DNA, 20 bp, Artificial Sequence
  Description of Artificial Sequence: Synthetic oligonucleotide
  Target: FXN; (-) strand; PAM type: YTN; PAM sequence: CTC
agtcttcattacaatcctgt

SEQ ID NO: 24229 - DNA, 20 bp, Artificial Sequence
  Description of Artificial Sequence: Synthetic oligonucleotide
  Target: FXN; (-) strand; PAM type: YTN; PAM sequence: TTA
tgtaaatggactcagtcttc

SEQ ID NO: 24230 - DNA, 20 bp, Artificial Sequence
  Description of Artificial Sequence: Synthetic oligonucleotide
  Target: FXN; (-) strand; PAM type: YTN; PAM sequence: TTT
atgtaaatggactcagtctt

SEQ ID NO: 24231 - DNA, 20 bp, Artificial Sequence
  Description of Artificial Sequence: Synthetic oligonucleotide
  Target: FXN; (-) strand; PAM type: YTN; PAM sequence: CTT
tatgtaaatggactcagtct

SEQ ID NO: 24232 - DNA, 20 bp, Artificial Sequence
  Description of Artificial Sequence: Synthetic oligonucleotide
  Target: FXN; (-) strand; PAM type: YTN; PAM sequence: CTC
agcctttatgtaaatggact

SEQ ID NO: 24233 - DNA, 20 bp, Artificial Sequence
  Description of Artificial Sequence: Synthetic oligonucleotide
  Target: FXN; (-) strand; PAM type: YTN; PAM sequence: CTC
tcagcctttatgtaaatgga

SEQ ID NO: 24234 - DNA, 20 bp, Artificial Sequence
  Description of Artificial Sequence: Synthetic oligonucleotide
  Target: FXN; (-) strand; PAM type: YTN; PAM sequence: CTG
ctctcagcctttatgtaaat

SEQ ID NO: 24235 - DNA, 20 bp, Artificial Sequence
  Description of Artificial Sequence: Synthetic oligonucleotide
  Target: FXN; (-) strand; PAM type: YTN; PAM sequence: TTG
acactgctctcagcctttat

SEQ ID NO: 24236 - DNA, 20 bp, Artificial Sequence
  Description of Artificial Sequence: Synthetic oligonucleotide
  Target: FXN; (-) strand; PAM type: YTN; PAM sequence: CTT
gacactgctctcagccttta

SEQ ID NO: 24237 - DNA, 20 bp, Artificial Sequence
  Description of Artificial Sequence: Synthetic oligonucleotide
  Target: FXN; (-) strand; PAM type: YTN; PAM sequence: CTG
cttgacactgctctcagcct

SEQ ID NO: 24238 - DNA, 20 bp, Artificial Sequence
  Description of Artificial Sequence: Synthetic oligonucleotide
  Target: FXN; (-) strand; PAM type: YTN; PAM sequence: CTC
catctgcttgacactgctct

SEQ ID NO: 24239 - DNA, 20 bp, Artificial Sequence
  Description of Artificial Sequence: Synthetic oligonucleotide
  Target: FXN; (-) strand; PAM type: YTN; PAM sequence: TTC
tccatctgcttgacactgct

SEQ ID NO: 24240 - DNA, 20 bp, Artificial Sequence
  Description of Artificial Sequence: Synthetic oligonucleotide
  Target: FXN; (-) strand; PAM type: YTN; PAM sequence: CTA
cagtgttctccatctgcttg

SEQ ID NO: 24241 - DNA, 20 bp, Artificial Sequence
  Description of Artificial Sequence: Synthetic oligonucleotide
  Target: FXN; (-) strand; PAM type: YTN; PAM sequence: TTC
tacagtgttctccatctgct

SEQ ID NO: 24242 - DNA, 20 bp, Artificial Sequence
  Description of Artificial Sequence: Synthetic oligonucleotide
  Target: FXN; (-) strand; PAM type: YTN; PAM sequence: CTA
tcgcacattctacagtgttc

SEQ ID NO: 24243 - DNA, 20 bp, Artificial Sequence
  Description of Artificial Sequence: Synthetic oligonucleotide
  Target: FXN; (-) strand; PAM type: YTN; PAM sequence: TTA
gagctatcgcacattctaca

SEQ ID NO: 24244 - DNA, 20 bp, Artificial Sequence
  Description of Artificial Sequence: Synthetic oligonucleotide
  Target: FXN; (-) strand; PAM type: YTN; PAM sequence: CTG
ttagagctatcgcacattct

SEQ ID NO: 24245 - DNA, 20 bp, Artificial Sequence
  Description of Artificial Sequence: Synthetic oligonucleotide
  Target: FXN; (-) strand; PAM type: YTN; PAM sequence: CTG
aagaagtgagagggcagcca

SEQ ID NO: 24246 - DNA, 20 bp, Artificial Sequence
  Description of Artificial Sequence: Synthetic oligonucleotide
  Target: FXN; (-) strand; PAM type: YTN; PAM sequence: CTC
tgaagaagtgagagggcagc

SEQ ID NO: 24247 - DNA, 20 bp, Artificial Sequence
  Description of Artificial Sequence: Synthetic oligonucleotide
  Target: FXN; (-) strand; PAM type: YTN; PAM sequence: TTA
gaaacacatgtctctgaaga

SEQ ID NO: 24248 - DNA, 20 bp, Artificial Sequence
  Description of Artificial Sequence: Synthetic oligonucleotide
  Target: FXN; (-) strand; PAM type: YTN; PAM sequence: CTT
agaaacacatgtctctgaag

SEQ ID NO: 24249 - DNA, 20 bp, Artificial Sequence
  Description of Artificial Sequence: Synthetic oligonucleotide
  Target: FXN; (-) strand; PAM type: YTN; PAM sequence: CTG
ggggacagtggatggggagg

SEQ ID NO: 24250 - DNA, 20 bp, Artificial Sequence
  Description of Artificial Sequence: Synthetic oligonucleotide
  Target: FXN; (-) strand; PAM type: YTN; PAM sequence: CTG
ggaagtaagtggaggaggaa

SEQ ID NO: 24251 - DNA, 20 bp, Artificial Sequence
  Description of Artificial Sequence: Synthetic oligonucleotide
  Target: FXN; (-) strand; PAM type: YTN; PAM sequence: CTC
agaaaagagaaggcagaagg

SEQ ID NO: 24252 - DNA, 20 bp, Artificial Sequence
  Description of Artificial Sequence: Synthetic oligonucleotide
  Target: FXN; (-) strand; PAM type: YTN; PAM sequence: TTA
gcaaactcagaaaagagaag

SEQ ID NO: 24253 - DNA, 20 bp, Artificial Sequence
  Description of Artificial Sequence: Synthetic oligonucleotide
  Target: FXN; (-) strand; PAM type: YTN; PAM sequence: CTT
agcaaactcagaaaagagaa

SEQ ID NO: 24254 - DNA, 20 bp, Artificial Sequence
  Description of Artificial Sequence: Synthetic oligonucleotide
  Target: FXN; (-) strand; PAM type: YTN; PAM sequence: TTG
agccagcagtgcccttagca

SEQ ID NO: 24255 - DNA, 20 bp, Artificial Sequence
  Description of Artificial Sequence: Synthetic oligonucleotide
  Target: FXN; (-) strand; PAM type: YTN; PAM sequence: CTT
gagccagcagtgcccttagc

SEQ ID NO: 24256 - DNA, 20 bp, Artificial Sequence
  Description of Artificial Sequence: Synthetic oligonucleotide
  Target: FXN; (-) strand; PAM type: YTN; PAM sequence: CTC
ttgagccagcagtgccctta

SEQ ID NO: 24257 - DNA, 20 bp, Artificial Sequence
  Description of Artificial Sequence: Synthetic oligonucleotide
  Target: FXN; (-) strand; PAM type: YTN; PAM sequence: CTG
ctcttgagccagcagtgccc

SEQ ID NO: 24258 - DNA, 20 bp, Artificial Sequence
  Description of Artificial Sequence: Synthetic oligonucleotide
  Target: FXN; (-) strand; PAM type: YTN; PAM sequence: TTA
ctgctcttgagccagcagtg

SEQ ID NO: 24259 - DNA, 20 bp, Artificial Sequence
  Description of Artificial Sequence: Synthetic oligonucleotide
  Target: FXN; (-) strand; PAM type: YTN; PAM sequence: TTA
gttactgctcttgagccagc

SEQ ID NO: 24260 - DNA, 20 bp, Artificial Sequence
  Description of Artificial Sequence: Synthetic oligonucleotide
  Target: FXN; (-) strand; PAM type: YTN; PAM sequence: CTG
ttagttactgctcttgagcc

SEQ ID NO: 24261 - DNA, 20 bp, Artificial Sequence
  Description of Artificial Sequence: Synthetic oligonucleotide
  Target: FXN; (-) strand; PAM type: YTN; PAM sequence: TTG
ccatggagagaagaggcgag

SEQ ID NO: 24262 - DNA, 20 bp, Artificial Sequence
  Description of Artificial Sequence: Synthetic oligonucleotide
  Target: FXN; (-) strand; PAM type: YTN; PAM sequence: CTG
gttgccatggagagaagagg

SEQ ID NO: 24263 - DNA, 20 bp, Artificial Sequence
  Description of Artificial Sequence: Synthetic oligonucleotide
  Target: FXN; (-) strand; PAM type: YTN; PAM sequence: CTC
caaaggtcactggttgccat

SEQ ID NO: 24264 - DNA, 20 bp, Artificial Sequence
  Description of Artificial Sequence: Synthetic oligonucleotide
  Target: FXN; (-) strand; PAM type: YTN; PAM sequence: TTC
tccaaaggtcactggttgcc

SEQ ID NO: 24265 - DNA, 20 bp, Artificial Sequence
  Description of Artificial Sequence: Synthetic oligonucleotide
  Target: FXN; (-) strand; PAM type: YTN; PAM sequence: TTA
cattctccaaaggtcactgg

SEQ ID NO: 24266 - DNA, 20 bp, Artificial Sequence
  Description of Artificial Sequence: Synthetic oligonucleotide
  Target: FXN; (-) strand; PAM type: YTN; PAM sequence: TTT
acattctccaaaggtcactg

SEQ ID NO: 24267 - DNA, 20 bp, Artificial Sequence
  Description of Artificial Sequence: Synthetic oligonucleotide
  Target: FXN; (-) strand; PAM type: YTN; PAM sequence: TTG
gtgataaggtttacattctc

SEQ ID NO: 24268 - DNA, 20 bp, Artificial Sequence
  Description of Artificial Sequence: Synthetic oligonucleotide
  Target: FXN; (-) strand; PAM type: YTN; PAM sequence: TTA
agagattggtgataaggttt

SEQ ID NO: 24269 - DNA, 20 bp, Artificial Sequence
  Description of Artificial Sequence: Synthetic oligonucleotide
  Target: FXN; (-) strand; PAM type: YTN; PAM sequence: TTT
aagagattggtgataaggtt

SEQ ID NO: 24270 - DNA, 20 bp, Artificial Sequence
  Description of Artificial Sequence: Synthetic oligonucleotide
  Target: FXN; (-) strand; PAM type: YTN; PAM sequence: CTT
taagagattggtgataaggt

SEQ ID NO: 24271 - DNA, 20 bp, Artificial Sequence
  Description of Artificial Sequence: Synthetic oligonucleotide
  Target: FXN; (-) strand; PAM type: YTN; PAM sequence: CTG
ggaaggcaccgaagggcttt

SEQ ID NO: 24272 - DNA, 20 bp, Artificial Sequence
  Description of Artificial Sequence: Synthetic oligonucleotide
  Target: FXN; (-) strand; PAM type: YTN; PAM sequence: CTG
gacgtcatcctgggaaggca

SEQ ID NO: 24273 - DNA, 20 bp, Artificial Sequence
  Description of Artificial Sequence: Synthetic oligonucleotide
  Target: FXN; (-) strand; PAM type: YTN; PAM sequence: CTC
agctggacgtcatcctggga

SEQ ID NO: 24274 - DNA, 20 bp, Artificial Sequence
  Description of Artificial Sequence: Synthetic oligonucleotide
  Target: FXN; (-) strand; PAM type: YTN; PAM sequence: TTG
ccaaggacctcagctggacg

SEQ ID NO: 24275 - DNA, 20 bp, Artificial Sequence
  Description of Artificial Sequence: Synthetic oligonucleotide
  Target: FXN; (-) strand; PAM type: YTN; PAM sequence: CTT
gccaaggacctcagctggac

SEQ ID NO: 24276 - DNA, 20 bp, Artificial Sequence
  Description of Artificial Sequence: Synthetic oligonucleotide
  Target: FXN; (-) strand; PAM type: YTN; PAM sequence: CTG
ggtcttgccaaggacctcag

SEQ ID NO: 24277 - DNA, 20 bp, Artificial Sequence
  Description of Artificial Sequence: Synthetic oligonucleotide
  Target: FXN; (-) strand; PAM type: YTN; PAM sequence: CTG
gagtagggagatgcagggga

SEQ ID NO: 24278 - DNA, 20 bp, Artificial Sequence
  Description of Artificial Sequence: Synthetic oligonucleotide
  Target: FXN; (-) strand; PAM type: YTN; PAM sequence: CTG
gggcacaagagtggtgcagc

SEQ ID NO: 24279 - DNA, 20 bp, Artificial Sequence
  Description of Artificial Sequence: Synthetic oligonucleotide
  Target: FXN; (-) strand; PAM type: YTN; PAM sequence: CTG
gggagatgaaggaaataatc

SEQ ID NO: 24280 - DNA, 20 bp, Artificial Sequence
  Description of Artificial Sequence: Synthetic oligonucleotide
  Target: FXN; (-) strand; PAM type: YTN; PAM sequence: CTG
accagctggggagatgaagg

SEQ ID NO: 24281 - DNA, 20 bp, Artificial Sequence
  Description of Artificial Sequence: Synthetic oligonucleotide
  Target: FXN; (-) strand; PAM type: YTN; PAM sequence: CTG
ctgaccagctggggagatga

SEQ ID NO: 24282 - DNA, 20 bp, Artificial Sequence
  Description of Artificial Sequence: Synthetic oligonucleotide
  Target: FXN; (-) strand; PAM type: YTN; PAM sequence: CTC
tgctgaccagctggggagat

SEQ ID NO: 24283 - DNA, 20 bp, Artificial Sequence
  Description of Artificial Sequence: Synthetic oligonucleotide
  Target: FXN; (-) strand; PAM type: YTN; PAM sequence: TTA
ccaccagctctgctgaccag

SEQ ID NO: 24284 - DNA, 20 bp, Artificial Sequence
  Description of Artificial Sequence: Synthetic oligonucleotide
  Target: FXN; (-) strand; PAM type: YTN; PAM sequence: TTG
attaccaccagctctgctga

SEQ ID NO: 24285 - DNA, 20 bp, Artificial Sequence
  Description of Artificial Sequence: Synthetic oligonucleotide
  Target: FXN; (-) strand; PAM type: YTN; PAM sequence: CTG
agttgattaccaccagctct

SEQ ID NO: 24286 - DNA, 20 bp, Artificial Sequence
  Description of Artificial Sequence: Synthetic oligonucleotide
  Target: FXN; (-) strand; PAM type: YTN; PAM sequence: CTG
gacatccaggtgacagggtc

SEQ ID NO: 24287 - DNA, 20 bp, Artificial Sequence
  Description of Artificial Sequence: Synthetic oligonucleotide
  Target: FXN; (-) strand; PAM type: YTN; PAM sequence: CTG
ctggacatccaggtgacagg

SEQ ID NO: 24288 - DNA, 20 bp, Artificial Sequence
  Description of Artificial Sequence: Synthetic oligonucleotide
  Target: FXN; (-) strand; PAM type: YTN; PAM sequence: CTA
actgctggacatccaggtga

SEQ ID NO: 24289 - DNA, 20 bp, Artificial Sequence
  Description of Artificial Sequence: Synthetic oligonucleotide
  Target: FXN; (-) strand; PAM type: YTN; PAM sequence: TTA
gtccctaactgctggacatc

SEQ ID NO: 24290 - DNA, 20 bp, Artificial Sequence
  Description of Artificial Sequence: Synthetic oligonucleotide
  Target: FXN; (-) strand; PAM type: YTN; PAM sequence: TTT
agtccctaactgctggacat

SEQ ID NO: 24291 - DNA, 20 bp, Artificial Sequence
  Description of Artificial Sequence: Synthetic oligonucleotide
  Target: FXN; (-) strand; PAM type: YTN; PAM sequence: TTT
tagtccctaactgctggaca

SEQ ID NO: 24292 - DNA, 20 bp, Artificial Sequence
  Description of Artificial Sequence: Synthetic oligonucleotide
  Target: FXN; (-) strand; PAM type: YTN; PAM sequence: TTT
ttagtccctaactgctggac

SEQ ID NO: 24293 - DNA, 20 bp, Artificial Sequence
  Description of Artificial Sequence: Synthetic oligonucleotide
  Target: FXN; (-) strand; PAM type: YTN; PAM sequence: TTT
tttagtccctaactgctgga

SEQ ID NO: 24294 - DNA, 20 bp, Artificial Sequence
  Description of Artificial Sequence: Synthetic oligonucleotide
  Target: FXN; (-) strand; PAM type: YTN; PAM sequence: TTT
ttttagtccctaactgctgg

SEQ ID NO: 24295 - DNA, 20 bp, Artificial Sequence
  Description of Artificial Sequence: Synthetic oligonucleotide
  Target: FXN; (-) strand; PAM type: YTN; PAM sequence: TTT
tttttagtccctaactgctg

SEQ ID NO: 24296 - DNA, 20 bp, Artificial Sequence
  Description of Artificial Sequence: Synthetic oligonucleotide
  Target: FXN; (-) strand; PAM type: YTN; PAM sequence: TTG
attttttttagtccctaact

SEQ ID NO: 24297 - DNA, 20 bp, Artificial Sequence
  Description of Artificial Sequence: Synthetic oligonucleotide
  Target: FXN; (-) strand; PAM type: YTN; PAM sequence: CTG
ttgattttttttagtcccta

SEQ ID NO: 24298 - DNA, 20 bp, Artificial Sequence
  Description of Artificial Sequence: Synthetic oligonucleotide
  Target: FXN; (-) strand; PAM type: YTN; PAM sequence: CTG
caggacagaatgtgacctgt

SEQ ID NO: 24299 - DNA, 20 bp, Artificial Sequence
  Description of Artificial Sequence: Synthetic oligonucleotide
  Target: FXN; (-) strand; PAM type: YTN; PAM sequence: TTA
tcatgatctgcaggacagaa

SEQ ID NO: 24300 - DNA, 20 bp, Artificial Sequence
  Description of Artificial Sequence: Synthetic oligonucleotide
  Target: FXN; (-) strand; PAM type: YTN; PAM sequence: TTA
ttatcatgatctgcaggaca

SEQ ID NO: 24301 - DNA, 20 bp, Artificial Sequence
  Description of Artificial Sequence: Synthetic oligonucleotide
  Target: FXN; (-) strand; PAM type: YTN; PAM sequence: CTT
attatcatgatctgcaggac

SEQ ID NO: 24302 - DNA, 20 bp, Artificial Sequence
  Description of Artificial Sequence: Synthetic oligonucleotide
  Target: FXN; (-) strand; PAM type: YTN; PAM sequence: CTG
acagatcttattatcatgat

SEQ ID NO: 24303 - DNA, 20 bp, Artificial Sequence
  Description of Artificial Sequence: Synthetic oligonucleotide
  Target: FXN; (-) strand; PAM type: YTN; PAM sequence: CTG
tctgacagatcttattatca

SEQ ID NO: 24304 - DNA, 20 bp, Artificial Sequence
  Description of Artificial Sequence: Synthetic oligonucleotide
  Target: FXN; (-) strand; PAM type: YTN; PAM sequence: CTG
ctgtctgacagatcttatta

SEQ ID NO: 24305 - DNA, 20 bp, Artificial Sequence
  Description of Artificial Sequence: Synthetic oligonucleotide
  Target: FXN; (-) strand; PAM type: YTN; PAM sequence: CTG
actgctgtctgacagatctt

SEQ ID NO: 24306 - DNA, 20 bp, Artificial Sequence
  Description of Artificial Sequence: Synthetic oligonucleotide
  Target: FXN; (-) strand; PAM type: YTN; PAM sequence: CTG
ctgactgctgtctgacagat

SEQ ID NO: 24307 - DNA, 20 bp, Artificial Sequence
  Description of Artificial Sequence: Synthetic oligonucleotide
  Target: FXN; (-) strand; PAM type: YTN; PAM sequence: CTG
actgctgactgctgtctgac

SEQ ID NO: 24308 - DNA, 20 bp, Artificial Sequence
  Description of Artificial Sequence: Synthetic oligonucleotide
  Target: FXN; (-) strand; PAM type: YTN; PAM sequence: CTC
tgactgctgactgctgtctg

SEQ ID NO: 24309 - DNA, 20 bp, Artificial Sequence
  Description of Artificial Sequence: Synthetic oligonucleotide
  Target: FXN; (-) strand; PAM type: YTN; PAM sequence: TTG
gctctgactgctgactgctg

SEQ ID NO: 24310 - DNA, 20 bp, Artificial Sequence
  Description of Artificial Sequence: Synthetic oligonucleotide
  Target: FXN; (-) strand; PAM type: YTN; PAM sequence: TTT
ggctctgactgctgactgct

SEQ ID NO: 24311 - DNA, 20 bp, Artificial Sequence
  Description of Artificial Sequence: Synthetic oligonucleotide
  Target: FXN; (-) strand; PAM type: YTN; PAM sequence: CTG
aagtccagaagatttggctc

SEQ ID NO: 24312 - DNA, 20 bp, Artificial Sequence
  Description of Artificial Sequence: Synthetic oligonucleotide
  Target: FXN; (-) strand; PAM type: YTN; PAM sequence: CTG
ctgaagtccagaagatttgg

SEQ ID NO: 24313 - DNA, 20 bp, Artificial Sequence
  Description of Artificial Sequence: Synthetic oligonucleotide
  Target: FXN; (-) strand; PAM type: YTN; PAM sequence: CTA
agagaggcaacaggaaatag

SEQ ID NO: 24314 - DNA, 20 bp, Artificial Sequence
  Description of Artificial Sequence: Synthetic oligonucleotide
  Target: FXN; (-) strand; PAM type: YTN; PAM sequence: TTA
aaaggtcactaagagaggca

SEQ ID NO: 24315 - DNA, 20 bp, Artificial Sequence
  Description of Artificial Sequence: Synthetic oligonucleotide
  Target: FXN; (-) strand; PAM type: YTN; PAM sequence: CTT
aaaaggtcactaagagaggc

SEQ ID NO: 24316 - DNA, 20 bp, Artificial Sequence
  Description of Artificial Sequence: Synthetic oligonucleotide
  Target: FXN; (-) strand; PAM type: YTN; PAM sequence: CTC
ttaaaaggtcactaagagag

SEQ ID NO: 24317 - DNA, 20 bp, Artificial Sequence
  Description of Artificial Sequence: Synthetic oligonucleotide
  Target: FXN; (-) strand; PAM type: YTN; PAM sequence: CTG
ggaggcatccacaatgctct

SEQ ID NO: 24318 - DNA, 20 bp, Artificial Sequence
  Description of Artificial Sequence: Synthetic oligonucleotide
  Target: FXN; (-) strand; PAM type: YTN; PAM sequence: TTA
gcaggaggctgggaggcatc

SEQ ID NO: 24319 - DNA, 20 bp, Artificial Sequence
  Description of Artificial Sequence: Synthetic oligonucleotide
  Target: FXN; (-) strand; PAM type: YTN; PAM sequence: TTA
cagggtggttagcaggaggc

SEQ ID NO: 24320 - DNA, 20 bp, Artificial Sequence
  Description of Artificial Sequence: Synthetic oligonucleotide
  Target: FXN; (-) strand; PAM type: YTN; PAM sequence: TTC
aggttacagggtggttagca

SEQ ID NO: 24321 - DNA, 20 bp, Artificial Sequence
  Description of Artificial Sequence: Synthetic oligonucleotide
  Target: FXN; (-) strand; PAM type: YTN; PAM sequence: CTG
ttcaggttacagggtggtta

SEQ ID NO: 24322 - DNA, 20 bp, Artificial Sequence
  Description of Artificial Sequence: Synthetic oligonucleotide
  Target: FXN; (-) strand; PAM type: YTN; PAM sequence: CTG
caggctgttcaggttacagg

SEQ ID NO: 24323 - DNA, 20 bp, Artificial Sequence
  Description of Artificial Sequence: Synthetic oligonucleotide
  Target: FXN; (-) strand; PAM type: YTN; PAM sequence: CTG
ctgcaggctgttcaggttac

SEQ ID NO: 24324 - DNA, 20 bp, Artificial Sequence
  Description of Artificial Sequence: Synthetic oligonucleotide
  Target: FXN; (-) strand; PAM type: YTN; PAM sequence: CTG
ggcagggctgctgcaggctg

SEQ ID NO: 24325 - DNA, 20 bp, Artificial Sequence
  Description of Artificial Sequence: Synthetic oligonucleotide
  Target: FXN; (-) strand; PAM type: YTN; PAM sequence: CTA
ctgggcagggctgctgcagg

SEQ ID NO: 24326 - DNA, 20 bp, Artificial Sequence
  Description of Artificial Sequence: Synthetic oligonucleotide
  Target: FXN; (-) strand; PAM type: YTN; PAM sequence: TTC
tactgggcagggctgctgca

SEQ ID NO: 24327 - DNA, 20 bp, Artificial Sequence
  Description of Artificial Sequence: Synthetic oligonucleotide
  Target: FXN; (-) strand; PAM type: YTN; PAM sequence: TTC
catcacatcaggaagttcta

SEQ ID NO: 24328 - DNA, 20 bp, Artificial Sequence
  Description of Artificial Sequence: Synthetic oligonucleotide
  Target: FXN; (-) strand; PAM type: YTN; PAM sequence: TTT
ccatcacatcaggaagttct

SEQ ID NO: 24329 - DNA, 20 bp, Artificial Sequence
  Description of Artificial Sequence: Synthetic oligonucleotide
  Target: FXN; (-) strand; PAM type: YTN; PAM sequence: CTA
gtggtgcagacacagcattt

SEQ ID NO: 24330 - DNA, 20 bp, Artificial Sequence
  Description of Artificial Sequence: Synthetic oligonucleotide
  Target: FXN; (-) strand; PAM type: YTN; PAM sequence: CTG
tggccacatgtggctagtgg

SEQ ID NO: 24331 - DNA, 20 bp, Artificial Sequence
  Description of Artificial Sequence: Synthetic oligonucleotide
  Target: FXN; (-) strand; PAM type: YTN; PAM sequence: TTC
gagaatcctgtggccacatg

SEQ ID NO: 24332 - DNA, 20 bp, Artificial Sequence
  Description of Artificial Sequence: Synthetic oligonucleotide
  Target: FXN; (-) strand; PAM type: YTN; PAM sequence: TTT
cgagaatcctgtggccacat

SEQ ID NO: 24333 - DNA, 20 bp, Artificial Sequence
  Description of Artificial Sequence: Synthetic oligonucleotide
  Target: FXN; (-) strand; PAM type: YTN; PAM sequence: CTG
caccaccagtttcgagaatc

SEQ ID NO: 24334 - DNA, 20 bp, Artificial Sequence
  Description of Artificial Sequence: Synthetic oligonucleotide
  Target: FXN; (-) strand; PAM type: YTN; PAM sequence: CTC
aactgcaccaccagtttcga

SEQ ID NO: 24335 - DNA, 20 bp, Artificial Sequence
  Description of Artificial Sequence: Synthetic oligonucleotide
  Target: FXN; (-) strand; PAM type: YTN; PAM sequence: CTC
ctcaactgcaccaccagttt

SEQ ID NO: 24336 - DNA, 20 bp, Artificial Sequence
  Description of Artificial Sequence: Synthetic oligonucleotide
  Target: FXN; (-) strand; PAM type: YTN; PAM sequence: TTA
atgagataaaatataaagtc

SEQ ID NO: 24337 - DNA, 20 bp, Artificial Sequence
  Description of Artificial Sequence: Synthetic oligonucleotide
  Target: FXN; (-) strand; PAM type: YTN; PAM sequence: TTT
aatgagataaaatataaagt

SEQ ID NO: 24338 - DNA, 20 bp, Artificial Sequence
  Description of Artificial Sequence: Synthetic oligonucleotide
  Target: FXN; (-) strand; PAM type: YTN; PAM sequence: TTA
aatttaatgagataaaatat

SEQ ID NO: 24339 - DNA, 20 bp, Artificial Sequence
  Description of Artificial Sequence: Synthetic oligonucleotide
  Target: FXN; (-) strand; PAM type: YTN; PAM sequence: TTT
aaatttaatgagataaaata

SEQ ID NO: 24340 - DNA, 20 bp, Artificial Sequence
  Description of Artificial Sequence: Synthetic oligonucleotide
  Target: FXN; (-) strand; PAM type: YTN; PAM sequence: TTA
catttaaatttaatgagata

SEQ ID NO: 24341 - DNA, 20 bp, Artificial Sequence
  Description of Artificial Sequence: Synthetic oligonucleotide
  Target: FXN; (-) strand; PAM type: YTN; PAM sequence: TTT
acatttaaatttaatgagat

SEQ ID NO: 24342 - DNA, 20 bp, Artificial Sequence
  Description of Artificial Sequence: Synthetic oligonucleotide
  Target: FXN; (-) strand; PAM type: YTN; PAM sequence: CTA
tttacatttaaatttaatga

SEQ ID NO: 24343 - DNA, 20 bp, Artificial Sequence
  Description of Artificial Sequence: Synthetic oligonucleotide
  Target: FXN; (-) strand; PAM type: YTN; PAM sequence: CTA
gccaacaagccacacgtagc

SEQ ID NO: 24344 - DNA, 20 bp, Artificial Sequence
  Description of Artificial Sequence: Synthetic oligonucleotide
  Target: FXN; (-) strand; PAM type: YTN; PAM sequence: TTC
caataggctagccaacaagc

SEQ ID NO: 24345 - DNA, 20 bp, Artificial Sequence
  Description of Artificial Sequence: Synthetic oligonucleotide
  Target: FXN; (-) strand; PAM type: YTN; PAM sequence: TTT
ccaataggctagccaacaag

SEQ ID NO: 24346 - DNA, 20 bp, Artificial Sequence
  Description of Artificial Sequence: Synthetic oligonucleotide
  Target: FXN; (-) strand; PAM type: YTN; PAM sequence: TTT
tccaataggctagccaacaa

SEQ ID NO: 24347 - DNA, 20 bp, Artificial Sequence
  Description of Artificial Sequence: Synthetic oligonucleotide
  Target: FXN; (-) strand; PAM type: YTN; PAM sequence: CTA
agcccgtgttttccaatagg

SEQ ID NO: 24348 - DNA, 20 bp, Artificial Sequence
  Description of Artificial Sequence: Synthetic oligonucleotide
  Target: FXN; (-) strand; PAM type: YTN; PAM sequence: CTC
taagcccgtgttttccaata

SEQ ID NO: 24349 - DNA, 20 bp, Artificial Sequence
  Description of Artificial Sequence: Synthetic oligonucleotide
  Target: FXN; (-) strand; PAM type: YTN; PAM sequence: CTC
tctaagcccgtgttttccaa

SEQ ID NO: 24350 - DNA, 20 bp, Artificial Sequence
  Description of Artificial Sequence: Synthetic oligonucleotide
  Target: FXN; (-) strand; PAM type: YTN; PAM sequence: CTG
tgtctctctaagcccgtgtt

SEQ ID NO: 24351 - DNA, 20 bp, Artificial Sequence
  Description of Artificial Sequence: Synthetic oligonucleotide
  Target: FXN; (-) strand; PAM type: YTN; PAM sequence: CTC
cctgtgtctctctaagcccg

SEQ ID NO: 24352 - DNA, 20 bp, Artificial Sequence
  Description of Artificial Sequence: Synthetic oligonucleotide
  Target: FXN; (-) strand; PAM type: YTN; PAM sequence: TTC
tccctgtgtctctctaagcc

SEQ ID NO: 24353 - DNA, 20 bp, Artificial Sequence
  Description of Artificial Sequence: Synthetic oligonucleotide
  Target: FXN; (-) strand; PAM type: YTN; PAM sequence: TTA
cagtgattctccctgtgtct

SEQ ID NO: 24354 - DNA, 20 bp, Artificial Sequence
  Description of Artificial Sequence: Synthetic oligonucleotide
  Target: FXN; (-) strand; PAM type: YTN; PAM sequence: TTA
gtgcattacagtgattctcc

SEQ ID NO: 24355 - DNA, 20 bp, Artificial Sequence
  Description of Artificial Sequence: Synthetic oligonucleotide
  Target: FXN; (-) strand; PAM type: YTN; PAM sequence: TTT
agtgcattacagtgattctc

SEQ ID NO: 24356 - DNA, 20 bp, Artificial Sequence
  Description of Artificial Sequence: Synthetic oligonucleotide
  Target: FXN; (-) strand; PAM type: YTN; PAM sequence: TTT
tagtgcattacagtgattct

SEQ ID NO: 24357 - DNA, 20 bp, Artificial Sequence
  Description of Artificial Sequence: Synthetic oligonucleotide
  Target: FXN; (-) strand; PAM type: YTN; PAM sequence: CTT
ttagtgcattacagtgattc

SEQ ID NO: 24358 - DNA, 20 bp, Artificial Sequence
  Description of Artificial Sequence: Synthetic oligonucleotide
  Target: FXN; (-) strand; PAM type: YTN; PAM sequence: TTC
ttttagtgcattacagtgat

SEQ ID NO: 24359 - DNA, 20 bp, Artificial Sequence
  Description of Artificial Sequence: Synthetic oligonucleotide
  Target: FXN; (-) strand; PAM type: YTN; PAM sequence: CTT
cttttagtgcattacagtga

SEQ ID NO: 24360 - DNA, 20 bp, Artificial Sequence
  Description of Artificial Sequence: Synthetic oligonucleotide
  Target: FXN; (-) strand; PAM type: YTN; PAM sequence: TTA
ccttcttttagtgcattaca

SEQ ID NO: 24361 - DNA, 20 bp, Artificial Sequence
  Description of Artificial Sequence: Synthetic oligonucleotide
  Target: FXN; (-) strand; PAM type: YTN; PAM sequence: TTT
accttcttttagtgcattac

SEQ ID NO: 24362 - DNA, 20 bp, Artificial Sequence
  Description of Artificial Sequence: Synthetic oligonucleotide
  Target: FXN; (-) strand; PAM type: YTN; PAM sequence: TTT
taccttcttttagtgcatta

SEQ ID NO: 24363 - DNA, 20 bp, Artificial Sequence
  Description of Artificial Sequence: Synthetic oligonucleotide
  Target: FXN; (-) strand; PAM type: YTN; PAM sequence: TTT
ttaccttcttttagtgcatt

SEQ ID NO: 24364 - DNA, 20 bp, Artificial Sequence
  Description of Artificial Sequence: Synthetic oligonucleotide
  Target: FXN; (-) strand; PAM type: YTN; PAM sequence: TTT
tttaccttcttttagtgcat

SEQ ID NO: 24365 - DNA, 20 bp, Artificial Sequence
  Description of Artificial Sequence: Synthetic oligonucleotide
  Target: FXN; (-) strand; PAM type: YTN; PAM sequence: TTT
ttttaccttcttttagtgca

SEQ ID NO: 24366 - DNA, 20 bp, Artificial Sequence
  Description of Artificial Sequence: Synthetic oligonucleotide
  Target: FXN; (-) strand; PAM type: YTN; PAM sequence: TTT
tttttaccttcttttagtgc

SEQ ID NO: 24367 - DNA, 20 bp, Artificial Sequence
  Description of Artificial Sequence: Synthetic oligonucleotide
  Target: FXN; (-) strand; PAM type: YTN; PAM sequence: TTT
ttttttaccttcttttagtg

SEQ ID NO: 24368 - DNA, 20 bp, Artificial Sequence
  Description of Artificial Sequence: Synthetic oligonucleotide
  Target: FXN; (-) strand; PAM type: YTN; PAM sequence: TTT
tttttttaccttcttttagt

SEQ ID NO: 24369 - DNA, 20 bp, Artificial Sequence
  Description of Artificial Sequence: Synthetic oligonucleotide
  Target: FXN; (-) strand; PAM type: YTN; PAM sequence: TTT
ttttttttaccttcttttag

SEQ ID NO: 24370 - DNA, 20 bp, Artificial Sequence
  Description of Artificial Sequence: Synthetic oligonucleotide
  Target: FXN; (-) strand; PAM type: YTN; PAM sequence: TTT
tttttttttaccttctttta

SEQ ID NO: 24371 - DNA, 20 bp, Artificial Sequence
  Description of Artificial Sequence: Synthetic oligonucleotide
  Target: FXN; (-) strand; PAM type: YTN; PAM sequence: TTT
ttttttttttaccttctttt

SEQ ID NO: 24372 - DNA, 20 bp, Artificial Sequence
  Description of Artificial Sequence: Synthetic oligonucleotide
  Target: FXN; (-) strand; PAM type: YTN; PAM sequence: TTA
ggatttttttttttttacct

SEQ ID NO: 24373 - DNA, 20 bp, Artificial Sequence
  Description of Artificial Sequence: Synthetic oligonucleotide
  Target: FXN; (-) strand; PAM type: YTN; PAM sequence: CTT
aggatttttttttttttacc

SEQ ID NO: 24374 - DNA, 20 bp, Artificial Sequence
  Description of Artificial Sequence: Synthetic oligonucleotide
  Target: FXN; (-) strand; PAM type: YTN; PAM sequence: TTC
ttaggattttttttttttta

SEQ ID NO: 24375 - DNA, 20 bp, Artificial Sequence
  Description of Artificial Sequence: Synthetic oligonucleotide
  Target: FXN; (-) strand; PAM type: YTN; PAM sequence: TTT
cttaggattttttttttttt

SEQ ID NO: 24376 - DNA, 20 bp, Artificial Sequence
  Description of Artificial Sequence: Synthetic oligonucleotide
  Target: FXN; (-) strand; PAM type: YTN; PAM sequence: TTA
ggaatatttcttaggatttt

SEQ ID NO: 24377 - DNA, 20 bp, Artificial Sequence
  Description of Artificial Sequence: Synthetic oligonucleotide
  Target: FXN; (-) strand; PAM type: YTN; PAM sequence: TTT
aggaatatttcttaggattt

SEQ ID NO: 24378 - DNA, 20 bp, Artificial Sequence
  Description of Artificial Sequence: Synthetic oligonucleotide
  Target: FXN; (-) strand; PAM type: YTN; PAM sequence: TTT
taggaatatttcttaggatt

SEQ ID NO: 24379 - DNA, 20 bp, Artificial Sequence
  Description of Artificial Sequence: Synthetic oligonucleotide
  Target: FXN; (-) strand; PAM type: YTN; PAM sequence: TTA
aagtattttaggaatatttc

SEQ ID NO: 24380 - DNA, 20 bp, Artificial Sequence
  Description of Artificial Sequence: Synthetic oligonucleotide
  Target: FXN; (-) strand; PAM type: YTN; PAM sequence: CTA
tattaaagtattttaggaat

SEQ ID NO: 24381 - DNA, 20 bp, Artificial Sequence
  Description of Artificial Sequence: Synthetic oligonucleotide
  Target: FXN; (-) strand; PAM type: YTN; PAM sequence: CTG
gatgtgagccaccgcaccca

SEQ ID NO: 24382 - DNA, 20 bp, Artificial Sequence
  Description of Artificial Sequence: Synthetic oligonucleotide
  Target: FXN; (-) strand; PAM type: YTN; PAM sequence: TTC
ccaaaatgctggatgtgagc

SEQ ID NO: 24383 - DNA, 20 bp, Artificial Sequence
  Description of Artificial Sequence: Synthetic oligonucleotide
  Target: FXN; (-) strand; PAM type: YTN; PAM sequence: CTT
cccaaaatgctggatgtgag

SEQ ID NO: 24384 - DNA, 20 bp, Artificial Sequence
  Description of Artificial Sequence: Synthetic oligonucleotide
  Target: FXN; (-) strand; PAM type: YTN; PAM sequence: CTC
agcttcccaaaatgctggat

SEQ ID NO: 24385 - DNA, 20 bp, Artificial Sequence
  Description of Artificial Sequence: Synthetic oligonucleotide
  Target: FXN; (-) strand; PAM type: YTN; PAM sequence: CTC
ctcagcttcccaaaatgctg

SEQ ID NO: 24386 - DNA, 20 bp, Artificial Sequence
  Description of Artificial Sequence: Synthetic oligonucleotide
  Target: FXN; (-) strand; PAM type: YTN; PAM sequence: CTG
ccctcctcagcttcccaaaa

SEQ ID NO: 24387 - DNA, 20 bp, Artificial Sequence
  Description of Artificial Sequence: Synthetic oligonucleotide
  Target: FXN; (-) strand; PAM type: YTN; PAM sequence: CTC
aagtgatctgccctcctcag

SEQ ID NO: 24388 - DNA, 20 bp, Artificial Sequence
  Description of Artificial Sequence: Synthetic oligonucleotide
  Target: FXN; (-) strand; PAM type: YTN; PAM sequence: CTG
gcctcaagtgatctgccctc

SEQ ID NO: 24389 - DNA, 20 bp, Artificial Sequence
  Description of Artificial Sequence: Synthetic oligonucleotide
  Target: FXN; (-) strand; PAM type: YTN; PAM sequence: CTC
ctggcctcaagtgatctgcc

SEQ ID NO: 24390 - DNA, 20 bp, Artificial Sequence
  Description of Artificial Sequence: Synthetic oligonucleotide
  Target: FXN; (-) strand; PAM type: YTN; PAM sequence: TTG
aactcctggcctcaagtgat

SEQ ID NO: 24391 - DNA, 20 bp, Artificial Sequence
  Description of Artificial Sequence: Synthetic oligonucleotide
  Target: FXN; (-) strand; PAM type: YTN; PAM sequence: CTT
gaactcctggcctcaagtga

SEQ ID NO: 24392 - DNA, 20 bp, Artificial Sequence
  Description of Artificial Sequence: Synthetic oligonucleotide
  Target: FXN; (-) strand; PAM type: YTN; PAM sequence: CTG
gtcttgaactcctggcctca

SEQ ID NO: 24393 - DNA, 20 bp, Artificial Sequence
  Description of Artificial Sequence: Synthetic oligonucleotide
  Target: FXN; (-) strand; PAM type: YTN; PAM sequence: TTG
gccaggctggtcttgaactc

SEQ ID NO: 24394 - DNA, 20 bp, Artificial Sequence
  Description of Artificial Sequence: Synthetic oligonucleotide
  Target: FXN; (-) strand; PAM type: YTN; PAM sequence: TTC
accatgttggccaggctggt

SEQ ID NO: 24395 - DNA, 20 bp, Artificial Sequence
  Description of Artificial Sequence: Synthetic oligonucleotide
  Target: FXN; (-) strand; PAM type: YTN; PAM sequence: TTT
caccatgttggccaggctgg

SEQ ID NO: 24396 - DNA, 20 bp, Artificial Sequence
  Description of Artificial Sequence: Synthetic oligonucleotide
  Target: FXN; (-) strand; PAM type: YTN; PAM sequence: TTA
gtagagacggggtttcacca

SEQ ID NO: 24397 - DNA, 20 bp, Artificial Sequence
  Description of Artificial Sequence: Synthetic oligonucleotide
  Target: FXN; (-) strand; PAM type: YTN; PAM sequence: TTT
agtagagacggggtttcacc

SEQ ID NO: 24398 - DNA, 20 bp, Artificial Sequence
  Description of Artificial Sequence: Synthetic oligonucleotide
  Target: FXN; (-) strand; PAM type: YTN; PAM sequence: TTT
tagtagagacggggtttcac

SEQ ID NO: 24399 - DNA, 20 bp, Artificial Sequence
  Description of Artificial Sequence: Synthetic oligonucleotide
  Target: FXN; (-) strand; PAM type: YTN; PAM sequence: TTT
ttagtagagacggggtttca

SEQ ID NO: 24400 - DNA, 20 bp, Artificial Sequence
  Description of Artificial Sequence: Synthetic oligonucleotide
  Target: FXN; (-) strand; PAM type: YTN; PAM sequence: TTG
tatttttagtagagacgggg

SEQ ID NO: 24401 - DNA, 20 bp, Artificial Sequence
  Description of Artificial Sequence: Synthetic oligonucleotide
  Target: FXN; (-) strand; PAM type: YTN; PAM sequence: TTT
gtatttttagtagagacggg

SEQ ID NO: 24402 - DNA, 20 bp, Artificial Sequence
  Description of Artificial Sequence: Synthetic oligonucleotide
  Target: FXN; (-) strand; PAM type: YTN; PAM sequence: TTT
tgtatttttagtagagacgg

SEQ ID NO: 24403 - DNA, 20 bp, Artificial Sequence
  Description of Artificial Sequence: Synthetic oligonucleotide
  Target: FXN; (-) strand; PAM type: YTN; PAM sequence: TTT
ttgtatttttagtagagacg

SEQ ID NO: 24404 - DNA, 20 bp, Artificial Sequence
  Description of Artificial Sequence: Synthetic oligonucleotide
  Target: FXN; (-) strand; PAM type: YTN; PAM sequence: TTT
tttgtatttttagtagagac

SEQ ID NO: 24405 - DNA, 20 bp, Artificial Sequence
  Description of Artificial Sequence: Synthetic oligonucleotide
  Target: FXN; (-) strand; PAM type: YTN; PAM sequence: TTA
caggcacccgccaccgcacc

SEQ ID NO: 24406 - DNA, 20 bp, Artificial Sequence
  Description of Artificial Sequence: Synthetic oligonucleotide
  Target: FXN; (-) strand; PAM type: YTN; PAM sequence: CTG
ggattacaggcacccgccac

SEQ ID NO: 24407 - DNA, 20 bp, Artificial Sequence
  Description of Artificial Sequence: Synthetic oligonucleotide
  Target: FXN; (-) strand; PAM type: YTN; PAM sequence: CTC
ccgcgtagctgggattacag

SEQ ID NO: 24408 - DNA, 20 bp, Artificial Sequence
  Description of Artificial Sequence: Synthetic oligonucleotide
  Target: FXN; (-) strand; PAM type: YTN; PAM sequence: CTC
agcctcccgcgtagctggga

SEQ ID NO: 24409 - DNA, 20 bp, Artificial Sequence
  Description of Artificial Sequence: Synthetic oligonucleotide
  Target: FXN; (-) strand; PAM type: YTN; PAM sequence: CTC
gtgcctcagcctcccgcgta

SEQ ID NO: 24410 - DNA, 20 bp, Artificial Sequence
  Description of Artificial Sequence: Synthetic oligonucleotide
  Target: FXN; (-) strand; PAM type: YTN; PAM sequence: TTC
tcgtgcctcagcctcccgcg

SEQ ID NO: 24411 - DNA, 20 bp, Artificial Sequence
  Description of Artificial Sequence: Synthetic oligonucleotide
  Target: FXN; (-) strand; PAM type: YTN; PAM sequence: TTC
gagtgattctcgtgcctcag

SEQ ID NO: 24412 - DNA, 20 bp, Artificial Sequence
  Description of Artificial Sequence: Synthetic oligonucleotide
  Target: FXN; (-) strand; PAM type: YTN; PAM sequence: CTC
ccgggttcgagtgattctcg

SEQ ID NO: 24413 - DNA, 20 bp, Artificial Sequence
  Description of Artificial Sequence: Synthetic oligonucleotide
  Target: FXN; (-) strand; PAM type: YTN; PAM sequence: CTG
caacccccgcctcccgggtt

SEQ ID NO: 24414 - DNA, 20 bp, Artificial Sequence
  Description of Artificial Sequence: Synthetic oligonucleotide
  Target: FXN; (-) strand; PAM type: YTN; PAM sequence: CTC
actgcaacccccgcctcccg

SEQ ID NO: 24415 - DNA, 20 bp, Artificial Sequence
  Description of Artificial Sequence: Synthetic oligonucleotide
  Target: FXN; (-) strand; PAM type: YTN; PAM sequence: CTC
ggctcactgcaacccccgcc

SEQ ID NO: 24416 - DNA, 20 bp, Artificial Sequence
  Description of Artificial Sequence: Synthetic oligonucleotide
  Target: FXN; (-) strand; PAM type: YTN; PAM sequence: CTG
gagtgcagtggcacgatctc

SEQ ID NO: 24417 - DNA, 20 bp, Artificial Sequence
  Description of Artificial Sequence: Synthetic oligonucleotide
  Target: FXN; (-) strand; PAM type: YTN; PAM sequence: CTG
tcgcccaggctggagtgcag

SEQ ID NO: 24418 - DNA, 20 bp, Artificial Sequence
  Description of Artificial Sequence: Synthetic oligonucleotide
  Target: FXN; (-) strand; PAM type: YTN; PAM sequence: CTC
tgtcgcccaggctggagtgc

SEQ ID NO: 24419 - DNA, 20 bp, Artificial Sequence
  Description of Artificial Sequence: Synthetic oligonucleotide
  Target: FXN; (-) strand; PAM type: YTN; PAM sequence: CTC
gctctgtcgcccaggctgga

SEQ ID NO: 24420 - DNA, 20 bp, Artificial Sequence
  Description of Artificial Sequence: Synthetic oligonucleotide
  Target: FXN; (-) strand; PAM type: YTN; PAM sequence: TTG
agatgaagtctcgctctgtc

SEQ ID NO: 24421 - DNA, 20 bp, Artificial Sequence
  Description of Artificial Sequence: Synthetic oligonucleotide
  Target: FXN; (-) strand; PAM type: YTN; PAM sequence: TTT
gagatgaagtctcgctctgt

SEQ ID NO: 24422 - DNA, 20 bp, Artificial Sequence
  Description of Artificial Sequence: Synthetic oligonucleotide
  Target: FXN; (-) strand; PAM type: YTN; PAM sequence: TTT
tgagatgaagtctcgctctg

SEQ ID NO: 24423 - DNA, 20 bp, Artificial Sequence
  Description of Artificial Sequence: Synthetic oligonucleotide
  Target: FXN; (-) strand; PAM type: YTN; PAM sequence: TTT
ttgagatgaagtctcgctct

SEQ ID NO: 24424 - DNA, 20 bp, Artificial Sequence
  Description of Artificial Sequence: Synthetic oligonucleotide
  Target: FXN; (-) strand; PAM type: YTN; PAM sequence: TTG
tttttgagatgaagtctcgc

SEQ ID NO: 24425 - DNA, 20 bp, Artificial Sequence
  Description of Artificial Sequence: Synthetic oligonucleotide
  Target: FXN; (-) strand; PAM type: YTN; PAM sequence: TTT
gtttttgagatgaagtctcg

SEQ ID NO: 24426 - DNA, 20 bp, Artificial Sequence
  Description of Artificial Sequence: Synthetic oligonucleotide
  Target: FXN; (-) strand; PAM type: YTN; PAM sequence: TTT
tgtttttgagatgaagtctc

SEQ ID NO: 24427 - DNA, 20 bp, Artificial Sequence
  Description of Artificial Sequence: Synthetic oligonucleotide
  Target: FXN; (-) strand; PAM type: YTN; PAM sequence: TTT
ttgtttttgagatgaagtct

SEQ ID NO: 24428 - DNA, 20 bp, Artificial Sequence
  Description of Artificial Sequence: Synthetic oligonucleotide
  Target: FXN; (-) strand; PAM type: YTN; PAM sequence: TTT
tttgtttttgagatgaagtc

SEQ ID NO: 24429 - DNA, 20 bp, Artificial Sequence
  Description of Artificial Sequence: Synthetic oligonucleotide
  Target: FXN; (-) strand; PAM type: YTN; PAM sequence: TTG
ttttttgtttttgagatgaa

SEQ ID NO: 24430 - DNA, 20 bp, Artificial Sequence
  Description of Artificial Sequence: Synthetic oligonucleotide
  Target: FXN; (-) strand; PAM type: YTN; PAM sequence: TTT
gttttttgtttttgagatga

SEQ ID NO: 24431 - DNA, 20 bp, Artificial Sequence
  Description of Artificial Sequence: Synthetic oligonucleotide
  Target: FXN; (-) strand; PAM type: YTN; PAM sequence: TTT
tgttttttgtttttgagatg

SEQ ID NO: 24432 - DNA, 20 bp, Artificial Sequence
  Description of Artificial Sequence: Synthetic oligonucleotide
  Target: FXN; (-) strand; PAM type: YTN; PAM sequence: TTT
ttgttttttgtttttgagat

SEQ ID NO: 24433 - DNA, 20 bp, Artificial Sequence
  Description of Artificial Sequence: Synthetic oligonucleotide
  Target: FXN; (-) strand; PAM type: YTN; PAM sequence: TTG
gtttttgttttttgtttttg

SEQ ID NO: 24434 - DNA, 20 bp, Artificial Sequence
  Description of Artificial Sequence: Synthetic oligonucleotide
  Target: FXN; (-) strand; PAM type: YTN; PAM sequence: TTT
ggtttttgttttttgttttt

SEQ ID NO: 24435 - DNA, 20 bp, Artificial Sequence
  Description of Artificial Sequence: Synthetic oligonucleotide
  Target: FXN; (-) strand; PAM type: YTN; PAM sequence: TTT
tggtttttgttttttgtttt

SEQ ID NO: 24436 - DNA, 20 bp, Artificial Sequence
  Description of Artificial Sequence: Synthetic oligonucleotide
  Target: FXN; (-) strand; PAM type: YTN; PAM sequence: TTT
ttggtttttgttttttgttt

SEQ ID NO: 24437 - DNA, 20 bp, Artificial Sequence
  Description of Artificial Sequence: Synthetic oligonucleotide
  Target: FXN; (-) strand; PAM type: YTN; PAM sequence: TTT
tttggtttttgttttttgtt

SEQ ID NO: 24438 - DNA, 20 bp, Artificial Sequence
  Description of Artificial Sequence: Synthetic oligonucleotide
  Target: FXN; (-) strand; PAM type: YTN; PAM sequence: TTT
ttttggtttttgttttttgt

SEQ ID NO: 24439 - DNA, 20 bp, Artificial Sequence
  Description of Artificial Sequence: Synthetic oligonucleotide
  Target: FXN; (-) strand; PAM type: YTN; PAM sequence: TTT
tttttggtttttgttttttg

SEQ ID NO: 24440 - DNA, 20 bp, Artificial Sequence
  Description of Artificial Sequence: Synthetic oligonucleotide
  Target: FXN; (-) strand; PAM type: YTN; PAM sequence: TTT
ttttttggtttttgtttttt

SEQ ID NO: 24441 - DNA, 20 bp, Artificial Sequence
  Description of Artificial Sequence: Synthetic oligonucleotide
  Target: FXN; (-) strand; PAM type: YTN; PAM sequence: TTT
tttttttggtttttgttttt

SEQ ID NO: 24442 - DNA, 20 bp, Artificial Sequence
  Description of Artificial Sequence: Synthetic oligonucleotide
  Target: FXN; (-) strand; PAM type: YTN; PAM sequence: TTT
ttttttttggtttttgtttt

SEQ ID NO: 24443 - DNA, 20 bp, Artificial Sequence
  Description of Artificial Sequence: Synthetic oligonucleotide
  Target: FXN; (-) strand; PAM type: YTN; PAM sequence: CTG
aagtttttttttttggtttt

SEQ ID NO: 24444 - DNA, 20 bp, Artificial Sequence
  Description of Artificial Sequence: Synthetic oligonucleotide
  Target: FXN; (-) strand; PAM type: YTN; PAM sequence: TTA
aataatcatgctgaagtttt

SEQ ID NO: 24445 - DNA, 20 bp, Artificial Sequence
  Description of Artificial Sequence: Synthetic oligonucleotide
  Target: FXN; (-) strand; PAM type: YTN; PAM sequence: TTG
gttaaataatcatgctgaag

SEQ ID NO: 24446 - DNA, 20 bp, Artificial Sequence
  Description of Artificial Sequence: Synthetic oligonucleotide
  Target: FXN; (-) strand; PAM type: YTN; PAM sequence: TTT
ggttaaataatcatgctgaa

SEQ ID NO: 24447 - DNA, 20 bp, Artificial Sequence
  Description of Artificial Sequence: Synthetic oligonucleotide
  Target: FXN; (-) strand; PAM type: YTN; PAM sequence: TTT
tggttaaataatcatgctga

SEQ ID NO: 24448 - DNA, 20 bp, Artificial Sequence
  Description of Artificial Sequence: Synthetic oligonucleotide
  Target: FXN; (-) strand; PAM type: YTN; PAM sequence: CTG
cattttggttaaataatcat

SEQ ID NO: 24449 - DNA, 20 bp, Artificial Sequence
  Description of Artificial Sequence: Synthetic oligonucleotide
  Target: FXN; (-) strand; PAM type: YTN; PAM sequence: CTA
acctgcattttggttaaata

SEQ ID NO: 24450 - DNA, 20 bp, Artificial Sequence
  Description of Artificial Sequence: Synthetic oligonucleotide
  Target: FXN; (-) strand; PAM type: YTN; PAM sequence: CTG
catccggtgaacaactaacc

SEQ ID NO: 24451 - DNA, 20 bp, Artificial Sequence
  Description of Artificial Sequence: Synthetic oligonucleotide
  Target: FXN; (-) strand; PAM type: YTN; PAM sequence: CTC
tgcatccggtgaacaactaa

SEQ ID NO: 24452 - DNA, 20 bp, Artificial Sequence
  Description of Artificial Sequence: Synthetic oligonucleotide
  Target: FXN; (-) strand; PAM type: YTN; PAM sequence: TTG
gactctgcatccggtgaaca

SEQ ID NO: 24453 - DNA, 20 bp, Artificial Sequence
  Description of Artificial Sequence: Synthetic oligonucleotide
  Target: FXN; (-) strand; PAM type: YTN; PAM sequence: TTA
attggactctgcatccggtg

SEQ ID NO: 24454 - DNA, 20 bp, Artificial Sequence
  Description of Artificial Sequence: Synthetic oligonucleotide
  Target: FXN; (-) strand; PAM type: YTN; PAM sequence: TTG
ttaattggactctgcatccg

SEQ ID NO: 24455 - DNA, 20 bp, Artificial Sequence
  Description of Artificial Sequence: Synthetic oligonucleotide
  Target: FXN; (-) strand; PAM type: YTN; PAM sequence: CTT
gttaattggactctgcatcc

SEQ ID NO: 24456 - DNA, 20 bp, Artificial Sequence
  Description of Artificial Sequence: Synthetic oligonucleotide
  Target: FXN; (-) strand; PAM type: YTN; PAM sequence: CTC
ttgttaattggactctgcat

SEQ ID NO: 24457 - DNA, 20 bp, Artificial Sequence
  Description of Artificial Sequence: Synthetic oligonucleotide
  Target: FXN; (-) strand; PAM type: YTN; PAM sequence: TTG
ctcttgttaattggactctg

SEQ ID NO: 24458 - DNA, 20 bp, Artificial Sequence
  Description of Artificial Sequence: Synthetic oligonucleotide
  Target: FXN; (-) strand; PAM type: YTN; PAM sequence: CTT
gctcttgttaattggactct

SEQ ID NO: 24459 - DNA, 20 bp, Artificial Sequence
  Description of Artificial Sequence: Synthetic oligonucleotide
  Target: FXN; (-) strand; PAM type: YTN; PAM sequence: TTG
gtaccaggccttgctcttgt

SEQ ID NO: 24460 - DNA, 20 bp, Artificial Sequence
  Description of Artificial Sequence: Synthetic oligonucleotide
  Target: FXN; (-) strand; PAM type: YTN; PAM sequence: TTT
ggtaccaggccttgctcttg

SEQ ID NO: 24461 - DNA, 20 bp, Artificial Sequence
  Description of Artificial Sequence: Synthetic oligonucleotide
  Target: FXN; (-) strand; PAM type: YTN; PAM sequence: TTT
tggtaccaggccttgctctt

SEQ ID NO: 24462 - DNA, 20 bp, Artificial Sequence
  Description of Artificial Sequence: Synthetic oligonucleotide
  Target: FXN; (-) strand; PAM type: YTN; PAM sequence: TTT
ttggtaccaggccttgctct

SEQ ID NO: 24463 - DNA, 20 bp, Artificial Sequence
  Description of Artificial Sequence: Synthetic oligonucleotide
  Target: FXN; (-) strand; PAM type: YTN; PAM sequence: TTT
tttggtaccaggccttgctc

SEQ ID NO: 24464 - DNA, 20 bp, Artificial Sequence
  Description of Artificial Sequence: Synthetic oligonucleotide
  Target: FXN; (-) strand; PAM type: YTN; PAM sequence: TTT
ttttggtaccaggccttgct

SEQ ID NO: 24465 - DNA, 20 bp, Artificial Sequence
  Description of Artificial Sequence: Synthetic oligonucleotide
  Target: FXN; (-) strand; PAM type: YTN; PAM sequence: CTT
tttttggtaccaggccttgc

SEQ ID NO: 24466 - DNA, 20 bp, Artificial Sequence
  Description of Artificial Sequence: Synthetic oligonucleotide
  Target: FXN; (-) strand; PAM type: YTN; PAM sequence: TTC
actttttttggtaccaggcc

SEQ ID NO: 24467 - DNA, 20 bp, Artificial Sequence
  Description of Artificial Sequence: Synthetic oligonucleotide
  Target: FXN; (-) strand; PAM type: YTN; PAM sequence: TTC
ggagtaaattcacttttttt

SEQ ID NO: 24468 - DNA, 20 bp, Artificial Sequence
  Description of Artificial Sequence: Synthetic oligonucleotide
  Target: FXN; (-) strand; PAM type: YTN; PAM sequence: TTT
cggagtaaattcactttttt

SEQ ID NO: 24469 - DNA, 20 bp, Artificial Sequence
  Description of Artificial Sequence: Synthetic oligonucleotide
  Target: FXN; (-) strand; PAM type: YTN; PAM sequence: CTA
gtttcggagtaaattcactt

SEQ ID NO: 24470 - DNA, 20 bp, Artificial Sequence
  Description of Artificial Sequence: Synthetic oligonucleotide
  Target: FXN; (-) strand; PAM type: YTN; PAM sequence: CTC
acccaagctagtttcggagt

SEQ ID NO: 24471 - DNA, 20 bp, Artificial Sequence
  Description of Artificial Sequence: Synthetic oligonucleotide
  Target: FXN; (-) strand; PAM type: YTN; PAM sequence: TTG
tacccctcacccaagctagt

SEQ ID NO: 24472 - DNA, 20 bp, Artificial Sequence
  Description of Artificial Sequence: Synthetic oligonucleotide
  Target: FXN; (-) strand; PAM type: YTN; PAM sequence: TTT
gtacccctcacccaagctag

SEQ ID NO: 24473 - DNA, 20 bp, Artificial Sequence
  Description of Artificial Sequence: Synthetic oligonucleotide
  Target: FXN; (-) strand; PAM type: YTN; PAM sequence: CTT
tgtacccctcacccaagcta

SEQ ID NO: 24474 - DNA, 20 bp, Artificial Sequence
  Description of Artificial Sequence: Synthetic oligonucleotide
  Target: FXN; (-) strand; PAM type: YTN; PAM sequence: TTA
aagaaaggcaggatgctttg

SEQ ID NO: 24475 - DNA, 20 bp, Artificial Sequence
  Description of Artificial Sequence: Synthetic oligonucleotide
  Target: FXN; (-) strand; PAM type: YTN; PAM sequence: TTT
aaagaaaggcaggatgcttt

SEQ ID NO: 24476 - DNA, 20 bp, Artificial Sequence
  Description of Artificial Sequence: Synthetic oligonucleotide
  Target: FXN; (-) strand; PAM type: YTN; PAM sequence: TTT
taaagaaaggcaggatgctt

SEQ ID NO: 24477 - DNA, 20 bp, Artificial Sequence
  Description of Artificial Sequence: Synthetic oligonucleotide
  Target: FXN; (-) strand; PAM type: YTN; PAM sequence: CTT
ttaaagaaaggcaggatgct

SEQ ID NO: 24478 - DNA, 20 bp, Artificial Sequence
  Description of Artificial Sequence: Synthetic oligonucleotide
  Target: FXN; (-) strand; PAM type: YTN; PAM sequence: TTC
caaggggaagcagcactttt

SEQ ID NO: 24479 - DNA, 20 bp, Artificial Sequence
  Description of Artificial Sequence: Synthetic oligonucleotide
  Target: FXN; (-) strand; PAM type: YTN; PAM sequence: CTT
ccaaggggaagcagcacttt

SEQ ID NO: 24480 - DNA, 20 bp, Artificial Sequence
  Description of Artificial Sequence: Synthetic oligonucleotide
  Target: FXN; (-) strand; PAM type: YTN; PAM sequence: CTA
cttccaaggggaagcagcac

SEQ ID NO: 24481 - DNA, 20 bp, Artificial Sequence
  Description of Artificial Sequence: Synthetic oligonucleotide
  Target: FXN; (-) strand; PAM type: YTN; PAM sequence: TTC
tacttccaaggggaagcagc

SEQ ID NO: 24482 - DNA, 20 bp, Artificial Sequence
  Description of Artificial Sequence: Synthetic oligonucleotide
  Target: FXN; (-) strand; PAM type: YTN; PAM sequence: TTT
ctacttccaaggggaagcag

SEQ ID NO: 24483 - DNA, 20 bp, Artificial Sequence
  Description of Artificial Sequence: Synthetic oligonucleotide
  Target: FXN; (-) strand; PAM type: YTN; PAM sequence: CTT
tctacttccaaggggaagca

SEQ ID NO: 24484 - DNA, 20 bp, Artificial Sequence
  Description of Artificial Sequence: Synthetic oligonucleotide
  Target: FXN; (-) strand; PAM type: YTN; PAM sequence: TTA
taaaagtgtccactttctac

SEQ ID NO: 24485 - DNA, 20 bp, Artificial Sequence
  Description of Artificial Sequence: Synthetic oligonucleotide
  Target: FXN; (-) strand; PAM type: YTN; PAM sequence: CTT
ataaaagtgtccactttcta

SEQ ID NO: 24486 - DNA, 20 bp, Artificial Sequence
  Description of Artificial Sequence: Synthetic oligonucleotide
  Target: FXN; (-) strand; PAM type: YTN; PAM sequence: TTA
ccttataaaagtgtccactt

SEQ ID NO: 24487 - DNA, 20 bp, Artificial Sequence
  Description of Artificial Sequence: Synthetic oligonucleotide
  Target: FXN; (-) strand; PAM type: YTN; PAM sequence: CTT
accttataaaagtgtccact

SEQ ID NO: 24488 - DNA, 20 bp, Artificial Sequence
  Description of Artificial Sequence: Synthetic oligonucleotide
  Target: FXN; (-) strand; PAM type: YTN; PAM sequence: TTC
cccccttaccttataaaagt

SEQ ID NO: 24489 - DNA, 20 bp, Artificial Sequence
  Description of Artificial Sequence: Synthetic oligonucleotide
  Target: FXN; (-) strand; PAM type: YTN; PAM sequence: CTT
ccccccttaccttataaaag

SEQ ID NO: 24490 - DNA, 20 bp, Artificial Sequence
  Description of Artificial Sequence: Synthetic oligonucleotide
  Target: FXN; (-) strand; PAM type: YTN; PAM sequence: TTG
cacacttccccccttacctt

SEQ ID NO: 24491 - DNA, 20 bp, Artificial Sequence
  Description of Artificial Sequence: Synthetic oligonucleotide
  Target: FXN; (-) strand; PAM type: YTN; PAM sequence: CTT
gcacacttccccccttacct

SEQ ID NO: 24492 - DNA, 20 bp, Artificial Sequence
  Description of Artificial Sequence: Synthetic oligonucleotide
  Target: FXN; (-) strand; PAM type: YTN; PAM sequence: TTG
cccttgcacacttcccccct

SEQ ID NO: 24493 - DNA, 20 bp, Artificial Sequence
  Description of Artificial Sequence: Synthetic oligonucleotide
  Target: FXN; (-) strand; PAM type: YTN; PAM sequence: CTT
gcccttgcacacttcccccc

SEQ ID NO: 24494 - DNA, 20 bp, Artificial Sequence
  Description of Artificial Sequence: Synthetic oligonucleotide
  Target: FXN; (-) strand; PAM type: YTN; PAM sequence: CTA
gcagagggacccccccactt

SEQ ID NO: 24495 - DNA, 20 bp, Artificial Sequence
  Description of Artificial Sequence: Synthetic oligonucleotide
  Target: FXN; (-) strand; PAM type: YTN; PAM sequence: CTG
tagagtatgcacggaactag

SEQ ID NO: 24496 - DNA, 20 bp, Artificial Sequence
  Description of Artificial Sequence: Synthetic oligonucleotide
  Target: FXN; (-) strand; PAM type: YTN; PAM sequence: CTG
tcctgtagagtatgcacgga

SEQ ID NO: 24497 - DNA, 20 bp, Artificial Sequence
  Description of Artificial Sequence: Synthetic oligonucleotide
  Target: FXN; (-) strand; PAM type: YTN; PAM sequence: CTA
accaggaaggtgccaagtca

SEQ ID NO: 24498 - DNA, 20 bp, Artificial Sequence
  Description of Artificial Sequence: Synthetic oligonucleotide
  Target: FXN; (-) strand; PAM type: YTN; PAM sequence: TTA
ctaaccaggaaggtgccaag

SEQ ID NO: 24499 - DNA, 20 bp, Artificial Sequence
  Description of Artificial Sequence: Synthetic oligonucleotide
  Target: FXN; (-) strand; PAM type: YTN; PAM sequence: TTA
ttactaaccaggaaggtgcc

SEQ ID NO: 24500 - DNA, 20 bp, Artificial Sequence
  Description of Artificial Sequence: Synthetic oligonucleotide
  Target: FXN; (-) strand; PAM type: YTN; PAM sequence: CTT
attactaaccaggaaggtgc

SEQ ID NO: 24501 - DNA, 20 bp, Artificial Sequence
  Description of Artificial Sequence: Synthetic oligonucleotide
  Target: FXN; (-) strand; PAM type: YTN; PAM sequence: CTA
cagcttattactaaccagga

SEQ ID NO: 24502 - DNA, 20 bp, Artificial Sequence
  Description of Artificial Sequence: Synthetic oligonucleotide
  Target: FXN; (-) strand; PAM type: YTN; PAM sequence: CTG
ctacagcttattactaacca

SEQ ID NO: 24503 - DNA, 20 bp, Artificial Sequence
  Description of Artificial Sequence: Synthetic oligonucleotide
  Target: FXN; (-) strand; PAM type: YTN; PAM sequence: TTG
gccactgctacagcttatta

SEQ ID NO: 24504 - DNA, 20 bp, Artificial Sequence
  Description of Artificial Sequence: Synthetic oligonucleotide
  Target: FXN; (-) strand; PAM type: YTN; PAM sequence: CTT
ggccactgctacagcttatt

SEQ ID NO: 24505 - DNA, 20 bp, Artificial Sequence
  Description of Artificial Sequence: Synthetic oligonucleotide
  Target: FXN; (-) strand; PAM type: YTN; PAM sequence: CTG
aaagcatgcccacttggcca

SEQ ID NO: 24506 - DNA, 20 bp, Artificial Sequence
  Description of Artificial Sequence: Synthetic oligonucleotide
  Target: FXN; (-) strand; PAM type: YTN; PAM sequence: CTG
ggagggcatactgaaagcat

SEQ ID NO: 24507 - DNA, 20 bp, Artificial Sequence
  Description of Artificial Sequence: Synthetic oligonucleotide
  Target: FXN; (-) strand; PAM type: YTN; PAM sequence: TTC
actgggagggcatactgaaa

SEQ ID NO: 24508 - DNA, 20 bp, Artificial Sequence
  Description of Artificial Sequence: Synthetic oligonucleotide
  Target: FXN; (-) strand; PAM type: YTN; PAM sequence: TTC
attcactgggagggcatact

SEQ ID NO: 24509 - DNA, 20 bp, Artificial Sequence
  Description of Artificial Sequence: Synthetic oligonucleotide
  Target: FXN; (-) strand; PAM type: YTN; PAM sequence: TTT
cattcactgggagggcatac

SEQ ID NO: 24510 - DNA, 20 bp, Artificial Sequence
  Description of Artificial Sequence: Synthetic oligonucleotide
  Target: FXN; (-) strand; PAM type: YTN; PAM sequence: CTT
tcattcactgggagggcata

SEQ ID NO: 24511 - DNA, 20 bp, Artificial Sequence
  Description of Artificial Sequence: Synthetic oligonucleotide
  Target: FXN; (-) strand; PAM type: YTN; PAM sequence: CTC
aggactttcattcactggga

SEQ ID NO: 24512 - DNA, 20 bp, Artificial Sequence
  Description of Artificial Sequence: Synthetic oligonucleotide
  Target: FXN; (-) strand; PAM type: YTN; PAM sequence: TTG
cctcaggactttcattcact

SEQ ID NO: 24513 - DNA, 20 bp, Artificial Sequence
  Description of Artificial Sequence: Synthetic oligonucleotide
  Target: FXN; (-) strand; PAM type: YTN; PAM sequence: TTG
ggggttgcctcaggactttc

SEQ ID NO: 24514 - DNA, 20 bp, Artificial Sequence
  Description of Artificial Sequence: Synthetic oligonucleotide
  Target: FXN; (-) strand; PAM type: YTN; PAM sequence: CTT
gggggttgcctcaggacttt

SEQ ID NO: 24515 - DNA, 20 bp, Artificial Sequence
  Description of Artificial Sequence: Synthetic oligonucleotide
  Target: FXN; (-) strand; PAM type: YTN; PAM sequence: TTC
cacccttgggggttgcctca

SEQ ID NO: 24516 - DNA, 20 bp, Artificial Sequence
  Description of Artificial Sequence: Synthetic oligonucleotide
  Target: FXN; (-) strand; PAM type: YTN; PAM sequence: CTT
ccacccttgggggttgcctc

SEQ ID NO: 24517 - DNA, 20 bp, Artificial Sequence
  Description of Artificial Sequence: Synthetic oligonucleotide
  Target: FXN; (-) strand; PAM type: YTN; PAM sequence: CTG
gcacttccacccttgggggt

SEQ ID NO: 24518 - DNA, 20 bp, Artificial Sequence
  Description of Artificial Sequence: Synthetic oligonucleotide
  Target: FXN; (-) strand; PAM type: YTN; PAM sequence: CTC
cagtgggtggtggcctggca

SEQ ID NO: 24519 - DNA, 20 bp, Artificial Sequence
  Description of Artificial Sequence: Synthetic oligonucleotide
  Target: FXN; (-) strand; PAM type: YTN; PAM sequence: TTC
acctccagtgggtggtggcc

SEQ ID NO: 24520 - DNA, 20 bp, Artificial Sequence
  Description of Artificial Sequence: Synthetic oligonucleotide
  Target: FXN; (-) strand; PAM type: YTN; PAM sequence: TTT
cacctccagtgggtggtggc

SEQ ID NO: 24521 - DNA, 20 bp, Artificial Sequence
  Description of Artificial Sequence: Synthetic oligonucleotide
  Target: FXN; (-) strand; PAM type: YTN; PAM sequence: CTT
tcacctccagtgggtggtgg

SEQ ID NO: 24522 - DNA, 20 bp, Artificial Sequence
  Description of Artificial Sequence: Synthetic oligonucleotide
  Target: FXN; (-) strand; PAM type: YTN; PAM sequence: TTC
gcagaccaaagcaaacccat

SEQ ID NO: 24523 - DNA, 20 bp, Artificial Sequence
  Description of Artificial Sequence: Synthetic oligonucleotide
  Target: FXN; (-) strand; PAM type: YTN; PAM sequence: CTC
cacatgacagtagattcgca

SEQ ID NO: 24524 - DNA, 20 bp, Artificial Sequence
  Description of Artificial Sequence: Synthetic oligonucleotide
  Target: FXN; (-) strand; PAM type: YTN; PAM sequence: CTC
tccacatgacagtagattcg

SEQ ID NO: 24525 - DNA, 20 bp, Artificial Sequence
  Description of Artificial Sequence: Synthetic oligonucleotide
  Target: FXN; (-) strand; PAM type: YTN; PAM sequence: TTC
cagagcacagatctctccac

SEQ ID NO: 24526 - DNA, 20 bp, Artificial Sequence
  Description of Artificial Sequence: Synthetic oligonucleotide
  Target: FXN; (-) strand; PAM type: YTN; PAM sequence: CTT
ccagagcacagatctctcca

SEQ ID NO: 24527 - DNA, 20 bp, Artificial Sequence
  Description of Artificial Sequence: Synthetic oligonucleotide
  Target: FXN; (-) strand; PAM type: YTN; PAM sequence: CTC
ttccagagcacagatctctc

SEQ ID NO: 24528 - DNA, 20 bp, Artificial Sequence
  Description of Artificial Sequence: Synthetic oligonucleotide
  Target: FXN; (-) strand; PAM type: YTN; PAM sequence: CTG
tatgctcttccagagcacag

SEQ ID NO: 24529 - DNA, 20 bp, Artificial Sequence
  Description of Artificial Sequence: Synthetic oligonucleotide
  Target: FXN; (-) strand; PAM type: YTN; PAM sequence: CTA
actgtatgctcttccagagc

SEQ ID NO: 24530 - DNA, 20 bp, Artificial Sequence
  Description of Artificial Sequence: Synthetic oligonucleotide
  Target: FXN; (-) strand; PAM type: YTN; PAM sequence: TTC
taactgtatgctcttccaga

SEQ ID NO: 24531 - DNA, 20 bp, Artificial Sequence
  Description of Artificial Sequence: Synthetic oligonucleotide
  Target: FXN; (-) strand; PAM type: YTN; PAM sequence: TTT
ctaactgtatgctcttccag

SEQ ID NO: 24532 - DNA, 20 bp, Artificial Sequence
  Description of Artificial Sequence: Synthetic oligonucleotide
  Target: FXN; (-) strand; PAM type: YTN; PAM sequence: TTT
tctaactgtatgctcttcca

SEQ ID NO: 24533 - DNA, 20 bp, Artificial Sequence
  Description of Artificial Sequence: Synthetic oligonucleotide
  Target: FXN; (-) strand; PAM type: YTN; PAM sequence: CTT
ttctaactgtatgctcttcc

SEQ ID NO: 24534 - DNA, 20 bp, Artificial Sequence
  Description of Artificial Sequence: Synthetic oligonucleotide
  Target: FXN; (-) strand; PAM type: YTN; PAM sequence: TTC
agggcaagcttttctaactg

SEQ ID NO: 24535 - DNA, 20 bp, Artificial Sequence
  Description of Artificial Sequence: Synthetic oligonucleotide
  Target: FXN; (-) strand; PAM type: YTN; PAM sequence: CTT
cagggcaagcttttctaact

SEQ ID NO: 24536 - DNA, 20 bp, Artificial Sequence
  Description of Artificial Sequence: Synthetic oligonucleotide
  Target: FXN; (-) strand; PAM type: YTN; PAM sequence: TTC
ccttcagggcaagcttttct

SEQ ID NO: 24537 - DNA, 20 bp, Artificial Sequence
  Description of Artificial Sequence: Synthetic oligonucleotide
  Target: FXN; (-) strand; PAM type: YTN; PAM sequence: TTC
accatacattcccttcaggg

SEQ ID NO: 24538 - DNA, 20 bp, Artificial Sequence
  Description of Artificial Sequence: Synthetic oligonucleotide
  Target: FXN; (-) strand; PAM type: YTN; PAM sequence: CTT
caccatacattcccttcagg

SEQ ID NO: 24539 - DNA, 20 bp, Artificial Sequence
  Description of Artificial Sequence: Synthetic oligonucleotide
  Target: FXN; (-) strand; PAM type: YTN; PAM sequence: CTC
cccttcaccatacattccct

SEQ ID NO: 24540 - DNA, 20 bp, Artificial Sequence
  Description of Artificial Sequence: Synthetic oligonucleotide
  Target: FXN; (-) strand; PAM type: YTN; PAM sequence: TTC
acctccccttcaccatacat

SEQ ID NO: 24541 - DNA, 20 bp, Artificial Sequence
  Description of Artificial Sequence: Synthetic oligonucleotide
  Target: FXN; (-) strand; PAM type: YTN; PAM sequence: TTT
cacctccccttcaccataca

SEQ ID NO: 24542 - DNA, 20 bp, Artificial Sequence
  Description of Artificial Sequence: Synthetic oligonucleotide
  Target: FXN; (-) strand; PAM type: YTN; PAM sequence: CTT
tcacctccccttcaccatac

SEQ ID NO: 24543 - DNA, 20 bp, Artificial Sequence
  Description of Artificial Sequence: Synthetic oligonucleotide
  Target: FXN; (-) strand; PAM type: YTN; PAM sequence: TTC
agaaatgcaaatataacctt

SEQ ID NO: 24544 - DNA, 20 bp, Artificial Sequence
  Description of Artificial Sequence: Synthetic oligonucleotide
  Target: FXN; (-) strand; PAM type: YTN; PAM sequence: CTT
cagaaatgcaaatataacct

SEQ ID NO: 24545 - DNA, 20 bp, Artificial Sequence
  Description of Artificial Sequence: Synthetic oligonucleotide
  Target: FXN; (-) strand; PAM type: YTN; PAM sequence: TTA
gcccttcagaaatgcaaata

SEQ ID NO: 24546 - DNA, 20 bp, Artificial Sequence
  Description of Artificial Sequence: Synthetic oligonucleotide
  Target: FXN; (-) strand; PAM type: YTN; PAM sequence: CTT
agcccttcagaaatgcaaat

SEQ ID NO: 24547 - DNA, 20 bp, Artificial Sequence
  Description of Artificial Sequence: Synthetic oligonucleotide
  Target: FXN; (-) strand; PAM type: YTN; PAM sequence: CTA
cttagcccttcagaaatgca

SEQ ID NO: 24548 - DNA, 20 bp, Artificial Sequence
  Description of Artificial Sequence: Synthetic oligonucleotide
  Target: FXN; (-) strand; PAM type: YTN; PAM sequence: TTC
ctacttagcccttcagaaat

SEQ ID NO: 24549 - DNA, 20 bp, Artificial Sequence
  Description of Artificial Sequence: Synthetic oligonucleotide
  Target: FXN; (-) strand; PAM type: YTN; PAM sequence: TTT
cctacttagcccttcagaaa

SEQ ID NO: 24550 - DNA, 20 bp, Artificial Sequence
  Description of Artificial Sequence: Synthetic oligonucleotide
  Target: FXN; (-) strand; PAM type: YTN; PAM sequence: TTC
ccggtttcctacttagccct

SEQ ID NO: 24551 - DNA, 20 bp, Artificial Sequence
  Description of Artificial Sequence: Synthetic oligonucleotide
  Target: FXN; (-) strand; PAM type: YTN; PAM sequence: CTG
gttcccggtttcctacttag

SEQ ID NO: 24552 - DNA, 20 bp, Artificial Sequence
  Description of Artificial Sequence: Synthetic oligonucleotide
  Target: FXN; (-) strand; PAM type: YTN; PAM sequence: CTC
ccctggttcccggtttccta

SEQ ID NO: 24553 - DNA, 20 bp, Artificial Sequence
  Description of Artificial Sequence: Synthetic oligonucleotide
  Target: FXN; (-) strand; PAM type: YTN; PAM sequence: CTC
tcccctggttcccggtttcc

SEQ ID NO: 24554 - DNA, 20 bp, Artificial Sequence
  Description of Artificial Sequence: Synthetic oligonucleotide
  Target: FXN; (-) strand; PAM type: YTN; PAM sequence: CTC
ctctcccctggttcccggtt

SEQ ID NO: 24555 - DNA, 20 bp, Artificial Sequence
  Description of Artificial Sequence: Synthetic oligonucleotide
  Target: FXN; (-) strand; PAM type: YTN; PAM sequence: TTC
tcctctcccctggttcccgg

SEQ ID NO: 24556 - DNA, 20 bp, Artificial Sequence
  Description of Artificial Sequence: Synthetic oligonucleotide
  Target: FXN; (-) strand; PAM type: YTN; PAM sequence: CTT
ctcctctcccctggttcccg

SEQ ID NO: 24557 - DNA, 20 bp, Artificial Sequence
  Description of Artificial Sequence: Synthetic oligonucleotide
  Target: FXN; (-) strand; PAM type: YTN; PAM sequence: CTC
ttctcctctcccctggttcc

SEQ ID NO: 24558 - DNA, 20 bp, Artificial Sequence
  Description of Artificial Sequence: Synthetic oligonucleotide
  Target: FXN; (-) strand; PAM type: YTN; PAM sequence: TTC
tcttctcctctcccctggtt

SEQ ID NO: 24559 - DNA, 20 bp, Artificial Sequence
  Description of Artificial Sequence: Synthetic oligonucleotide
  Target: FXN; (-) strand; PAM type: YTN; PAM sequence: CTT
ctcttctcctctcccctggt

SEQ ID NO: 24560 - DNA, 20 bp, Artificial Sequence
  Description of Artificial Sequence: Synthetic oligonucleotide
  Target: FXN; (-) strand; PAM type: YTN; PAM sequence: CTC
ttctcttctcctctcccctg

SEQ ID NO: 24561 - DNA, 20 bp, Artificial Sequence
  Description of Artificial Sequence: Synthetic oligonucleotide
  Target: FXN; (-) strand; PAM type: YTN; PAM sequence: CTC
tcttctcttctcctctcccc

SEQ ID NO: 24562 - DNA, 20 bp, Artificial Sequence
  Description of Artificial Sequence: Synthetic oligonucleotide
  Target: FXN; (-) strand; PAM type: YTN; PAM sequence: TTA
tcctctcttctcttctcctc

SEQ ID NO: 24563 - DNA, 20 bp, Artificial Sequence
  Description of Artificial Sequence: Synthetic oligonucleotide
  Target: FXN; (-) strand; PAM type: YTN; PAM sequence: TTA
aaaaaaattatcctctcttc

SEQ ID NO: 24564 - DNA, 20 bp, Artificial Sequence
  Description of Artificial Sequence: Synthetic oligonucleotide
  Target: FXN; (-) strand; PAM type: YTN; PAM sequence: CTT
aaaaaaaattatcctctctt

SEQ ID NO: 24565 - DNA, 20 bp, Artificial Sequence
  Description of Artificial Sequence: Synthetic oligonucleotide
  Target: FXN; (-) strand; PAM type: YTN; PAM sequence: TTC
ttaaaaaaaattatcctctc

SEQ ID NO: 24566 - DNA, 20 bp, Artificial Sequence
  Description of Artificial Sequence: Synthetic oligonucleotide
  Target: FXN; (-) strand; PAM type: YTN; PAM sequence: TTT
cttaaaaaaaattatcctct

SEQ ID NO: 24567 - DNA, 20 bp, Artificial Sequence
  Description of Artificial Sequence: Synthetic oligonucleotide
  Target: FXN; (-) strand; PAM type: YTN; PAM sequence: TTT
tcttaaaaaaaattatcctc

SEQ ID NO: 24568 - DNA, 20 bp, Artificial Sequence
  Description of Artificial Sequence: Synthetic oligonucleotide
  Target: FXN; (-) strand; PAM type: YTN; PAM sequence: CTT
ttcttaaaaaaaattatcct

SEQ ID NO: 24569 - DNA, 20 bp, Artificial Sequence
  Description of Artificial Sequence: Synthetic oligonucleotide
  Target: FXN; (-) strand; PAM type: YTN; PAM sequence: TTG
cttttcttaaaaaaaattat

SEQ ID NO: 24570 - DNA, 20 bp, Artificial Sequence
  Description of Artificial Sequence: Synthetic oligonucleotide
  Target: FXN; (-) strand; PAM type: YTN; PAM sequence: CTA
agaaaaagggaatatgttgc

SEQ ID NO: 24571 - DNA, 20 bp, Artificial Sequence
  Description of Artificial Sequence: Synthetic oligonucleotide
  Target: FXN; (-) strand; PAM type: YTN; PAM sequence: TTC
taagaaaaagggaatatgtt

SEQ ID NO: 24572 - DNA, 20 bp, Artificial Sequence
  Description of Artificial Sequence: Synthetic oligonucleotide
  Target: FXN; (-) strand; PAM type: YTN; PAM sequence: TTT
ctaagaaaaagggaatatgt

SEQ ID NO: 24573 - DNA, 20 bp, Artificial Sequence
  Description of Artificial Sequence: Synthetic oligonucleotide
  Target: FXN; (-) strand; PAM type: YTN; PAM sequence: TTT
tctaagaaaaagggaatatg

SEQ ID NO: 24574 - DNA, 20 bp, Artificial Sequence
  Description of Artificial Sequence: Synthetic oligonucleotide
  Target: FXN; (-) strand; PAM type: YTN; PAM sequence: TTT
ttctaagaaaaagggaatat

SEQ ID NO: 24575 - DNA, 20 bp, Artificial Sequence
  Description of Artificial Sequence: Synthetic oligonucleotide
  Target: FXN; (-) strand; PAM type: YTN; PAM sequence: TTT
tttctaagaaaaagggaata

SEQ ID NO: 24576 - DNA, 20 bp, Artificial Sequence
  Description of Artificial Sequence: Synthetic oligonucleotide
  Target: FXN; (-) strand; PAM type: YTN; PAM sequence: CTC
cattttttctaagaaaaagg

SEQ ID NO: 24577 - DNA, 20 bp, Artificial Sequence
  Description of Artificial Sequence: Synthetic oligonucleotide
  Target: FXN; (-) strand; PAM type: YTN; PAM sequence: CTG
taaccgagtgctccattttt

SEQ ID NO: 24578 - DNA, 20 bp, Artificial Sequence
  Description of Artificial Sequence: Synthetic oligonucleotide
  Target: FXN; (-) strand; PAM type: YTN; PAM sequence: TTC
gagtgcctgtaaccgagtgc

SEQ ID NO: 24579 - DNA, 20 bp, Artificial Sequence
  Description of Artificial Sequence: Synthetic oligonucleotide
  Target: FXN; (-) strand; PAM type: YTN; PAM sequence: CTA
cattcgagtgcctgtaaccg

SEQ ID NO: 24580 - DNA, 20 bp, Artificial Sequence
  Description of Artificial Sequence: Synthetic oligonucleotide
  Target: FXN; (-) strand; PAM type: YTN; PAM sequence: TTC
tacattcgagtgcctgtaac

SEQ ID NO: 24581 - DNA, 20 bp, Artificial Sequence
  Description of Artificial Sequence: Synthetic oligonucleotide
  Target: FXN; (-) strand; PAM type: YTN; PAM sequence: CTT
ctacattcgagtgcctgtaa

SEQ ID NO: 24582 - DNA, 20 bp, Artificial Sequence
  Description of Artificial Sequence: Synthetic oligonucleotide
  Target: FXN; (-) strand; PAM type: YTN; PAM sequence: CTA
cttctacattcgagtgcctg

SEQ ID NO: 24583 - DNA, 20 bp, Artificial Sequence
  Description of Artificial Sequence: Synthetic oligonucleotide
  Target: FXN; (-) strand; PAM type: YTN; PAM sequence: TTG
ctacttctacattcgagtgc

SEQ ID NO: 24584 - DNA, 20 bp, Artificial Sequence
  Description of Artificial Sequence: Synthetic oligonucleotide
  Target: FXN; (-) strand; PAM type: YTN; PAM sequence: TTA
tatattgctacttctacatt

SEQ ID NO: 24585 - DNA, 20 bp, Artificial Sequence
  Description of Artificial Sequence: Synthetic oligonucleotide
  Target: FXN; (-) strand; PAM type: YTN; PAM sequence: TTT
atatattgctacttctacat

SEQ ID NO: 24586 - DNA, 20 bp, Artificial Sequence
  Description of Artificial Sequence: Synthetic oligonucleotide
  Target: FXN; (-) strand; PAM type: YTN; PAM sequence: TTA
atgcataatttatatattgc

SEQ ID NO: 24587 - DNA, 20 bp, Artificial Sequence
  Description of Artificial Sequence: Synthetic oligonucleotide
  Target: FXN; (-) strand; PAM type: YTN; PAM sequence: TTA
taacccattaatgcataatt

SEQ ID NO: 24588 - DNA, 20 bp, Artificial Sequence
  Description of Artificial Sequence: Synthetic oligonucleotide
  Target: FXN; (-) strand; PAM type: YTN; PAM sequence: TTC
agtgaattataacccattaa

SEQ ID NO: 24589 - DNA, 20 bp, Artificial Sequence
  Description of Artificial Sequence: Synthetic oligonucleotide
  Target: FXN; (-) strand; PAM type: YTN; PAM sequence: TTT
cagtgaattataacccatta

SEQ ID NO: 24590 - DNA, 20 bp, Artificial Sequence
  Description of Artificial Sequence: Synthetic oligonucleotide
  Target: FXN; (-) strand; PAM type: YTN; PAM sequence: TTT
tcagtgaattataacccatt

SEQ ID NO: 24591 - DNA, 20 bp, Artificial Sequence
  Description of Artificial Sequence: Synthetic oligonucleotide
  Target: FXN; (-) strand; PAM type: YTN; PAM sequence: TTT
ttcagtgaattataacccat

SEQ ID NO: 24592 - DNA, 20 bp, Artificial Sequence
  Description of Artificial Sequence: Synthetic oligonucleotide
  Target: FXN; (-) strand; PAM type: YTN; PAM sequence: CTA
tttttcagtgaattataacc

SEQ ID NO: 24593 - DNA, 20 bp, Artificial Sequence
  Description of Artificial Sequence: Synthetic oligonucleotide
  Target: FXN; (-) strand; PAM type: YTN; PAM sequence: TTA
ctatttttcagtgaattata

SEQ ID NO: 24594 - DNA, 20 bp, Artificial Sequence
  Description of Artificial Sequence: Synthetic oligonucleotide
  Target: FXN; (-) strand; PAM type: YTN; PAM sequence: TTA
agaagtacgttactattttt

SEQ ID NO: 24595 - DNA, 20 bp, Artificial Sequence
  Description of Artificial Sequence: Synthetic oligonucleotide
  Target: FXN; (-) strand; PAM type: YTN; PAM sequence: CTG
aaagccaaagttaagaagta

SEQ ID NO: 24596 - DNA, 20 bp, Artificial Sequence
  Description of Artificial Sequence: Synthetic oligonucleotide
  Target: FXN; (-) strand; PAM type: YTN; PAM sequence: CTC
tgaaagccaaagttaagaag

SEQ ID NO: 24597 - DNA, 20 bp, Artificial Sequence
  Description of Artificial Sequence: Synthetic oligonucleotide
  Target: FXN; (-) strand; PAM type: YTN; PAM sequence: TTC
gaactctgaaagccaaagtt

SEQ ID NO: 24598 - DNA, 20 bp, Artificial Sequence
  Description of Artificial Sequence: Synthetic oligonucleotide
  Target: FXN; (-) strand; PAM type: YTN; PAM sequence: TTG
gttcgaactctgaaagccaa

SEQ ID NO: 24599 - DNA, 20 bp, Artificial Sequence
  Description of Artificial Sequence: Synthetic oligonucleotide
  Target: FXN; (-) strand; PAM type: YTN; PAM sequence: TTG
aggccacgttggttcgaact

SEQ ID NO: 24600 - DNA, 20 bp, Artificial Sequence
  Description of Artificial Sequence: Synthetic oligonucleotide
  Target: FXN; (-) strand; PAM type: YTN; PAM sequence: CTG
gttgaggccacgttggttcg

SEQ ID NO: 24601 - DNA, 20 bp, Artificial Sequence
  Description of Artificial Sequence: Synthetic oligonucleotide
  Target: FXN; (-) strand; PAM type: YTN; PAM sequence: TTC
caaatctggttgaggccacg

SEQ ID NO: 24602 - DNA, 20 bp, Artificial Sequence
  Description of Artificial Sequence: Synthetic oligonucleotide
  Target: FXN; (-) strand; PAM type: YTN; PAM sequence: TTG
acattccaaatctggttgag

SEQ ID NO: 24603 - DNA, 20 bp, Artificial Sequence
  Description of Artificial Sequence: Synthetic oligonucleotide
  Target: FXN; (-) strand; PAM type: YTN; PAM sequence: TTT
gacattccaaatctggttga

SEQ ID NO: 24604 - DNA, 20 bp, Artificial Sequence
  Description of Artificial Sequence: Synthetic oligonucleotide
  Target: FXN; (-) strand; PAM type: YTN; PAM sequence: TTT
tgacattccaaatctggttg

SEQ ID NO: 24605 - DNA, 20 bp, Artificial Sequence
  Description of Artificial Sequence: Synthetic oligonucleotide
  Target: FXN; (-) strand; PAM type: YTN; PAM sequence: TTT
ttgacattccaaatctggtt

SEQ ID NO: 24606 - DNA, 20 bp, Artificial Sequence
  Description of Artificial Sequence: Synthetic oligonucleotide
  Target: FXN; (-) strand; PAM type: YTN; PAM sequence: CTT
tttgacattccaaatctggt

SEQ ID NO: 24607 - DNA, 20 bp, Artificial Sequence
  Description of Artificial Sequence: Synthetic oligonucleotide
  Target: FXN; (-) strand; PAM type: YTN; PAM sequence: CTG
ctttttgacattccaaatct

SEQ ID NO: 24608 - DNA, 20 bp, Artificial Sequence
  Description of Artificial Sequence: Synthetic oligonucleotide
  Target: FXN; (-) strand; PAM type: YTN; PAM sequence: CTC
tgctttttgacattccaaat

SEQ ID NO: 24609 - DNA, 20 bp, Artificial Sequence
  Description of Artificial Sequence: Synthetic oligonucleotide
  Target: FXN; (-) strand; PAM type: YTN; PAM sequence: TTC
atcaaatagacactctgctt

SEQ ID NO: 24610 - DNA, 20 bp, Artificial Sequence
  Description of Artificial Sequence: Synthetic oligonucleotide
  Target: FXN; (-) strand; PAM type: YTN; PAM sequence: CTC
aaattcatcaaatagacact

SEQ ID NO: 24611 - DNA, 20 bp, Artificial Sequence
  Description of Artificial Sequence: Synthetic oligonucleotide
  Target: FXN; (-) strand; PAM type: YTN; PAM sequence: TTC
ctcaaattcatcaaatagac

SEQ ID NO: 24612 - DNA, 20 bp, Artificial Sequence
  Description of Artificial Sequence: Synthetic oligonucleotide
  Target: FXN; (-) strand; PAM type: YTN; PAM sequence: TTT
cctcaaattcatcaaataga

SEQ ID NO: 24613 - DNA, 20 bp, Artificial Sequence
  Description of Artificial Sequence: Synthetic oligonucleotide
  Target: FXN; (-) strand; PAM type: YTN; PAM sequence: TTC
cagatttcctcaaattcatc

SEQ ID NO: 24614 - DNA, 20 bp, Artificial Sequence
  Description of Artificial Sequence: Synthetic oligonucleotide
  Target: FXN; (-) strand; PAM type: YTN; PAM sequence: CTG
ggtggcccaaagttccagat

SEQ ID NO: 24615 - DNA, 20 bp, Artificial Sequence
  Description of Artificial Sequence: Synthetic oligonucleotide
  Target: FXN; (-) strand; PAM type: YTN; PAM sequence: TTA
ccctgggtggcccaaagttc
